United States Patent 9,061,059 (MODIFIED POLYNUCLEOTIDES FOR TREATING PROTEIN DEFICIENCY) - sequence listing, part 90

SEQ ID NO: 176772 - DNA, 3564 bp, Artificial Sequence
  Description of Artificial Sequence: Synthetic coding sequence
atggccaccagctccatgcctgagagcgagagaaatgtggccaccaaggccagcggggcccccatgaccagccccatgagcagcagcaccctggcccacagcctggccgccatcgaggccctggctgatggccccaccagcaccagcacctgcctggaggcccagggcggccccagcagccctgtgcagctgcccccagccagcggggctgaggagccagacctgcagagcctggaggccatgatggaggtggtggtggtgcagcagttcaagtgcaagatgtgccagtaccgcagcagcaccaaggccaccctgctgcggcacatgagggagcggcacttccggcctgtggccgctgctgctgctgctgctgggaagaagggccgcctgaggaagtggagcaccagcaccaagagccaggaggaggagggccctgaggaggaggatgatgatgacatcgtggatgctggggccattgatgacctggaggaggacagcgactacaacccagcagaagatgagccccggggccggcagctgcggctgcagaggcccacccccagcaccccccggccccggcggcggcccggccggcccaggaagctgccccggctggagatcagtgacctgcctgatggagtggagggggagcccctggtgagcagccagagcggccagagccccccagagccccaggaccctgaggcccccagcagcagcggccctggccacctggtggccatgggcaaggtgtccaggacccctgtggaggccggcgtgtcccagagtgatgctgaaaatgctgcccccagctgcccagatgaacatgacaccctgccccggcggcggggccggcccagccgccgcttcctgggcaagaagtacaggaagtactactacaagagccccaagcccctgctgcggcccttcctgtgccgcatctgtggcagccgcttcctgagccatgaggacctgcgcttccacgtgaacagccatgaggccggggacccccagctgttcaagtgcctgcagtgcagctaccgcagccgccgctggagcagcctgaaggagcacatgttcaaccacgtgggcagcaagccctacaagtgtgatgagtgcagctacacctctgtgtacaggaaggatgtgatcagacatgctgctgtgcacagccgggacaggaagaagaggccagaccccacccccaagctgagcagcttcccctgccctgtgtgtggccgggtgtaccccatgcagaagaggctgacccagcacatgaagacccacagcacagagaagccccacatgtgtgacaagtgtgggaagagcttcaagaagcgctacaccttcaagatgcacctgctgacccacatccaggccgtggccaacagacgcttcaagtgtgagttctgtgaatttgtgtgtgaggacaagaaggccctgctgaaccaccagctgagccacgtgtctgacaagcccttcaagtgcagcttctgcccctaccgcaccttccgggaggacttcctgctgagccacgtggccgtgaagcacactggagccaagccctttgcctgtgagtactgccacttcagcaccaggcacaagaagaacctgcggctgcacgtgcgctgcagacatgccagcagctttgaggagtggggcagaagacaccctgaggagccccccagcagaagaagacccttcttcagcctgcagcagatcgaggagctgaagcagcagcacagcgctgcccctggccccccacccagcagccctggccccccagagatccccccagaggccaccaccttccagagcagcgaggcccccagcctgctgtgcagcgacaccctgggcggggccaccatcatctaccagcagggcgctgaggagagcacagccatggccacccagacagccctggacctgctgctgaacatgtctgcccagcgggagctgggcggcacagccctgcaggtggccgtggtgaagtcagaagatgtggaggccggcctggccagccctgggggccagcccagccctgagggcgccaccccccaggtggtgaccctgcacgtggccgagcccggcggcggcgctgctgctgagagccagctgggccccccagacctgccccagatcaccctggcccctggcccctttggaggcaccggctacagcgtcatcacagccccacccatggaggagggcaccagcgcccctggcaccccctacagcgaggagcctgctggggaggccgcccaggccgtggtggtgtctgacaccctgaaggaggccggcacccactacatcatggccacagatggcacccagctgcaccacatcgagctgacagcagatggcagcatctccttccccagcccagatgccctggccagcggggccaagtggcccctgctgcagtgtggcggcctgcccagagatggccctgagccccccagccctgccaagacccactgtgtgggggacagccagagcagcgccagcagccccccagccaccagcaaggccctgggcctggccgtgccccccagccccccatctgctgccacagctgccagcaagaagttcagctgcaagatctgtgccgaggccttccctggccgggcagagatggagagccacaagagggcccatgctggccctggggccttcaagtgcccagactgccccttcagcgcccggcagtggccagaggtgcgggcccacatggcccagcacagcagcctgcggccccaccagtgcagccagtgcagctttgccagcaagaacaagaaggacctgcggcggcacatgctgacccacaccaaggagaagccctttgcctgccacctgtgtggccagcgcttcaacagaaatggccacctgaagttccacatccagaggctgcacagcccagatggcaggaagagcggcacccccacagcccgggcccccacccagacccccacccagaccatcatcctgaacagtgatgatgagaccctggccaccctgcacacagccctgcagagcagccacggcgtgctgggccctgagcggctgcagcaggccctgagccaggagcacatcatcgtggcccaggagcagacagtgaccaaccaggaggaggccgcctacatccaggagatcaccacagcagatggccagacagtgcagcacctggtgaccagtgacaaccaggtgcagtacatcatcagccaggatggagtgcagcacctgctgccccaggagtatgtggtggtgcctgagggccaccacatccaggtgcaggagggccagatcacccacatccagtatgagcagggcgcccccttcctgcaggagagccagatccagtatgtgcctgtgtccccaggccagcagctggtgacccaggcccagctggaggccgccgcccacagcgctgtgacagctgtggctgatgctgccatggcccaggcccagggcctgtttggaacagatgagaccgtgcctgagcacatccagcagctgcagcaccagggcattgaatatgatgtgatcaccctggctgatgactag

SEQ ID NO: 176773 - DNA, 330 bp, Artificial Sequence
  Description of Artificial Sequence: Synthetic coding sequence
atgctggagaactacagcaacctggtgtctgtgggctactgtgtgcacaagccagaggtgatcttccggctgcagcagggcgaggagccctggaagcaggaggaggagttccccagccagagcttccctgagatgggcttccaccacgtgcctgctggcctgaagctgctgagcagcagtgaccccccagccctggccagccagagcggccgcatcaccggcatgagccacagcatcccccctgtgatgggcagcttcaagttcaccaccagcatcttcacctgtgtgggcctcttccgcttcttcttcttctacctgtcctggttctag

SEQ ID NO: 176774 - DNA, 417 bp, Artificial Sequence
  Description of Artificial Sequence: Synthetic coding sequence
atgaacaaggtggagcagaagagccaggagagcgtgtccttcaaggatgtgacagtgggcttcacccaggaggagtggcagcacctggaccccagccagagggccctgtacagagatgtgatgctggagaactacagcaacctggtgtctgtgggctactgtgtgcacaagccagaggtgatcttccggctgcagcagggcgaggagccctggaagcaggaggaggagttccccagccagagcttccctgaggtgtggacagctgaccacctgaaggagaggagccaggagaaccagagcaagcacctgtgggaggtggtgttcatcaacaatgagatgctgaccaaggagcagggagatgtgattggcatccccttcaacgtggatgcccctgagatgctgatgcccctggactag

SEQ ID NO: 176775 - DNA, 2433 bp, Artificial Sequence
  Description of Artificial Sequence: Synthetic coding sequence
atgaacaaggtggagcagaagagccaggagagcgtgtccttcaaggatgtgacagtgggcttcacccaggaggagtggcagcacctggaccccagccagagggccctgtacagagatgtgatgctggagaactacagcaacctggtgtctgtgggctactgtgtgcacaagccagaggtgatcttccggctgcagcagggcgaggagccctggaagcaggaggaggagttccccagccagagcttccctgtgtggacagctgaccacctgaaggagaggagccaggagaaccagagcaagcacctgtgggaggtggtgttcatcaacaatgagatgctgaccaaggagcagggagatgtgattggcatccccttcaacgtggatgtgtcctccttccccagcaggaagatgttctgccagtgtgacagctgtggcatgtccttcaacacagtgtctgagctggtgatcagcaagatcaactacctgggcaagaagagtgatgagttcaatgcctgtgggaagctgctgctgaacatcaagcatgatgagacccacacccaggagaagaatgaggtgctgaagaacagaaacaccctgagccaccacgaggagaccctgcagcacgagaagatccagaccctggagcacaactttgagtacagcatctgccaggagaccctgctggagaaggctgtgttcaacacccagaagagagaaaatgctgaggagaacaactgtgactacaatgaatttggaagaaccctgtgtgacagcagcagcctgctcttccaccagatcagccccagccgggacaaccactatgagttcagtgactgtgagaagttcctgtgtgtgaagagcaccctgagcaagccccatggagtgtccatgaagcactatgactgtggggagagcggcaacaacttccggaggaagctgtgcctgagccacctgcagaagggggacaagggggagaagcactttgaatgtaatgaatgtgggaaggccttctgggagaagagccacctgaccaggcaccagagggtgcacacaggccagaagcccttccagtgcaatgaatgtgagaaggccttctgggacaagagcaacctgaccaagcaccagaggagccacactggagagaagccctttgaatgtaatgaatgtgggaaggccttcagccacaagagcgccctgaccctgcaccagaggacccacactggagagaagccctaccagtgcaatgcctgtgggaagaccttctgccagaagagtgacctgaccaagcaccagaggacccacacaggcctgaagccctatgaatgttatgaatgtgggaagagcttccgggtgaccagccacctgaaggtgcaccagaggacccacactggagagaagccctttgaatgtctggagtgtgggaagagcttcagcgagaagagcaacctgacccagcaccagaggatccacatcggggacaagagctatgaatgtaatgcctgtgggaagaccttctaccacaagagcctgctgaccaggcaccagatcatccacacaggctggaagccctatgaatgttatgaatgtgggaagaccttctgcctgaagagtgacctgactgtgcaccagaggacccacacaggccagaagccctttgcctgcccagaatgtgggaagttcttcagccacaagagcaccctgagccagcactaccgcacccacactggagagaagccctatgaatgtcatgaatgtgggaagatcttctacaacaagagctacctgaccaagcacaacagaacccacactggagagaagccctatgaatgtaatgaatgtgggaaggccttctaccagaagagccagctgacccagcaccagaggatccacatcggggagaagccctacaagtgcaatgaatgtgggaaggccttctgccacaagagcgccctgattgtgcaccagaggacccacacccaggagaagccctacaagtgcaatgaatgtgggaagagcttctgtgtgaagagcggcctcatcttccacgagaggaagcacactggagagaagccctatgaatgtaatgaatgtgggaagttcttccgccacaagagcagcctgactgtgcaccaccgggcccacactggagagaagagctgccagtgcaatgaatgtgggaagatcttctacaggaagtctgagctggcccagcaccagaggagccacactggagagaagccctatgagtgcaacacctgcaggaagaccttcagccagaagagcaacctgattgtgcaccagaggaggcacatcggggagaacctgatgaatgagatggacatccggaacttccagccccaggtgtccctgcacaatgccagcgagtacagccactgtggggagagcccagatgacatcctgaatgtgcagtag

SEQ ID NO: 176776 - DNA, 2436 bp, Artificial Sequence
  Description of Artificial Sequence: Synthetic coding sequence
atgaacaaggtggagcagaagagccaggagagcgtgtccttcaaggatgtgacagtgggcttcacccaggaggagtggcagcacctggaccccagccagagggccctgtacagagatgtgatgctggagaactacagcaacctggtgtctgtgggctactgtgtgcacaagccagaggtgatcttccggctgcagcagggcgaggagccctggaagcaggaggaggagttccccagccagagcttccctgaggtgtggacagctgaccacctgaaggagaggagccaggagaaccagagcaagcacctgtgggaggtggtgttcatcaacaatgagatgctgaccaaggagcagggagatgtgattggcatccccttcaacgtggatgtgagcagcttccccagcaggaagatgttctgccagtgtgacagctgtggcatgtccttcaacacagtgtctgagctggtgatcagcaagatcaactacctgggcaagaagagtgatgagttcaatgcctgtgggaagctgctgctgaacatcaagcatgatgagacccacacccaggagaagaatgaggtgctgaagaacagaaacaccctgagccaccacgaggagaccctgcagcacgagaagatccagaccctggagcacaactttgagtacagcatctgccaggagaccctgctggagaaggctgtgttcaacacccagaagcgggagaatgctgaggagaacaactgtgactacaatgaatttggccgcaccctgtgtgacagcagcagcctgctcttccaccagatcagccccagccgggacaaccactatgagttcagtgactgtgagaagttcctgtgtgtgaagagcaccctgagcaagccccacggcgtgtccatgaagcactatgactgtggggagagcggcaacaacttccggaggaagctgtgcctgagccacctgcagaagggggacaagggggagaagcactttgagtgcaatgaatgtgggaaggccttctgggagaagagccacctgaccaggcaccagagggtgcacacaggccagaagcccttccagtgcaatgaatgtgagaaggccttctgggacaagagcaacctgaccaagcaccagaggagccacactggagagaagccctttgagtgcaatgaatgtgggaaggccttcagccacaagagcgccctgaccctgcaccagaggacccacactggagagaagccctaccagtgcaatgcctgtgggaagaccttctgccagaagagtgacctgaccaagcaccagaggacccacacaggcctgaagccctatgagtgctatgaatgtgggaagagcttccgggtgaccagccacctgaaggtgcaccagaggacccacactggagagaagccctttgagtgcctggagtgtgggaagagcttcagcgagaagagcaacctgacccagcaccagaggatccacatcggggacaagagctatgagtgcaatgcctgtgggaagaccttctaccacaagagcctgctgaccaggcaccagatcatccacacaggctggaagccctatgagtgctatgaatgtgggaagaccttctgcctgaagagtgacctgactgtgcaccagaggacccacacaggccagaagccctttgcctgcccagaatgtgggaagttcttcagccacaagagcaccctgagccagcactaccgcacccacactggagagaagccctatgagtgccatgaatgtgggaagatcttctacaacaagagctacctgaccaagcacaacagaacccacactggagagaagccctatgagtgcaatgaatgtgggaaggccttctaccagaagagccagctgacccagcaccagaggatccacatcggggagaagccctacaagtgcaatgaatgtgggaaggccttctgccacaagagcgccctgattgtgcaccagaggacccacacccaggagaagccctacaagtgcaatgaatgtgggaagagcttctgtgtgaagagcggcctcatcttccacgagaggaagcacactggagagaagccctatgagtgcaatgaatgtgggaagttcttccgccacaagagcagcctgactgtgcaccaccgggcccacactggagagaagagctgccagtgcaatgaatgtgggaagatcttctacaggaagtctgagctggcccagcaccagaggagccacactggagagaagccctatgagtgcaacacctgcaggaagaccttcagccagaagagcaacctgattgtgcaccagaggaggcacatcggggagaacctgatgaatgagatggacatccggaacttccagccccaggtgtccctgcacaatgccagcgagtacagccactgtggggagagcccagatgacatcctgaatgtgcagtag

SEQ ID NO: 176777 - DNA, 2454 bp, Artificial Sequence
  Description of Artificial Sequence: Synthetic coding sequence
atggccaatgccacccggcggggcagcggcgtggagcagaagagccaggagagcgtgtccttcaaggatgtgacagtgggcttcacccaggaggagtggcagcacctggaccccagccagagggccctgtacagagatgtgatgctggagaactacagcaacctggtgtctgtgggctactgtgtgcacaagccagaggtgatcttccggctgcagcagggcgaggagccctggaagcaggaggaggagttccccagccagagcttccctgtgtggacagctgaccacctgaaggagaggagccaggagaaccagagcaagcacctgtgggaggtggtgttcatcaacaatgagatgctgaccaaggagcagggagatgtgattggcatccccttcaacgtggatgtgagcagcttccccagcaggaagatgttctgccagtgtgacagctgtggcatgtccttcaacacagtgtctgagctggtgatcagcaagatcaactacctgggcaagaagagtgatgagttcaatgcctgtgggaagctgctgctgaacatcaagcatgatgagacccacacccaggagaagaatgaggtgctgaagaacagaaacaccctgagccaccacgaggagaccctgcagcacgagaagatccagaccctggagcacaactttgagtacagcatctgccaggagaccctgctggagaaggctgtgttcaacacccagaagcgggagaatgctgaggagaacaactgtgactacaatgaatttggccgcaccctgtgtgacagcagcagcctgctcttccaccagatcagccccagccgggacaaccactatgagttcagtgactgtgagaagttcctgtgtgtgaagagcaccctgagcaagccccacggcgtgtccatgaagcactatgactgtggggagagcggcaacaacttccggaggaagctgtgcctgagccacctgcagaagggggacaagggggagaagcactttgagtgcaatgaatgtgggaaggccttctgggagaagagccacctgaccaggcaccagagggtgcacacaggccagaagcccttccagtgcaatgaatgtgagaaggccttctgggacaagagcaacctgaccaagcaccagaggagccacactggagagaagccctttgagtgcaatgaatgtgggaaggccttcagccacaagagcgccctgaccctgcaccagaggacccacactggagagaagccctaccagtgcaatgcctgtgggaagaccttctgccagaagagtgacctgaccaagcaccagaggacccacacaggcctgaagccctatgagtgctatgaatgtgggaagagcttccgggtgaccagccacctgaaggtgcaccagaggacccacactggagagaagccctttgagtgcctggagtgtgggaagagcttcagcgagaagagcaacctgacccagcaccagaggatccacatcggggacaagagctatgagtgcaatgcctgtgggaagaccttctaccacaagagcctgctgaccaggcaccagatcatccacacaggctggaagccctatgagtgctatgaatgtgggaagaccttctgcctgaagagtgacctgactgtgcaccagaggacccacacaggccagaagccctttgcctgcccagaatgtgggaagttcttcagccacaagagcaccctgagccagcactaccgcacccacactggagagaagccctatgagtgccatgaatgtgggaagatcttctacaacaagagctacctgaccaagcacaacagaacccacactggagagaagccctatgagtgcaatgaatgtgggaaggccttctaccagaagagccagctgacccagcaccagaggatccacatcggggagaagccctacaagtgcaatgaatgtgggaaggccttctgccacaagagcgccctgattgtgcaccagaggacccacacccaggagaagccctacaagtgcaatgaatgtgggaagagcttctgtgtgaagagcggcctcatcttccacgagaggaagcacactggagagaagccctatgagtgcaatgaatgtgggaagttcttccgccacaagagcagcctgactgtgcaccaccgggcccacactggagagaagagctgccagtgcaatgaatgtgggaagatcttctacaggaagtctgagctggcccagcaccagaggagccacactggagagaagccctatgagtgcaacacctgcaggaagaccttcagccagaagagcaacctgattgtgcaccagaggaggcacatcggggagaacctgatgaatgagatggacatccggaacttccagccccaggtgtccctgcacaatgccagcgagtacagccactgtggggagagcccagatgacatcctgaatgtgcagtag

SEQ ID NO: 176778 - DNA, 2433 bp, Artificial Sequence; identical to SEQ ID NO: 176775
  Description of Artificial Sequence: Synthetic coding sequence

SEQ ID NO: 176779 - DNA, 417 bp, Artificial Sequence; identical to SEQ ID NO: 176774
  Description of Artificial Sequence: Synthetic coding sequence

SEQ ID NO: 176780 - DNA, 2337 bp, Artificial Sequence
  Description of Artificial Sequence: Synthetic coding sequence
atgaacaaggtggaccagaagttccagggctctgtgtccttcaaggatgtgacagtgggcttcacccaggaggagtggcagcacctggaccccagccagagggccctgtacagagatgtgatgctggagaactacagcaacctggtgtctgtgggctactgtgcccacaagccagaggtgatcttccggctggagcagggcgaggagccctggaggctggaggaggagttccccagccagagcttccctgaggtgtggacagctgaccacctgaaggagaggagccaggagaaccagagcaagcacctgtgggaggtggtgttcatcaacaatgagatgctgaccaaggagcagggcaatgtcatcggcatccccttcaacatggatgtgagcagcttccccagcaggaagatgttctgccagtatgacagccggggcatgtccttcaacacagtgtctgagctggtgatcagcaagatcaactacctgggcaagaagagtgatgagttcaatgcctgtgggaagctgctgctgaacatcaagcatgatgagacccacacccgggagaagaatgaggtgctgaagaacagaaacaccctgagccaccgggagaacaccctgcagcacgagaagatccagaccctggaccacaactttgagtacagcatctgccaggagaccctgctggagaaggctgtgttcaacaccaggaagcgggagaatgctgaggagaacaactgtgactacaatgaatttggccgcaccttctgtgacagcagcagcctgctcttccaccagatcccccccagcaaggacagccactatgagttcagtgactgtgagaagttcctgtgtgtgaagagcaccctgagcaagcatgatggagtgcctgtgaagcactatgactgtggggagagcggcaacaacttccggaggaagctgtgcctgagccagctgcagaagggggacaagggggagaagcactttgagtgcaatgaatgtgggaaggccttctgggagaagagccacctgaccaggcaccagagggtgcacactggagagaagcacttccagtgcaaccagtgtgggaagaccttctgggagaagagcaacctgaccaagcaccagaggagccacactggagagaagccctttgagtgcaatgaatgtgggaaggccttcagccacaagagcgccctgaccctgcaccagaggacccacactggagagaagccctaccagtgcaatgcctgtgggaagaccttctaccagaagagtgacctgaccaagcaccagaggacccacacaggccagaagccctatgagtgctatgaatgtgggaagagcttctgcatgaacagccacctgactgtgcaccagaggacccacactggagagaagccctttgagtgcctggagtgtgggaagagcttctgccagaagagccacctgacccagcaccagaggacccacatcggggacaagccctatgagtgcaatgcctgtgggaagaccttctaccacaagtctgtgctgaccaggcaccagatcatccacacaggcctgaagccctatgagtgctatgaatgtgggaagaccttctgcctgaagagtgacctgaccatccaccagaggacccacactggagagaagccctttgcctgcccagaatgtgggaagttcttcagccacaagagcaccctgagccagcactaccgcacccacactggagagaagccctatgagtgccatgaatgtgggaagatcttctacaacaagagctacctgaccaagcacaacagaacccacactggagagaagccctatgagtgcaatgaatgtgggaagaccttctgccagaagagccagctgacccagcaccagaggatccacatcggggagaagccctatgagtgcaatgaatgtgggaaggccttctgccacaagagcgccctgattgtgcaccagaggacccacacccaggagaagccctacaagtgcaatgaatgtgggaagagcttctgtgtgaagagcggcctcatcctgcacgagaggaagcacactggagagaagccctatgagtgcaatgaatgtgggaagagcttcagccacaagagcagcctgactgtgcaccaccgggcccacactggagagaagagctgccagtgcaatgaatgtgggaagatcttctacaggaagagtgacctggccaagcaccagaggagccacactggagagaagccctatgagtgcaacacctgcaggaagaccttcagccagaagagcaacctgattgtgcaccagaggacccacatcggggagaagccctatgaatag

SEQ ID NO: 176781 - DNA, 2235 bp, Artificial Sequence
  Description of Artificial Sequence: Synthetic coding sequence
atgaacaaggtggaccagaagttccagggctctgtgtccttcaaggatgtgacagtgggcttcacccaggaggagtggcagcacctggaccccagccagagggccctgtacagagatgtgatgctggagaactacagcaacctggtgtctgtgggcacagctgaccacctgaaggagaggagccaggagaaccagagcaagcacctgtgggaggtggtgttcatcaacaatgagatgctgaccaaggagcagggcaatgtcatcggcatccccttcaacatggatgtgagcagcttccccagcaggaagatgttctgccagtatgacagccggggcatgtccttcaacacagtgtctgagctggtgatcagcaagatcaactacctgggcaagaagagtgatgagttcaatgcctgtgggaagctgctgctgaacatcaagcatgatgagacccacacccgggagaagaatgaggtgctgaagaacagaaacaccctgagccaccgggagaacaccctgcagcacgagaagatccagaccctggaccacaactttgagtacagcatctgccaggagaccctgctggagaaggctgtgttcaacaccaggaagcgggagaatgctgaggagaacaactgtgactacaatgaatttggccgcaccttctgtgacagcagcagcctgctcttccaccagatcccccccagcaaggacagccactatgagttcagtgactgtgagaagttcctgtgtgtgaagagcaccctgagcaagcatgatggagtgcctgtgaagcactatgactgtggggagagcggcaacaacttccggaggaagctgtgcctgagccagctgcagaagggggacaagggggagaagcactttgagtgcaatgaatgtgggaaggccttctgggagaagagccacctgaccaggcaccagagggtgcacactggagagaagcacttccagtgcaaccagtgtgggaagaccttctgggagaagagcaacctgaccaagcaccagaggagccacactggagagaagccctttgagtgcaatgaatgtgggaaggccttcagccacaagagcgccctgaccctgcaccagaggacccacactggagagaagccctaccagtgcaatgcctgtgggaagaccttctaccagaagagtgacctgaccaagcaccagaggacccacacaggccagaagccctatgagtgctatgaatgtgggaagagcttctgcatgaacagccacctgactgtgcaccagaggacccacactggagagaagccctttgagtgcctggagtgtgggaagagcttctgccagaagagccacctgacccagcaccagaggacccacatcggggacaagccctatgagtgcaatgcctgtgggaagaccttctaccacaagtctgtgctgaccaggcaccagatcatccacacaggcctgaagccctatgagtgctatgaatgtgggaagaccttctgcctgaagagtgacctgaccatccaccagaggacccacactggagagaagccctttgcctgcccagaatgtgggaagttcttcagccacaagagcaccctgagccagcactaccgcacccacactggagagaagccctatgagtgccatgaatgtgggaagatcttctacaacaagagctacctgaccaagcacaacagaacccacactggagagaagccctatgagtgcaatgaatgtgggaagaccttctgccagaagagccagctgacccagcaccagaggatccacatcggggagaagccctatgagtgcaatgaatgtgggaaggccttctgccacaagagcgccctgattgtgcaccagaggacccacacccaggagaagccctacaagtgcaatgaatgtgggaagagcttctgtgtgaagagcggcctcatcctgcacgagaggaagcacactggagagaagccctatgagtgcaatgaatgtgggaagagcttcagccacaagagcagcctgactgtgcaccaccgggcccacactggagagaagagctgccagtgcaatgaatgtgggaagatcttctacaggaagagtgacctggccaagcaccagaggagccacactggagagaagccctatgagtgcaacacctgcaggaagaccttcagccagaagagcaacctgattgtgcaccagaggacccacatcggggagaagccctatgaatag

SEQ ID NO: 176782 - DNA, 1683 bp, Artificial Sequence
  Description of Artificial Sequence: Synthetic coding sequence
atgctgctgctgctgagtgaccagctgctgctgacagccctgaggaagcccaacccccaggccatggccgccctcttcctgagcgccccaccccaggccgaggtgacctttgaagatgtggccgtgtacctgagccgggaggagtggggccgcctgggccctgcccagaggggcctgtacagagatgtgatgctggagacctacggcaacctggtgtccctgggcgtgggccctgctggccccaagccaggagtcatcagccagctggagagaggagatgagccctgggtgctggatgtgcagggcaccagcggcaaggagcacctgcgggtgaacagccctgccctgggcaccaggacagagtacaaggagctgaccagccaggagacctttggagaggaggacccccagggcagcgagcctgtggaggcctgtgaccacatcagcaagtctgagggcagcctggagaagctggtggagcagaggggccccagggctgtgaccctgaccaatggagagagcagccgggagagcggcggcaacctgcggctgctgagcaggcctgtgcctgaccagaggccccacaagtgtgacatctgtgagcagagctttgagcagaggagctacctgaacaaccacaagagggtgcacaggagcaagaagaccaacacagtgaggaacagcggggagatcttcagcgccaacctggtggtgaaggaggaccagaagatccccaccgggaagaagctgcactactgcagctactgtgggaagaccttccgctacagcgccaacctggtgaagcaccagaggctgcacacagaggagaagccctacaagtgtgatgaatgtgggaaggccttcagccagagctgtgagttcatcaaccacaggaggatgcacagcggggagatcccctaccgctgtgatgaatgtgggaagaccttcacccggcggcccaacctgatgaagcaccagaggatccacactggagagaagccctacaagtgtggagaatgtgggaagcacttcagcgcctacagcagcctcatctaccaccagaggatccacactggagagaagccctacaagtgcaatgactgtgggaaggccttcagtgatggcagcatcctgatccgccacaggaggacccacactggagagaagccctttgagtgcaaggaatgtgggaagggcttcacccagagcagcaacctgatccagcaccagaggatccacactggagagaagccctacaagtgcaatgaatgtgagaaggccttcatccagaagaccaagctggtggagcaccagaggagccacactggagagaagccctatgagtgcaatgactgtgggaaggtgttcagccagagcacccacctgatccagcaccagaggatccacactggagagaagccctacaagtgcagtgaatgtgggaaggccttccacaacagcagccgcctcatccaccaccagaggctgcaccacggggagaagccctaccgctgcagcgactgcaagaaggccttcagccagagcacctacctgatccagcaccggcgcatccacactggagagaagccctacaagtgcagtgaatgtgggaaggccttccgccacagcagcaacatgtgccagcaccagaggatccacctgcgggaggacttctccatgtag

SEQ ID NO: 176783 - DNA, 1620 bp, Artificial Sequence
  Description of Artificial Sequence: Synthetic coding sequence
atggccgccctcttcctgagcgccccaccccaggccgaggtgacctttgaagatgtggccgtgtacctgagccgggaggagtggggccgcctgggccctgcccagaggggcctgtacagagatgtgatgctggagacctacggcaacctggtgtccctgggcgtgggccctgctggccccaagccaggagtcatcagccagctggagagaggagatgagccctgggtgctggatgtgcagggcaccagcggcaaggagcacctgcgggtgaacagccctgccctgggcaccaggacagagtacaaggagctgaccagccaggagaccttcggggaggaggacccccagggcagcgagcctgtggaggcctgtgaccacatcagcaagtctgagggcagcctggagaagctggtggagcagaggggccccagggctgtgaccctgaccaacggggagagcagccgggagagcggcggcaacctgcggctgctgagcaggcctgtgcctgaccagaggccccacaagtgtgacatctgtgagcagagctttgagcagaggagctacctgaacaaccacaagagggtgcacaggagcaagaagaccaacacagtgagaaattctggagagatcttcagcgccaacctggtggtgaaggaggaccagaagatccccaccgggaagaagctgcactactgcagctactgcggcaagaccttccgctacagcgccaacctggtgaagcaccagaggctgcacacagaggagaagccctacaagtgtgatgaatgtgggaaggccttcagccagagctgtgagttcatcaaccacaggaggatgcacagcggggagatcccctaccgctgtgatgaatgtgggaagaccttcacccggcggcccaacctgatgaagcaccagaggatccacactggagagaagccctacaagtgtggggagtgtgggaagcacttcagcgcctacagcagcctcatctaccaccagaggatccacactggagagaagccctacaagtgcaatgactgtgggaaggccttcagtgatggcagcatcctgatccgccacaggaggacccacactggagagaagccctttgagtgcaaggaatgtgggaagggcttcacccagagcagcaacctgatccagcaccagaggatccacactggagagaagccctacaagtgcaatgaatgtgagaaggccttcatccagaagaccaagctggtggagcaccagaggagccacactggagagaagccctatgaatgtaatgactgtgggaaggtgttcagccagagcacccacctgatccagcaccagaggatccacactggagagaagccctacaagtgcagtgaatgtgggaaggccttccacaacagcagccgcctcatccaccaccagaggctgcaccacggggagaagccctaccgctgcagcgactgcaagaaggccttcagccagagcacctacctgatccagcaccggcgcatccacactggagagaagccctacaagtgcagtgaatgtgggaaggccttccgccacagcagcaacatgtgccagcaccagaggatccacctgcgggaggacttctccatgtag

SEQ ID NO: 176784 - DNA, 1560 bp, Artificial Sequence
  Description of Artificial Sequence: Synthetic coding sequence
atgtacctgatccgggagagccacgccagcggcagcagctctgtgaccagcagctgcagcctgcccagcgagagccccaccctgcggcagtggaggccctgcagctgcctgccccaccccaggcctggggtcatcagccagctggagagaggagatgagccctgggtgctggatgtgcagggcaccagcggcaaggagcacctgcgggtgaacagccctgccctgggcaccaggacagagtacaaggagctgaccagccaggagaccttcggggaggaggacccccagggcagcgagcctgtggaggcctgtgaccacatcagcaagtctgagggcagcctggagaagctggtggagcagaggggccccagggctgtgaccctgaccaacggggagagcagccgggagagcggcggcaacctgcggctgctgagcaggcctgtgcctgaccagaggccccacaagtgtgacatctgtgagcagagctttgagcagaggagctacctgaacaaccacaagagggtgcacaggagcaagaagaccaacacagtgagaaattctggagagatcttcagcgccaacctggtggtgaaggaggaccagaagatccccaccgggaagaagctgcactactgcagctactgcggcaagaccttccgctacagcgccaacctggtgaagcaccagaggctgcacacagaggagaagccctacaagtgtgatgaatgtgggaaggccttcagccagagctgtgagttcatcaaccacaggaggatgcacagcggggagatcccctaccgctgtgatgaatgtgggaagaccttcacccggcggcccaacctgatgaagcaccagaggatccacactggagagaagccctacaagtgtggggagtgtgggaagcacttcagcgcctacagcagcctcatctaccaccagaggatccacactggagagaagccctacaagtgcaatgactgtgggaaggccttcagtgatggcagcatcctgatccgccacaggaggacccacactggagagaagccctttgagtgcaaggaatgtgggaagggcttcacccagagcagcaacctgatccagcaccagaggatccacactggagagaagccctacaagtgcaatgaatgtgagaaggccttcatccagaagaccaagctggtggagcaccagaggagccacactggagagaagccctatgaatgtaatgactgtgggaaggtgttcagccagagcacccacctgatccagcaccagaggatccacactggagagaagccctacaagtgcagtgaatgtgggaaggccttccacaacagcagccgcctcatccaccaccagaggctgcaccacggggagaagccctaccgctgcagcgactgcaagaaggccttcagccagagcacctacctgatccagcaccggcgcatccacactggagagaagccctacaagtgcagtgaatgtgggaaggccttccgccacagcagcaacatgtgccagcaccagaggatccacctgcgggaggacttctccatgtag

SEQ ID NO: 176785 - DNA, 1584 bp, Artificial Sequence
  Description of Artificial Sequence: Synthetic coding sequence
atgacagctgagctgcgggaggccatggccctggccccctggggccctgtgaaggtgaagaaggaggaggaggaggaggagaacttccctggccaggccagcagccagcaggtgcacagcgagaacatcaaggtgtgggcccctgtgcagggcctgcagacaggcctggatggcagcgaggaggaggagaagggccagaacatctcctgggacatggctgtggtgctgaaggccacccaggaggccccagctgccagcaccctgggcagctacagcctgcccggcaccctggccaagtctgagatcctggagacccacggcaccatgaacttcctgggcgctgagaccaagaacctgcagctgctggtgcccaagacagagatctgtgaggaggccgagaagcccctcatcatcagcgagcgcatccagaaggctgacccccagggccctgagctgggggaggcctgtgagaagggcaacatgctgaagaggcagaggatcaagcgggagaagaaggacttccggcaggtgattgtgaatgactgccacctgcctgagagcttcaaggaggaggagaaccagaagtgcaagaagagcggcggcaagtacagcctgaacagcggggctgtgaagaaccccaagacccagctgggccagaagcccttcacctgcagcgtgtgtgggaagggcttcagccagagcgccaacctggtggtgcaccagaggatccacactggagagaagccctttgaatgtcatgaatgtgggaaggccttcatccagagcgccaacctggtggtgcaccagaggatccacacaggccagaagccctacgtgtgcagcaaatgtgggaaggccttcacccagagcagcaacctgactgtgcaccagaagatccacagcctggagaagaccttcaagtgcaatgaatgtgagaaggccttctcctacagcagccagctggcccggcaccagaaggtgcacatcacagagaagtgctatgaatgtaatgaatgtgggaagaccttcaccaggagcagcaacctgattgtgcaccagaggatccacactggagagaagccctttgcctgcaatgactgtgggaaggccttcacccagagcgccaacctgattgtgcaccagaggagccacactggagagaagccctatgagtgcaaggaatgtgggaaggccttcagctgcttcagccacctgattgtgcaccagaggatccacacagctgagaagccctatgactgcagtgaatgtgggaaggccttcagccagctgagctgcctgattgtgcaccagaggatccacagcggggacctgccctacgtgtgcaatgaatgtgggaaggccttcacctgcagcagctacctgctgatccaccagaggatccacaatggagagaagccctacacctgcaatgaatgtgggaaggccttccggcagaggagcagcctgactgtgcaccagaggacccacactggagagaagccctatgaatgtgagaagtgtggggccgccttcatcagcaacagccacctgatgaggcaccacaggacccacctggtggagtag

SEQ ID NO: 176786 - DNA, 405 bp, Artificial Sequence
  Description of Artificial Sequence: Synthetic coding sequence
atgacagctgagctgcgggaggccatggccctggccccctggggccctgtgaaggtgaagaaggaggaggaggaggaggagaacttccctggccaggccagcagccagcaggtgcacagcgagaacatcaaggtgtgggcccctgtgcagggcctgcagacaggcctggatggcagcgaggaggaggagaagggccagaacatctcctgggacatggctgtggtgctgaaggccacccaggaggccccagctgccagcaccctgggcagctacagcctgcccggcaccctggccaagtctgagatcctggagacccacggcaccatgaacttcctgggcgctgagaccaagaacctgcagctgctggtgcccaagacagagatctgtgaggaggccgagaagtag

SEQ ID NO: 176787 - DNA, 339 bp, Artificial Sequence
  Description of Artificial Sequence: Synthetic coding sequence
atgacagctgagctgcgggaggccatggccctggccccctggggccctgtgaaggtgaagaaggaggaggaggaggaggagaacttccctggccaggccagcagccagcaggtgcacagcgagaacatcaaggtgtgggcccctgtgcagggcctgcagacaggcctggatggcagcgaggaggaggagaagggccagaacatctcctgggacatggctgtggtgctgaaggccacccaggaggccccagctgccagcaccctgggcagctacagcctgcccggcaccctggccaagtctgagatcctggagacccacggcaccatgaacttcctgtag

SEQ ID NO: 176788 - DNA, 1104 bp, Artificial Sequence
  Description of Artificial Sequence: Synthetic coding sequence
atgctgaagaggcagaggatcaagcgggagaagaaggacttccggcaggtgattgtgaatgactgccacctgcctgagagcttcaaggaggaggagaaccagaagtgcaagaagagcggcggcaagtacagcctgaacagcggggctgtgaagaaccccaagacccagctgggccagaagcccttcacctgcagcgtgtgtgggaagggcttcagccagagcgccaacctggtggtgcaccagaggatccacactggagagaagccctttgaatgtcatgaatgtgggaaggccttcatccagagcgccaacctggtggtgcaccagaggatccacacaggccagaagccctacgtgtgcagcaaatgtgggaaggccttcacccagagcagcaacctgactgtgcaccagaagatccacagcctggagaagaccttcaagtgcaatgaatgtgagaaggccttctcctacagcagccagctggcccggcaccagaaggtgcacatcacagagaagtgctatgaatgtaatgaatgtgggaagaccttcaccaggagcagcaacctgattgtgcaccagaggatccacactggagagaagccctttgcctgcaatgactgtgggaaggccttcacccagagcgccaacctgattgtgcaccagaggagccacactggagagaagccctatgagtgcaaggaatgtgggaaggccttcagctgcttcagccacctgattgtgcaccagaggatccacacagctgagaagccctatgactgcagtgaatgtgggaaggccttcagccagctgagctgcctgattgtgcaccagaggatccacagcggggacctgccctacgtgtgcaatgaatgtgggaaggccttcacctgcagcagctacctgctgatccaccagaggatccacaatggagagaagccctacacctgcaatgaatgtgggaaggccttccggcagaggagcagcctgactgtgcaccagaggacccacactggagagaagccctatgaatgtgagaagtgtggggccgccttcatcagcaacagccacctgatgaggcaccacaggacccacctggtggagtag

SEQ ID NO: 176789 - DNA, 981 bp, Artificial Sequence
  Description of Artificial Sequence: Synthetic coding sequence
atggacctgacagccatctatgagagcctgctgagcctgagcccagatgtgcctgtgcccagcgaccatggaggaacagagagcagccctggctggggcagcagcggcccctggagcctgagccccagcgacagcagccccagcggcgtgaccagccggctgcccggccgcagcaccagcctggtggagggccgcagctgtggctgggtgcccccacctcctggctttgcccccctggccccccggctgggccctgagctgagccccagccccaccagccccacagccaccagcaccacccccagccgctacaagacagagctgtgcaggaccttcagcgagagcggccgctgccgctacggggccaagtgccagtttgcccacggcctgggggagctgcggcaggccaacagacaccccaagtacaagacagagctgtgccacaagttctacctgcagggccgctgcccctacggcagccgctgccacttcatccacaaccccagcgaggacctggccgcccctggccacccccctgtgctgcggcagagcatctccttcagcggcctgcccagcggccgccgcaccagccccccacctcctggcctggccggccccagcctgagcagcagcagcttcagccccagcagcagccccccacctcctggggacctgcccctgagccccagcgccttctctgctgcccctggcacccccctggcccggcgggaccccacccctgtgtgctgccccagctgccggcgggccacccccatctctgtgtggggccccctgggcggcctggtgaggaccccatctgtgcagagcctgggcagtgaccctgatgaatatgccagcagcggcagcagcctgggcggcagtgacagccctgtgtttgaagctggggtgtttgccccaccccagcctgtggccgccccccggcggctgcccatcttcaaccgcatctctgtgtctgagtag

SEQ ID NO: 176790 - DNA, 1017 bp, Artificial Sequence
  Description of Artificial Sequence: Synthetic coding sequence
atgaccaccaccctggtgtctgccaccatctttgacctgtctgaggtgctgtgcaagggcaacaagatgctgaactacagcgcccccagcgctgggggctgcctgctggacaggaaggctgtgggcaccccagctgggggcggcttccccaggaggcacagcgtgaccctgcccagcagcaagttccaccagaaccagctgctgagcagcctgaagggggagcccgccccagccctgagcagccgggacagccgcttccgggacaggagcttcagcgagggcggggagcggctgctgcccacccagaagcagcccggcggcggccaggtgaacagcagccgctacaagacagagctgtgccggccctttgaagaaaatggagcctgcaagtatggagacaagtgccagtttgcccacggcatccacgagctgcggagcctgaccaggcaccccaagtacaagacagagctgtgcaggaccttccacaccatcggcttctgcccctacggcccccgctgccacttcatccacaatgctgaggagcggcgggccctggccggggcccgggacctgtctgctgaccggccccggctgcagcacagcttctcctttgctggcttccccagcgctgctgccacagctgctgccaccggcctgctggacagccccaccagcatcaccccaccacccatcctgtctgcagatgacctgctgggcagccccaccctgcctgatggcaccaacaacccctttgccttcagcagccaggagctggccagcctgtttgcccccagcatgggcctgcccggcggcggcagccccaccaccttcctgttccggcccatgtctgagagcccccacatgtttgacagcccccccagcccccaggacagcctgagtgaccaggagggctacctgagcagcagcagcagcagccacagcggcagtgacagccccaccctggacaacagccggcggctgcccatcttcagccggctgagcatcagtgatgactag

SEQ ID NO: 176791 - DNA, 501 bp, Artificial Sequence
  Description of Artificial Sequence: Synthetic coding sequence
atgaacacctacaccaggtctgccagcttcacccccaagaccttcaccttccccctggcccagaacagaaccagccaccccaccaccaccagcaagctgaagtacctgggccggcccagccccaggagagatgccctgcaggccaatggagagggccctgaggtgggccctggaacagaggagcccgcccaccggctgcctgtgggcagcggcagcgctggggaggccgccgccagcctgggcacagcccgggtgcgcagcggccgggcagaatgtacagccaagctggccggagatggccacgcccggctggccagcgccttcctgcacagaagagctgccctgcccccacccctgggcacctgccggccccggctgggggagggcggcagcgccccagccctgggccccagcccccggcggggcagaagagtgtctgagggcctgcgggacagcctgccccccctgggcagcctgaccctgggcaagagccccaagtag

SEQ ID NO: 176792 - DNA, 966 bp, Artificial Sequence
  Description of Artificial Sequence: Synthetic coding sequence
atgaccaccaccctggtgtctgccaccatctttgacctgtctgaggtgctgtgcaagggcaacaagatgctgaactacagcgcccccagcgctgggggctgcctgctggacaggaaggctgtgggcaccccagctgggggcggcttccccaggaggcacagcgtgaccctgcccagcagcaagttccaccagaaccagctgctgagcagcctgaagggggagcccgccccagccctgagcagccgggacagccgcttccgggacaggagcttcagcgagggcggggagcggctgctgcccacccagaagcagccctttgaggagaatggagcctgcaagtacggggacaagtgccagtttgcccacggcatccacgagctgcggagcctgaccaggcaccccaagtacaagacagagctgtgcaggaccttccacaccatcggcttctgcccctacggcccccgctgccacttcatccacaatgctgaggagcggcgggccctggccggggcccgggacctgtctgctgaccggccccggctgcagcacagcttctcctttgctggcttccccagcgctgctgccacagctgctgccaccggcctgctggacagccccaccagcatcaccccaccacccatcctgtctgcagatgacctgctgggcagccccaccctgcctgatggcaccaacaacccctttgccttcagcagccaggagctggccagcctgtttgcccccagcatgggcctgcccggcggcggcagccccaccaccttcctgttccggcccatgtctgagagcccccacatgtttgacagcccccccagcccccaggacagcctgagtgaccaggagggctacctgagcagcagcagcagcagccacagcggcagtgacagccccaccctggacaacagccggcggctgcccatcttcagccggctgagcatcagtgatgactag

SEQ ID NO: 176793 - DNA, 1017 bp, Artificial Sequence; identical to SEQ ID NO: 176790
  Description of Artificial Sequence: Synthetic coding sequence

SEQ ID NO: 176794 - DNA, 1485 bp, Artificial Sequence
  Description of Artificial Sequence: Synthetic coding sequence
atgagcaccaccctgctgagcgccttctatgatgtggacttcctgtgcaagacagagaagagcctggccaacctgaacctgaacaacatgctggacaagaaggctgtgggcacccctgtggccgccgcccccagcagcggctttgcccctggcttcctgcggcggcacagcgccagcaacctgcacgccctggcccacccagcccccagccctggcagctgcagccccaagtttcctggagctgccaacggcagcagctgtggcagcgctgctgctgggggccccaccagctatggcaccctgaaggagcccagcggcggcggcggcacagccctgctgaacaaggagaacaagttccgggaccgctccttctctgaaaatggagacaggagccagcacctgctgcacctgcagcagcagcagaagggcggcggcggcagccagatcaacagcacccgctacaagacagagctgtgccggccctttgaggagagcggcacctgcaagtacggggagaagtgccagtttgcccacggcttccacgagctgcggagcctgaccaggcaccccaagtacaagacagagctgtgcaggaccttccacaccatcggcttctgcccctacggcccccgctgccacttcatccacaatgctgatgaaagaagacctgcccccagcggcggggccagcggggacctgcgggccttcggcaccagagatgccctgcacctgggcttcccccgggagccccggcccaagctgcaccacagcctgtccttcagcggcttccccagcggccaccaccagcccccaggcggcctggagagccccctgctgctggacagccccaccagcaggaccccacctccacccagctgcagcagcgccagcagctgcagcagcagcgccagcagctgcagcagcgccagcgctgccagcacccccagcggggcccccacctgctgtgccagcgctgctgctgctgctgctgctgccctgctgtatggaactggaggagctgaggacctgctggcccctggggccccctgtgccgcctgcagcagcgccagctgtgccaacaatgcctttgcctttggacctgagctgagcagcctcatcacccccctggccatccagacccacaactttgctgctgtggccgctgctgcctactaccgcagccagcagcagcagcagcagcagggcctggcccccccagcccagcccccagccccacccagcgccaccctgcctgctggagctgctgccccacccagcccccccttctccttccagctgccccggcggctgagtgacagccctgtgtttgatgccccacccagccccccagacagcctgagtgaccgggacagctacctgagcggcagcctgagcagcggcagcctgagcggcagcgagagccccagcctggaccctggaagaaggctgcccatcttcagccggctgagcatcagtgatgactag

SEQ ID NO: 176795 - DNA, 651 bp, Artificial Sequence
  Description of Artificial Sequence: Synthetic coding sequence
atgtctgccctgggccagatcaccatcaccgtgagccgctgctggaacacagaaagaaaccagacagacaagaacccctgcctgcatggagcctacctgcagctgcgggagaccgtgaagaacaagagcacccacctgaagaagcccctgatgaagcaggccccaccctggaaggaccacctgaccttccagcccctgcaccctgctgagaggaagacccaggtgtggcgctggcagagcggcaacagcagtgacctggagaccaccagcagcgccagcccctggcccaccggcagcaacagagatgtggtgctgaacaccctggccgagagctgctgcggcctgtctgagctgatcacagccccaccctatgccggcgtgtccatccagggcttcagccagatctgggtgctcttccccttctgtggcggcaccttccaccacaatgagaaggatgtgctgggcctgcaggactttgagcgggagagcgtgtccaccagccagagcaggaacatcagcctgctgaccctgggccagctgcagaactgtgtgattggcaagctgaccatcatcgacctgctgacagagcacctgctgggcgtgagacatggagtcatctgcttcccctggggcctgcccagcagcagctag

SEQ ID NO: 176796 - DNA, 1224 bp, Artificial Sequence
  Description of Artificial Sequence: Synthetic coding sequence
atgcagcagaaggcctttgaggagagccgctacccctggcaggagagctttgaaaatgtggccgtgtgcctgcccctgcgctgcccccgctgtggggaccacacccgcttccgcagcctgagcagcctgcgggcccacctggagttcagccacagctatgaggagaggaccctgctgaccaagtgcagcctcttccccagcctgaaggacacagacctggtgaccagcagcgagctgctgaagccaggcaagctgcagagcagtggaaatgtggtgaagcagaagcccagctatgtgaacctgtacagcatcagccatgagcacagcaaggacaggaagccctttgaggtggtggccgagaggcctgtgtcctatgtgcagacctacacagccatggacctgcacgccgacagcctggatggcaccaggagcggccctggcctgcccaccagtgacaccaaggccagctttgaggcccacgtgcgggagaagttcaacaggatggtggaggccgtggacaggaccatcgagaagagaattgacaagctgaccaaggagctggcccagaagacagctgagctgctggaggtgcgggccgcctttgtgcagctgacccagaagaagcaggaggtgcagaggcgggagcgggccctgaaccggcaggtggatgtggccgtggagatgattgctgtgctgcggcagaggctgacagaaagtgaggaggagctgctgaggaaggaggaggaggtggtgaccttcaaccacttcctggaggccgctgctgagaaggaggtgcagggcaaggcccggctgcaggacttcatcgagaacctgctgcagagggtggagctggccgagaagcagctggagtactaccagagccagcaggccagcggctttgtgcgggacctgagcggccacgtgctgacagacatcagcagcaacaggaagcccaagtgcctgagccggggccacccccacagcgtgtgcaaccacccagacctgaaggcccacttccaccccaagggcaggaaccacctgaagaaggccaaggatgaccgggcctccatgcagcctgccaaggccatccacgagcaggccgagagcagccgggacctgtgccggccccccaagaagggggagctgctgggctttggaaggaagggcaacatccggcccaagatggccaagaagaagcccacagccatcgtgaacatcatctag

SEQ ID NO: 176797 - DNA, 1002 bp, Artificial Sequence
  Description of Artificial Sequence: Synthetic coding sequence
atgcagcagaaggcctttgaggagagccgctacccctggcaggagagctttgaaaatgtggccgtgtgcctgcccctgcgctgcccccgctgtggggaccacacccgcttccgcagcctgagcagcctgcgggcccacctggagttcagccacagctatgaggagaggaccctgctgaccaagtgcagcctcttccccagcctgaaggacacagacctggtgaccagcagcgagctgctgaagccaggcaagctgcagagcagtggaaatgtggtgaagcagaagcccagctatgtgaacctgtacagcatcagccatgagcacagcaaggacaggaagccctttgaggtggtggccgagaggcctgtgtcctatgtgcagacctacacagccatggacctgcacgccgacagcctggatggcaccaggagcggccctggcctgcccaccagtgacaccaaggccagctttgaggcccacgtgcgggagaagttcaacaggatggtggaggccgtggacaggaccatcgagaagagaattgacaagctgaccaaggagctggcccagaagacagctgagctgctggaggtgcgggccgcctttgtgcagctgacccagaagaagcaggaggtgcagaggcgggagcgggccctgaaccggcaggtggatgtggccgtggagatgattgctgtgctgcggcagaggctgacagaaagtgaggaggagctgctgaggaaggaggaggaggtggtgaccttcaaccacttcctggaggccgctgctgagaaggaggtgcagggcaaggcccggctgcaggacttcatcgagaacctgctgcagagggtggagctggccgagaagcagctggagtactaccagagccagcaggccagcggctttgtgcgggacctgagcggccacgtgtcctggaagggagctggggaggcccggctggtgtgccagaatgacctggagctggaggagagcgccatcgtggagtag

SEQ ID NO: 176798 - DNA, 1389 bp, Artificial Sequence
  Description of Artificial Sequence: Synthetic coding sequence
atgcagcagaaggcctttgaggagagccgctacccctggcaggagagctttgaaaatgtggccgtgtgcctgcccctgcgctgcccccgctgtggggaccacacccgcttccgcagcctgagcagcctgcgggcccacctggagttcagccacagctatgaggagaggaccctgctgaccaagtgcagcctcttccccagcctgaaggacacagacctggtgaccagcagcgagctgctgaagccaggcaagctgcagagcagtggaaatgtggtgaagcagaagcccagctatgtgaacctgtacagcatcagccatgagcacagcaaggacaggaagccctttgaggtggtggccgagaggcctgtgtcctatgtgcagacctacacagccatggacctgcacgccgacagcctggatggcaccaggagcggccctggcctgcccaccagtgacaccaaggccagctttgaggcccacgtgcgggagaagttcaacaggatggtggaggccgtggacaggaccatcgagaagagaattgacaagctgaccaaggagctggcccagaagacagctgagctgctggaggtgcgggccgcctttgtgcagctgacccagaagaagcaggaggtgcagaggcgggagcgggccctgaaccggcaggtggatgtggccgtggagatgattgctgtgctgcggcagaggctgacagaaagtgaggaggagctgctgaggaaggaggaggaggtggtgaccttcaaccacttcctggaggccgctgctgagaaggaggtgcagggcaaggcccggctgcaggacttcatcgagaacctgctgcagagggtggagctggccgagaagcagctggagtactaccagagccagcaggccagcggctttgtgcgggacctgagcggccacgtgtcctggaagggagctggggaggcccggctggtgtgccagaatgacctggagctggagatcttcggccacatcaaccaccacctgagcggcctgaaggacagccactgcctggtgttcctgcaggcccctcctgtgccctggatcatcctggccagcttcctgtggatcctgggcaacccctggaccagcagcacagccacagctggcttcagccagatctgggtgctcttccccttctgtggcggcaccttccaccacaatgagaaggatgtgctgggcctgcaggactttgagcgggagagcgtgtccaccagccagagcaggaacatcagcctgctgaccctgggccagctgcagaactgtgtgattggcaagctgaccatcatcgacctgctgacagagcacctgctgggcgtgagacatggagtcatctgcttcccctggggcctgcccagcagcagctag

SEQ ID NO: 176799 - DNA, 162 bp, Artificial Sequence
  Description of Artificial Sequence: Synthetic coding sequence
atgcagcagaaggcctttgaggagagccgctacccctggcaggagagctttgaaaatgtggccgtgtgcctgcccctgcgctgcccccgctgtggggaccacacccgcttccgcagcctgagcagcctgcgggcccacctggagttcagccacagctactag

SEQ ID NO: 176800 - DNA, 1893 bp, Artificial Sequence
  Description of Artificial Sequence: Synthetic coding sequence
atgtctgtgtcctctggagtgcagatcctgaccaagccagagaccgtggacagaagaagatctgctgagaccaccaaggaggccggccggcccctggagatggctgtgtctgagcctgaggccagcgctgctgagtggaagcagctggaccctgcccagagcaacctgtacaatgatgtgatgctggagaactactgcaaccaggcctccatgggctgccaggcccccaagccagacatgatcagcaagctggagaagggggaggccccctggctgggcaagggcaagaggcccagccagggctgccccagcaagatcgcccggcccaagcagaaggagacagatggcaaggtgcagaaggatgatgaccagctggagaacatccagaagagccagaacaagctgctgcgggaggtggccgtgaagaagaagacccaggccaagaagaatggaagtgactgtggcagcctgggcaagaagaacaacctgcacaagaagcacgtgcccagcaagaagaggctgctgaagtttgagagctgtgggaagatcctgaagcagaacctggacctgcctgaccacagcaggaactgtgtgaagaggaagagtgatgctgccaaggagcacaagaagagcttcaaccacagcctgagtgacaccaggaagggcaagaagcagacaggcaagaagcatgagaagctgagcagccacagcagcagtgacaagtgcaacaagacaggcaagaagcatgacaagctgtgctgccacagcagcagccacatcaagcaggacaagatccagacaggagagaagcatgagaagagccccagcctgagcagcagcaccaagcatgagaagccccaggcctgtgtgaagccctatgagtgcaaccagtgtgggaaggtgctgagccacaagcagggcctgattgaccaccagagggtgcacactggagagaagccctatgagtgcaatgaatgtggcatcgccttcagccagaagagccacctggtggtgcaccagaggacccacactggagagaagccctatgagtgcatccagtgtgggaaggcccacggccacaagcacgccctgacagaccacctgcgcatccacactggagagaagccctatgaatgtgctgaatgtgggaagaccttccgccacagcagcaacctgatccagcacgtgcgcagccacactggagagaagccctatgagtgcaaggaatgtgggaagagcttccgctacaacagcagcctgacagaacatgtgaggacccacactggagagatcccctatgagtgcaatgaatgtgggaaggccttcaagtacagcagcagcctgaccaagcacatgaggatccacactggagagaagccctttgagtgcaatgaatgtgggaaggccttcagcaagaagagccacctgatcatccaccagaggacccacaccaaggagaagccctacaagtgcaatgaatgtgggaaggccttcggccacagcagcagcctgacctaccacatgaggacccacactggagagagcccctttgagtgcaaccagtgtgggaagggcttcaagcagatcgagggcctgacccagcaccagagggtgcacactggagagaagccctatgagtgcaatgaatgtgggaaggccttcagccagaagagccacctgattgtgcaccagaggacccacactggagagaagccctatgagtgcaatgaatgtgagaaggccttcaatgccaagagccagctggtgatccaccagaggagccacactggagagaagccctatgagtgcaatgaatgtgggaagaccttcaagcagaatgccagcctgaccaagcacgtgaagacccacagcgaggacaagagccatgaatag

SEQ ID NO: 176801 - DNA, 1938 bp, Artificial Sequence
  Description of Artificial Sequence: Synthetic coding sequence
atgtctgtgtcctctggagtgcagatcctgaccaagccagagaccgtggacagaagaagatctgctgagaccaccaaggaggccggccggcccctggagatggctgtgtctgagcctgaggccagcgctgctgtgtctgtgaccttcaagcacgtgaccatggccttcacccagaaggagtggaagcagctggaccctgcccagagcaacctgtacaatgatgtgatgctggagaactactgcaaccaggcctccatgggctgccaggcccccaagccagacatgatcagcaagctggagaagggggaggccccctggctgggcaagggcaagaggcccagccagggctgccccagcaagatcgcccggcccaagcagaaggagacagatggcaaggtgcagaaggatgatgaccagctggagaacatccagaagagccagaacaagctgctgcgggaggtggccgtgaagaagaagacccaggccaagaagaatggaagtgactgtggcagcctgggcaagaagaacaacctgcacaagaagcacgtgcccagcaagaagaggctgctgaagtttgagagctgtgggaagatcctgaagcagaacctggacctgcctgaccacagcaggaactgtgtgaagaggaagagtgatgctgccaaggagcacaagaagagcttcaaccacagcctgagtgacaccaggaagggcaagaagcagacaggcaagaagcatgagaagctgagcagccacagcagcagtgacaagtgcaacaagacaggcaagaagcatgacaagctgtgctgccacagcagcagccacatcaagcaggacaagatccagacaggagagaagcatgagaagagccccagcctgagcagcagcaccaagcatgagaagccccaggcctgtgtgaagccctatgagtgcaaccagtgtgggaaggtgctgagccacaagcagggcctgattgaccaccagagggtgcacactggagagaagccctatgaatgtaatgaatgtggcatcgccttcagccagaagagccacctggtggtgcaccagaggacccacactggagagaagccctatgagtgcatccagtgtgggaaggcccacggccacaagcacgccctgacagaccacctgcgcatccacactggagagaagccctatgaatgtgccgagtgtgggaagaccttccgccacagcagcaacctgatccagcacgtgcgcagccacactggagagaagccctatgagtgcaaggaatgtgggaagagcttccgctacaacagcagcctgacagagcacgtgaggacccacactggagagatcccctatgaatgtaatgaatgtgggaaggccttcaagtacagcagcagcctgaccaagcacatgaggatccacactggagagaagccctttgaatgtaatgaatgtgggaaggccttcagcaagaagagccacctgatcatccaccagaggacccacaccaaggagaagccctacaagtgcaatgaatgtgggaaggccttcggccacagcagcagcctgacctaccacatgaggacccacactggagagagcccctttgagtgcaaccagtgtgggaagggcttcaagcagatcgagggcctgacccagcaccagagggtgcacactggagagaagccctatgaatgtaatgaatgtgggaaggccttcagccagaagagccacctgattgtgcaccagaggacccacactggagagaagccctatgaatgtaatgaatgtgagaaggccttcaatgccaagagccagctggtgatccaccagaggagccacactggagagaagccctatgaatgtaatgaatgtgggaagaccttcaagcagaatgccagcctgaccaagcacgtgaagacccacagcgaggacaagagccatgaatag

SEQ ID NO: 176802 - DNA, 1896 bp, Artificial Sequence
  Description of Artificial Sequence: Synthetic coding sequence
atgtctgtgtcctctggagtgcagatcctgaccaagccagagaccgtggacagaagaagatctgctgagaccaccaaggaggccggccggcccctggagatggctgtgtctgagcctgaggccagcgctgccaaggagtggaagcagctggaccctgcccagagcaacctgtacaatgatgtgatgctggagaactactgcaaccaggcctccatgggctgccaggcccccaagccagacatgatcagcaagctggagaagggggaggccccctggctgggcaagggcaagaggcccagccagggctgccccagcaagatcgcccggcccaagcagaaggagacagatggcaaggtgcagaaggatgatgaccagctggagaacatccagaagagccagaacaagctgctgcgggaggtggccgtgaagaagaagacccaggccaagaagaatggaagtgactgtggcagcctgggcaagaagaacaacctgcacaagaagcacgtgcccagcaagaagaggctgctgaagtttgagagctgtgggaagatcctgaagcagaacctggacctgcctgaccacagcaggaactgtgtgaagaggaagagtgatgctgccaaggagcacaagaagagcttcaaccacagcctgagtgacaccaggaagggcaagaagcagacaggcaagaagcatgagaagctgagcagccacagcagcagtgacaagtgcaacaagacaggcaagaagcatgacaagctgtgctgccacagcagcagccacatcaagcaggacaagatccagacaggagagaagcatgagaagagccccagcctgagcagcagcaccaagcatgagaagccccaggcctgtgtgaagccctatgagtgcaaccagtgtgggaaggtgctgagccacaagcagggcctgattgaccaccagagggtgcacactggagagaagccctatgaatgtaatgaatgtggcatcgccttcagccagaagagccacctggtggtgcaccagaggacccacactggagagaagccctatgagtgcatccagtgtgggaaggcccacggccacaagcacgccctgacagaccacctgcgcatccacactggagagaagccctatgaatgtgccgagtgtgggaagaccttccgccacagcagcaacctgatccagcacgtgcgcagccacactggagagaagccctatgagtgcaaggaatgtgggaagagcttccgctacaacagcagcctgacagagcacgtgaggacccacactggagagatcccctatgaatgtaatgaatgtgggaaggccttcaagtacagcagcagcctgaccaagcacatgaggatccacactggagagaagccctttgaatgtaatgaatgtgggaaggccttcagcaagaagagccacctgatcatccaccagaggacccacaccaaggagaagccctacaagtgcaatgaatgtgggaaggccttcggccacagcagcagcctgacctaccacatgaggacccacactggagagagcccctttgagtgcaaccagtgtgggaagggcttcaagcagatcgagggcctgacccagcaccagagggtgcacactggagagaagccctatgaatgtaatgaatgtgggaaggccttcagccagaagagccacctgattgtgcaccagaggacccacactggagagaagccctatgaatgtaatgaatgtgagaaggccttcaatgccaagagccagctggtgatccaccagaggagccacactggagagaagccctatgaatgtaatgaatgtgggaagaccttcaagcagaatgccagcctgaccaagcacgtgaagacccacagcgaggacaagagccatgaatag

SEQ ID NO: 176803 - DNA, 1653 bp, Artificial Sequence
  Description of Artificial Sequence: Synthetic coding sequence
atgcccctgcagggctctgtgtccttcaaggatgtgacagtggacttcacccaggaggagtggcagcagctggaccctgcccagaaggccctgtacagagatgtgatgctggagaactactgccactttgtgtctgtgggcttccacatggccaagccagacatgatcaggaagctggagcagggcgaggagctgtggacccagaggatcttccccagctacagctacctggaggaggatggcaagacagaagatgtgctggtgaagttcaaggagtaccaggacagacacagccggcccctcatcttcatcaaccacaagaagctgatcaaggagaggagcaacatctacggcaagaccttcaccctgggcaagaaccgcatcagcaagaccatcctgtgtgagtacaagccagatggcaaggtgctgaagaacatcagcgagctggtgatccggaacatcagccccatcaaggagaagtttggagacagcacaggctgggagaagagcctgctgaacaccaagcatgagaagatccaccctgctgtgaacctgcacaagcagacagagcgggtgctgagcggcaagcaggagctgatccagcaccagaaggtgcaggcccctgagcagccctttgaccacaatgaatgtgagaagagcttcctgatgaagggcatgctgttcacccacacccgggcccacagaggagagaggacctttgagtacaacaaggatggcatcgccttcatcgagaagagcagcctgtctgtgcaccccagcaacctgatggagaagaagcccagcgcctacaacaagtatggcaagttcctgtgcaggaagcctgtgttcatcatgccccagaggccccagacagaggagaagcccttccactgcccctactgcggcaacaacttccggaggaagagctacctgattgagcaccagaggatccacactggagagaagccctacgtgtgcaaccagtgtgggaaggccttccggcagaagacagccctgaccctgcacgagaagacccacatcgagggcaagcccttcatctgcatcgactgtgggaagagcttccggcagaaggccaccctgaccaggcaccacaagacccacactggagagaaggcctatgaatgtccccagtgtggcagcgccttcaggaagaagagctacctgattgaccaccagaggacccacactggagagaagccctaccagtgcaatgaatgtgggaaggccttcatccagaagaccaccctgactgtgcaccagaggacccacactggagagaagccctacatctgcaatgaatgtgggaagagcttctgccagaagaccaccctgaccctgcaccagaggatccacactggagagaagccctacatctgcaatgaatgtgggaagagcttccggcagaaggccatcctgactgtgcaccaccgcatccacactggagagaagagcaatggctgcccccagtgtgggaaggccttcagcaggaagagcaacctgatccgccaccagaagacccacactggagagaagccctatgagtgcaagcagtgtgggaagttcttcagctgcaagagcaacctgattgtgcaccagaagacccacaaggtggagaccaccggcatccagtag

SEQ ID NO: 176804 - DNA, 1650 bp, Artificial Sequence
  Description of Artificial Sequence: Synthetic coding sequence
atgagccagggctctgtgtccttcaaggatgtgacagtggacttcacccaggaggagtggcagcagctggaccctgcccagaaggccctgtacagagatgtgatgctggagaactactgccactttgtgtctgtgggcttccacatggccaagccagacatgatcaggaagctggagcagggcgaggagctgtggacccagaggatcttccccagctacagctacctggaggaggatggcaagacagaagatgtgctggtgaagttcaaggagtaccaggacagacacagccggcccctcatcttcatcaaccacaagaagctgatcaaggagaggagcaacatctacggcaagaccttcaccctgggcaagaaccgcatcagcaagaccatcctgtgtgagtacaagccagatggcaaggtgctgaagaacatcagcgagctggtgatccggaacatcagccccatcaaggagaagtttggagacagcacaggctgggagaagagcctgctgaacaccaagcatgagaagatccaccctgctgtgaacctgcacaagcagacagagcgggtgctgagcggcaagcaggagctgatccagcaccagaaggtgcaggcccctgagcagccctttgaccacaatgaatgtgagaagagcttcctgatgaagggcatgctgttcacccacacccgggcccacagaggagagaggacctttgagtacaacaaggatggcatcgccttcatcgagaagagcagcctgtctgtgcaccccagcaacctgatggagaagaagcccagcgcctacaacaagtatggcaagttcctgtgcaggaagcctgtgttcatcatgccccagaggccccagacagaggagaagcccttccactgcccctactgcggcaacaacttccggaggaagagctacctgattgagcaccagaggatccacactggagagaagccctacgtgtgcaaccagtgtgggaaggccttccggcagaagacagccctgaccctgcacgagaagacccacatcgagggcaagcccttcatctgcatcgactgtgggaagagcttccggcagaaggccaccctgaccaggcaccacaagacccacactggagagaaggcctatgagtgcccccagtgtggcagcgccttcaggaagaagagctacctgattgaccaccagaggacccacactggagagaagccctaccagtgcaatgaatgtgggaaggccttcatccagaagaccaccctgactgtgcaccagaggacccacactggagagaagccctacatctgcaatgaatgtgggaagagcttctgccagaagaccaccctgaccctgcaccagaggatccacactggagagaagccctacatctgcaatgaatgtgggaagagcttccggcagaaggccatcctgactgtgcaccaccgcatccacactggagagaagagcaatggctgcccccagtgtgggaaggccttcagcaggaagagcaacctgatccgccaccagaagacccacactggagagaagccctatgagtgcaagcagtgtgggaagttcttcagctgcaagagcaacctgattgtgcaccagaagacccacaaggtggagaccaccggcatccagtag

SEQ ID NO: 176805 - DNA, 1503 bp, Artificial Sequence
  Description of Artificial Sequence: Synthetic coding sequence
atggaggagagccacttcaacagcaacccctacttctggcccagcatccccaccgtgtctggccagatcgagaacaccatgttcatcaacaagatgaaggaccagctgctgcctgagaagggctgcggcctggccccaccccactaccccaccctgctgactgtgcctgcctctgtgtccctgcccagcggcatctccatggacacagagagcaagagtgaccagctgaccccccacagccaggcctctgtgacccagaacatcaccgtggtgcctgtgcccagcacaggcctgatgacagctggccctggcctggtgatcaccagccccagcggcagcctggtgaccacagccagcagcgcccagaccttccccatcagcgcccccatgattgtgtctgccctgcccccaggcagccaggccctgcaggtggtgcctgacctgagcaagaaggtggccagcaccctgacagaggagggcggcggcggcggcggcggcggcggctctgtggcccccaagccaccccggggcaggaagaagaagaggatgctggagagcggcctgcctgagatgaatgacccctacgtgctgagcccagaagatgatgatgaccaccagaaggatggcaagacctaccgctgcaggatgtgcagcctgaccttctacagcaagtctgagatgcagatccacagcaagagccacacagagaccaagccccacaagtgcccccactgcagcaagacctttgccaacagcagctacctggcccagcacatccgcatccacagcggggccaagccctacagctgcaacttctgtgagaagagcttccggcagctgagccacctgcagcagcacacccgcatccacactggagaccggccctacaagtgtgcccaccctggctgtgagaaggccttcacccagctgagcaacctgcagagccaccggcggcagcacaacaaggacaagcccttcaagtgccacaactgccaccgggcctacacagatgctgccagcctggaggtgcacctgagcacccacacagtgaagcacgccaaggtgtacacctgcaccatctgcagccgggcctacaccagcgagacctacctgatgaagcacatgaggaagcacaaccccccagacctgcagcagcaggtgcaggccgctgctgctgctgctgctgtggcccaggcccaggcccaggcccaggcccaggcccaggcccaggcccaggcccaggcccaggcccaggccagccaggccagccagcagcagcagcagcagcagcagcagcagcagcagcagcagcagcagcccccaccccacttccagagccctggagctgccccccagggcggcggcggcggggacagcaaccccaaccccccaccccagtgcagctttgacctgaccccctacaagacagctgagcaccacaaggacatctgcctgactgtgaccaccagcaccatccaggtggagcacctggccagcagctag

SEQ ID NO: 176806 - DNA, 1734 bp, Artificial Sequence
  Description of Artificial Sequence: Synthetic coding sequence
atggaggagagccacttcaacagcaacccctacttctggcccagcatccccaccgtgtctggccagatcgagaacaccatgttcatcaacaagatgaaggaccagctgctgcctgagaagggctgcggcctggccccaccccactaccccaccctgctgactgtgcctgcctctgtgtccctgcccagcggcatctccatggacacagagagcaagagtgaccagctgaccccccacagccaggcctctgtgacccagaacatcaccgtggtgcctgtgcccagcacaggcctgatgacagctggggtgtcctgcagccagcgctggaggcgggagggcagccagagccggggccctggcctggtgatcaccagccccagcggcagcctggtgaccacagccagcagcgcccagaccttccccatcagcgcccccatgattgtgtctgccctgcccccaggcagccaggccctgcaggtggtgcctgacctgagcaagaaggtggccagcaccctgacagaggagggcggcggcggcggcggcggcggcggctctgtggcccccaagccaccccggggcaggaagaagaagaggatgctggagagcggcctgcctgagatgaatgacccctacgtgctgagcccagaagatgatgatgaccaccagaaggatggcaagacctaccgctgcaggatgtgcagcctgaccttctacagcaagtctgagatgcagatccacagcaagagccacacagagaccaagccccacaagtgcccccactgcagcaagacctttgccaacagcagctacctggcccagcacatccgcatccacagcggggccaagccctacagctgcaacttctgtgagaagagcttccggcagctgagccacctgcagcagcacacccgcatccacagcaagatgcacacagagaccatcaagccccacaagtgcccccactgcagcaagacctttgccaacaccagctacctggcccagcacctgcgcatccacagcggggccaagccctacaactgcagctactgccagaaggccttccggcagctgagccacctgcagcagcacacccgcatccacactggagaccggccctacaagtgtgcccaccctggctgtgagaaggccttcacccagctgagcaacctgcagagccaccggcggcagcacaacaaggacaagcccttcaagtgccacaactgccaccgggcctacacagatgctgccagcctggaggtgcacctgagcacccacacagtgaagcacgccaaggtgtacacctgcaccatctgcagccgggcctacaccagcgagacctacctgatgaagcacatgaggaagcacaaccccccagacctgcagcagcaggtgcaggccgctgctgctgctgctgctgtggcccaggcccaggcccaggcccaggcccaggcccaggcccaggcccaggcccaggcccaggcccaggccagccaggccagccagcagcagcagcagcagcagcagcagcagcagcagcagcagcagcagcccccaccccacttccagagccctggggccgccccccagggcggcggcggcggggacagcaaccccaaccccccaccccagtgcagctttgacctgaccccctacaagacagctgagcaccacaaggacatctgcctgactgtgaccaccagcaccatccaggtggagcacctggccagcagctag

SEQ ID NO: 176807 - DNA, 1551 bp, Artificial Sequence
  Description of Artificial Sequence: Synthetic coding sequence
atggaggagagccacttcaacagcaacccctacttctggcccagcatccccaccgtgtctggccagatcgagaacaccatgttcatcaacaagatgaaggaccagctgctgcctgagaagggctgcggcctggccccaccccactaccccaccctgctgactgtgcctgcctctgtgtccctgcccagcggcatctccatggacacagagagcaagagtgaccagctgaccccccacagccaggcctctgtgacccagaacatcaccgtggtgcctgtgcccagcacaggcctgatgacagctggggtgtcctgcagccagcgctggaggcgggagggcagccagagccggggccctggcctggtgatcaccagccccagcggcagcctggtgaccacagccagcagcgcccagaccttccccatcagcgcccccatgattgtgtctgccctgcccccaggcagccaggccctgcaggtggtgcctgacctgagcaagaaggtggccagcaccctgacagaggagggcggcggcggcggcggcggcggcggctctgtggcccccaagccaccccggggcaggaagaagaagaggatgctggagagcggcctgcctgagatgaatgacccctacgtgctgagcccagaagatgatgatgaccaccagaaggatggcaagacctaccgctgcaggatgtgcagcctgaccttctacagcaagtctgagatgcagatccacagcaagagccacacagagaccaagccccacaagtgcccccactgcagcaagacctttgccaacagcagctacctggcccagcacatccgcatccacagcggggccaagccctacagctgcaacttctgtgagaagagcttccggcagctgagccacctgcagcagcacacccgcatccacactggagaccggccctacaagtgtgcccaccctggctgtgagaaggccttcacccagctgagcaacctgcagagccaccggcggcagcacaacaaggacaagcccttcaagtgccacaactgccaccgggcctacacagatgctgccagcctggaggtgcacctgagcacccacacagtgaagcacgccaaggtgtacacctgcaccatctgcagccgggcctacaccagcgagacctacctgatgaagcacatgaggaagcacaaccccccagacctgcagcagcaggtgcaggccgctgctgctgctgctgctgtggcccaggcccaggcccaggcccaggcccaggcccaggcccaggcccaggcccaggcccaggcccaggccagccaggccagccagcagcagcagcagcagcagcagcagcagcagcagcagcagcagcagcccccaccccacttccagagccctggagctgccccccagggcggcggcggcggggacagcaaccccaaccccccaccccagtgcagctttgacctgaccccctacaagacagctgagcaccacaaggacatctgcctgactgtgaccaccagcaccatccaggtggagcacctggccagcagctag

SEQ ID NO: 176808 - DNA, 1551 bp, Artificial Sequence; identical to SEQ ID NO: 176807
  Description of Artificial Sequence: Synthetic coding sequence

SEQ ID NO: 176809 - DNA, 1734 bp, Artificial Sequence; identical to SEQ ID NO: 176806
  Description of Artificial Sequence: Synthetic coding sequence

SEQ ID NO: 176810 - DNA, 1008 bp, Artificial Sequence
  Description of Artificial Sequence: Synthetic coding sequence
atggaggagagccacttcaacagcaacccctacttctggcccagcatccccaccgtgtctggccagatcgagaacaccatgttcatcaacaagatgaaggaccagctgctgcctgagaagggctgcggcctggccccaccccactaccccaccctgctgactgtgcctgcctctgtgtccctgcccagcggcatctccatggacacagagagcaagagtgaccagctgaccccccacagccaggcctctgtgacccagaacatcaccgtggtgcctgtgcccagcacaggcctgatgacagctggggtgtcctgcagccagcgctggaggcgggagggcagccagagccggggccctggcctggtgatcaccagccccagcggcagcctggtgaccacagccagcagcgcccagaccttccccatcagcgcccccatgattgtgtctgccctgcccccaggcagccaggccctgcaggtggtgcctgacctgagcaagaaggtggccagcaccctgacagaggagggcggcggcggcggcggcggcggcggctctgtggcccccaagccaccccggggcaggaagaagaagaggatgctggagagcggcctgcctgagatgaatgacccctacgtgctgagcccagaagatgatgatgaccaccagaaggatggcaagacctacagaagtgagggcaactgtggcactggaaatggccagagcctgggcctgatggattctgtgcccggcagcaccaccaacctgctgtgtgaccccggctgcaggatgtgcagcctgaccttctacagcaagtctgagatgcagatccacagcaagagccacacagagaccaagccccacaagtgcccccactgcagcaagacctttgccaacagcagctacctggcccagcacatccgcatccacagcggggccaagccctacagctgcaacttctgtgagaagagcttccggcagctgagccacctgcagcagcacaccaggtag

SEQ ID NO: 176811 - DNA, 834 bp, Artificial Sequence
  Description of Artificial Sequence: Synthetic coding sequence
atggaggagagccacttcaacagcaacccctacttctggcccagcatccccaccgtgtctggccagatcgagaacaccatgttcatcaacaagatgaaggaccagctgctgcctgagaagggctgcggcctggccccaccccactaccccaccctgctgactgtgcctgcctctgtgtccctgcccagcggcatctccatggacacagagagcaagagtgaccagctgaccccccacagccaggcctctgtgacccagaacatcaccgtggtgcctgtgcccagcacaggcctgatgacagctggccctggcctggtgatcaccagccccagcggcagcctggtgaccacagccagcagcgcccagaccttccccatcagcgcccccatgattgtgtctgccctgcccccaggcagccaggccctgcaggtggtgcctgacctgagcaagaaggtggccagcaccctgacagaggagggcggcggcggcggcggcggcggcggctctgtggcccccaagccaccccggggcaggaagaagaagaggatgctggagagcggcctgcctgagatgaatgacccctacgtgctgagcccagaagatgatgatgaccaccagaaggatggcaagacctaccgctgcaggatgtgcagcctgaccttctacagcaagtctgagatgcagatccacagcaagagccacacagagaccaagccccacaagtgcccccactgcagcaagacctttgccaacagcagctacctggcccagcacatccgcatccacagcggggccaagccctacagctgcaacttctgtgagaagagcttctag

SEQ ID NO: 176812 - DNA, 1386 bp, Artificial Sequence
  Description of Artificial Sequence: Synthetic coding sequence
atggaggagagccacttcaacagcaacccctacttctggcccagcatccccaccgtgtctggccagatcgagaacaccatgttcatcaacaagatgaaggaccagctgctgcctgagaagggctgcggcctggccccaccccactaccccaccctgctgactgtgcctgcctctgtgtccctgcccagcggcatctccatggacacagagagcaagagtgaccagctgaccccccacagccaggcctctgtgacccagaacatcaccgtggtgcctgtgcccagcacaggcctgatgacagctgccctgcaggtggtgcctgacctgagcaagaaggtggccagcaccctgacagaggagggcggcggcggcggcggcggcggcggctctgtggcccccaagccaccccggggcaggaagaagaagaggatgctggagagcggcctgcctgagatgaatgacccctacgtgctgagcccagaagatgatgatgaccaccagaaggatggcaagacctaccgctgcaggatgtgcagcctgaccttctacagcaagtctgagatgcagatccacagcaagagccacacagagaccaagccccacaagtgcccccactgcagcaagacctttgccaacagcagctacctggcccagcacatccgcatccacagcggggccaagccctacagctgcaacttctgtgagaagagcttccggcagctgagccacctgcagcagcacacccgcatccacactggagaccggccctacaagtgtgcccaccctggctgtgagaaggccttcacccagctgagcaacctgcagagccaccggcggcagcacaacaaggacaagcccttcaagtgccacaactgccaccgggcctacacagatgctgccagcctggaggtgcacctgagcacccacacagtgaagcacgccaaggtgtacacctgcaccatctgcagccgggcctacaccagcgagacctacctgatgaagcacatgaggaagcacaaccccccagacctgcagcagcaggtgcaggccgctgctgctgctgctgctgtggcccaggcccaggcccaggcccaggcccaggcccaggcccaggcccaggcccaggcccaggcccaggccagccaggccagccagcagcagcagcagcagcagcagcagcagcagcagcagcagcagcagcccccaccccacttccagagccctggggccgccccccagggcggcggcggcggggacagcaaccccaaccccccaccccagtgcagctttgacctgaccccctacaagacagctgagcaccacaaggacatctgcctgactgtgaccaccagcaccatccaggtggagcacctggccagcagctag

SEQ ID NO: 176813 - DNA, 1161 bp, Artificial Sequence
  Description of Artificial Sequence: Synthetic coding sequence
atgatcctgggcagcctgagcagagctggccccctgcccctgctgcggcagccccccatcatgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggcccccaggcctgtgtccatggagaatggcctgggccctgcccctggcagccctgagaagcagcccggcagccccagccccccatccatccctgagaccggccagggcgtgaccaagggggagggcggcaccccagccccagccagcctgcccggcggcagcaaggaggaggaggagaaggccaagaggctgctgtactgtgccctgtgcaaggtggccgtgaacagcctgagccagctggaggcccacaacaagggcaccaagcacaagaccatcctggaggcccggagcggcctgggccccatcaaggcctacccccggctgggcccccccaccccaggagagcctgaggccccagcccaggacaggaccttccactgtgagatctgcaatgtgaaggtgaacagcgaggtgcagctgaagcagcacatcagcagcagaagacacagagatggagtggccggcaagcccaaccccctgctgagccgccacaagaagagcagaggagctggggagctggccggcaccctgaccttcagcaaggagctgcccaagagcctggccggcggcctgctgcccagccccctggccgtggccgctgtgatggctgctgctgctggcagccccctgagcctgcggcctgccccagctgcccccctgctgcagggcccccccatcacccaccccctgctgcacccagcccctggccccatcagaacagcccacggccccatcctcttcagcccctactag

SEQ ID NO: 176814 - DNA, 918 bp, Artificial Sequence
  Description of Artificial Sequence: Synthetic coding sequence
atgatcctgggcagcctgagcagagctggccccctgcccctgctgcggcagccccccatcatgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggccccccggcccggcaccaagcacaagaccatcctggaggcccggagcggcctgggccccatcaaggcctacccccggctgggcccccccaccccaggagagcctgaggccccagcccaggacaggaccttccactgtgagatctgcaatgtgaaggtgaacagcgaggtgcagctgaagcagcacatcagcagccgccgccacagagatggagtggccggcaagcccaaccccctgctgagccgccacaagaagagcagaggagctggggagctggccggcaccctgaccttcagcaaggagctgcccaagagcctggccggcggcctgctgcccagccccctggccgtggccgctgtgatggctgctgctgctggcagccccctgagcctgcggcctgccccagctgcccccctgctgcagggcccccccatcacccaccccctgctgcacccagcccctggccccatcagaacagcccacggccccatcctcttcagcccctactag

SEQ ID NO: 176815 - DNA, 1101 bp, Artificial Sequence
  Description of Artificial Sequence: Synthetic coding sequence
atgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggcccccaggcctgtgtccatggagaatggcctgggccctgcccctggcagccctgagaagcagcccggcagccccagccccccatccatccctgagaccggccagggcgtgaccaagggggagggcggcaccccagccccagccagcctgcccggcggcagcaaggaggaggaggagaaggccaagaggctgctgtactgtgccctgtgcaaggtggccgtgaacagcctgagccagctggaggcccacaacaagggcaccaagcacaagaccatcctggaggcccggagcggcctgggccccatcaaggcctacccccggctgggcccccccaccccaggagagcctgaggccccagcccaggacaggaccttccactgtgagatctgcaatgtgaaggtgaacagcgaggtgcagctgaagcagcacatcagcagcagaagacacagagatggagtggccggcaagcccaaccccctgctgagccgccacaagaagagcagaggagctggggagctggccggcaccctgaccttcagcaaggagctgcccaagagcctggccggcggcctgctgcccagccccctggccgtggccgctgtgatggctgctgctgctggcagccccctgagcctgcggcctgccccagctgcccccctgctgcagggcccccccatcacccaccccctgctgcacccagcccctggccccatcagaacagcccacggccccatcctcttcagcccctactag

SEQ ID NO: 176816 - DNA, 699 bp, Artificial Sequence
  Description of Artificial Sequence: Synthetic coding sequence
atgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggcccccaggcctgtgtccatggagaatggcctgggccctgcccctggcagccctgagaagcagcccggcagccccagccccccatccatccctgagaccggccagggcgtgaccaagggggagggcggcaccccagccccagccagcctgcccggcggcagcaaggaggaggaggagaaggccaagaggctgctgtactgtgccctgtgcaaggtggccgtgaacagcctgagccagctggaggcccacaacaagggcaccaagcacaagaccatcctggaggcccggagcggcctgggccccatcaaggcctacccccggctgggcccccccaccccaggagagccctag

SEQ ID NO: 176817 - DNA, 1101 bp, Artificial Sequence; identical to SEQ ID NO: 176815
  Description of Artificial Sequence: Synthetic coding sequence

SEQ ID NO: 176818 - DNA, 498 bp, Artificial Sequence
  Description of Artificial Sequence: Synthetic coding sequence
atgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggcccccaggcctgtgtccatggagaatggcctgggccctgcccctggcagccctgagaagcagcccggcagccccagccccccatccatccctgagaccggccagggcgtgaccaagggggagggcggcaccccagccccagccagctag

SEQ ID NO: 176819 - DNA, 438 bp, Artificial Sequence
  Description of Artificial Sequence: Synthetic coding sequence
atgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggcccccaggcctgtgtccatggagaatggcctgggccctgcccctggcagccctgagaagcagcccggcagccccagcccccccagctag

SEQ ID NO: 176820 - DNA, 1101 bp, Artificial Sequence; identical to SEQ ID NO: 176815
  Description of Artificial Sequence: Synthetic coding sequence

SEQ ID NO: 176821 - DNA, 858 bp, Artificial Sequence
  Description of Artificial Sequence: Synthetic coding sequence
atgcagccccccctggacctgaagcagatcctgcccttccccctggagcccgcccccaccctgggcctcttcagcaactacagcaccatggaccctgtgcagaaggctgtgctgagccacaccttcggcggccccctgctgaagaccaagaggcctgtgatcagctgcaacatctgccagatccgcttcaacagccagagccaggccgaggcccactacaagggcaacagacatgcccggcgggtgaagggcattgaagctgccaagacccggggccgggagcccggggtgcgggagcccggggaccctgcccctcctggcagcacccccaccaatggagatggagtggccccccggcccggcaccaagcacaagaccatcctggaggcccggagcggcctgggccccatcaaggcctacccccggctgggcccccccaccccaggagagcctgaggccccagcccaggacaggaccttccactgtgagatctgcaatgtgaaggtgaacagcgaggtgcagctgaagcagcacatcagcagccgccgccacagagatggagtggccggcaagcccaaccccctgctgagccgccacaagaagagcagaggagctggggagctggccggcaccctgaccttcagcaaggagctgcccaagagcctggccggcggcctgctgcccagccccctggccgtggccgctgtgatggctgctgctgctggcagccccctgagcctgcggcctgccccagctgcccccctgctgcagggcccccccatcacccaccccctgctgcacccagcccctggccccatcagaacagcccacggccccatcctcttcagcccctactag

SEQ ID NO: 176822 - DNA, 1110 bp, Artificial Sequence
  Description of Artificial Sequence: Synthetic coding sequence
atgatgcagcccagcctggacatcaagcccttcatgtccttccctgtggacagcagcagcgctgtgggcctcttccccaacttcaacaccatggaccctgtgcagaaggctgtgatcaaccacacctttggagtgtccatcccccccaagaagaagcaggtgatcagctgcaatgtgtgccagctgcgcttcaacagcgacagccaggccgaggcccactacaagggcagcaagcacgccaagaaggtgaaggccctggatgccaccaagaacaagcccaagatggtgcccagcaaggacagcgccaaggccaaccccagctgcagcatcacccccatcaccggcaacaacagcgacaagtctgaggacaagggcaagctgaaggccagcagcagcagccagcccagcagcagcgagagcggcagcttcctgctgaagagcggcaccacccccctgcccccaggggccgccaccagccccagcaagagcaccaatggagcccctggcaccgtggtggagagcgaggaggagaaggccaagaagctgctgtactgcagcctgtgcaaggtggccgtgaacagcctgagccagctggaggcccacaacacaggcagcaagcacaagaccatggtggaggccagaaatggagctggccccatcaagagctacccccggcccggcagccggctgaagatgcagaatggcagcaaaggaagtggcctgcagaacaagaccttccactgtgagatctgtgatgtgcacgtgaacagcgagatccagctgaagcagcacatcagcagccgccgccacaaggacagagtggccggcaagcccctgaagcccaagtacagcccctacaacaagctgcagaggagccccagcatcctggccgccaagctggccttccagaaggacatgatgaagcccctggccccagccttcctgagcagccccctggccgctgctgctgctgtgtcctctgccctgagcctgcccccccggcccagcgccagcctcttccaggccccagccatccccccagccctgctgcggcccggccacggccccatccgggccaccccagccagcatcctgtttgccccctactag

SEQ ID NO: 176823 - DNA, 1188 bp, Artificial Sequence
  Description of Artificial Sequence: Synthetic coding sequence
atgtggagcggcctgcccagccggggcagcacctgccacaccaccaccctgcctgccctggtgaggacccccaccctgatgatgcagcccagcctggacatcaagcccttcatgtccttccctgtggacagcagcagcgctgtgggcctcttccccaacttcaacaccatggaccctgtgcagaaggctgtgatcaaccacacctttggagtgtccatcccccccaagaagaagcaggtgatcagctgcaatgtgtgccagctgcgcttcaacagcgacagccaggccgaggcccactacaagggcagcaagcacgccaagaaggtgaaggccctggatgccaccaagaacaagcccaagatggtgcccagcaaggacagcgccaaggccaaccccagctgcagcatcacccccatcaccggcaacaacagcgacaagtctgaggacaagggcaagctgaaggccagcagcagcagccagcccagcagcagcgagagcggcagcttcctgctgaagagcggcaccacccccctgcccccaggggccgccaccagccccagcaagagcaccaatggagcccctggcaccgtggtggagagcgaggaggagaaggccaagaagctgctgtactgcagcctgtgcaaggtggccgtgaacagcctgagccagctggaggcccacaacacaggcagcaagcacaagaccatggtggaggccagaaatggagctggccccatcaagagctacccccggcccggcagccggctgaagatgcagaatggcagcaaaggaagtggcctgcagaacaagaccttccactgtgagatctgtgatgtgcacgtgaacagcgagatccagctgaagcagcacatcagcagccgccgccacaaggacagagtggccggcaagcccctgaagcccaagtacagcccctacaacaagctgcagaggagccccagcatcctggccgccaagctggccttccagaaggacatgatgaagcccctggccccagccttcctgagcagccccctggccgctgctgctgctgtgtcctctgccctgagcctgcccccccggcccagcgccagcctcttccaggccccagccatccccccagccctgctgcggcccggccacggccccatccgggccaccccagccagcatcctgtttgccccctactag

SEQ ID NO: 176824 - DNA, 1110 bp, Artificial Sequence; identical to SEQ ID NO: 176822
  Description of Artificial Sequence: Synthetic coding sequence

SEQ ID NO: 176825 - DNA, 1416 bp, Artificial Sequence
  Description of Artificial Sequence: Synthetic coding sequence
atgaacatggccaacttcctgcggggctttgaggagaagggcatcaagaatgacaggcctgaggaccagctgagcaaggagaagaagaagatcctcttctccttctgtgaggtgtgcaacatccagctgaacagcgctgcccaggcccaggtgcacagcaatggcaagagccacaggaagagggtgaagcagctgagtgatggccagcccccacctccagcccaggccagccccagcagcaacagcagcacaggcagcacctgccacaccaccaccctgcctgccctggtgaggacccccaccctgatgatgcagcccagcctggacatcaagcccttcatgtccttccctgtggacagcagcagcgctgtgggcctcttccccaacttcaacaccatggaccctgtgcagaaggctgtgatcaaccacacctttggagtgtccatcccccccaagaagaagcaggtgatcagctgcaatgtgtgccagctgcgcttcaacagcgacagccaggccgaggcccactacaagggcagcaagcacgccaagaaggtgaaggccctggatgccaccaagaacaagcccaagatggtgcccagcaaggacagcgccaaggccaaccccagctgcagcatcacccccatcaccggcaacaacagcgacaagtctgaggacaagggcaagctgaaggccagcagcagcagccagcccagcagcagcgagagcggcagcttcctgctgaagagcggcaccacccccctgcccccaggggccgccaccagccccagcaagagcaccaatggagcccctggcaccgtggtggagagcgaggaggagaaggccaagaagctgctgtactgcagcctgtgcaaggtggccgtgaacagcctgagccagctggaggcccacaacacaggcagcaagcacaagaccatggtggaggccagaaatggagctggccccatcaagagctacccccggcccggcagccggctgaagatgcagaatggcagcaaaggaagtggcctgcagaacaagaccttccactgtgagatctgtgatgtgcacgtgaacagcgagatccagctgaagcagcacatcagcagccgccgccacaaggacagagtggccggcaagcccctgaagcccaagtacagcccctacaacaagctgcagaggagccccagcatcctggccgccaagctggccttccagaaggacatgatgaagcccctggccccagccttcctgagcagccccctggccgctgctgctgctgtgtcctctgccctgagcctgcccccccggcccagcgccagcctcttccaggccccagccatccccccagccctgctgcggcccggccacggccccatccgggccaccccagccagcatcctgtttgccccctactag

SEQ ID NO: 176826 - DNA, 96 bp, Artificial Sequence
  Description of Artificial Sequence: Synthetic coding sequence
atgaacatggccaacttcctgcggggctttgaggagaagggcatcaagaatgacaggcctgaggaccagctgagcaaggagaagaagaagatctag

SEQ ID NO: 176827 - DNA, 417 bp, Artificial Sequence
  Description of Artificial Sequence: Synthetic coding sequence
atgctgggcagcacctgccacaccaccaccctgcctgccctggtgaggacccccaccctgatgatgcagcccagcctggacatcaagcccttcatgtccttccctgtggacagcagcagcgctgtgggcctcttccccaacttcaacaccaagaggcggggcctgtttgagaccaacaagttctgccagatggaccctgtgcagaaggccgtcatcaaccacaccttcggcgtgtccatcccccccaagaagaagcaggtgatcagctgcaatgtgtgccagctgcgcttcaacagcgacagccaggccgaggcccactacaagggcagcaagcacgccaagaaggtgaaggccctggatgccaccaagaacaagcccaagatggtgcccagcaaggacagcgccaaggccaactag

SEQ ID NO: 176828 - DNA, 228 bp, Artificial Sequence
  Description of Artificial Sequence: Synthetic coding sequence
atgaacatggccaacttcctgcggggctttgaggagaagggcatcaagaatgacaggcctgaggaccagctgagcaaggagaagaagaagatcctcttctccttctgtgaggtgtgcaacatccagctgaacagcgctgcccaggcccaggtgcacagcaatggcaagagccacaggaagagggtgaagcagctgagtgatggccagcccccacctccagcccagtag

SEQ ID NO: 176829 - DNA, 792 bp, Artificial Sequence
  Description of Artificial Sequence: Synthetic coding sequence
atgatgcagcccagcctggacatcaagcccttcatgtccttccctgtggacagcagcagcgctgtgggcctcttccccaacttcaacaccatggaccctgtgcagaaggctgtgatcaaccacacctttggagtgtccatcccccccaagaagaagcaggtgatcagctgcaatgtgtgccagctgcgcttcaacagcgacagccaggccgaggcccactacaagggcagcaagcacgccaagaaggtgaaggccctggatgccaccaagaacaagcccaagatggtgcccagcaaggacagcgccaaggccaaccccagctgcagcatcacccccatcaccggcaacaacagcgacaagtctgaggacaagggcaagctgaaggccagcagcagcagccagcccagcagcagcgagagcggcagcttcctgctgaagagcggcaccacccccctgcccccaggggccgccaccagccccagcaagagcaccaatggagcccctggcaccgtggtggagagcgaggaggagaaggccaagaagctgctgtactgcagcctgtgcaaggtggccgtgaacagcctgagccagctggaggcccacaacacaggcagcaagcacaagaccatggtggaggccagaaatggagctggccccatcaagagctacccccggcccggcagccggctgaagatgcagaatggcagcaaaggaagtggcctgcagaacaagaccttccactgtgagatctgtgatgtgcacgtgaacagcgagatccagctgaagcagtag

SEQ ID NO: 176830 - DNA, 1002 bp, Artificial Sequence
  Description of Artificial Sequence: Synthetic coding sequence
atgtctgccaagctgggcaagagcagcagcctgctgacccagaccagcgaggagtgcaatggcatcctgacagagaagatggaggaggaggagcagacctgtgaccctgacagcagcctgcactggagcagcagctacagccctgagaccttccggcagcagttccggcagtttggctaccaggacagccctggcccccatgaggccctgagccggctgtgggagctgtgccacctgtggctgcggcctgaggtgcacaccaaggagcagatcctggagctgctggtgctggagcagttcctggccatcctgcccaaggagctgcaggcctgggtgcagaagcaccacccagaaaatggagaggagaccgtgaccatgctggaggatgtggagcgggagctggatggccccaagcagatcttcttcggccgcaggaaggacatgattgctgagaagctggcccccagcgagatcacagaggagctgcccagcagccagctgatgcctgtgaagaagcagctgcagggcgcctcctgggagctgcagagcctgcggccccatgatgaggacatcaagaccaccaacgtgaagagcgccagccggcagaagaccagcctgggcatcgagctgcactgcaatgtgagcaacatcctgcacatgaatggcagccagagcagcacctaccggggcacctatgagcaggacggccgctttgagaagaggcagggcaaccccagctggaagaagcagcagaagtgtgatgaatgtgggaagatcttcagccagagcagcgccctgatcctgcaccagaggatccacagcggcaagaagccctatgcctgtgatgaatgtgccaaggccttcagccgcagcgccatcctgatccagcacaggaggacccacacagacagcaaatatgagcacgccatcgccgaggcccagaagaacatgtacttcaagacccggctgaagtgccccaggagcctgagcggcggccgctag

SEQ ID NO: 176831 - DNA, 1008 bp, Artificial Sequence
  Description of Artificial Sequence: Synthetic coding sequence
atgtctgccaagctgggcaagagcagcagcctgctgacccagaccagcgaggagtgcaatggcatcctgacagagaagatggaggaggaggagcagacctgtgaccctgacagcagcctgcactggagcagcagctacagccctgagaccttccggcagcagttccggcagtttggctaccaggacagccctggcccccatgaggccctgagccggctgtgggagctgtgccacctgtggctgcggcctgaggtgcacaccaaggagcagatcctggagctgctggtgctggagcagttcctggccatcctgcccaaggagctgcaggcctgggtgcagaagcaccacccagaaaatggagaggagaccgtgaccatgctggaggatgtggagcgggagctggatggccccaagcagatcttcttcggccgcaggaaggacatgattgctgagaagctggcccccagcgagatcacagaggagctgcccagcagccagctgatgcctgtgaagaagcagctgcagggcgcctcctgggagctgcagagcctgcggccccatgatgaggacatcaagaccaccaacgtgaagagcgccagccggcagaagaccagcctgggcatcgagctgcactgcaatgtgagcaacatcctgcacatgaatggcagccagagcagcacctaccggggcacctatgagcaggacggccgctttgagaagaggcagggcaaccccagctggaagaagcagcagaagtgtgatgaatgtgggaagatcttcagccagagcagcgccctgatcctgcaccagaggatccacagcggcaagaagccctatgcctgtgatgaatgtgccaaggccttcagccgcagcgccatcctgatccagcacaggaggacccacactggagagaagccctacaagtgccacgactgtgggaaggccttcagccagagcagcaacctcttccgccacaggaagaggcacatcaggaagaaggtgccctag

SEQ ID NO: 176832 - DNA, 828 bp, Artificial Sequence
  Description of Artificial Sequence: Synthetic coding sequence
atggctgtggagagcggggtcatcagcaccctcatcccccaggaccccccagagcaggagctgatcctggtgaaggtggaggacaacttctcctgggatgagaagttcaagcagaatggcagcacccagagctgccaggagctgttccggcagcagttcaggaagttctgctaccaggagaccccaggcccccgggaggccctgagccggctgcaggagctgtgctaccagtggctgatgcctgagctgcacaccaaggagcagatcctggagctgctggtgctggagcagttcctgagcatcctgcctgaggagctgcagatctgggtgcagcagcacaaccctgagagcggggaggaggccgtgaccctgctggaggacctggagcgggagtttgatgatcctggccagcaggtgcctgccagcccccagggccctgctgtgccctggaaggacctgacctgcctgcgggccagccaggagagcacagacatccacctgcagcccctgaagacccagctgaagtcctggaagccctgcctgagccccaagagtgactgtgagaacagcgagacagccaccaaggagggcatcagcgaggagaagagccagggcctgccccaggagcccagcttccggggcatcaagctgagccggccccccaaggccagcagcgccatccgctgggagtgtgtgtccccaggcagcttccctggggacatcatcgctgctgaggccacccacagcaccatcagctgctttgccatcaacaccctgcctgccaccatcctgcccagcaagaatgtgaacaggaagtacttctcctag

SEQ ID NO: 176833 - DNA, 1605 bp, Artificial Sequence
  Description of Artificial Sequence: Synthetic coding sequence
atggctgtggagagcggggtcatcagcaccctcatcccccaggaccccccagagcaggagctgatcctggtgaaggtggaggacaacttctcctgggatgagaagttcaagcagaatggcagcacccagagctgccaggagctgttccggcagcagttcaggaagttctgctaccaggagaccccaggcccccgggaggccctgagccggctgcaggagctgtgctaccagtggctgatgcctgagctgcacaccaaggagcagatcctggagctgctggtgctggagcagttcctgagcatcctgcctgaggagctgcagatctgggtgcagcagcacaaccctgagagcggggaggaggccgtgaccctgctggaggacctggagcgggagtttgatgatcctggccagcaggtgcctgccagcccccagggccctgctgtgccctggaaggacctgacctgcctgcgggccagccaggagagcacagacatccacctgcagcccctgaagacccagctgaagtcctggaagccctgcctgagccccaagagtgactgtgagaacagcgagacagccaccaaggagggcatcagcgaggagaagagccagggcctgccccaggagcccagcttccggggcatcagcgagcacgagagcaacctggtgtggaagcagggcagcgccaccggggagaagctgcggagccccagccagggcggcagcttcagccaggtgatcttcaccaacaagagcctgggcaagagggacctgtatgatgaggccgagcgctgcctgatcctgaccacagacagcatcatgtgccagaaggtgcccccagaggagcggccctaccgctgtgatgtgtgtggccacagcttcaagcagcacagcagcctgacccagcaccagaggatccacactggagagaagccctacaagtgcaaccagtgtgggaaggccttcagcctgcggagctacctgatcatccaccagaggatccacagcggggagaaggcctatgagtgcagtgaatgtgggaaggccttcaaccagagcagcgccctgatccgccacaggaagatccacactggagagaaggcctgcaagtgcaatgaatgtgggaaggccttcagccagagcagctacctgatcatccaccagaggatccacactggagagaagccctatgagtgcaatgaatgtgggaagaccttcagccagagcagcaagctgatccgccaccagaggatccacactggagagcggccctatgagtgcaatgaatgtgggaaggccttccggcagagcagcgagctgatcacccaccagaggatccacagcggggagaagccctatgagtgcagtgaatgtgggaaggccttcagcctgagcagcaacctgatccgccaccagaggatccacagcggggaggagccctaccagtgcaatgaatgtgggaagaccttcaagaggagcagcgccctggtgcagcaccagaggatccacagcggagatgaggcctacatctgcaatgaatgtgggaaggccttccgccacaggtctgtgctgatgaggcaccagagggtgcacaccatcaagtag

SEQ ID NO: 176834 - DNA, 738 bp, Artificial Sequence
  Description of Artificial Sequence: Synthetic coding sequence
atggctgtggagagcggggtcatcagcaccctcatcccccaggaccccccagagcaggagctgatcctggtgaaggtggaggacaacttctcctgggatgagaagttcaagcagaatggcagcacccagagctgccaggagctgttccggcagcagttcaggaagttctgctaccaggagaccccaggcccccgggaggccctgagccggctgcaggagctgtgctaccagtggctgatgcctgagctgcacaccaaggagcagatcctggagctgctggtgctggagcagttcctgagcatcctgcctgaggagctgcagatctgggtgcagcagcacaaccctgagagcggggaggaggccgtgaccctgctggaggacctggagcgggagtttgatgatcctggccagcaggtgcctgccagcccccagggccctgctgtgccctggaaggacctgacctgcctgcgggccagccaggagagcacagacatccacctgcagcccctgaagacccagctgaagtcctggaagccctgcctgagccccaagtctgagctgagccggccccccaaggccagcagcgccatccgctgggagtgtgtgtccccaggcagcttccctggggacatcatcgctgctgaggccacccacagcaccatcagctgctttgccatcaacaccctgcctgccaccatcctgcccagcaagaatgtgaacaggaagtacttctcctag

SEQ ID NO: 176835 - DNA, 2340 bp, Artificial Sequence
  Description of Artificial Sequence: Synthetic coding sequence
atggccgccaacggggacagccccccctggagccctgccctggccgctgagggccggggcagcagctgtgaggcctctgtgtcctttgaagatgtgacagtggacttcagcaaggaggagtggcagcacctggaccctgcccagaggcggctgtactgggatgtgaccctggagaactacagccacctgctgtctgtgggctaccagatccccaagtctgaggccgccttcaagctggagcagggcgagggcccctggatgctggagggggaggccccccaccagagctgcagcggggaggccatcggcaagatgcagcagcagggcatccctgggggcatcttcttccactgtgaaagatttgaccagcccatcggggaggacagcctgtgcagcatcctggaggagctgtggcaggacaatgaccagctggagcagaggcaggagaaccagaacaacctgctgagccacgtgaaggtgctgatcaaggagcggggctatgagcacaagaacatcgagaagatcatccacgtgaccaccaagctggtgcccagcatcaagaggctgcacaactgtgacaccatcctgaagcacaccctgaacagccacaaccacaacagaaattctgccaccaagaacctgggcaagatctttggaaatggaaacaacttcccccacagccccagcagcaccaagaatgaaaatgccaagacaggagccaacagctgtgaacatgaccactatgagaagcacctgagccacaagcaggcccccacccaccaccagaagatccaccctgaggagaagctgtatgtgtgcacagaatgtgtgatgggcttcacccagaagagccacctgtttgagcaccagagaattcatgctggggagaagagccgggagtgtgacaagagcaacaaggtgttcccccagaagccccaggtggatgtgcaccccagcgtgtacaccggggagaagccctacctgtgcacccagtgtgggaaggtgttcaccctgaagagcaacctgatcacccaccagaagatccacacaggccagaagccctacaagtgcagtgaatgtgggaaggccttcttccagaggagtgacctcttccgccacctgcgcatccacactggagagaagccctatgagtgcagtgaatgtgggaagggcttcagccagaacagcgacctgagcatccaccagaagacccacactggagagaagcactatgagtgcaatgaatgtgggaaggccttcaccaggaagagcgccctgaggatgcaccagaggatccacactggagagaagccctacgtgtgtgccgactgtgggaaggccttcatccagaagagccacttcaacacccaccagaggatccacactggagagaagccctatgagtgcagcgactgtgggaagagcttcaccaagaagagccagctgcacgtgcaccagaggatccacactggagagaagccctacatctgcacagaatgtgggaaggtgttcacccacaggaccaacctgaccacccaccagaagacccacactggagagaagccctacatgtgtgctgaatgtgggaaggccttcacagaccagagcaacctgatcaagcaccagaagacccacactggagagaagccctacaagtgcaatggctgtgggaaggccttcatctggaagagccggctgaagatccaccagaagagccacatcggggagcggcactatgagtgcaaggactgtgggaaggccttcatccagaagagcaccctgtctgtgcaccagaggatccacactggagagaagccctacgtgtgcccagaatgtgggaaggccttcatccagaagagccacttcatcgcccaccaccgcatccacactggagagaagccctatgagtgcagcgactgtgggaagtgcttcaccaagaagagccagctgcgggtgcaccagaagatccacactggagagaagcccaacatctgtgctgaatgtgggaaggccttcacagacaggagcaacctgatcacccaccagaagatccacacccgggagaagccctatgaatgtggggactgtgggaagaccttcacctggaagagccggctgaacatccaccagaagagccacactggagagcggcactatgagtgcagcaaatgtgggaaggccttcatccagaaggccaccctgtccatgcaccagatcatccacacaggcaagaagccctatgcctgcacagagtgccagaaggccttcacagacaggagcaacctgatcaagcaccagaagatgcacagcggggagaagcgctacaaggccagtgactag

SEQ ID NO: 176836 - DNA, 2340 bp, Artificial Sequence; identical to SEQ ID NO: 176835
  Description of Artificial Sequence: Synthetic coding sequence

SEQ ID NO: 176837 - DNA, 2370 bp, Artificial Sequence
  Description of Artificial Sequence: Synthetic coding sequence
atgggcaccctgccccacggcccccggccctggctgcagagagatgtggccgcccacgtgtctgctgaccatgctgccctgaacagcatcgtgtccctgcaggcctctgtgtcctttgaagatgtgacagtggacttcagcaaggaggagtggcagcacctggaccctgcccagaggcggctgtactgggatgtgaccctggagaactacagccacctgctgtctgtgggctaccagatccccaagtctgaggccgccttcaagctggagcagggcgagggcccctggatgctggagggggaggccccccaccagagctgcagcggggaggccatcggcaagatgcagcagcagggcatccctgggggcatcttcttccactgtgaaagatttgaccagcccatcggggaggacagcctgtgcagcatcctggaggagctgtggcaggacaatgaccagctggagcagaggcaggagaaccagaacaacctgctgagccacgtgaaggtgctgatcaaggagcggggctatgagcacaagaacatcgagaagatcatccacgtgaccaccaagctggtgcccagcatcaagaggctgcacaactgtgacaccatcctgaagcacaccctgaacagccacaaccacaacagaaattctgccaccaagaacctgggcaagatctttggaaatggaaacaacttcccccacagccccagcagcaccaagaatgaaaatgccaagacaggagccaacagctgtgaacatgaccactatgagaagcacctgagccacaagcaggcccccacccaccaccagaagatccaccctgaggagaagctgtatgtgtgcacagaatgtgtgatgggcttcacccagaagagccacctgtttgagcaccagagaattcatgctggggagaagagccgggagtgtgacaagagcaacaaggtgttcccccagaagccccaggtggatgtgcaccccagcgtgtacaccggggagaagccctacctgtgcacccagtgtgggaaggtgttcaccctgaagagcaacctgatcacccaccagaagatccacacaggccagaagccctacaagtgcagtgaatgtgggaaggccttcttccagaggagtgacctcttccgccacctgcgcatccacactggagagaagccctatgagtgcagtgaatgtgggaagggcttcagccagaacagcgacctgagcatccaccagaagacccacactggagagaagcactatgagtgcaatgaatgtgggaaggccttcaccaggaagagcgccctgaggatgcaccagaggatccacactggagagaagccctacgtgtgtgccgactgtgggaaggccttcatccagaagagccacttcaacacccaccagaggatccacactggagagaagccctatgagtgcagcgactgtgggaagagcttcaccaagaagagccagctgcacgtgcaccagaggatccacactggagagaagccctacatctgcacagaatgtgggaaggtgttcacccacaggaccaacctgaccacccaccagaagacccacactggagagaagccctacatgtgtgctgaatgtgggaaggccttcacagaccagagcaacctgatcaagcaccagaagacccacactggagagaagccctacaagtgcaatggctgtgggaaggccttcatctggaagagccggctgaagatccaccagaagagccacatcggggagcggcactatgagtgcaaggactgtgggaaggccttcatccagaagagcaccctgtctgtgcaccagaggatccacactggagagaagccctacgtgtgcccagaatgtgggaaggccttcatccagaagagccacttcatcgcccaccaccgcatccacactggagagaagccctatgagtgcagcgactgtgggaagtgcttcaccaagaagagccagctgcgggtgcaccagaagatccacactggagagaagcccaacatctgtgctgaatgtgggaaggccttcacagacaggagcaacctgatcacccaccagaagatccacacccgggagaagccctatgaatgtggggactgtgggaagaccttcacctggaagagccggctgaacatccaccagaagagccacactggagagcggcactatgagtgcagcaaatgtgggaaggccttcatccagaaggccaccctgtccatgcaccagatcatccacacaggcaagaagccctatgcctgcacagagtgccagaaggccttcacagacaggagcaacctgatcaagcaccagaagatgcacagcggggagaagcgctacaaggccagtgactag

SEQ ID NO: 176838 - DNA, 537 bp, Artificial Sequence
  Description of Artificial Sequence: Synthetic coding sequence
atgggcaccctgccccacggcccccggccctggctgcagagagatgtggccgcccacgtgtctgctgaccatgctgccctgaacagcatcgtgtccctgcaggcctctgtgtcctttgaagatgtgacagtggacttcagcaaggaggagtggcagcacctggaccctgcccagaggcggctgtactgggatgtgaccctggagaactacagccacctgctgtctgtgggctaccagatccccaagtctgaggccgccttcaagctggagcagggcgagggcccctggatgctggagggggaggccccccaccagagctgcagcggggaggccatcggcaagatgcagcagcagggcatccctgggggcatcttcttccactgtgaaagatttgaccagcccatcggggaggacagcctgtgcagcatcctggaggagctgtggcaggacaatgaccagctggagcagaggcaggagaaccagaacaacctgctgagccacgtgaaggtgctgatcaaggagcggggctatgaatag

SEQ ID NO: 176839 - DNA, 3855 bp, Artificial Sequence
  Description of Artificial Sequence: Synthetic coding sequence
atgcacaagaagagggtggaggagggggaggccagtgacttcagcctggcctgggacagctctgtgacagctgctgggggcctggagggggagccagaatgtgaccagaagaccagccgggccctggaggacagaaattctgtgaccagccaggaggagagaaatgaagatgatgaggacatggaggatgagagcatctacacctgtgaccactgccagcaggactttgagagcctggccgacctgacagaccaccgggcccaccgctgccctggagatggagatgatgacccccagctgtcctgggtggccagcagccccagcagcaaggatgtggccagccccacccagatgattggagatggctgtgacctgggcctgggggaggaggagggcggcaccggcctgccctacccctgccagttctgtgacaagagcttcatccggctgagctacctgaagagacatgagcagatccacagcgacaagctgcccttcaagtgcacctactgcagccgcctcttcaagcacaagaggagccgggacagacacatcaagctgcacactggagacaagaagtaccactgccatgaatgtgaggccgccttcagcagaagtgaccacctgaagatccacctgaagacccacagcagcagcaagcccttcaagtgcaccgtgtgcaagaggggcttcagcagcaccagcagcctgcagagccacatgcaggcccacaagaagaacaaggagcacctggccaagtctgagaaggaggccaagaaggatgacttcatgtgtgactactgtgaggacaccttcagccagacagaggagctggagaagcacgtgctgaccaggcacccccagctgtctgagaaggctgacctgcagtgcatccactgcccagaggtgtttgtggatgagaacaccctgctggcccacatccaccaggcccacgccaaccagaagcacaagtgccccatgtgcccagagcagttcagctctgtggagggcgtgtactgccacctggacagccaccggcagcctgacagcagcaaccacagcgtgtccccagaccctgtgctgggctctgtggcctccatgagcagcgccaccccagacagcagcgcctctgtggagcggggcagcaccccagacagcaccctgaagcccctgcggggccagaagaagatgagagatgatggccagggctggaccaaggtggtgtacagctgcccctactgcagcaagagggacttcaacagcctggccgtgctggagatccacctgaagaccatccacgccgacaagccccagcagagccacacctgccagatctgcctggacagcatgcccaccctgtacaacctgaatgaacatgtgaggaagctgcacaagaaccacgcctaccctgtgatgcagtttggaaacatcagcgccttccactgcaactactgcccagagatgtttgctgacatcaacagcctgcaggagcacatccgggtgagccactgcggccccaatgccaaccccagtgatggcaacaatgccttcttctgcaaccagtgcagcatgggcttcctgacagagagcagcctgacagagcacatccagcaggcccactgcagcgtgggcagcgccaagctggagagccctgtggtgcagcccacccagagcttcatggaggtgtacagctgcccctactgcaccaacagccccatcttcggcagcatcctgaagctgaccaagcacatcaaggagaaccacaagaacatccccctggcccacagcaagaagagcaaggccgagcagagccctgtgtccagtgatgtggaggtgagcagccccaagaggcagaggctgagcgccagcgccaacagcatcagcaatggagagtacccctgcaaccagtgtgacctgaagttcagcaactttgagagcttccagacccacctgaagctgcacctggagctgctgctgaggaagcaggcctgcccccagtgcaaggaggactttgacagccaggagagcctgctgcagcacctgactgtgcactacatgaccaccagcacccactacgtgtgtgagagctgtgacaagcagttcagctctgtggatgacctgcagaagcacctgctggacatgcacacctttgtgctgtaccactgcaccctgtgccaggaggtgtttgacagcaaggtgtccatccaggtgcacctggccgtgaagcacagcaatgagaagaagatgtaccgctgcacagcctgcaactgggacttcaggaaggaggccgacctgcaggtgcacgtgaagcacagccacctgggcaacccagccaaggcccacaagtgcatcttctgtggggagaccttcagcacagaggtggagctgcagtgccacatcaccacccacagcaagaagtacaactgcaagttctgcagcaaggccttccacgccatcatcctgctggagaagcacctgcgggagaagcactgtgtgtttgatgctgccacagaaaatggaacagccaatggagtgccccccatggccaccaagaaggccgagcctgctgacctgcagggcatgctgctgaagaaccctgaggcccccaacagccatgaggcctctgaagatgatgtggatgccagcgagcccatgtatggctgtgacatctgtggggccgcctacaccatggaggtgctgctgcagaaccaccggctgcgggaccacaacatccggcctggagaagatgatggcagcaggaagaaggccgagttcatcaagggcagccacaagtgcaatgtgtgcagcaggaccttcttctctgaaaatggcctgcgggagcacctgcagacccaccggggccctgccaagcactacatgtgccccatctgtggggagcgcttccccagcctgctgaccctgacagagcacaaggtgacccacagcaagagcctggacaccggcacctgccgcatctgcaagatgcccctgcagagcgaggaggagttcatcgagcactgccagatgcacccagacctgaggaacagcctgaccggcttccgctgtgtggtgtgcatgcagacagtgaccagcaccctggagctgaagatccacggcaccttccacatgcagaagctggccggcagcagcgctgccagcagccccaacggccagggcctgcagaagctgtacaagtgtgccctgtgcctgaaggagttccgcagcaagcaggacctggtgaagctggatgtgaatggcctgccctacggcctgtgtgccggctgcatggcccggagcgccaacggccaggtgggcggcctggcccctcctgagcctgctgaccggccctgtgccggcctgcgctgcccagagtgcagcgtgaagtttgaatctgctgaggacctggagagccacatgcaggtggaccaccgggacctgaccccagagaccagcggccccaggaagggcacccagaccagccctgtgcccaggaagaagacctaccagtgcatcaagtgccagatgacctttgaaaatgaaagagagatccagatccacgtggccaaccacatgattgaggagggcatcaaccacgagtgcaagctgtgcaaccagatgtttgacagccctgccaagctgctgtgccacctgattgagcacagctttgagggcatgggcggcaccttcaagtgccctgtgtgcttcaccgtgtttgtgcaggccaacaagctgcagcagcacatctttgctgtgcacggccaggaggacaagatctatgactgcagccagtgcccccagaagttcttcttccagacagagctgcagaaccacaccatgagccagcacgcccagtag

SEQ ID NO: 176840 - DNA, 3504 bp, Artificial Sequence
  Description of Artificial Sequence: Synthetic coding sequence
atgattggagatggctgtgacctgggcctgggggaggaggagggcggcaccggcctgccctacccctgccagttctgtgacaagagcttcatccggctgagctacctgaagagacatgagcagatccacagcgacaagctgcccttcaagtgcacctactgcagccgcctcttcaagcacaagaggagccgggacagacacatcaagctgcacactggagacaagaagtaccactgccatgaatgtgaggccgccttcagcagaagtgaccacctgaagatccacctgaagacccacagcagcagcaagcccttcaagtgcaccgtgtgcaagaggggcttcagcagcaccagcagcctgcagagccacatgcaggcccacaagaagaacaaggagcacctggccaagtctgagaaggaggccaagaaggatgacttcatgtgtgactactgtgaggacaccttcagccagacagaggagctggagaagcacgtgctgaccaggcacccccagctgtctgagaaggctgacctgcagtgcatccactgcccagaggtgtttgtggatgagaacaccctgctggcccacatccaccaggcccacgccaaccagaagcacaagtgccccatgtgcccagagcagttcagctctgtggagggcgtgtactgccacctggacagccaccggcagcctgacagcagcaaccacagcgtgtccccagaccctgtgctgggctctgtggcctccatgagcagcgccaccccagacagcagcgcctctgtggagcggggcagcaccccagacagcaccctgaagcccctgcggggccagaagaagatgagagatgatggccagggctggaccaaggtggtgtacagctgcccctactgcagcaagagggacttcaacagcctggccgtgctggagatccacctgaagaccatccatgctgacaagccccagcagagccacacctgccagatctgcctggacagcatgcccaccctgtacaacctgaatgagcacgtgaggaagctgcacaagaaccacgcctaccctgtgatgcagtttggaaacatcagcgccttccactgcaactactgcccagagatgtttgctgacatcaacagcctgcaggagcacatccgggtgagccactgcggccccaatgccaaccccagtgatggcaacaatgccttcttctgcaaccagtgcagcatgggcttcctgacagagagcagcctgacagagcacatccagcaggcccactgcagcgtgggcagcgccaagctggagagccctgtggtgcagcccacccagagcttcatggaggtgtacagctgcccctactgcaccaacagccccatcttcggcagcatcctgaagctgaccaagcacatcaaggagaaccacaagaacatccccctggcccacagcaagaagagcaaggccgagcagagccctgtgtccagtgatgtggaggtgagcagccccaagaggcagaggctgagcgccagcgccaacagcatcagcaatggagagtacccctgcaaccagtgtgacctgaagttcagcaactttgagagcttccagacccacctgaagctgcacctggagctgctgctgaggaagcaggcctgcccccagtgcaaggaggactttgacagccaggagagcctgctgcagcacctgactgtgcactacatgaccaccagcacccactacgtgtgtgagagctgtgacaagcagttcagctctgtggatgacctgcagaagcacctgctggacatgcacacctttgtgctgtaccactgcaccctgtgccaggaggtgtttgacagcaaggtgtccatccaggtgcacctggccgtgaagcacagcaatgagaagaagatgtaccgctgcacagcctgcaactgggacttcaggaaggaggccgacctgcaggtgcacgtgaagcacagccacctgggcaacccagccaaggcccacaagtgcatcttctgtggggagaccttcagcacagaggtggagctgcagtgccacatcaccacccacagcaagaagtacaactgcaagttctgcagcaaggccttccacgccatcatcctgctggagaagcacctgcgggagaagcactgtgtgtttgatgctgccacagaaaatggaacagccaacggggtgccccccatggccaccaagaaggccgagcctgctgacctgcagggcatgctgctgaagaaccctgaggcccccaacagccatgaggcctctgaagatgatgtggatgccagcgagcccatgtatggctgtgacatctgtggggccgcctacaccatggaggtgctgctgcagaaccaccggctgcgggaccacaacatccggcctggagaagatgatggcagcaggaagaaggccgagttcatcaagggcagccacaagtgcaatgtgtgcagcaggaccttcttctctgaaaatggcctgcgggagcacctgcagacccaccggggccctgccaagcactacatgtgccccatctgtggggagcgcttccccagcctgctgaccctgacagagcacaaggtgacccacagcaagagcctggacaccggcacctgccgcatctgcaagatgcccctgcagagcgaggaggagttcatcgagcactgccagatgcacccagacctgaggaacagcctgaccggcttccgctgtgtggtgtgcatgcagacagtgaccagcaccctggagctgaagatccacggcaccttccacatgcagaagctggccggcagcagcgctgccagcagccccaacggccagggcctgcagaagctgtacaagtgtgccctgtgcctgaaggagttccgcagcaagcaggacctggtgaagctggatgtgaatggcctgccctacggcctgtgtgccggctgcatggcccggagcgccaacggccaggtgggcggcctggcccctcctgagcctgctgaccggccctgtgccggcctgcgctgcccagaatgttctgtgaagtttgagagcgctgaggacctggagagccacatgcaggtggaccaccgggacctgaccccagagaccagcggccccaggaagggcacccagaccagccctgtgcccaggaagaagacctaccagtgcatcaagtgccagatgacctttgaaaatgaaagagagatccagatccacgtggccaaccacatgattgaggagggcatcaaccacgagtgcaagctgtgcaaccagatgtttgacagccctgccaagctgctgtgccacctgattgagcacagctttgagggcatgggcggcaccttcaagtgccctgtgtgcttcaccgtgtttgtgcaggccaacaagctgcagcagcacatctttgctgtgcacggccaggaggacaagatctatgactgcagccagtgcccccagaagttcttcttccagacagagctgcagaaccacaccatgagccagcacgcccagtag

SEQ ID NO: 176841 - DNA, 3855 bp, Artificial Sequence; identical to SEQ ID NO: 176839
  Description of Artificial Sequence: Synthetic coding sequence

SEQ ID NO: 176842 - DNA, 2430 bp, Artificial Sequence
  Description of Artificial Sequence: Synthetic coding sequence
atgggccccctgaccttcatggatgtggccatcgagttctgcctggaggagtggcagtgcctggacatcgcccagcagaacctgtacagaaatgtgatgctggagaactacagaaacctggtgttcctgggcattgctgtgtccaagccagacctgatcacctgcctggagcaggagaaggagccctgggagcccatgagaagacatgagatggtggccaagccccctgtgatgtgcagccacttcacccaggacttctggccagagcagcacatcaaggaccccttccagaaggccaccctgcggcgctacaagaactgtgagcacaagaatgtgcacctgaagaaggaccacaagtctgtggatgagtgcaaggtgcacagaggaggctacaacggcttcaaccagtgcctgcctgccacccagagcaagatcttcctgtttgacaagtgtgtgaaggccttccacaagttcagcaacagcaacagacacaagatcagccacacagagaagaagctgttcaagtgcaaggaatgtgggaagagcttctgcatgctgccccacctggcccagcacaagatcatccacaccagggtgaacttctgcaagtgtgagaagtgtgggaaggccttcaactgccccagcatcatcaccaagcacaagaggatcaacacaggagagaagccctacacctgtgaggagtgtgggaaggtgttcaactggagcagccggctgaccacccacaagaagaactacacccgctacaagctgtacaagtgtgaggagtgtgggaaggccttcaacaagagcagcatcctgaccacccacaagatcatcagaactggagagaagttctacaagtgcaaggaatgtgccaaggccttcaaccagagcagcaacctgacagagcacaagaagatccaccctggagagaagccctacaagtgtgaggagtgtgggaaggccttcaactggcccagcaccctgaccaagcacaagaggatccacactggagagaagccctacacctgtgaggagtgtgggaaggccttcaaccagttcagcaacctgaccacccacaagaggatccacacagctgagaagttctacaagtgcacagaatgtggggaggccttcagccgcagcagcaacctgaccaagcacaagaagatccacacagagaagaagccctacaagtgtgaggagtgtgggaaggccttcaagtggagcagcaagctgacagagcacaagctgacccacactggagagaagccctacaagtgtgaggagtgtgggaaggccttcaactggcccagcaccctgaccaagcacaaccgcatccacactggagagaagccctacaagtgtgaggtgtgtgggaaggccttcaaccagttcagcaacctgaccacccacaagaggatccacacagctgagaagccctacaagtgtgaggagtgtgggaaggccttcagccgcagcagcaacctgaccaagcacaagaagatccacatcgagaagaagccctacaagtgtgaggagtgtgggaaggccttcaagtggagcagcaagctgacagagcacaagatcacccacactggagagaagccctacaagtgtgaggagtgtgggaaggccttcaaccacttcagcatcctgaccaagcacaagaggatccacactggagagaagccctacaagtgtgaggagtgtgggaaggccttcacccagagcagcaacctgaccacccacaagaagatccacactggagagaagttctacaagtgtgaggagtgtgggaaggccttcacccagagcagcaacctgaccacccacaagaagatccacactggaggcaagccctacaagtgtgaggagtgtgggaaggccttcaaccagttcagcaccctgaccaagcacaagatcatccacacagaggagaagccctacaagtgtgaggagtgtgggaaggccttcaagtggagcagcaccctgaccaagcacaagatcatccacactggagagaagccctacaagtgtgaggagtgtgggaaggccttcaagctgagcagcaccctgagcacccacaagatcatccacactggagagaagccctacaagtgtgagaagtgtgggaaggccttcaacagaagcagcaacctgattgagcacaagaagatccacactggagagcagccctacaagtgtgaggagtgtgggaaggccttcaactacagcagccacctgaacacccacaagaggatccacaccaaggagcagccctacaagtgcaaggaatgtgggaaggccttcaaccagtacagcaacctgaccacccacaacaagatccacactggagagaagctgtacaagccagaagatgtgaccgtcatcctgaccaccccccagaccttcagcaacatcaagtag

SEQ ID NO: 176843 - DNA, 2427 bp, Artificial Sequence
  Description of Artificial Sequence: Synthetic coding sequence
ggccccctgaccttcatggatgtggccatcgagttctgcctggaggagtggcagtgcctggacatcgcccagcagaacctgtacagaaatgtgatgctggagaactacagaaacctggtgttcctgggcattgctgtgtccaagccagacctgatcacctgcctggagcaggagaaggagccctgggagcccatgagaagacatgagatggtggccaagccccctgtgatgtgcagccacttcacccaggacttctggccagagcagcacatcaaggaccccttccagaaggccaccctgcggcgctacaagaactgtgagcacaagaatgtgcacctgaagaaggaccacaagtctgtggatgagtgcaaggtgcaccggggcggctacaacggcttcaaccagtgcctgcctgccacccagagcaagatcttcctgtttgataaatgtgtgaaggccttccacaagttcagcaacagcaacagacacaagatcagccacacagagaagaagctgttcaagtgcaaggaatgtgggaagagcttctgcatgctgccccacctggcccagcacaagatcatccacaccagggtgaacttctgcaagtgtgagaagtgtgggaaggccttcaactgccccagcatcatcaccaagcacaagaggatcaacacaggagagaagccctacacctgtgaagaatgtgggaaggtgttcaactggagcagccggctgaccacccacaagaagaactacacccgctacaagctgtacaagtgtgaagaatgtgggaaggccttcaacaagagcagcatcctgaccacccacaagatcatcagaactggagagaagttctacaagtgcaaggaatgtgccaaggccttcaaccagagcagcaacctgacagagcacaagaagatccaccctggagagaagccctacaagtgtgaagaatgtgggaaggccttcaactggcccagcaccctgaccaagcacaagaggatccacactggagagaagccctacacctgtgaagaatgtgggaaggccttcaaccagttcagcaacctgaccacccacaagaggatccacacagctgagaagttctacaagtgcacagaatgtggggaggccttcagccgcagcagcaacctgaccaagcacaagaagatccacacagagaagaagccctacaagtgtgaagaatgtgggaaggccttcaagtggagcagcaagctgacagagcacaagctgacccacactggagagaagccctacaagtgtgaagaatgtgggaaggccttcaactggcccagcaccctgaccaagcacaaccgcatccacactggagagaagccctacaagtgtgaggtgtgtgggaaggccttcaaccagttcagcaacctgaccacccacaagaggatccacacagctgagaagccctacaagtgtgaagaatgtgggaaggccttcagccgcagcagcaacctgaccaagcacaagaagatccacatcgagaagaagccctacaagtgtgaagaatgtgggaaggccttcaagtggagcagcaagctgacagagcacaagatcacccacactggagagaagccctacaagtgtgaagaatgtgggaaggccttcaaccacttcagcatcctgaccaagcacaagaggatccacactggagagaagccctacaagtgtgaagaatgtgggaaggccttcacccagagcagcaacctgaccacccacaagaagatccacactggagagaagttctacaagtgtgaagaatgtgggaaggccttcacccagagcagcaacctgaccacccacaagaagatccacactggaggcaagccctacaagtgtgaagaatgtgggaaggccttcaaccagttcagcaccctgaccaagcacaagatcatccacacagaggagaagccctacaagtgtgaagaatgtgggaaggccttcaagtggagcagcaccctgaccaagcacaagatcatccacactggagagaagccctacaagtgtgaagaatgtgggaaggccttcaagctgagcagcaccctgagcacccacaagatcatccacactggagagaagccctacaagtgtgagaagtgtgggaaggccttcaacagaagcagcaacctgattgagcacaagaagatccacactggagagcagccctacaagtgtgaagaatgtgggaaggccttcaactacagcagccacctgaacacccacaagaggatccacaccaaggagcagccctacaagtgcaaggaatgtgggaaggccttcaaccagtacagcaacctgaccacccacaacaagatccacactggagagaagctgtacaagccagaagatgtgaccgtcatcctgaccaccccccagaccttcagcaacatcaagtag

SEQ ID NO: 176844 - DNA, 2412 bp, Artificial Sequence
  Description of Artificial Sequence: Synthetic coding sequence
atggatgtggccatcgagttctgcctggaggagtggcagtgcctggacatcgcccagcagaacctgtacagaaatgtgatgctggagaactacagaaacctggtgttcctgggcattgctgtgtccaagccagacctgatcacctgcctggagcaggagaaggagccctgggagcccatgagaagacatgagatggtggccaagccccctgtgatgtgcagccacttcacccaggacttctggccagagcagcacatcaaggaccccttccagaaggccaccctgcggcgctacaagaactgtgagcacaagaatgtgcacctgaagaaggaccacaagtctgtggatgagtgcaaggtgcacagaggaggctacaacggcttcaaccagtgcctgcctgccacccagagcaagatcttcctgtttgacaagtgtgtgaaggccttccacaagttcagcaacagcaacagacacaagatcagccacacagagaagaagctgttcaagtgcaaggaatgtgggaagagcttctgcatgctgccccacctggcccagcacaagatcatccacaccagggtgaacttctgcaagtgtgagaagtgtgggaaggccttcaactgccccagcatcatcaccaagcacaagaggatcaacacaggagagaagccctacacctgtgaggagtgtgggaaggtgttcaactggagcagccggctgaccacccacaagaagaactacacccgctacaagctgtacaagtgtgaggagtgtgggaaggccttcaacaagagcagcatcctgaccacccacaagatcatcagaactggagagaagttctacaagtgcaaggaatgtgccaaggccttcaaccagagcagcaacctgacagagcacaagaagatccaccctggagagaagccctacaagtgtgaggagtgtgggaaggccttcaactggcccagcaccctgaccaagcacaagaggatccacactggagagaagccctacacctgtgaggagtgtgggaaggccttcaaccagttcagcaacctgaccacccacaagaggatccacacagctgagaagttctacaagtgcacagaatgtggggaggccttcagccgcagcagcaacctgaccaagcacaagaagatccacacagagaagaagccctacaagtgtgaggagtgtgggaaggccttcaagtggagcagcaagctgacagagcacaagctgacccacactggagagaagccctacaagtgtgaggagtgtgggaaggccttcaactggcccagcaccctgaccaagcacaaccgcatccacactggagagaagccctacaagtgtgaggtgtgtgggaaggccttcaaccagttcagcaacctgaccacccacaagaggatccacacagctgagaagccctacaagtgtgaggagtgtgggaaggccttcagccgcagcagcaacctgaccaagcacaagaagatccacatcgagaagaagccctacaagtgtgaggagtgtgggaaggccttcaagtggagcagcaagctgacagagcacaagatcacccacactggagagaagccctacaagtgtgaggagtgtgggaaggccttcaaccacttcagcatcctgaccaagcacaagaggatccacactggagagaagccctacaagtgtgaggagtgtgggaaggccttcacccagagcagcaacctgaccacccacaagaagatccacactggagagaagttctacaagtgtgaggagtgtgggaaggccttcacccagagcagcaacctgaccacccacaagaagatccacactggaggcaagccctacaagtgtgaggagtgtgggaaggccttcaaccagttcagcaccctgaccaagcacaagatcatccacacagaggagaagccctacaagtgtgaggagtgtgggaaggccttcaagtggagcagcaccctgaccaagcacaagatcatccacactggagagaagccctacaagtgtgaggagtgtgggaaggccttcaagctgagcagcaccctgagcacccacaagatcatccacactggagagaagccctacaagtgtgagaagtgtgggaaggccttcaacagaagcagcaacctgattgagcacaagaagatccacactggagagcagccctacaagtgtgaggagtgtgggaaggccttcaactacagcagccacctgaacacccacaagaggatccacaccaaggagcagccctacaagtgcaaggaatgtgggaaggccttcaaccagtacagcaacctgaccacccacaacaagatccacactggagagaagctgtacaagccagaagatgtgaccgtcatcctgaccaccccccagaccttcagcaacatcaagtag

SEQ ID NO: 176845 - DNA, 1713 bp, Artificial Sequence
  Description of Artificial Sequence: Synthetic coding sequence
atggagaacctgaagagcggcgtgtaccccctgaaggaggccagcggctgccctggagctgacaggaacctgctggtgtacagcttctatgagaagggccccctgaccttcagagatgtggccatcgagttcagcctggaggagtggcagtgcctggacacagcccagcaggacctgtacaggaaggtgatgctggagaactacagaaacctggtgttcctggccggcattgctgtgtccaagccagacctgatcacctgcctggagcagggcaaggagccctggaacatgaagagacatgccatggtggaccagccccctgtgacctacagccactttgcccaggacctgtggccagagcagggcatcaaggacagcttccaggaggtgatcctgcggcgctatggaaaatgtggccacgaggacctgcagctgaggacaggctgcaagtctgtggatgagtgcaacctgcacaaggagtgctatgatgagctgaaccagtgcctgaccaccacccagagcgagatcttccagtatgacaagtatgtgaatgtgttctacaagttcagcaaccccaacatccagaagatccgccacacaggcaagaagcccttcaagtgcaagaagtgtgacaagagcttctgcatgctgctgcacctgacccagcacaagaggatccacatccgggagaacagctaccagtgtgaagaatgtgggaaggtgttcaactggttcagcaccctgaccaggcaccggcgcatccacactggagagaagccctacaagtgtgagcagtgtgggaaggccttcaagcagagcagcaccctgaccacccacaagatcatccacactggagagaagccctaccgctgtgaagaatgtgggaagaccttcaacagaagcagccacctgaccacccacaagaggatccacactggagagaagccctaccgctgtgaagaatgtggccgggccttcaacagaagcagccacctgaccacccacaagatcatccacactggagagaagccctacaagtgtgaagaatgtgggaaggccttcaaccagagcagcaccctgaccacccacaagatcatccacgccggggagaagccctacaagtgtgaagaatgtgggaaggccttctaccgcttctcctacctgaccaagcacaagatcatccacactggagagaagttctacaagtgtgaagaatgtgggaagggcttcaactggagcagcaccctgaccaagcacaagaggatccacactggagagaagccctacaagtgtgagcagtgtgggaaggccttcaatgaaagcagcaacctgacagcccacaagatcatccacactggagagaagccctacaagtgtgaagaatgtgggaaggccttcaacagaagccccaagctgacagcccacaaggtgatccacagcggggagaagccctacaagtgtgaagaatgtgggaaggccttcaaccagttcagcaacctgaccaagcacaagatcacccacatcggggacaccagctacaagtacctggagtgtgacaaggccttcagccagagcagcaccctgaccaagcacaaggtgatccacactggagagaagccctacaactgtgaggagtatggcaaggccttcaaccagagcagcaacctgattgagcagagcaacagctactggagggagaccctgcagatgtag

SEQ ID NO: 176846 - DNA, 1413 bp, Artificial Sequence
  Description of Artificial Sequence: Synthetic coding sequence
atggccgccaccctgctgatggccggcagccaggcccctgtgacctttgaggacatggccatgtacctgacccgggaggagtggaggcccctggatgctgcccagagggacctgtacagagatgtgatgcaggagaactatggaaatgtggtgtccctggactttgagatccgctcagaaaatgaggtgaaccccaagcaggagatcagtgaagatgtgcagtttggcaccaccagcgagaggcctgcagaaaatgctgaggagaaccctgagagcgaggagggctttgagagcggggacagaagtgagcggcagtggggagacctgacagctgaggagtgggtgtcctaccccctgcagcctgtgacagacctgctggtgcacaaggaggtgcacacaggcatccgctaccacatctgcagccactgcggcaaggccttcagccagatcagtgacctgaacagacaccagaagacccacactggagaccggccctacaagtgctatgaatgtgggaagggcttcagccgcagcagccacctgatccagcaccagaggacccacactggagagcggccctatgactgcaatgaatgtgggaagagctttggccgcagcagccacctgatccagcaccagaccatccacactggagagaagccccacaagtgcaatgaatgtgggaagagcttctgccgcctgagccacctgatccagcaccagaggacccacagcggggagaagccctatgaatgtgaggagtgtgggaagagcttcagccgcagcagccacctggcccagcaccagaggacccacactggagagaagccctatgaatgtaatgaatgtggccggggcttcagcgagaggagtgacctgatcaagcactacagagtgcacactggagagcggccctacaagtgtgatgaatgtgggaagaacttcagccagaacagcgacctggtgcgccacagaagagcccacactggagagaagccctaccactgcaatgaatgtggggagaacttcagccgcatcagccacctggtgcagcaccagaggacccacactggagagaagccctatgaatgtaatgcctgtgggaagagcttcagccgcagcagccacctgatcacccaccagaagatccacactggagagaagccctatgaatgtaatgaatgctggaggagctttggagagaggagtgacctgatcaagcaccagaggacccacactggagagaagccctatgaatgtgtgcagtgtgggaagggcttcacccagagcagcaacctgatcacccaccagagggtgcacactggagagaagccctatgaatgtacagaatgtgagaagagcttcagccgcagcagcgccctgatcaagcacaagagggtgcacacagactag

SEQ ID NO: 176847 - DNA, 1413 bp, Artificial Sequence; identical to SEQ ID NO: 176846
  Description of Artificial Sequence: Synthetic coding sequence

SEQ ID NO: 176848 - DNA, 909 bp, Artificial Sequence
  Description of Artificial Sequence: Synthetic coding sequence
atggccgccaccctgctgatggccggcagccaggcccctgtgacctttgaggacatggccatgtacctgacccgggaggagtggaggcccctggatgctgcccagagggacctgtacagagatgtgatgcaggagaactatggaaatgtggtgtccctggactttgagatccgctcagaaaatgaggtgaaccccaagcaggagatcagtgaagatgtgcagtttggcaccaccagcgagaggcctgcagaaaatgctgaggagaaccctgagagcgaggagggctttgagagcggggacagaagtgagcggcagtggggagacctgacagctgaggagtgggtgtcctaccccctgcagcctgtgacagacctgctggtgcacaaggaggtgcacacaggcatccgctaccacatctgcagccactgcggcaaggccttcagccagatcagtgacctgaacagacaccagaagacccacactggagaccggccctacaagtgctatgaatgtgggaagggcttcagccgcagcagccacctgatccagcaccagaggacccacactggagagcggccctatgactgcaatgaatgtgggaagagctttggccgcagcagccacctgatccagcaccagaccatccacactggagagaagccccacaagtgcaatgaatgtgggaagagcttctgccgcctgagccacctgatccagcaccagaggacccacagcggggagaagccctatgaatgtgaggagtgtgggaagagcttcagccgcagcagccacctggcccagcaccagaggacccacactggagagaagccctatgaatgtacagaatgtgagaagagcttcagccgcagcagcgccctgatcaagcacaagagggtgcacacagactag

SEQ ID NO: 176849 - DNA, 1848 bp, Artificial Sequence
  Description of Artificial Sequence: Synthetic coding sequence
atggattctgtggcctttgaagatgtggccgtgaacttcacccatgaggagtgggccctgctgggccccagccagaagaacctgtacagagatgtgatgagggagaccatccggaacctgaactgcatcggcatgaagtgggagaaccagaacattgatgaccagcaccagaacctgcggaggaacccccgctgtgatgtggtggagagatttgggaagagcaaggatggcagccagtgtggggagaccctgagccagatccggaacagcatcgtgaacaagaacaccccagcccgggtggatgcctgtggcagctctgtgaatggagaggtgatcatgggccacagcagcctgaactgctacatccgggtggacaccggccacaagcaccgggagtgccacgagtatgcagagaagagctacacccacaagcagtgtgggaagggcctgagctaccgccacagcttccagacctgtgagcggccccacacaggcaagaagccctatgactgcaaggaatgtgggaagaccttcagcagccctggcaacctgcggcggcacatggtggtgaagggaggagatggcccctacaagtgtgagctgtgtgggaaggccttcttctggcccagcctgctgaggatgcatgagaggacccacactggagagaagccctatgagtgcaagcagtgcagcaaggccttccctgtgtacagcagctacctgcggcatgagaagatccacactggagagaagccctatgagtgcaagcagtgcagcaaggccttcccagactacagcagctacctgcggcatgagaggacccacactggagagaagccctacaagtgcaagcagtgtgggaaggccttctctgtgtctggcagcctgcgggtgcatgagcgcatccacactggagagaagccctacacctgcaagcagtgtgggaaggccttctgccacctgggcagcttccagaggcacatgatcatgcacagcggagatggcccccacaagtgcaagatctgtgggaagggctttgacttccctggcagcgcccgcatccacgagggcacccacaccctggagaagccctatgagtgcaagcagtgtgggaagctgctgagccacaggagcagcttcagaagacacatgatggcccacactggagatggcccccacaagtgcaccgtgtgtgggaaggcctttgacagccccagcgtcttccagagacatgagaggacccacactggagagaagccctatgagtgcaagcagtgtgggaaggccttccgcaccagcagcagcctgaggaagcatgagaccacccacactggagagcagccctacaagtgcaagtgtgggaaggccttcagtgacctcttctccttccagagccatgagaccacccacagcgaggaggagccctatgagtgcaaggaatgtgggaaggccttcagcagcttcaagtacttctgcagacatgagaggacccacagcgaggagaagagctatgagtgccagatctgtgggaaggccttcagccgcttctcctacctgaagacccatgagaggacccacacagctgagaagccctatgagtgcaagcagtgcaggaaggccttcttctggcccagcttcctgctgcggcatgagaggacccacactggagagcggccctatgagtgcaagcactgcggcaaggccttcagccgcagcagcttctgccgggagcacgagaggacccacactggagagaagccctatgagtgcaaggaatgtgggaaggccttcagcagcctgagcagcttcaacagacacaagaggacccactggaaggacatcctgtag

SEQ ID NO: 176850 - DNA, 1992 bp, Artificial Sequence
  Description of Artificial Sequence: Synthetic coding sequence
atggccctgtgctacggcaccttctggggctaccccaagatgctggaggccgccaacctgatggagggcctggtggacatcggcccctgggtgaccctgccccggggccagcctgaggtgctggagtggggcctgcccaaggaccaggacagcgtggcctttgaagatgtggccgtgaacttcacccatgaggagtgggccctgctgggccccagccagaagaacctgtacagagatgtgatgagggagaccatccggaacctgaactgcatcggcatgaagtgggagaaccagaacattgatgaccagcaccagaacctgcggaggaacccccgctgtgatgtggtggagagatttgggaagagcaaggatggcagccagtgtggggagaccctgagccagatccggaacagcatcgtgaacaagaacaccccagcccgggtggatgcctgtggcagctctgtgaatggagaggtgatcatgggccacagcagcctgaactgctacatccgggtggacaccggccacaagcaccgggagtgccacgagtatgcagagaagagctacacccacaagcagtgtgggaagggcctgagctaccgccacagcttccagacctgtgagcggccccacacaggcaagaagccctatgactgcaaggaatgtgggaagaccttcagcagccctggcaacctgcggcggcacatggtggtgaagggaggagatggcccctacaagtgtgagctgtgtgggaaggccttcttctggcccagcctgctgaggatgcatgagaggacccacactggagagaagccctatgagtgcaagcagtgcagcaaggccttccctgtgtacagcagctacctgcggcatgagaagatccacactggagagaagccctatgagtgcaagcagtgcagcaaggccttcccagactacagcagctacctgcggcatgagaggacccacactggagagaagccctacaagtgcaagcagtgtgggaaggccttctctgtgtctggcagcctgcgggtgcatgagcgcatccacactggagagaagccctacacctgcaagcagtgtgggaaggccttctgccacctgggcagcttccagaggcacatgatcatgcacagcggagatggcccccacaagtgcaagatctgtgggaagggctttgacttccctggcagcgcccgcatccacgagggcacccacaccctggagaagccctatgagtgcaagcagtgtgggaagctgctgagccacaggagcagcttcagaagacacatgatggcccacactggagatggcccccacaagtgcaccgtgtgtgggaaggcctttgacagccccagcgtcttccagagacatgagaggacccacactggagagaagccctatgagtgcaagcagtgtgggaaggccttccgcaccagcagcagcctgaggaagcatgagaccacccacactggagagcagccctacaagtgcaagtgtgggaaggccttcagtgacctcttctccttccagagccatgagaccacccacagcgaggaggagccctatgagtgcaaggaatgtgggaaggccttcagcagcttcaagtacttctgcagacatgagaggacccacagcgaggagaagagctatgagtgccagatctgtgggaaggccttcagccgcttctcctacctgaagacccatgagaggacccacacagctgagaagccctatgagtgcaagcagtgcaggaaggccttcttctggcccagcttcctgctgcggcatgagaggacccacactggagagcggccctatgagtgcaagcactgcggcaaggccttcagccgcagcagcttctgccgggagcacgagaggacccacactggagagaagccctatgagtgcaaggaatgtgggaaggccttcagcagcctgagcagcttcaacagacacaagaggacccactggaaggacatcctgtag

SEQ ID NO: 176851 - DNA, 1914 bp, Artificial Sequence
  Description of Artificial Sequence: Synthetic coding sequence
atggccctgtgctacggcaccttctggggctaccccaagatgctggaggccgccaacctgatggagggcctggtggacatcggcccctgggtgaccctgccccggggccagcctgaggtgctggagtggggcctgcccaaggaccaggacagcgtggcctttgaagatgtggccgtgaacttcacccatgaggagtgggccctgctgggccccagccagaagaacctgtacagagatgtgatgagggagaccatccggaacctgaactgcatcggcatgaagtgggagaaccagaacattgatgaccagcaccagaacctgcggaggaacccccgctgtgatgtggtggagagatttgggaagagcaaggatggcagccagtgtggggagaccctgagccagatccggaacagcatcgtgaacaagaacaccccagcccgggtggatgcctgtggcagctctgtgaatggagaggtgatcatgggccacagcagcctgaactgctacatccgggtggacaccggccacaagcaccgggagtgccacgagtatgcagagaagagctacacccacaagcagtgtgggaagggcctgagctaccgccacagcttccagacctgtgagcggccccacacaggcaagaagccctatgactgcaaggaatgtgggaagaccttcagcagccctggcaacctgcggcggcacatggtggtgaagggaggagatggcccctacaagtgtgagctgtgtgggaaggccttcttctggcccagcctgctgaggatgcatgagaggacccacactggagagaagccctatgagtgcaagcagtgcagcaaggccttccctgtgtacagcagctacctgcggcatgagaagatccacactggagagaagccctatgagtgcaagcagtgcagcaaggccttcccagactacagcagctacctgcggcatgagaggacccacactggagagaagccctacaagtgcaagcagtgtgggaaggccttctctgtgtctggcagcctgcgggtgcatgagcgcatccacactggagagaagccctacacctgcaagcagtgtgggaaggccttctgccacctgggcagcttccagaggcacatgatcatgcacagcggagatggcccccacaagtgcaagatctgtgggaagggctttgacttccctggcagcgcccgcatccacgagggcacccacaccctggagaagccctatgagtgcaagcagtgtgggaagctgctgagccacaggagcagcttcagaagacacatgatggcccacactggagatggcccccacaagtgcaccgtgtgtgggaaggcctttgacagccccagcgtcttccagagacatgagaggacccacactggagagaagccctatgagtgcaagcagtgtgggaaggccttccgcaccagcagcagcctgaggaagcatgagaccacccacactggagagcagccctacaagtgcaagtgtgggaaggccttcagtgacctcttctccttccagagccatgagaccacccacagcgaggaggagccctatgagtgcaaggaatgtgggaaggccttcagcagcttcaagtacttctgcagacatgagaggacccacagcgaggagaagagctatgagtgccagatctgtgggaaggccttcagccgcttctcctacctgaagacccatgagaggacccacacagctgagaagccctatgagtgcaagcagtgcaggaaggccttcttctggcccagcttcctgctgcggcatgagaggacccacactggagagcggccctatgagtgcaagcactgcggcaaggccttcagccgcagcagcttctgccgggagcacgagaggacccacactggagagaagccctatgaatag

SEQ ID NO: 176852 - DNA, 1770 bp, Artificial Sequence
  Description of Artificial Sequence: Synthetic coding sequence
atggattctgtggcctttgaagatgtggccgtgaacttcacccatgaggagtgggccctgctgggccccagccagaagaacctgtacagagatgtgatgagggagaccatccggaacctgaactgcatcggcatgaagtgggagaaccagaacattgatgaccagcaccagaacctgcggaggaacccccgctgtgatgtggtggagagatttgggaagagcaaggatggcagccagtgtggggagaccctgagccagatccggaacagcatcgtgaacaagaacaccccagcccgggtggatgcctgtggcagctctgtgaatggagaggtgatcatgggccacagcagcctgaactgctacatccgggtggacaccggccacaagcaccgggagtgccacgagtatgcagagaagagctacacccacaagcagtgtgggaagggcctgagctaccgccacagcttccagacctgtgagcggccccacacaggcaagaagccctatgactgcaaggaatgtgggaagaccttcagcagccctggcaacctgcggcggcacatggtggtgaagggaggagatggcccctacaagtgtgagctgtgtgggaaggccttcttctggcccagcctgctgaggatgcatgagaggacccacactggagagaagccctatgagtgcaagcagtgcagcaaggccttccctgtgtacagcagctacctgcggcatgagaagatccacactggagagaagccctatgagtgcaagcagtgcagcaaggccttcccagactacagcagctacctgcggcatgagaggacccacactggagagaagccctacaagtgcaagcagtgtgggaaggccttctctgtgtctggcagcctgcgggtgcatgagcgcatccacactggagagaagccctacacctgcaagcagtgtgggaaggccttctgccacctgggcagcttccagaggcacatgatcatgcacagcggagatggcccccacaagtgcaagatctgtgggaagggctttgacttccctggcagcgcccgcatccacgagggcacccacaccctggagaagccctatgagtgcaagcagtgtgggaagctgctgagccacaggagcagcttcagaagacacatgatggcccacactggagatggcccccacaagtgcaccgtgtgtgggaaggcctttgacagccccagcgtcttccagagacatgagaggacccacactggagagaagccctatgagtgcaagcagtgtgggaaggccttccgcaccagcagcagcctgaggaagcatgagaccacccacactggagagcagccctacaagtgcaagtgtgggaaggccttcagtgacctcttctccttccagagccatgagaccacccacagcgaggaggagccctatgagtgcaaggaatgtgggaaggccttcagcagcttcaagtacttctgcagacatgagaggacccacagcgaggagaagagctatgagtgccagatctgtgggaaggccttcagccgcttctcctacctgaagacccatgagaggacccacacagctgagaagccctatgagtgcaagcagtgcaggaaggccttcttctggcccagcttcctgctgcggcatgagaggacccacactggagagcggccctatgagtgcaagcactgcggcaaggccttcagccgcagcagcttctgccgggagcacgagaggacccacactggagagaagccctatgaatag

SEQ ID NO: 176853 - DNA, 1623 bp, Artificial Sequence
  Description of Artificial Sequence: Synthetic coding sequence
atgggcatcgtggagaaggccagcagcagcagtgacagcgtgacctttgaagatgtggccgtgaacttcacccaggaggagtggaccctgctggaccccagccagaagaagctgtacagagatgtgatgtgggagaccttcaggaacctggccaccatcggcaccaagcagaaggagtggaacatcgaggagcagtacaagaaccagggcaggaacctgaggaaccacatggtggagcggctgtgtgagagcaaggagggcagccatggaggagagggcttcagccagatcgccaacctgagcctgaacaagaagacccccagcggcggcaagctgtgggagagctctgtgtgtgggaaggtgctgagccaccacagcagcctgaacagacacatccgcagctacaccaggcacaagctgtacaagtgccaggagtatggagagaagccctacaagtgcaagaagtgtgggaagcccttctcctacctgcagagcttcaagaagcacaagaggacccacagcgctggcatcgtgtacaagtgcaaggcctgtgggaaggccttcagctgccagaggagcttccagatccacggccgcacccacactggagacaagcccttcaagtgcaaggaatgtgggaaggccttccgctaccaccagagcgcccagaagcatgagaaggcccacactggagagaagccctacaagtgcaaggaatgtgggaagcccttcatctaccgccacagcgcccgggcccatgaaagaaaccacacagtgcagaagagatatgagtgcaagcagtgtgggaagacctacatcagctctgtgggcttccaggcccacgagaggacccacactggagagaagccctatgagtgcaagaagtgtgggaaggtgtttgtgtaccacaacagcgcccagagacatgagaagacccacactggagagaagccctacaagtgcaaggaatgtgggaaggccttctcctaccactgcacagcccagaagcatgaaagaaaccacacagcccagaagcactatgagtgcaagctgtgtgggaagacctacctgagccccctgggcttccaggcccacgagagcacccacactggagacaagccctttgagtgcaagaagtgtgggaaggccttccgctactactacagcgcccagagacatgagaggacccacactggagagaagccctacaagtgcaaggaatgtgggaaggccttctactgctgcagcagcgccaggagacatgagaggatgcacacagccaagaagcagtatgagtgcaagaagtgtgggaagacctacatcaccctggccggcttccagatccacgagaggacccacactggagagaagccctatgagtgcaagcagtgtgggaaggccttcagcagcagcagctacatccacatccacgagcgcatccacactggagagaagccctatgagtgcaaggaatgtgggaagcccttctccttcctgaccggcttccgggtgcacatgaggatgcacactggagagaagccctacaagtgcaaggactgtggaaatgccttcatctggagggccagcctgcagtaccacgtgaagaaggtgcatgctgagtag

SEQ ID NO: 176854 - DNA, 1848 bp, Artificial Sequence; identical to SEQ ID NO: 176849
  Description of Artificial Sequence: Synthetic coding sequence

SEQ ID NO: 176855 - DNA, 984 bp, Artificial Sequence
  Description of Artificial Sequence: Synthetic coding sequence
atggaggtggccgtgcctgtgaagcaggaggccgagggcctggccctggacagcccctggcaccgcttccgccgcttccacctgggagatgcccctggcccccgggaggccctgggcctgctgcgggccctgtgccgggactggctgcggcctgaggtgcacaccaaggagcagatgctggagctgctggtgctggagcagttcctgagcgccctgcctgctgacacccaggcctgggtgtgcagccggcagccccagagcggggaggaggccgtggccctgctggaggagctgtggggccctgctgccagcccagatggcagcagcgccaccagggtgccccaggatgtgacccagggccctggggccaccggcggcaaggaggacagcggcatgatccccctggccggcacagcccctggagctgagggccctgcccctggggacagccaggccgtgcggccctacaagcaggagcccagcagcccccccctggcccctggcctgcctgccttcctggccgcccctggcaccaccagctgcccagaatgtgggaagaccagcctgaagccagcccacctgctgcggcaccggcagagccacagcggggagaagccccacgcctgcccagaatgtgggaaggccttccggaggaaggagcacctgcggcggcaccgggacacccaccctggcagccctggcagccctggccctgccctgcggcccctgcctgcccgggagaagccccacgcctgctgtgaatgtgggaagaccttctactggagggagcacctggtgcgccacaggaagacccacagcggggcccggccctttgcctgctgggagtgtgggaaaggatttggaagaagagagcacgtgctgcggcaccagaggatccacggccgggccgccgccagcgcccagggcgctgtggcccctggcccagatggcggcggccccttccccccctggcccctgggctag

SEQ ID NO: 176856 - DNA, 1557 bp, Artificial Sequence
  Description of Artificial Sequence: Synthetic coding sequence
atggctgtggccctgggctgtgccatccaggccagcctgaaccagggctctgtgttccaggagtatgacacagactgtgaggtgttccggcagcgcttccggcagttccagtaccgggaggccgccggcccccatgaggccttcaacaagctgtgggagctgtgctgccagtggctgaagcccaagatgaggagcaaggagcagatcctggagctgctggtgctggagcagttcctgaccatcctgcccacagaaattgagacctgggtgcgggagcactgcccagagaaccgggagcgggtggtgtccctgattgaggacctgcagcgggagctggagatccctgagcagcaggtggacatgcatgacatgctgctggaggagctggcccctgtgggcacagcccacatcccccccaccatgcacctggagagccctgccctgcaggtgatgggccctgcccaggaggcccctgtggccgaggcctggatcccccaggccggccccccagagctgaactacggggccactggagagtgccagaacttcctggaccccggctaccccctgcccaagctggacatgaacttcagcctggagaaccgggaggagccctgggtgaaggagctgcaggacagcaaggagatgaagcagctgctggacagcaagattggatttgagatcggcattgaaaatgaggaggacaccagcaagcagaagaagatggagaccatgtaccccttcatcgtgaccctggagggcaatgccctgcagggccccatcctgcagaaggactatgtgcagctggagaaccagtgggagaccccacctgaggacctgcagacagacctggccaagctggtggaccagcagaaccccaccctgggggagaccccagagaacagcaacctggaggagcccctgaaccccaagccccacaagaagaagagccctggagagaagccccaccgctgcccccagtgtgggaagtgctttgccaggaagagccagctgaccggccaccagaggatccacagcggggaggagccccacaagtgcccagaatgtgggaagcgcttcctgcggagcagtgacctgtaccgccaccagaggctgcacactggagagcggccctatgagtgcaccgtgtgcaagaagcgcttcacccggcgcagccacctgattggccaccagaggacccacagcgaggaggagacctacaagtgcctggagtgtgggaagagcttctgccacggcagcagcctgaagaggcacctgaagacccacactggagagaagccccaccgctgccacaactgtgggaagagcttcagccggctgacagccctgaccctgcaccagaggacccacacagaggagcggcccttcaagtgcaactactgtgggaagagcttccggcagaggcccagcctggtgatccacctgcgcatccacactggagagaagccctacaagtgcacccactgcagcaagagcttccggcagagagctggcctcatcatgcaccaggtgacccacttccggggcctcatctag

SEQ ID NO: 176857 - DNA, 384 bp, Artificial Sequence
  Description of Artificial Sequence: Synthetic coding sequence
atggctgtggccctgggctgtgccatccaggccagcctgaaccagggctctgtgttccaggagtatgacacagactgtgaggtgttccggcagcgcttccggcagttccagtaccgggaggccgccggcccccatgaggccttcaacaagctgtgggagctgtgctgccagtggctgaagcccaagatgaggagcaaggagcagatcctggagctgctggtgctggagcagttcctgaccatcctgcccacagaaattgagacctgggtgcgggagcactgcccagagaaccgggagcgggtggtgtccctgattgaggacctgcagcgggagctggagatccctgagcagcagacctttgctgctgagtacagccactactag

SEQ ID NO: 176858 - DNA, 495 bp, Artificial Sequence
  Description of Artificial Sequence: Synthetic coding sequence
atggctgtggccctgggctgtgccatccaggccagcctgaaccagggctctgtgttccaggagtatgacacagactgtgaggtgttccggcagcgcttccggcagttccagtaccgggaggccgccggcccccatgaggccttcaacaagctgtgggagctgtgctgccagtggctgaagcccaagatgaggagcaaggagcagatcctggagctgctggtgctggagcagttcctgaccatcctgcccacagaaattgagacctgggtgcgggagcactgcccagagaaccgggagcgggtggtgtccctgattgaggacctgcagcgggagctggagatccctgagcagcaggtgaggaaagaatgtggcatcttcgtcatcggccccaaggaggtggccgaggccgccggcacccggccccacatctgcctgtatgtgatcccccagccccaggacttcagccgggtgctcttcctgttcctgttctgctag

SEQ ID NO: 176859 - DNA, 2049 bp, Artificial Sequence
  Description of Artificial Sequence: Synthetic coding sequence
atgaccaagagcaaggaggccgtgaccttcaaggatgtggccgtggtgttcagcgaggaggagctgcagctgctggacctggcccagaggaagctgtacagagatgtgatgctggagaacttcagaaatgtggtgtctgtgggccaccagagcaccccagatggcctgccccagctggagcgggaggagaagctgtggatgatgaagatggccacccagagggacaacagcagcggggccaagaacctgaaggagatggagaccctgcaggaggtgggcctgcgctacctgccccatgaggagctgttctgcagccagatctggcagcagatcacccgggagctgatcaagtaccaggacagcgtggtgaacatccagaggacaggctgccagctggagaagagagatgacctgcactacaaggatgagggcttcagcaaccagagcagccacctgcaggtgcaccgggtgcacactggagagaagccctacaagggggagcactgtgtgaagagcttctcctggagcagccacctgcagatcaaccagagggcccatgctggggagaagccctacaagtgtgagaagtgtgacaatgccttccgccgcttcagcagcctgcaggcccaccagagggtgcacagccgggccaagagctacaccaatgatgccagctaccgctccttcagccagaggagccacctgccccaccaccagagggtgcccactggagagaacccctacaagtatgaggagtgtggcagaaatgtgggcaagagcagccactgccaggcccccctcatcgtgcacactggagagaagccctacaagtgtgaggagtgtggggtgggcttcagccagaggagctacctgcaggtgcacctgaaggtgcacacaggcaagaagccctacaagtgtgaggagtgtgggaagagcttctcctggaggagccggctgcaggcccacgagcgcatccacactggagagaagccctacaagtgcaatgcctgtgggaagagcttctcctacagcagccacctgaacatccactgccgcatccacactggagagaagccctacaagtgtgaggagtgtgggaagggcttctctgtgggcagccacctgcaggcccaccagatcagccacactggagagaagccctacaagtgtgaggagtgtgggaagggcttctgccgggccagcaacctgctggaccaccagaggggccacactggagagaagccctaccagtgtgatgcctgtgggaagggcttcagccgcagcagtgacttcaacatccacttccgggtgcacactggagagaagccctacaagtgtgaggagtgtgggaagggcttcagccaggccagcaacctgctggcccaccagaggggccacactggagagaagccctacaagtgtggcacctgtgggaagggcttcagccgcagcagtgacctgaatgtgcactgccgcatccacactggagagaagccctacaagtgtgagcgctgtgggaaggccttcagccagttcagcagcctgcaggtgcaccagagggtgcacactggagagaagccctaccagtgtgccgagtgtgggaagggcttctctgtgggcagccagctgcaggcccaccagcgctgccacactggagagaagccctaccagtgtgaggagtgtgggaagggcttctgccgggccagcaacttcctggcccaccggggcgtgcacactggagagaagccctaccgctgtgatgtgtgtgggaagcgcttccggcagaggagctacctgcaggcccaccagagggtgcacactggagagcggccctacaagtgtgaggagtgtgggaaggtgttctcctggagcagctacctgcaggcccaccagagggtgcacactggagagaagccctacaagtgtgaggagtgtgggaagggcttctcctggagcagcagcctcatcatccaccagagggtgcatgctgatgatgaaggagacaaggacttccccagcagcgaggacagccacaggaagaccaggtag

SEQ ID NO: 176860 - DNA, 1617 bp, Artificial Sequence
  Description of Artificial Sequence: Synthetic coding sequence
atgaccaagagcaaggaggccgtgaccttcaaggatgtggccgtggtgttcagcgaggaggagctgcagctgctggacctggcccagaggaagctgtacagagatgtgatgctggagaacttcagaaatgtggtgtctgtgggccaccagagcaccccagatggcctgccccagctggagcgggaggagaagctgtggatgatgaagatggccacccagagggacaacagcagcggggccaagaacctgaaggagatggagaccctgcaggaggtgggcctgcgctacctgccccatgaggagctgttctgcagccagatctggcagcagatcacccgggagctgatcaagtaccaggacagcgtggtgaacatccagaggacaggctgccagctggagaagagagatgacctgcactacaaggatgagggcttcagcaaccagagcagccacctgcaggtgcaccgggtgcacactggagagaagccctacaagggggagcactgtgtgaagagcttctcctggagcagccacctgcagatcaaccagagggcccatgctggggagaagccctacaagtgtgagaagtgtgacaatgccttccgccgcttcagcagcctgcaggcccaccagagggtgcacagccgggccaagagctacaccaatgatgccagctaccgctccttcagccagaggagccacctgccccaccaccagagggtgcccactggagagaacccctacaagtatgaggagtgtggcagaaatgtgggcaagagcagccactgccaggcccccctcatcgtgcacactggagagaagccctacaagtgtgaggagtgtggggtgggcttcagccagaggagctacctgcaggtgcacctgaaggtgcacacaggcaagaagccctacaagtgtgaggagtgtgggaagagcttctcctggaggagccggctgcaggcccacgagcgcatccacactggagagaagccctacaagtgcaatgcctgtgggaagagcttctcctacagcagccacctgaacatccactgccgcatccacactggagagaagccctacaagtgtgaggagtgtgggaagggcttctctgtgggcagccacctgcaggcccaccagatcagccacactggagagaagccctacaagtgtgaggagtgtgggaagggcttctgccgggccagcaacctgctggaccaccagaggggccacactggagagaagccctaccagtgtgatgcctgtgggaagggcttcagccgcagcagtgacttcaacatccacttccgggtgcacacaggcaagaaccccatcaacgtgcgctctgtggcccgggccagcgcccggccccagatcttctggcccatcaaggaggccaccctggagaggaaccccaccaacgtggtgcacgtgggccgggcctctgtgggcgcccagatcctgatgtacacagtggagagcacccaggagaggaaccccatcaatgcccggggcgtggtgcggcccagcgtgagcagccctgccttccgctgcatccgggagttcaccctggagaggaaccacatctctgtgcagagcgtgggccgggcctctgtgtag

SEQ ID NO: 176861 - DNA, 1689 bp, Artificial Sequence
  Description of Artificial Sequence: Synthetic coding sequence
atggctgctgcctggatggccccagcccaggagagcgtgacctttgaagatgtggccgtgaccttcacccaggaggagtggggccagctggatgtgacccagagggccctgtatgtggaggtgatgctggagacctgtggcctgctggtggccctgggggacagcaccaagccagagaccgtggagcccatccccagccacctggccctgcctgaggaggtgtccctgcaggagcagctggcccagggcgtgccccgctacagctacctgggccaggccatggaccaggacggccccagcgagatgcaggagtacttcctgcggcctggaacagacccccagagcgagaagctgcacggcaagatgagcctggagcacgagggcctggccacagcagatggcatctgcagcatgatgatccagaaccaggtgtccccagaagatgccctgtatggctttgacagctatggccctgtgacagacagcctcatccatgaaggagagaacagctacaagtttgaggagatgtttaatgaaaactgcttcctggtgcagcacgagcagatcctgccccgggtgaagccctatgactgcccagaatgtgggaaggccttcggcaagagcaagcacctgctgcagcaccacatcatccacactggagagaagccctacaagtgcctggagtgtgggaaggacttcaacagaagaagccacctgaccaggcaccagaggacccacaatggagacaagccctttgtgtgcagtgaatgtggccgcaccttcaacagaggcagccacctgaccaggcaccagagggtgcacagcggggagaagccctttgtgtgcaatgaatgtgggaaggccttcacctaccgcagcaactttgtgctgcacaacaagagccacaatgagaagaagccctttgcctgcagtgaatgtgggaagggcttctatgagagcacagccctgatccagcacttcatcatccacactggagagcggcccttcaagtgcctggagtgtgggaaggccttcaactgccgcagccacctgaagcagcacgagcgcatccacactggagagaagccctttgtgtgcagccagtgtgggaaggccttcacccactacagcacctacgtgctgcacgagcgggcccacactggagagaagccctttgagtgcaaggaatgtgggaaggccttcagcatcaggaaggacctgatccgccacttcaacatccacactggagagaagccctatgaatgtctgcagtgtgggaaggccttcaccaggatgagcggcctgaccaggcaccagtggatccacactggagagaagccctacgtgtgcatccagtgtgggaaggccttctgcaggaccaccaacctgatccgccacttcagcatccacactggagagaagccctatgaatgtgtggagtgtgggaaggccttcaacagaagaagccccctgaccaggcaccagaggatccacacagctgagaagagccatgagcccatccagagcggaaatgtgtcctgtgagagcacagacctgatccagcacagcatcatccacacagagagcagccctgtgtctgctgtgaacatggagacccccagcattgctgcccacagcagcagcctggacatcaatggcttcatcgtggaggagaccctgcccctgtag

SEQ ID NO: 176862 - DNA, 1566 bp, Artificial Sequence
  Description of Artificial Sequence: Synthetic coding sequence
atgctggagacctgtggcctgctggtggccctgggggacagcaccaagccagagaccgtggagcccatccccagccacctggccctgcctgaggaggtgtccctgcaggagcagctggcccagggcgtgccccgctacagctacctgggccaggccatggaccaggacggccccagcgagatgcaggagtacttcctgcggcccggcacagacccccagagcgagaagctgcacggcaagatgagcctggagcacgagggcctggccacagcagatggcatctgcagcatgatgatccagaaccaggtgtccccagaagatgccctgtatggctttgacagctatggccctgtgacagacagcctcatccacgagggagaaaattcctacaagtttgaggagatgtttaatgaaaactgcttcctggtgcagcacgagcagatcctgccccgggtgaagccctatgactgcccagaatgtgggaaggccttcggcaagagcaagcacctgctgcagcaccacatcatccacactggagagaagccctacaagtgcctggagtgtgggaaggacttcaacagaagaagccacctgaccaggcaccagaggacccacaacggggacaagccctttgtgtgcagtgaatgtggccgcaccttcaacagaggcagccacctgaccaggcaccagagggtgcacagcggggagaagccctttgtgtgcaatgaatgtgggaaggccttcacctaccgcagcaactttgtgctgcacaacaagagccacaatgagaagaagccctttgcctgcagtgaatgtgggaagggcttctatgagagcacagccctgatccagcacttcatcatccacactggagagcggcccttcaagtgcctggagtgtgggaaggccttcaactgccgcagccacctgaagcagcacgagcgcatccacactggagagaagccctttgtgtgcagccagtgtgggaaggccttcacccactacagcacctacgtgctgcacgagcgggcccacactggagagaagccctttgagtgcaaggaatgtgggaaggccttcagcatcaggaaggacctgatccgccacttcaacatccacactggagagaagccctatgagtgcctgcagtgtgggaaggccttcaccaggatgagcggcctgaccaggcaccagtggatccacactggagagaagccctacgtgtgcatccagtgtgggaaggccttctgcaggaccaccaacctgatccgccacttcagcatccacactggagagaagccctatgaatgtgtggagtgtgggaaggccttcaacagaagaagccccctgaccaggcaccagaggatccacacagctgagaagagccatgagcccatccagagcggaaatgtgtcctgtgagagcacagacctgatccagcacagcatcatccacacagagagcagccctgtgtctgctgtgaacatggagacccccagcattgctgcccacagcagcagcctggacatcaatggcttcatcgtggaggagaccctgcccctgtag

SEQ ID NO: 176863 - DNA, 1623 bp, Artificial Sequence
  Description of Artificial Sequence: Synthetic coding sequence
atggcccacgagctggtgatgttcagagatgtggccattgatgtgtcccaggaggagtgggagtgcctgaacccagcccagaggaacctgtacaaggaggtgatgctggagaactacagcaacctggtgtccctgggcctgtctgtgtccaagccagctgtgatcagcagcctggagcagggcaaggagccctggatggtggtgcgggaggagaccggccgctggtgcccagacctggccagcagagatgagccccagaagctgagccccaagagggacatctatgaaacagagctgagccagtgggtgaacatggaggagttcaagagccacagccctgagaggagcatcttcagcgccatctgggagggcaactgccactttgagcagcaccagggccaggaggagggctacttccggcagctgatgatcaaccacgagaacatgcccatcttcagccagcacaccctgctgacccaggagttctatgaccgggagaagatcagcgagtgcaagaagtgcaggaagatcttctcctaccacctgttcttcagccaccacaagaggacccacagcaaggagctgtctgagtgcaaggagtgcacagagatcgtgaacaccccctgcctcttcaagcagcagaccatccagaatggagacaagtgcaatgaatgcaaggagtgctggaaggcctttgtgcactgcagccagctgaagcacctgcgcatccacaatggagagaagagatatgaatgtaatgaatgtgggaaggccttcaactacggcagcgagctgaccctgcaccagaggatccacactggagagaagccctatgagtgcaaggaatgtgggaaggccttccggcagaggagccagctgacccagcaccagaggctgcacactggagagaagccctatgagtgcaagcagtgtgggaaggccttcatccggggcttccagctgacagagcacctgcggctgcacactggagagaagccctatgagtgcaaggaatgtgggaagaccttccgccacaggagccacctgaccatccaccagaggatccacactggagagaagccctatgaatgtcgggagtgtgggaaggccttctcctaccacagcagcttcagccaccaccagaagatccacagcggcaagaagccctatgaatgtcatgaatgtgggaaggccttctgtgatggcctgcagctgaccctgcaccagaggatccacactggagagaagccctatgagtgcaaggaatgtgggaagaccttccggcagtgcagccacctgaagaggcaccagaggatccacactggagagaagccccatgagtgcatgatctgtgggaaggccttccggctgcacagccacctgatccagcaccagaggatccacactggagagaagccctatgagtgcaaggaatgtgggaaggccttctcctaccacagcagcttcagccaccaccagaggatccacagcggcaagaagccctaccagtgtgggaaggccttcaaccaccggctgcagctgaacctgcaccagaccctgcacactggagagaagcctgtgcgcttccccctgctgcccccccaccccagcctggccagctag

SEQ ID NO: 176864 - DNA, 741 bp, Artificial Sequence
  Description of Artificial Sequence: Synthetic coding sequence
atggtggtgcgggaggagaccggccgctggtgccccggcacctggaagacctggggcttccacaacaacttcctggacaacaatgaggccacagacatcaatgctgacctggccagcagagatgagccccagaagctgagccccaagagggacatctatgaaacagagctgagccagtgggtgaacatggaggagttcaagagccacagccctgagaggagcatcttcagcgccatctgggagggcaactgccactttgagcagcaccagggccaggaggagggctacttccggcagctgatgatcaaccacgagaacatgcccatcttcagccagcacaccctgctgacccaggagttctatgaccgggagaagatcagcgagtgcaagaagtgcaggaagatcttctcctaccacctgttcttcagccaccacaagtgcagccacctgaagaggcaccagaggatccacactggagagaagccccatgagtgcatgatctgtgggaaggccttccggctgcacagccacctgatccagcaccagaggatccacactggagagaagccctatgagtgcaaggaatgtgggaaggccttctcctaccacagcagcttcagccaccaccagaggatccacagcggcaagaagccctaccagtgtgggaaggccttcaaccaccggctgcagctgaacctgcaccagaccctgcacactggagagaagcctgtgcgcttctag

SEQ ID NO: 176865 - DNA, 1692 bp, Artificial Sequence
  Description of Artificial Sequence: Synthetic coding sequence
atggcccacgagctggtgatgttcagagatgtggccattgatgtgtcccaggaggagtgggagtgcctgaacccagcccagaggaacctgtacaaggaggtgatgctggagaactacagcaacctggtgtccctgggcctgtctgtgtccaagccagctgtgatcagcagcctggagcagggcaaggagccctggatggtggtgcgggaggagaccggccgctggtgccccggcacctggaagacctggggcttccacaacaacttcctggacaacaatgaggccacagacatcaatgctgacctggccagcagagatgagccccagaagctgagccccaagagggacatctatgaaacagagctgagccagtgggtgaacatggaggagttcaagagccacagccctgagaggagcatcttcagcgccatctgggagggcaactgccactttgagcagcaccagggccaggaggagggctacttccggcagctgatgatcaaccacgagaacatgcccatcttcagccagcacaccctgctgacccaggagttctatgaccgggagaagatcagcgagtgcaagaagtgcaggaagatcttctcctaccacctgttcttcagccaccacaagaggacccacagcaaggagctgtctgagtgcaaggaatgtacagaaattgtgaacaccccctgcctcttcaagcagcagaccatccagaatggagacaagtgcaatgaatgcaaggagtgctggaaggcctttgtgcactgcagccagctgaagcacctgcgcatccacaacggggagaagagatatgagtgcaatgaatgtgggaaggccttcaactacggcagcgagctgaccctgcaccagaggatccacactggagagaagccctatgagtgcaaggaatgtgggaaggccttccggcagaggagccagctgacccagcaccagaggctgcacactggagagaagccctatgagtgcaagcagtgtgggaaggccttcatccggggcttccagctgacagagcacctgcggctgcacactggagagaagccctatgagtgcaaggaatgtgggaagaccttccgccacaggagccacctgaccatccaccagaggatccacactggagagaagccctatgagtgcagagaatgtgggaaggccttctcctaccacagcagcttcagccaccaccagaagatccacagcggcaagaagccctatgagtgccatgaatgtgggaaggccttctgtgatggcctgcagctgaccctgcaccagaggatccacactggagagaagccctatgagtgcaaggaatgtgggaagaccttccggcagtgcagccacctgaagaggcaccagaggatccacactggagagaagccccatgagtgcatgatctgtgggaaggccttccggctgcacagccacctgatccagcaccagaggatccacactggagagaagccctatgagtgcaaggaatgtgggaaggccttctcctaccacagcagcttcagccaccaccagaggatccacagcggcaagaagccctaccagtgtgggaaggccttcaaccaccggctgcagctgaacctgcaccagaccctgcacactggagagaagcctgtgcgcttccccctgctgcccccccaccccagcctggccagctag

SEQ ID NO: 176866 - DNA, 777 bp, Artificial Sequence
  Description of Artificial Sequence: Synthetic coding sequence
gagaagagatatgaatgtaatgaatgtgggaaggccttcaactacggcagcgagctgaccctgcaccagaggatccacactggagagaagccctatgagtgcaaggaatgtgggaaggccttccggcagaggagccagctgacccagcaccagaggctgcacactggagagaagccctatgagtgcaagcagtgtgggaaggccttcatccggggcttccagctgacagagcacctgcggctgcacactggagagaagccctatgagtgcaaggaatgtgggaagaccttccgccacaggagccacctgaccatccaccagaggatccacactggagagaagccctatgaatgtcgggagtgtgggaaggccttctcctaccacagcagcttcagccaccaccagaagatccacagcggcaagaagccctatgaatgtcatgaatgtgggaaggccttctgtgatggcctgcagctgaccctgcaccagaggatccacactggagagaagccctatgagtgcaaggaatgtgggaagaccttccggcagtgcagccacctgaagaggcaccagaggatccacactggagagaagccccatgagtgcatgatctgtgggaaggccttccggctgcacagccacctgatccagcaccagaggatccacactggagagaagccctatgagtgcaaggaatgtgggaaggccttctcctaccacagcagcttcagccaccaccagaggatccacagtgatgccaccacagccatctcctag

SEQ ID NO: 176867 - DNA, 1311 bp, Artificial Sequence
  Description of Artificial Sequence: Synthetic coding sequence
atggaggagttcaagagccacagccctgagaggagcatcttcagcgccatctgggagggcaactgccactttgagcagcaccagggccaggaggagggctacttccggcagctgatgatcaaccacgagaacatgcccatcttcagccagcacaccctgctgacccaggagttctatgaccgggagaagatcagcgagtgcaagaagtgcaggaagatcttctcctaccacctgttcttcagccaccacaagaggacccacagcaaggagctgtctgagtgcaaggagtgcacagagatcgtgaacaccccctgcctcttcaagcagcagaccatccagaatggagacaagtgcaatgaatgcaaggagtgctggaaggcctttgtgcactgcagccagctgaagcacctgcgcatccacaatggagagaagagatatgaatgtaatgaatgtgggaaggccttcaactacggcagcgagctgaccctgcaccagaggatccacactggagagaagccctatgagtgcaaggaatgtgggaaggccttccggcagaggagccagctgacccagcaccagaggctgcacactggagagaagccctatgagtgcaagcagtgtgggaaggccttcatccggggcttccagctgacagagcacctgcggctgcacactggagagaagccctatgagtgcaaggaatgtgggaagaccttccgccacaggagccacctgaccatccaccagaggatccacactggagagaagccctatgaatgtcgggagtgtgggaaggccttctcctaccacagcagcttcagccaccaccagaagatccacagcggcaagaagccctatgaatgtcatgaatgtgggaaggccttctgtgatggcctgcagctgaccctgcaccagaggatccacactggagagaagccctatgagtgcaaggaatgtgggaagaccttccggcagtgcagccacctgaagaggcaccagaggatccacactggagagaagccccatgagtgcatgatctgtgggaaggccttccggctgcacagccacctgatccagcaccagaggatccacactggagagaagccctatgagtgcaaggaatgtgggaaggccttctcctaccacagcagcttcagccaccaccagaggatccacagcggcaagaagccctaccagtgtgggaaggccttcaaccaccggctgcagctgaacctgcaccagaccctgcacactggagagaagcctgtgcgcttccccctgctgcccccccaccccagcctggccagctag

SEQ ID NO: 176868 - DNA, 1692 bp, Artificial Sequence; identical to SEQ ID NO: 176865
  Description of Artificial Sequence: Synthetic coding sequence

SEQ ID NO: 176869 - DNA, 1788 bp, Artificial Sequence
  Description of Artificial Sequence: Synthetic coding sequence
atgagggagaccctggaggccctgagcagcctgggcttctctgtgggccagcctgagatggccccccagagcgagccccgggagggcagccacaatgcccaggagcagatgagcagcagccgggaggagcgggccctgggcgtgtgcagcggccacgaggcccccaccccagaggagggcgcccacacagagcaggccgaggccccctgccggggccaggcctgcagcgcccagaaggcccagcctgtgggcacctgccctggagaggagtggatgatcaggaaggtgaaggtggaggatgaggaccaggaggccgaggaggaggtggagtggccccagcacctgagcctgctgcccagccccttccctgccccagacctgggccacctggccgccgcctacaagctggagcccggggcccctggggccctgagcggcctggccctgagcggctggggccccatgcctgagaagccctacggctgtggggagtgtgaaagacgcttccgggaccagctgaccctgcggctgcaccagaggctgcacagaggagagggcccctgtgcctgcccagactgtggccgctccttcacccagagggcccacatgctgctgcaccagaggagccacagaggagagcggcccttcccctgcagtgaatgtgacaagcgcttcagcaagaaggcccacctgaccaggcacctgcggacccacactggagagcggccctacccctgtgccgagtgtgggaagcgcttcagccagaagatccacctgggcagccaccagaagacccacactggagagcggcccttcccctgcacagaatgtgagaagcgcttcaggaagaagacccacctgatccgccaccagaggatccacactggagagcggccctaccagtgtgcccagtgtgcccggagcttcacccacaagcagcacctggtgcgccaccagagggtgcaccagacagctggccctgcccggcccagcccagacagcagcgccagcccccacagcacagcccccagccccacccccagcttccctggccccaagccctttgcctgcagcgactgtggcctgagctttggctggaagaagaacctggccacccaccagtgcctgcacaggtctgagggccggcccttcggctgtgatgaatgtgccctgggcgccaccgtggatgccccagctgccaagcccctggccagcgcccctgggggccctggctgcggccctggcagtgaccctgtggtgccccagagggcccccagcggggagaggagcttcttctgcccagactgtggccggggcttcagccacggccagcacctggcccggcacccccgggtgcacactggagagcggccctttgcctgcacccagtgtgaccggcgcttcggcagccggcccaacctggtggcccacagccgggcccacagcggggcccggccctttgcctgtgcccagtgtggccgccgcttcagcaggaagagccacctgggccgccaccaggccgtgcacacaggcagccggccccacgcctgtgctgtgtgtgcccgctccttcagcagcaagaccaacctggtgcgccaccaggccatccacacaggcagccggcccttcagctgcccccagtgtgggaagagcttcagcaggaagacccacctggtgcgccaccagctgattcatggagaggccgcccatgctgccccagatgctgccctggccgccccagcctggagcgcccctcctgaggtggcccctcctcctctcttcttctag

SEQ ID NO: 176870 - DNA, 11778 bp, Artificial Sequence
  Description of Artificial Sequence: Synthetic coding sequence
atgcctggagagcggcccaggggggcccccccacccaccatgactggagacctgcagccccggcaggtggccagcagccctggccaccccagccagccccccctggaggacaacaccccagccaccaggaccaccaagggggcccgggaggccggcggccaggcccaggccatggagctgcctgaggcccagccccggcaggccagagatggagagctgaagccacccagcctgcggggccaggcccccagcagcaccccaggcaagaggggcagcccccagaccccacctggccgcagccccctgcaggcccccagccggctggccggccgggcagagggcagccccccccagcgctacatcctgggcatcgccagcagcaggaccaagcccaccctggatgagaccccagagaacccccagctggaggccgcccagctgcctgaggtggacaccccccagggccctggcaccggggcccccctgcggcccggcctgcccaggacagaggcccagcctgctgctgaggagctgggcttccaccgctgcttccaggagccccccagcagcttcaccagcaccaactacaccagccccagcgccaccccccggcccccagcccctggccccccccagagccggggcaccagccccctgcagcccggcagctacccagagtaccaggccagcggggctgacagctggcccccagctgctgagaacagcttccctggggccaactttggagtgcccccagctgagcctgagcccatccccaagggcagcaggcctgggggcagcccccggggcgtgtccttccagttccccttccctgccctgcatggagccagcaccaagcccttcccagcagatgtggccggccacgccttcaccaacggccccctggtgtttgccttccaccagccccagggcgcctggccagaggaggccgtgggcaccggccctgcctaccccctgcccacccagcctgcccccagccccctgccctgctaccagggccagcccggcggcctgaacagacacagcgacctgagcggggccctgagcagccctggggccgcccacagcgccccccggcccttcagtgacagcctgcacaagagcctgaccaagatcctgcctgagcggccccccagcgcccaggacggcctgggcagcacccggggcccccccagcagcctgccccagaggcacttccctggccaggcctaccgggccagcggcgtggacaccagccctggccccccagacacagagctggccgcccctggccccccaccagcccggctgccccagctgtgggaccccacagctgccccctaccccaccccacctgggggccccctggccgccaccaggtccatgttcttcaacggccagcccagccctggccagaggctgtgcctgccccagagcgcccccctgccctggccccaggtgctgcccacagcccggcccagcccccacggcatggagatgctgagccggctgcccttccctgctgggggccctgagtggcagggcggcagccagggcgccctgggcacagctgggaagaccccaggcccccgggagaagctgcctgctgtgcgcagcagccagggcggcagccctgccctcttcacctacaacggcatgacagaccccggggcccagcccctcttctttggagtggcccagccccaggtgagcccccacggcacccccagcctgcccccaccccgggtggtgggcgccagccccagcgagagccccctgcccagccctgccaccaacacagctggcagcacctgcagcagcctgagccccatgagcagcagccctgccaaccccagcagcgaggagagccagctgcccggccccctgggccccagcgccttcttccacccccccacccacccccaggagaccggcagccccttccccagccctgagcccccccacagcctgcccacccactaccagcctgagcccgccaaggccttccccttcccagcagatggcctgggcgctgagggcgccttccagtgcctggaggagacccccttcccccatgagggccctgaggtgggccggggcggcctgcagggcttcccccgggcccccccaccctaccccacccaccacttcagcctgagcagcgccagcctggaccagctggatgtgctgctgacctgccggcagtgtgacaggaactacagcagcctggccgccttcctggcccaccggcagttctgtggcctgctgctggcccgggccaaggatggccaccagaggagccctggccccccaggcctgcccagccccccagctgccccccgggtgcctgcagatgcccacgccggcctgctgagccacgccaagaccttcctgctggccggagatgcccaggccgagggcaaggatgaccccctgaggacaggcttcctgcccagcctggccgccacccccttccccctgcctgccagtgacctggacatggaggatgatgccaagctggacagcctcatcacagaggccctgaatggcatggagtaccagagcgacaaccctgagattgacagcagcttcattgatgtgtttgctgatgaggagcccagcggcccccggggccccagcagcggccaccccctgaagagcaaggccggcgtgaccccagagagcaaggcccccccacccctgcctgctgccaccccagacccccagacccccaggcctggggaccggggctgcccagcccggggccggcccaagaccaggagcctgggcctggcccccacagaagcagatgcccccagccagggccggcagcagaggcggggcaagcagctgaagctgttcaggaaggacctggacagcggcggcgctgctgagggcagcggcagcggcggcggcggccgggccagcggcctgcggcccaggagaaatgatggcctgggggagcggcccccaccccggccccggcggcccaggacccaggcccctggcagcagagctgaccctgccccccgggtgcccagggctgctgccctgcctgaggagaccaggagcagcagaagaagaaggctgccccccaggaaggaccccaggaagaggaaggcccggggcggggcctggggcaaggagctgatcctgaagatcgtgcagcagaagaaccggctgcgggagtatgactttgccagcgagagcgaggaggatgagcagcccccaccccggggccctggcttccggggccggcggggccgcggggagaagaggaaggaggtggagctgacccagggcccccgggaggatgagccccagaagcccaggaaggccgcccggcaggaggccggaggagatggagccccagccaaccctgaggagcccggcggcagcaggcctggccctggccgcagcccccaggcccggggccccagccgcagcctggagaccggggctgctgcccgggagggcggccccaagtgtgccgaccggcccagcgtggcccccaaggaccccctgcaggtgcccaccaacacagagaccagcgaggagacccggcccagcctggacttcccccaggaggccaaggagcctgagacagctgaggagagcgccccagacagcacagagttcacagaggccctgcggagccccccagctgcctgtgccggggagatgggcgccagccctggcctgctgatccctgagcagcccccacccagcagacatgacaccggcacccccaagcccagcggcagcctggccaacacagccccccacggcagcagccccaccccaggagtgggcagcctgctgggcggccctgggggcacccaggcccctgtgagccacaacagcaaggaccccccagcccggcagcccggggagttcctggcccctgtggccaaccccagcagcacagcctgccccaagcccagcgtgctgagcagcaagatcagcagctttggctgtgaccctgctggcttcaacagagaccccctgggcgtgcctgtggccaagaagggcccccagccctacagcagcccccacagcgagctgttcctgggccccaaggacctggccggctgcttcctggaggagctgcaccccaagcccagcgccagagatgcccccccagccagcagcagctgcctgtgccaggatggagaagatgctggcagcctggagccccagctgcccaggagccccccaggcacagctgagacagagcccggccgggccgccagcccccccaccctggagagcagcagcctcttcccagacctgcctgtggacagatttgacccccccctgtatggcagcctgagcgccaacagagacagcggcctgccctttgcctgtgccgaccccccccagaagacagtgcccagcgaccccccctaccccagcttcctgctgctggaggaggtgagccccatgctgcccagccacttcccagacctgagcggcggcaaggtgctgagcaagacctgccccccagagaggacagtggtgcctggggccgcccccagcctgcctggaaaaggaagtggctgcagcgtggccctgatgagccacctgtctgaagatgagctggagatccagaagctggtgacagagctggagagccagctgcagaggagcaaggacaccaggggggccccccgggagctggccgaggccgagagcgtgggccgggtggagctgggcactggaacagagccccccagccagaggaggacctgccaggccaccgtgccccatgaggacaccttctctgctgctgacctgaccagggtgggggagagcacagcccaccgggagggcgctgagagcgctgtggccaccgtggaggccgtgcagggccggcctgggggcacctggccctgcccagccagcttccaccctggccatgctgccctgctgccctgtgcccaggaggacctggtgtctggggcccccttcagccccaggggggccaacttccacttccagcctgtgcagaaggccggggccagcaagacaggcctgtgccaggccgagggggacagccggcccccccaggatgtgtgcctgcctgagcccagcaagcagcccggcccccagctggatgctggcagcctggccaagtgcagcccagaccaggagctgtccttccccaagaacaaggaggccgccagcagccaggagagcgaggacagcctgcggctgctgccctgtgagcagaggggcggcttcctgcctgagcccggcacagctgaccagccccacagaggagccccagcccctgaggccttcggcagccctgctgtgcacctggccccagacctggccttccagggagatggagccccacccctggatgccacctggccctttggagccagccccagccacgccgcccagggccacagcgctggccgggccggcggccacctgcaccccacagctggccggcccggctttgagggcaatgaatttgccccagctggggccagcagcctgacagccccccggggccgggaggcctggctggtgcctgtgcccagccctgcctgtgtgagcaacacccaccccagcagaagaagccaggaccctgccctgagcccccccatccggcagctgcagctgcccggccctggggtggccaagagcaaggatggcatcctgggcctgcaggagctgaccccagctgcccagagccccccccgggtgaaccccagcggcctggagggcggcaccgtggagggcggcaaggtggcctgtggccctgcccagggcagccctggaggagtgcaggtgaccaccctgcctgctgtggccggccaccagctgggcctggaggctgatggccactggggcctgctgggccaggccgagaagacccagggccagggcacagccaaccagctgcagccagaaaatggagtgtccccaggcggcacagacaaccacgcctctgtgaatgccagccccaagacagccctgaccggccccacagagggcgctgtgctgctggagaagtgcaagggcagccgggccgccatgagcctgcaggaggaggccgagcccacccccagcccccccagccccaaccgggagagcctggccctggccctgacagctgcccacagccgcagcggcagcgagggccgcaccccagagcgggccagcagccctggcctgaacaagcccctgctggccactggagacagccctgcccccagcgtgggggacctggccgcctgtgcccccagccccaccagcgctgcccacatgccctgcagcctgggccccctgccccgggaggaccccctgaccagccccagccgggcccagggcggcctgggcggccagctgcctgccagccccagctgccgggaccccccaggcccccagcagctgctggcctgcagccctgcctgggcccccctggaggaggctgatggagtgcaggccaccacagacacaggagctgaggacagccctgtggccccacccagcctgaccaccagcccctgtgaccccaaggaggccctggccggctgcctgctgcagggcgagggcagccccctggaggaccccagctcctggcccccaggctctgtgtctgctgtgacctgcacccacagcggggacacccccaaggacagcaccctgcgcatccctgaggacagcaggaaggagaagctgtgggagagccctggccgggccaccagcccccccctggccggggctgtgagccccagcgtggccgtgcgggccaccggcctgagcagcacccccactggagatgaggcccaggccggccggggcctgcccggccctgacccccagagcagaggagccccaccccacaccaacccagacaggatgccccggggccacagcagctacagccccagcaacacagcccggctgggccaccgggagggccaggccgtgacagctgtgcccacagagccccccaccctgcagggcgccggccctgacagccctgcctgcctggagggggagatgggcaccagcagcaaggagcctgaggaccccggcaccccagagaccggccgcagcggggccaccaagatgccccgggtgacctgccccagcacaggcctgggcctgggccgcaccacagcccccagcagcacagccagtgacttccagagcgacagcccccagagccacagaaatgccagccaccagaccccccagggcgaccccctgggcccccaggacctgaagcagaggagccggggctacaagaagaagccagccagcacagaaaatggccagtggaagggccaggcccctcatggccctgtgacctgtgaggtgtgtgccgccagcttccgcagcggccctggcctgagccgccacaaggccaggaagcaccggccccaccctggggccccagctgagcccagccctgctgccctgcctgcccagcagcccctggagcccctggcccagaagtgccagccccccaggaagaagagccaccgggtgtctgggaaggagcggcccaaccacagcagaggagaccccagccacgtgacccagcccccaccagcccagggcagcaaggaggtgctgcgggcccctggcagcccccacagccagcagctgcacccccccagccccacagaacatgaggtggatgtgaagaccccagccagcaagcccaggccagaccaggccagagaagatgagctgcaccccaagcaggccgagaagcgggagggccgccgctggaggcgggagcccaccgtggacagccccagccacagcgagggcaagagcaacaagaagaggggcaagctgcggggccgccgcctgcgggaggagagcatcctgcctgtgtctgcagatgtgatcagtgatggccggggcagccggcccagccctgccatggccagctatgctgccagccccagccactgcctgtctgtggagggcggccctgaggctgatggagagcagcccccccggctggccaccctgggccctggggtgatggagggcgctgctgagacagaccaggaggccctgtgtgccggggagactggagcccagaagcccccaggggacaggatgctgtgccccggccgcatggatggagctgccctgggggagcagcccaccggccagaagggggccagcgcccggggcttctggggcccccgggagaccaaggccctgggcgtgtgcaaggagagcggcagcgagcctgctgaggacagcagccgggcccacagccgctctgaggagggcgtgtgggaggagaacaccccacccctgggccccctgggcttccctgagaccagcagcagccctgctgacagcaccaccagcagctgcctgcagggcctgcctgacaacccagacacccagggcggcgtgcagggccctgagggccccaccccagatgccagcggcagcagcgccaaggacccccccagcctgtttgatgatgaggtgtccttcagccagctgttccccccaggcggccgcctgaccaggaagaggaacccccacgtgtatggcaagagatgtgagaagcctgtgctgcccctgcccacccagcccagctttgaggagggcggggaccccaccctgggccctgcccggctgcccacagacctgagtgacagcagcagcctgtgcctgtgccacgaggacccctgggaggatgaagatcctgctggcctgcctgagagcttcctgctggatggcttcctgaacagccgggtgcccggcatcgacccctgggcccctggcctgagcctgtgggccctggagcccagccgggaggccggggctgagaagctgcccagccactgcccagaagatgacaggcctgaggccatccctgagctgcacatggtgcctgctgcctggaggggcctggagatgcctgccccagcagatgacagcagcagcagcctgggagatgtgtccccagagccccccagcctggagcgggagcgctgtgatggcggcctgcccggcaacacccacctgctgcccctgcgggccacagactttgaggtgctgagcaccaagtttgagatgcaggacctgtgcttcctgggcccctttgaagatcctgtgggcctgcccggccccagcttcctggactttgagggcacagccagcagccagggcccccagagcagaagaacagaggaggccgccggggccggccgggcccagggccggggccgcccagccaagggcagaagagccagctacaagtgcaaggtgtgcttccagcgcttccgcagcctgggggagctggacctgcacaagctggcccacaccccagcccccccacccacctgctacatgtgtgtggagaggagatttggcagccgggagctgctgcggggccacctgcaggagagacatgcccagagcaaggccggcccctgggcctgtggcatgtgcctgaaggaggtggctgatgtgtggatgtacaatgagcacctgcgggagcacgctgtgcgctttgcccggcggggccaggcccggcgcagcctgggggacctgcccggcggcctggagggcagcagcgctgtggcccacctgctgaacagcatcacagagcccgcccccaagcaccaccggggcaagaggtctgctgggaaggctgctggcagccctggggacccctggggccaggagggggaggccaagaaggacagccctggagagcgggccaagccccgggcccggagcacccccagcaacccagatggagctgccaccccagacagcgccagcgccacagccctggctgatgctggcagccctggcccccccaggaccacccccagccccagcccagacccctgggccggcggggagcccctgctgcaggccacccctgtgcatgaggcctgcaaggaccccagccgggactgccaccactgtgggaagcgcttccccaagcccttcaagctgcagaggcacctggccgtgcacagcccccagagggtgtacctgtgcccccgctgcccccgggtgtacccagagcacggggagctgctggcccacctgggcggggcccacggcctgctggagaggcctgagctgcagcacacccccctgtatgcctgtgagctgtgtgccaccgtgatgaggatcatcaagaagagctttgcctgcagcagctgcaactacacctttgccaagaaggagcagtttgacagacacatgaacaagcacctgcggggcggccggcagccctttgccttccggggcgtgcggcggcctggggcccctggccagaaggcccgggccctggagggcaccctgcccagcaagagaagaagagtggccatgcctggcagcgcccctggccctggagaggaccggcccccaccccggggcagcagccccatcctgtctgagggcagcctgcctgccctgctgcacctgtgcagcgaggtggcccccagcaccaccaagggctggccagagaccctggagaggcctgtggaccctgtgacccaccccatccggggctgtgagctgcccagcaaccaccaggagtgccccccacccagcctgagccccttccctgctgccctggctgatggccgcggggactgtgccctggatggagccctggagaggccagaaaatgaggccagccctggcagccctggccccctgctgcagcaggccctgcccctgggcgccagcctgcccaggcctggggcccggggccaggatgctgagggcaagagggcccccctggtgttttctgggaagaggcgggcccctggggcccggggccgctgtgccccagaccacttccaggaggaccacctgctgcagaaggagaaggaggtgagcagcagccacatggtgtctgagggcggcccccggggcaccttccacaagggcagcgccaccaagccagctggctgccagagcagcagcaaggacagatctgctgccagcacccccagcaaggccctgaagtttcctgtgcaccccaggaaggctgtgggcagcctggcccctggagagctggcccggggcacagaaaatggcatgaagccagccacccccaaggccaagccaggccccagcagccagggcagcggcagcccccggcccggcaccaagacaggaggcggcagccagccccagcctgccagcggccagctgcagagcgagacagccaccaccccagccaagcccagcttccccagccgcagccctgcccctgagcggctgcctgcccgggcccaggccaagagctgcaccaagggcccccgggaggccggggagcagggcccccacggcagcctgggccccaaggagaagggggagagcagcaccaagaggaagaagggccaggtgcccggccctgcccggtctgagagcgtgggcagctttggccgggcccccagcgccccagacaagccacccaggacccccaggaagcaggccacccccagccgggtgctgcccaccaagcccaagcccaacagccagaacaagccccggcccccaccttctgagcagaggaaggccgagcccggccacacccagaggaaggaccggctgggcaaggccttcccccagggccggcccctgctgcggccccccaagaggggcacagctgtgcacggggctgagcctgctgagccccacacccacaggacagctgaggcccagagcgacctgctgagccagctgtttggccagaggctgaccggcttcaagatccccctgaagaaggatgccagcgagtag

SEQ ID NO: 176871 - DNA, 1479 bp, Artificial Sequence
  Description of Artificial Sequence: Synthetic coding sequence
atgctgtgtgatgagaaggcccagaagaggaggaagaggaaggccaaggagagcggcatggccctgccccagggccacctgaccttcagagatgtggccatcgagttcagccaggccgagtggaagtgcctggaccctgcccagagggccctgtacaaggatgtgatgctggagaactacagaaacctggtgtccctgggcagcagctatgccctgggcagcaatgctgaggacaagcccatcaagaagcagctgggcgtgtccttccacctgcacctgtctgagctggagctgttcccagatgagagggtcatcaatggctgcaaccaggtggagaacttcatcaaccacagcagctctgtgtcctgcctgcaggagatgagcagctctgtgaagacccccatcttcaacagaaatgactttgatgacagcagcttcctgccccaggagcagaaggtgcacctgcgggagaagccctatgaatgtaatgagcacagcaaggtgttccgggtgagcagcagcctgaccaagcaccaggtgatccacacagtggagaagccctacaagtgcaacagctgtgggaaggtgttcagcaggaacagccacctggccgagcactgccgcatccacactggagagaagccctacaagtgcaatgtgtgtgggaaggtgttctcctacaacagcaactttgcccggcaccagaggatccacacccgggagaagccctatgaatgtaatgaatgtgggaaggtgttcagcaacaacagctacctggcccggcaccagagaattcatgctgaggagaagccctacaagtgcaatgaatgtgggaagggcttcagccacaagagcagcctggccaaccactggaggatctacacaggagagaagccctacaagtgtgatgaatgtgggaaggccttctaccgcatcgccctgctggtgcgccaccagaagatccacactggagagaagccctacaagtgcaatgaatgtgggaaggtgttcatccagaacagccacctggcccagcactggaggatccacactggagagaagccctacaagtgcaatgaatgtgggaaggtgttcaaccagctgagcaacctggcccggcaccggcgcatccacactggagagaagccctacaagtgcaatgaatgtgggaaggccttcagcgagtacagcggcctgagcgcccacctggtgatccacactggagagaagccctacaagtgcagtgaatgtgggaaggccttccgccacaagctgagcctgaccaaccaccagaggatccacactggagagcggccctacaagtgcaatgaatgtgggaaggtgttcaaccgcatcgcccacctggcccggcacaggaagatccacactggagagaagccctacaagtgcaatgaatgtgggaaggccttcagccgcatctcctacctggcccagcactggaccatccacatgggctag

SEQ ID NO: 176872 - DNA, 1377 bp, Artificial Sequence
  Description of Artificial Sequence: Synthetic coding sequence
atgctggagcagaggcgggagccctggagcggggagagcgaggtgaagatcgccaagaacagtgatggaagagagtgcatcaagggcgtgaacacaggcagcagctatgccctgggcagcaatgctgaggacaagcccatcaagaagcagctgggcgtgtccttccacctgcacctgtctgagctggagctgttcccagatgagagggtcatcaatggctgcaaccaggtggagaacttcatcaaccacagcagctctgtgtcctgcctgcaggagatgagcagctctgtgaagacccccatcttcaacagaaatgactttgatgacagcagcttcctgccccaggagcagaaggtgcacctgcgggagaagccctatgaatgtaatgagcacagcaaggtgttccgggtgagcagcagcctgaccaagcaccaggtgatccacacagtggagaagccctacaagtgcaacagctgtgggaaggtgttcagcaggaacagccacctggccgagcactgccgcatccacactggagagaagccctacaagtgcaatgtgtgtgggaaggtgttctcctacaacagcaactttgcccggcaccagaggatccacacccgggagaagccctatgaatgtaatgaatgtgggaaggtgttcagcaacaacagctacctggcccggcaccagagaattcatgctgaggagaagccctacaagtgcaatgaatgtgggaagggcttcagccacaagagcagcctggccaaccactggaggatctacacaggagagaagccctacaagtgtgatgaatgtgggaaggccttctaccgcatcgccctgctggtgcgccaccagaagatccacactggagagaagccctacaagtgcaatgaatgtgggaaggtgttcatccagaacagccacctggcccagcactggaggatccacactggagagaagccctacaagtgcaatgaatgtgggaaggtgttcaaccagctgagcaacctggcccggcaccggcgcatccacactggagagaagccctacaagtgcaatgaatgtgggaaggccttcagcgagtacagcggcctgagcgcccacctggtgatccacactggagagaagccctacaagtgcagtgaatgtgggaaggccttccgccacaagctgagcctgaccaaccaccagaggatccacactggagagcggccctacaagtgcaatgaatgtgggaaggtgttcaaccgcatcgcccacctggcccggcacaggaagatccacactggagagaagccctacaagtgcaatgaatgtgggaaggccttcagccgcatctcctacctggcccagcactggaccatccacatgggctag

SEQ ID NO: 176873 - DNA, 537 bp, Artificial Sequence
  Description of Artificial Sequence: Synthetic coding sequence
ttcccccagaccaggaagagaattgcctggagcgagggccatgctgctgcccggctgaccagcaaggagagctgctgtgagaaggcccagaagaggaggaagaggaaggccaaggagagcggcatggccctgccccagggccacctgaccttcagagatgtggccatcgagttcagccaggccgagtggaagtgcctggaccctgcccagagggccctgtacaaggatgtgatgctggagaactacagaaacctggtgtccctgggcatcagcctgcctgacctgaacatcaacagcatgctggagcagaggcgggagccctggagcggggagagcgaggtgaagatcgccaagaacagtgatggccgggagtgcatcaagggcgtgaacacaggcagcagctatgccctgggcagcaatgctgaggacaagcccatcaagaagcagctgggcgtgtccttccacctgcacctgtctgagctggagctgttcccagatgagagggtcatcaatggctgcaaccaggtggagaactag

SEQ ID NO: 176874 - DNA, 1608 bp, Artificial Sequence
  Description of Artificial Sequence: Synthetic coding sequence
atgctgtgtgatgagaaggcccagaagaggaggaagaggaaggccaaggagagcggcatggccctgccccagggccacctgaccttcagagatgtggccatcgagttcagccaggccgagtggaagtgcctggaccctgcccagagggccctgtacaaggatgtgatgctggagaactacagaaacctggtgtccctgggcatcagcctgcctgacctgaacatcaacagcatgctggagcagaggcgggagccctggagcggggagagcgaggtgaagatcgccaagaacagtgatggccgggagtgcatcaagggcgtgaacacaggcagcagctatgccctgggcagcaatgctgaggacaagcccatcaagaagcagctgggcgtgtccttccacctgcacctgtctgagctggagctgttcccagatgagagggtcatcaatggctgcaaccaggtggagaacttcatcaaccacagcagctctgtgtcctgcctgcaggagatgagcagctctgtgaagacccccatcttcaacagaaatgactttgatgacagcagcttcctgccccaggagcagaaggtgcacctgcgggagaagccctatgagtgcaatgagcacagcaaggtgttccgggtgagcagcagcctgaccaagcaccaggtgatccacacagtggagaagccctacaagtgcaacagctgtgggaaggtgttcagcaggaacagccacctggccgagcactgccgcatccacactggagagaagccctacaagtgcaatgtgtgtgggaaggtgttctcctacaacagcaactttgcccggcaccagaggatccacacccgggagaagccctatgagtgcaatgaatgtgggaaggtgttcagcaacaacagctacctggcccggcaccagagaattcatgctgaggagaagccctacaagtgcaatgaatgtgggaagggcttcagccacaagagcagcctggccaaccactggaggatctacaccggggagaagccctacaagtgtgatgaatgtgggaaggccttctacagaattgccctgctggtgcgccaccagaagatccacactggagagaagccctacaagtgcaatgaatgtgggaaggtgttcatccagaacagccacctggcccagcactggaggatccacactggagagaagccctacaagtgcaatgaatgtgggaaggtgttcaaccagctgagcaacctggcccggcaccggcgcatccacactggagagaagccctacaagtgcaatgaatgtgggaaggccttcagcgagtacagcggcctgagcgcccacctggtgatccacactggagagaagccctacaagtgcagtgaatgtgggaaggccttccgccacaagctgagcctgaccaaccaccagaggatccacactggagagcggccctacaagtgcaatgaatgtgggaaggtgttcaacagaattgcccacctggcccggcacaggaagatccacactggagagaagccctacaagtgcaatgaatgtgggaaggccttcagccgcatctcctacctggcccagcactggaccatccacatgggctag

SEQ ID NO: 176875 - DNA, 1608 bp, Artificial Sequence; identical to SEQ ID NO: 176874
  Description of Artificial Sequence: Synthetic coding sequence

SEQ ID NO: 176876 - DNA, 1764 bp, Artificial Sequence
  Description of Artificial Sequence: Synthetic coding sequence
atgcccacagccctgtgcccccgggtgctggcccccaaggagagcgaggagcccaggaagatgaggagccccccaggagagaaccccagcccccagggcgagctgcccagccctgagagcagccggcggctcttccgccgcttccgctaccaggaggccgccggcccccgggaggccctgcagaggctgtgggacctgtgtggcggctggctgcggcctgagcggcacaccaaggagcagatcctggagctgctggtgctggagcagttcctggccatcctgccccgggagatccagagctgggtgcgggcccaggagcctgagagcggggagcaggccgtggccgctgtggaggccctggagcgggagcccggccggccctggcagtggctgaagcactgtgaagatcctgtggtgattgatgatggagacagccccctggaccaggagcaggagcagctgcctgtggagccccacagcgacctggccaagaaccaggatgcccagcccatcaccctggcccagtgcctgggcctgcccagcaggcctcccagccagctgagcggggaccctgtgctgcaggatgccttcctgctgcaggaggagaatgtgcgggacacccagcaggtgaccaccctgcagctgccccccagccgggtgagccccttcaaggacatgatcctgtgcttcagcgaggaggactggagcctgctggaccctgcccagacaggcttctacggggagttcatcattggagaagattatggagtgtccatgcccccaaatgacctggccgcccagcctgacctgagccagggcgaggagaatgagccccgggtgcctgagctgcaggacctgcagggcaaggaggtgccccaggtgtcctacctggacagccccagcctgcagcccttccaggtggaggagaggaggaagcgggaggagctgcaggtgcctgagttccaggcctgcccccagacagtggtgccccagaacacctacccagctgggggcaaccccaggagcctggagaacagcctggatgaggaggtgaccattgaaattgtgctgagcagcagtggagatgaggacagccagcacggcccctactgcacagaggagctgggcagccccacagagaagcagaggagcctgcctgccagccacaggagcagcacagaagctggaggagaggtgcagaccagcaagaagagctatgtgtgccccaactgtgggaagatcttccgctggagggtgaacttcatccgccacctgcggagccggcgggagcaggagaagccccatgagtgcagcgtgtgtggggagctgttcagtgacagcgaggacctggatggccacctggagagccatgaggcccagaagccctaccgctgtggggcctgtgggaagagcttccggctgaacagccacctgctgagccaccggcgcatccacctgcagcctgaccggctgcagcctgtggagaagcgggagcaggccgcctctgaagatgctgacaagggccccaaggagcccctggagaatggcaaggccaagctgtccttccagtgctgtgaatgtgggaaggccttccagagacatgaccacctggcccggcacaggagccacttccacctgaaggacaaggcccggcccttccagtgccgctactgtgtgaagagcttcacccagaactatgacctgctgcggcatgagcggctgcacatgaagaggaggagcaagcaggccctgaacagctactag

SEQ ID NO: 176877 - DNA, 1872 bp, Artificial Sequence
  Description of Artificial Sequence: Synthetic coding sequence
atgcccacagccctgtgcccccgggtgctggcccccaaggagagcgaggagcccaggaagatgaggagccccccaggagagaaccccagcccccagggcgagctgcccagccctgagagcagccggcggctcttccgccgcttccgctaccaggaggccgccggcccccgggaggccctgcagaggctgtgggacctgtgtggcggctggctgcggcctgagcggcacaccaaggagcagatcctggagctgctggtgctggagcagttcctggccatcctgccccgggagatccagagctgggtgcgggcccaggagcctgagagcggggagcaggccgtggccgctgtggaggccctggagcgggagcccggccggccctggcagtggctgaagcactgtgaagatcctgtggtgattgatgatggagacagccccctggaccaggagcaggagcagctgcctgtggagccccacagcgacctggccaagaaccaggatgcccagcccatcaccctggcccagtgcctgggcctgcccagcaggcctcccagccagctgagcggggaccctgtgctgcaggatgccttcctgctgcaggaggagaatgtgcgggacacccagcaggtgaccaccctgcagctgcccccacgcatcttccagttcaacaaccacaggagcaatggctacatcctggagatgctgggcagcggcggcaagaaggcccagatcatctctgtgctgagccagatctacgtgtcccgggtgagccccttcaaggacatgatcctgtgcttcagcgaggaggactggagcctgctggaccctgcccagacaggcttctacggggagttcatcattggagaagattatggagtgtccatgcccccaaatgacctggccgcccagcctgacctgagccagggcgaggagaatgagccccgggtgcctgagctgcaggacctgcagggcaaggaggtgccccaggtgtcctacctggacagccccagcctgcagcccttccaggtggaggagaggaggaagcgggaggagctgcaggtgcctgagttccaggcctgcccccagacagtggtgccccagaacacctacccagctgggggcaaccccaggagcctggagaacagcctggatgaggaggtgaccattgaaattgtgctgagcagcagtggagatgaggacagccagcacggcccctactgcacagaggagctgggcagccccacagagaagcagaggagcctgcctgccagccacaggagcagcacagaagctggaggagaggtgcagaccagcaagaagagctatgtgtgccccaactgtgggaagatcttccgctggagggtgaacttcatccgccacctgcggagccggcgggagcaggagaagccccatgagtgcagcgtgtgtggggagctgttcagtgacagcgaggacctggatggccacctggagagccatgaggcccagaagccctaccgctgtggggcctgtgggaagagcttccggctgaacagccacctgctgagccaccggcgcatccacctgcagcctgaccggctgcagcctgtggagaagcgggagcaggccgcctctgaagatgctgacaagggccccaaggagcccctggagaatggcaaggccaagctgtccttccagtgctgtgaatgtgggaaggccttccagagacatgaccacctggcccggcacaggagccacttccacctgaaggacaaggcccggcccttccagtgccgctactgtgtgaagagcttcacccagaactatgacctgctgcggcatgagcggctgcacatgaagaggaggagcaagcaggccctgaacagctactag

SEQ ID NO: 176878 - DNA, 1830 bp, Artificial Sequence
  Description of Artificial Sequence: Synthetic coding sequence
atgagcacagcccccagcctgagcgccctgcggagcagcaagcacagcggcggcggcggcggcggcggcggcggcggcggcgctgaccctgcctggaccagcgccctgagcggcaacagcagcggccctggccctggcagcagccctgctggcagcaccaagccctttgtgcatgctgtgcccccaagtgaccccctgcggcaggccaaccggctgcccatcaaggtgctgaagatgctgacagccaggacaggccacatcctgcaccctgagtacctgcagcccctgcccagcacccctgtgagccccatcgagctggatgccaagaagagccccctggccctgctggcccagacctgcagccagatcggcaagccagaccccagccccagcagcaagctgagctctgtggccagcaatggaggaggagctgggggcgccggcggcggggccgccggggacaaggacaccaagagcggccccctgaagctgagtgacattggagtggaggacaagagcagcttcaagccctacagcaagccaggcagtgacaagaaggagcccggcggcggcggcggcggcggcggcggcggcggcggcggcggcggcggcgtgtcctctgagaagagcggcttccgggtgcccagcgccacctgccagcccttcacccccaggacaggcagccccagcagcagcgccagcgctgagggcggccccaccggcctggcccacggccgcatcagctgtggcggcggcatcaacgtggatgtgaaccagcacccagatggcggccctgggggcaaggccctgggcagtgactgtggcggcagcagcggcagcagcagcggcagcggccccagcgcccccaccagcagctctgtgctgggcagcggcctggtggcccctgtgagcccctacaagccaggccagacagtgttccccctgcccccagctggcatgacctacccaggcagcctggccggggcctatgccggctacccaccccagttcctgccccacggcgtggccctggaccccaccaagccaggcagcctggtgggcgcccagctggccgctgctgctgctggcagcctgggctgcagcaagccagctggcagcagccccctggccggggccagccccccatctgtgatgacagccagcctgtgccgggacccctactgcctgagctaccactgtgccagccacctggccggggctgctgctgccagcgccagctgtgcccatgaccctgctgctgctgctgctgccctgaagagcggctaccccctggtgtaccccacccaccccctgcatggagtgcacagcagcctgacagctgctgctgctgctggggccaccccacccagcctggccggccaccccctgtacccctacggcttcatgctgcccaatgaccccctgccccacatctgcaactgggtgtctgccaacggcccctgtgacaagagatttgccaccagcgaggagctgctgagccacctgcggacccacacagccttccctggaacagacaagctgctgagcggctaccccagcagcagcagcctggccagcgctgctgctgctgccatggcctgccacatgcacatccccaccagcggggcccctggcagccctggcaccctggccctgcggagcccccaccacgccctgggcctgagcagccgctaccacccctacagcaagagccccctgcccacccctggggcccctgtgcctgtgcctgctgccaccggcccctactacagcccctatgccctgtatggccagaggctgaccacagccagcgccctgggctaccagtag

SEQ ID NO: 176879 - DNA, 1941 bp, Artificial Sequence
  Description of Artificial Sequence: Synthetic coding sequence
atgagcacagcccccagcctgagcgccctgcggagcagcaagcacagcggcggcggcggcggcggcggcggcggcggcggcgctgaccctgcctggaccagcgccctgagcggcaacagcagcggccctggccctggcagcagccctgctggcagcaccaagccctttgtgcatgctgtgcccccaagtgaccccctgcggcaggccaaccggctgcccatcaaggtgctgaagatgctgacagccaggacaggccacatcctgcaccctgagtacctgcagcccctgcccagcacccctgtgagccccatcgagctggatgccaagaagagccccctggccctgctggcccagacctgcagccagatcggcaagccagaccccagccccagcagcaagctgagctctgtggccagcaatggaggaggagctgggggcgccggcggcggggccgccggggacaaggacaccaagagcggccccctgaagctgagtgacattggagtggaggacaagagcagcttcaagccctacagcaagccaggcagtgacaagaaggagcccggcggcggcggcggcggcggcggcggcggcggcggcggcggcggcggcgtgtcctctgagaagagcggcttccgggtgcccagcgccacctgccagcccttcacccccaggacaggcagccccagcagcagcgccagcgcctgcagccctgggggcatgctgagcagcgctggaggagcccctgagggcaaggatgacaagaaggacacagatgtgggcggcggcggcaaaggaactggaggagccagcgctgagggcggccccaccggcctggcccacggccgcatcagctgtggcggcggcatcaacgtggatgtgaaccagcacccagatggcggccctgggggcaaggccctgggcagtgactgtggcggcagcagcggcagcagcagcggcagcggccccagcgcccccaccagcagctctgtgctgggcagcggcctggtggcccctgtgagcccctacaagccaggccagaccgtcttccccctgcccccagctggcatgacctacccaggcagcctggccggggcctatgccggctacccaccccagttcctgccccatggagtggccctggaccccaccaagccaggcagcctggtgggcgcccagctggccgctgctgctgctggcagcctgggctgcagcaagccagctggcagcagccccctggccggggccagcccccccagcgtgatgacagccagcctgtgccgggacccctactgcctgagctaccactgtgccagccacctggccggggctgctgctgccagcgccagctgtgcccatgaccctgctgctgctgctgctgccctgaagagcggctaccccctggtgtaccccacccaccccctgcacggcgtgcacagcagcctgacagctgctgctgctgctggggccaccccacccagcctggccggccaccccctgtacccctacggcttcatgctgcccaatgaccccctgccccacatctgcaactgggtgtctgccaacggcccctgtgacaagagatttgccaccagcgaggagctgctgagccacctgcggacccacacagccttccctggaacagacaagctgctgagcggctaccccagcagcagcagcctggccagcgctgctgctgctgccatggcctgccacatgcacatccccaccagcggggcccctggcagccctggcaccctggccctgcggagcccccaccacgccctgggcctgagcagccgctaccacccctacagcaagagccccctgcccacccctggggcccctgtgcctgtgcctgctgccaccggcccctactacagcccctatgccctgtatggccagaggctgaccacagccagcgccctgggctaccagtag

SEQ ID NO: 176880 - DNA, 1941 bp, Artificial Sequence; identical to SEQ ID NO: 176879
  Description of Artificial Sequence: Synthetic coding sequence

SEQ ID NO: 176881 - DNA, 1626 bp, Artificial Sequence
  Description of Artificial Sequence: Synthetic coding sequence
atgcccaggaggaagcagagccacccccagcctgtgaagtgtgagggcgtgaaggtggacacagaggacagcctggatgagggccctggggccctggtgctggagagtgacctgctgctgggccaggacctggagtttgaggaggaggaggaggaggaggagggagatggcaacagcgaccagctgatgggctttgagcgggacagcgagggggacagcctgggcgcccggcccggcctgccctacggcctgagtgatgatgaaagtggcggcggccgggccctgtctgctgagagcgaggtggaggagcccgcccggggccctggagaggcccggggggagcggcccggccctgcctgccagctgtgtggcggccccactggagagggcccctgctgcggggccggcggccctgggggcggccccctgctgcccccccggctgctgtacagctgccgcctgtgcacctttgtgagccactacagcagccacctgaagaggcacatgcagacccacagcggggagaagcccttccgctgtggccgctgcccctatgccagcgcccagctggtgaacctgaccaggcacaccaggacccacactggagagaagccctaccgctgcccccactgcccctttgcctgcagcagcctgggcaacctgcggcggcaccagaggacccatgctggcccccccaccccaccctgccccacctgtggcttccgctgctgcacccccaggcctgcccggccccccagccccacagagcaggagggcgctgtgcccaggaggccagaagatgccctgctgctgcctgacctgagcctgcacgtgcccccaggaggagccagcttcctgcctgactgtggccagctgcggggggagggggagggcctgtgtggcaccggcagcgagcccctgcctgagctgctcttcccctggacctgccggggctgcggccaggagctggaggagggggagggcagccggctgggcgccgccatgtgtggccgctgcatgagaggagaggccggcggcggggccagcggcggcccccagggccccagcgacaagggctttgcctgcagcctgtgcccctttgccacccactaccccaaccacctggcccggcacatgaagacccacagcggggagaagcccttccgctgtgcccgctgcccctatgccagcgcccacctggacaacctgaagaggcaccagagggtgcacactggagagaagccctacaagtgccccctgtgcccctatgcctgtggcaacctggccaacctgaagagacatggccgcatccacagcggggacaagcccttccgctgcagcctgtgcaactacagctgcaaccagagcatgaacctgaagaggcacatgctgcggcacactggagagaagcccttccgctgtgccacctgtgcctacaccaccggccactgggacaactacaagaggcaccagaaggtgcacggccacggcggggccggcggccctggcctgagcgccagcgagggctgggccccaccccacagcccccccagcgtgctgagcagccggggccccccagccctgggcacagctggcagcagagctgtgcacacagacagcagctag

SEQ ID NO: 176882 - DNA, 1440 bp, Artificial Sequence
  Description of Artificial Sequence: Synthetic coding sequence
atgggctttgagcgggacagcgagggggacagcctgggcgcccggcccggcctgccctacggcctgagtgatgatgaaagtggcggcggccgggccctgtctgctgagagcgaggtggaggagcccgcccggggccctggagaggcccggggggagcggcccggccctgcctgccagctgtgtggcggccccactggagagggcccctgctgcggggccggcggccctgggggcggccccctgctgcccccccggctgctgtacagctgccgcctgtgcacctttgtgagccactacagcagccacctgaagaggcacatgcagacccacagcggggagaagcccttccgctgtggccgctgcccctatgccagcgcccagctggtgaacctgaccaggcacaccaggacccacactggagagaagccctaccgctgcccccactgcccctttgcctgcagcagcctgggcaacctgcggcggcaccagaggacccatgctggcccccccaccccaccctgccccacctgtggcttccgctgctgcacccccaggcctgcccggccccccagccccacagagcaggagggcgctgtgcccaggaggccagaagatgccctgctgctgcctgacctgagcctgcacgtgcccccaggaggagccagcttcctgcctgactgtggccagctgcggggggagggggagggcctgtgtggcaccggcagcgagcccctgcctgagctgctcttcccctggacctgccggggctgcggccaggagctggaggagggggagggcagccggctgggcgccgccatgtgtggccgctgcatgagaggagaggccggcggcggggccagcggcggcccccagggccccagcgacaagggctttgcctgcagcctgtgcccctttgccacccactaccccaaccacctggcccggcacatgaagacccacagcggggagaagcccttccgctgtgcccgctgcccctatgccagcgcccacctggacaacctgaagaggcaccagagggtgcacactggagagaagccctacaagtgccccctgtgcccctatgcctgtggcaacctggccaacctgaagagacatggccgcatccacagcggggacaagcccttccgctgcagcctgtgcaactacagctgcaaccagagcatgaacctgaagaggcacatgctgcggcacactggagagaagcccttccgctgtgccacctgtgcctacaccaccggccactgggacaactacaagaggcaccagaaggtgcacggccacggcggggccggcggccctggcctgagcgccagcgagggctgggccccaccccacagcccccccagcgtgctgagcagccggggccccccagccctgggcacagctggcagcagagctgtgcacacagacagcagctag

SEQ ID NO: 176883 - DNA, 3936 bp, Artificial Sequence
  Description of Artificial Sequence: Synthetic coding sequence
atgagcaggaggaagcaggccaagcccaggagcctgaaggaccccaactgcaagctggaggacaagacagaagatggagaggccctggactgcaagaagaggccagaagatggagaggagctggaggatgaagctgtgcacagctgtgacagctgcctgcaggtgtttgagagcctgagtgacatcacagagcacaagatcaaccagtgccagctgacagatggagtggatgtggaggatgaccccacctgctcctggccagccagcagccccagcagcaaggaccagaccagccccagccatggagagggctgtgactttggagaggaggagggcggccctggcctgccctacccctgccagttctgtgacaagagcttcagccggctgagctacctgaagcaccacgagcagagccacagcgacaagctgcccttcaagtgcacctactgcagccgcctcttcaagcacaagaggagccgggacagacacatcaagctgcacactggagacaagaagtaccactgcagtgaatgtgatgctgccttcagcagaagtgaccacctgaagatccacctgaagacccacaccagcaacaagccctacaagtgtgccatctgccggcggggcttcctgagcagcagcagcctgcacggccacatgcaggtgcatgagaggaacaaggatggcagccagagcggcagcaggatggaggactggaagatgaaggacacccagaagtgcagccagtgtgaggagggctttgacttccctgaggacctgcagaagcacatcgccgagtgccacccagaatgtagccccaatgaagatagagctgccctgcagtgtgtgtactgccacgagctgtttgtggaggagaccagcctgatgaaccacatggagcaggtgcacagcggggagaagaagaacagctgcagcatctgcagcgagagcttccacacagtggaggagctgtacagccacatggacagccaccagcagcctgagagctgcaaccacagcaacagccccagcctggtgacagtgggctacacctctgtgagcagcaccaccccagacagcaacctgtctgtggacagcagcaccatggtggaggccgccccacccatccccaagagccggggcaggaagagagctgcccagcagaccccagacatgacaggccccagcagcaagcaggccaaggtgacctacagctgcatctactgcaacaagcagctgttcagcagcctggccgtgctgcagatccacctgaagaccatgcacctggacaagccagagcaggcccacatctgccagtactgcctggaggtgctgcccagcctgtacaacctgaatgagcacctgaagcaggtgcatgaggcccaggaccccggcctcatcgtgtctgccatgcctgccatcgtgtaccagtgcaacttctgcagcgaggtggtgaatgacctgaacaccctgcaggagcacatccgctgcagccacggctttgccaacccagctgccaaggacagcaatgccttcttctgcccccactgctacatgggcttcctgacagacagcagcctggaggagcacatccggcaggtgcactgtgacctgagcggcagccgcttcggcagccctgtgctgggcacccccaaggagcctgtggtggaggtgtacagctgcagctactgcaccaacagccccatcttcaacagcgtgctgaagctgaacaagcacatcaaggagaaccacaagaacatccccctggccctgaactacatccacaacgggaagaagagccgggccctgagccccctgagccctgtggccatcgagcagaccagcctgaagatgatgcaggccgtgggcggggccccagcccggcccactggagagtacatctgcaaccagtgtggggccaagtacaccagcctggacagcttccagacccacctgaagacccacctggacacagtgctgcccaagctgacctgcccccagtgcaacaaggagttccccaaccaggagagcctgctgaagcacgtgaccatccacttcatgatcaccagcacctactacatctgtgagagctgtgacaagcagttcacctctgtggatgacctgcagaagcacctgctggacatgcacacctttgtgttcttccgctgcaccctgtgccaggaggtgtttgacagcaaggtgtccatccagctgcacctggccgtgaagcacagcaatgagaagaaggtgtaccgctgcaccagctgcaactgggacttcagaaatgaaacagacctgcagctgcacgtgaagcacaaccacctggagaaccagggcaaggtgcacaagtgcatcttctgtggggagagctttggaacagaggtggagctgcagtgccacatcaccacccacagcaagaagtacaactgcaagttctgcagcaaggccttccacgccatcatcctgctggagaagcacctgcgggagaagcactgtgtgtttgagaccaagacccccaactgtggcaccaatggagccagcgagcaggtgcagaaggaggaggtggagctgcagaccctgctgaccaacagccaggagagccacaacagccatgatggctctgaagaagatgtggacaccagcgagcccatgtatggctgtgacatctgtggggccgcctacaccatggagaccctgctgcagaaccaccagctgcgggaccacaacatccggcctggagagagcgccatcgtgaagaagaaggccgagctgatcaagggcaactacaagtgcaatgtgtgcagcaggaccttcttctctgaaaatggcctgcgggagcacatgcagacccacctgggccctgtgaagcactacatgtgccccatctgtggggagcgcttccccagcctgctgaccctgacagagcacaaggtgacccacagcaagagcctggacaccggcaactgccgcatctgcaagatgcccctgcagagcgaggaggagttcctggagcactgccagatgcacccagacctgaggaacagcctgaccggcttccgctgtgtggtgtgcatgcagacagtgaccagcaccctggagctgaagatccacggcaccttccacatgcagaagacaggaaatggcagcgctgtgcagaccaccggccggggccagcacgtgcagaagctgtacaagtgtgccagctgcctgaaggagttccgcagcaagcaggacctggtgaagctggacatcaatggcctgccctacggcctgtgtgccggctgtgtgaacctgagcaagagcgccagccctggcatcaacgtgcccccaggcaccaaccggcccggcctgggccagaatgaaaacctgagcgccatcgagggcaagggcaaggtgggcggcctgaagacccgctgcagcagctgcaatgtgaagtttgaaagtgaaagtgagctgcagaaccacatccagaccatccaccgggagctggtgcctgacagcaacagcacccagctgaagaccccccaggtgagccccatgccccgcatcagccccagccagagtgatgagaagaagacctaccagtgcatcaagtgccagatggtgttctacaatgagtgggacatccaggtgcacgtggccaaccacatgattgatgagggcctgaaccacgagtgcaagctgtgcagccagacctttgacagccctgccaagctgcagtgccacctgattgagcacagctttgagggcatgggcggcaccttcaagtgccctgtgtgcttcaccgtgtttgtgcaggccaacaagctgcagcagcacatcttcagcgcccacggccaggaggacaagatctatgactgcacccagtgcccccagaagttcttcttccagacagagctgcagaaccacaccatgacccagcacagcagctag

SEQ ID NO: 176884 - DNA, 3936 bp, Artificial Sequence
  Description of Artificial Sequence: Synthetic coding sequence
atcagccgggcccagaaggcccagacccggcggctgaatgaccccaactgcaagctggaggacaagacagaagatggagaggccctggactgcaagaagaggccagaagatggagaggagctggaggatgaagctgtgcacagctgtgacagctgcctgcaggtgtttgagagcctgagtgacatcacagagcacaagatcaaccagtgccagctgacagatggagtggatgtggaggatgaccccacctgctcctggccagccagcagccccagcagcaaggaccagaccagccccagccatggagagggctgtgactttggagaggaggagggcggccctggcctgccctacccctgccagttctgtgacaagagcttcagccggctgagctacctgaagcaccacgagcagagccacagcgacaagctgcccttcaagtgcacctactgcagccgcctcttcaagcacaagaggagccgggacagacacatcaagctgcacactggagacaagaagtaccactgcagtgaatgtgatgctgccttcagcagaagtgaccacctgaagatccacctgaagacccacaccagcaacaagccctacaagtgtgccatctgccggcggggcttcctgagcagcagcagcctgcacggccacatgcaggtgcatgagaggaacaaggatggcagccagagcggcagcaggatggaggactggaagatgaaggacacccagaagtgcagccagtgtgaggagggctttgacttccctgaggacctgcagaagcacatcgccgagtgccacccagaatgtagccccaatgaagatagagctgccctgcagtgtgtgtactgccacgagctgtttgtggaggagaccagcctgatgaaccacatggagcaggtgcacagcggggagaagaagaacagctgcagcatctgcagcgagagcttccacacagtggaggagctgtacagccacatggacagccaccagcagcctgagagctgcaaccacagcaacagccccagcctggtgacagtgggctacacctctgtgagcagcaccaccccagacagcaacctgtctgtggacagcagcaccatggtggaggccgccccacccatccccaagagccggggcaggaagagagctgcccagcagaccccagacatgacaggccccagcagcaagcaggccaaggtgacctacagctgcatctactgcaacaagcagctgttcagcagcctggccgtgctgcagatccacctgaagaccatgcacctggacaagccagagcaggcccacatctgccagtactgcctggaggtgctgcccagcctgtacaacctgaatgagcacctgaagcaggtgcatgaggcccaggaccccggcctcatcgtgtctgccatgcctgccatcgtgtaccagtgcaacttctgcagcgaggtggtgaatgacctgaacaccctgcaggagcacatccgctgcagccacggctttgccaacccagctgccaaggacagcaatgccttcttctgcccccactgctacatgggcttcctgacagacagcagcctggaggagcacatccggcaggtgcactgtgacctgagcggcagccgcttcggcagccctgtgctgggcacccccaaggagcctgtggtggaggtgtacagctgcagctactgcaccaacagccccatcttcaacagcgtgctgaagctgaacaagcacatcaaggagaaccacaagaacatccccctggccctgaactacatccacaacgggaagaagagccgggccctgagccccctgagccctgtggccatcgagcagaccagcctgaagatgatgcaggccgtgggcggggccccagcccggcccactggagagtacatctgcaaccagtgtggggccaagtacaccagcctggacagcttccagacccacctgaagacccacctggacacagtgctgcccaagctgacctgcccccagtgcaacaaggagttccccaaccaggagagcctgctgaagcacgtgaccatccacttcatgatcaccagcacctactacatctgtgagagctgtgacaagcagttcacctctgtggatgacctgcagaagcacctgctggacatgcacacctttgtgttcttccgctgcaccctgtgccaggaggtgtttgacagcaaggtgtccatccagctgcacctggccgtgaagcacagcaatgagaagaaggtgtaccgctgcaccagctgcaactgggacttcagaaatgaaacagacctgcagctgcacgtgaagcacaaccacctggagaaccagggcaaggtgcacaagtgcatcttctgtggggagagctttggaacagaggtggagctgcagtgccacatcaccacccacagcaagaagtacaactgcaagttctgcagcaaggccttccacgccatcatcctgctggagaagcacctgcgggagaagcactgtgtgtttgagaccaagacccccaactgtggcaccaatggagccagcgagcaggtgcagaaggaggaggtggagctgcagaccctgctgaccaacagccaggagagccacaacagccatgatggctctgaagaagatgtggacaccagcgagcccatgtatggctgtgacatctgtggggccgcctacaccatggagaccctgctgcagaaccaccagctgcgggaccacaacatccggcctggagagagcgccatcgtgaagaagaaggccgagctgatcaagggcaactacaagtgcaatgtgtgcagcaggaccttcttctctgaaaatggcctgcgggagcacatgcagacccacctgggccctgtgaagcactacatgtgccccatctgtggggagcgcttccccagcctgctgaccctgacagagcacaaggtgacccacagcaagagcctggacaccggcaactgccgcatctgcaagatgcccctgcagagcgaggaggagttcctggagcactgccagatgcacccagacctgaggaacagcctgaccggcttccgctgtgtggtgtgcatgcagacagtgaccagcaccctggagctgaagatccacggcaccttccacatgcagaagacaggaaatggcagcgctgtgcagaccaccggccggggccagcacgtgcagaagctgtacaagtgtgccagctgcctgaaggagttccgcagcaagcaggacctggtgaagctggacatcaatggcctgccctacggcctgtgtgccggctgtgtgaacctgagcaagagcgccagccctggcatcaacgtgcccccaggcaccaaccggcccggcctgggccagaatgaaaacctgagcgccatcgagggcaagggcaaggtgggcggcctgaagacccgctgcagcagctgcaatgtgaagtttgaaagtgaaagtgagctgcagaaccacatccagaccatccaccgggagctggtgcctgacagcaacagcacccagctgaagaccccccaggtgagccccatgccccgcatcagccccagccagagtgatgagaagaagacctaccagtgcatcaagtgccagatggtgttctacaatgagtgggacatccaggtgcacgtggccaaccacatgattgatgagggcctgaaccacgagtgcaagctgtgcagccagacctttgacagccctgccaagctgcagtgccacctgattgagcacagctttgagggcatgggcggcaccttcaagtgccctgtgtgcttcaccgtgtttgtgcaggccaacaagctgcagcagcacatcttcagcgcccacggccaggaggacaagatctatgactgcacccagtgcccccagaagttcttcttccagacagagctgcaggtgcacacagccaccccccggcagagctag

SEQ ID NO: 176885 - DNA, 4038 bp, Artificial Sequence
  Description of Artificial Sequence: Synthetic coding sequence
ttcctgagtgactatgtgcagagcgagagcctgcgggtgcggggccccctgtggagccacccagatggctttggaggcctggccagcatcttccactactacgtggactacagaagtgacagcgctgtgcaggacctggccgaccccaactgcaagctggaggacaagacagaagatggagaggccctggactgcaagaagaggccagaagatggagaggagctggaggatgaagctgtgcacagctgtgacagctgcctgcaggtgtttgagagcctgagtgacatcacagagcacaagatcaaccagtgccagctgacagatggagtggatgtggaggatgaccccacctgctcctggccagccagcagccccagcagcaaggaccagaccagccccagccatggagagggctgtgactttggagaggaggagggcggccctggcctgccctacccctgccagttctgtgacaagagcttcagccggctgagctacctgaagcaccacgagcagagccacagcgacaagctgcccttcaagtgcacctactgcagccgcctcttcaagcacaagaggagccgggacagacacatcaagctgcacactggagacaagaagtaccactgcagtgaatgtgatgctgccttcagcagaagtgaccacctgaagatccacctgaagacccacaccagcaacaagccctacaagtgtgccatctgccggcggggcttcctgagcagcagcagcctgcacggccacatgcaggtgcatgagaggaacaaggatggcagccagagcggcagcaggatggaggactggaagatgaaggacacccagaagtgcagccagtgtgaggagggctttgacttccctgaggacctgcagaagcacatcgccgagtgccacccagaatgtagccccaatgaagatagagctgccctgcagtgtgtgtactgccacgagctgtttgtggaggagaccagcctgatgaaccacatggagcaggtgcacagcggggagaagaagaacagctgcagcatctgcagcgagagcttccacacagtggaggagctgtacagccacatggacagccaccagcagcctgagagctgcaaccacagcaacagccccagcctggtgacagtgggctacacctctgtgagcagcaccaccccagacagcaacctgtctgtggacagcagcaccatggtggaggccgccccacccatccccaagagccggggcaggaagagagctgcccagcagaccccagacatgacaggccccagcagcaagcaggccaaggtgacctacagctgcatctactgcaacaagcagctgttcagcagcctggccgtgctgcagatccacctgaagaccatgcacctggacaagccagagcaggcccacatctgccagtactgcctggaggtgctgcccagcctgtacaacctgaatgagcacctgaagcaggtgcatgaggcccaggaccccggcctcatcgtgtctgccatgcctgccatcgtgtaccagtgcaacttctgcagcgaggtggtgaatgacctgaacaccctgcaggagcacatccgctgcagccacggctttgccaacccagctgccaaggacagcaatgccttcttctgcccccactgctacatgggcttcctgacagacagcagcctggaggagcacatccggcaggtgcactgtgacctgagcggcagccgcttcggcagccctgtgctgggcacccccaaggagcctgtggtggaggtgtacagctgcagctactgcaccaacagccccatcttcaacagcgtgctgaagctgaacaagcacatcaaggagaaccacaagaacatccccctggccctgaactacatccacaacgggaagaagagccgggccctgagccccctgagccctgtggccatcgagcagaccagcctgaagatgatgcaggccgtgggcggggccccagcccggcccactggagagtacatctgcaaccagtgtggggccaagtacaccagcctggacagcttccagacccacctgaagacccacctggacacagtgctgcccaagctgacctgcccccagtgcaacaaggagttccccaaccaggagagcctgctgaagcacgtgaccatccacttcatgatcaccagcacctactacatctgtgagagctgtgacaagcagttcacctctgtggatgacctgcagaagcacctgctggacatgcacacctttgtgttcttccgctgcaccctgtgccaggaggtgtttgacagcaaggtgtccatccagctgcacctggccgtgaagcacagcaatgagaagaaggtgtaccgctgcaccagctgcaactgggacttcagaaatgaaacagacctgcagctgcacgtgaagcacaaccacctggagaaccagggcaaggtgcacaagtgcatcttctgtggggagagctttggaacagaggtggagctgcagtgccacatcaccacccacagcaagaagtacaactgcaagttctgcagcaaggccttccacgccatcatcctgctggagaagcacctgcgggagaagcactgtgtgtttgagaccaagacccccaactgtggcaccaatggagccagcgagcaggtgcagaaggaggaggtggagctgcagaccctgctgaccaacagccaggagagccacaacagccatgatggctctgaagaagatgtggacaccagcgagcccatgtatggctgtgacatctgtggggccgcctacaccatggagaccctgctgcagaaccaccagctgcgggaccacaacatccggcctggagagagcgccatcgtgaagaagaaggccgagctgatcaagggcaactacaagtgcaatgtgtgcagcaggaccttcttctctgaaaatggcctgcgggagcacatgcagacccacctgggccctgtgaagcactacatgtgccccatctgtggggagcgcttccccagcctgctgaccctgacagagcacaaggtgacccacagcaagagcctggacaccggcaactgccgcatctgcaagatgcccctgcagagcgaggaggagttcctggagcactgccagatgcacccagacctgaggaacagcctgaccggcttccgctgtgtggtgtgcatgcagacagtgaccagcaccctggagctgaagatccacggcaccttccacatgcagaagacaggaaatggcagcgctgtgcagaccaccggccggggccagcacgtgcagaagctgtacaagtgtgccagctgcctgaaggagttccgcagcaagcaggacctggtgaagctggacatcaatggcctgccctacggcctgtgtgccggctgtgtgaacctgagcaagagcgccagccctggcatcaacgtgcccccaggcaccaaccggcccggcctgggccagaatgaaaacctgagcgccatcgagggcaagggcaaggtgggcggcctgaagacccgctgcagcagctgcaatgtgaagtttgaaagtgaaagtgagctgcagaaccacatccagaccatccaccgggagctggtgcctgacagcaacagcacccagctgaagaccccccaggtgagccccatgccccgcatcagccccagccagagtgatgagaagaagacctaccagtgcatcaagtgccagatggtgttctacaatgagtgggacatccaggtgcacgtggccaaccacatgattgatgagggcctgaaccacgagtgcaagctgtgcagccagacctttgacagccctgccaagctgcagtgccacctgattgagcacagctttgagggcatgggcggcaccttcaagtgccctgtgtgcttcaccgtgtttgtgcaggccaacaagctgcagcagcacatcttcagcgcccacggccaggaggacaagatctatgactgcacccagtgcccccagaagttcttcttccagacagagctgcaggtgcacacagccaccccccggcagagctag

SEQ ID NO: 176886 - DNA, 2013 bp, Artificial Sequence
  Description of Artificial Sequence: Synthetic coding sequence
atggccgaggtggtggccgaggtggccgagatgcccacccagatgagccctggagctgtggagatgagcacccccatgtctgctgagatgatggagatgagcacagaggtgacagagatgaccccaggagaggccctggccagcagcctcttcttccagcaccaccagttcatgtgcagtgaatgtggcagcctgtacaacaccctggaggaggtgctgagccaccaggagcagcacatgctggccgtgtctgaggaggaggccctgaccacccagaatgtgggcctggagcctgagctggtgcctggagctgagggccccttccagtgtggggagtgcagccagctgatcctgagccctggagagctgctggcccaccaggatgcccacctgcgggagagcgccaaccagatccagtaccagtgctgggactgccaggagctgttccccagccctgagctgtgggtggcccacaggaaggcccagcacctgagcgccaccgtggccgagccccctgtgcccccacccctgcccccacccacccccctgcccccacccagcccccccagcgaggtgaagatggagccctatgagtgcccagaatgttccaccctgtgtgccaccccagaggagttcctggagcaccagggcacccactttgacagcctggagaaggaggagagaaatggcctggaggaggaggaggaggatgatgaggaggatgaagaagatgatgaggagatggaggatgaggaggccatggccgaggtgggagatgatgctgtgggcggagatgagagcacagctggctgggcccagggctgtggggactgcccccagcaccagcccagcgctggggcccggcggcagcacagaagaacagcccacagccctgccagcgccacccaccccttccactgcagccagtgccagaggagcttcagcagcgccaaccggctgcaggcccacggccgggcccacgtgggcggcacccatgaatgtaccacctgcagcaaggtgttcaagaaggccgccagcctggagcagcacctgcggctgcacagaggagaggcccgctacctgtgtgtggactgtggccggggctttggaacagagctgaccctggtggcccacagaagagcccacacagccaaccccctgcaccgctgccgctgtgggaagaccttcagcaacatgaccaagttcctgtaccacaggaggacccacgccggcaagagcggggccccacccaccggggccacagcccccccagccccagctgagcccaccccacctcctcctcctccagcccccccagcccagctgccctgcccccagtgcagcaagagctttgccagcgccagccggctgagccgccacagaagagctgtgcacggccccccagagcggcggcaccgctgtggggtgtgtgggaagggcttcaagaagctgatccacgtgaggaaccacctgcggacccacactggagagcggcccttccagtgccacagctgtgggaagacctttgccagcctggccaacctgagccgccaccagctgacccacactggagcccggccctaccagtgcctggactgtgggaagcgcttcacccagagcagcaacctgcagcagcaccggcggctgcacctgcggcctgtggcctttgcccgggccccccggctgcccatcaccggcctgtacaacaagagcccctactactgcggcacctgtggccgctggttccgggccatggccggcctgcggctgcaccagagggtgcacgcccgggcccggaccctgaccctgcagcccccaagaagccccagccctgcccctcctcctcctcctgagccccagcagaccatcatgtgcacagagctgggggagaccatcgccatcatcgagaccagccagcccctggccctggaggacaccctgcagctgtgccaggccgccctgggcgccagcgaggccggcggcctgctgcagctggacacagcctttgtgtag

SEQ ID NO: 176887 - DNA, 1581 bp, Artificial Sequence
  Description of Artificial Sequence: Synthetic coding sequence
atggccgaggtggtggccgaggtggccgagatgcccacccagatgagccctggagctgtggagatgagcacccccatgtctgctgagatgatggagatgagcacagaggtgacagagatgacccccagcccccccagcgaggtgaagatggagccctatgagtgcccagaatgttccaccctgtgtgccaccccagaggagttcctggagcaccagggcacccactttgacagcctggagaaggaggagagaaatggcctggaggaggaggaggaggatgatgaggaggatgaagaagatgatgaggagatggaggatgaggaggccatggccgaggtgggagatgatgctgtgggcggagatgagagcacagctggctgggcccagggctgtggggactgcccccagcaccagcccagcgctggggcccggcggcagcacagaagaacagcccacagccctgccagcgccacccaccccttccactgcagccagtgccagaggagcttcagcagcgccaaccggctgcaggcccacggccgggcccacgtgggcggcacccatgaatgtaccacctgcagcaaggtgttcaagaaggccgccagcctggagcagcacctgcggctgcacagaggagaggcccgctacctgtgtgtggactgtggccggggctttggaacagagctgaccctggtggcccacagaagagcccacacagccaaccccctgcaccgctgccgctgtgggaagaccttcagcaacatgaccaagttcctgtaccacaggaggacccacgccggcaagagcggggccccacccaccggggccacagcccccccagccccagctgagcccaccccacctcctcctcctccagcccccccagcccagctgccctgcccccagtgcagcaagagctttgccagcgccagccggctgagccgccacagaagagctgtgcacggccccccagagcggcggcaccgctgtggggtgtgtgggaagggcttcaagaagctgatccacgtgaggaaccacctgcggacccacactggagagcggcccttccagtgccacagctgtgggaagacctttgccagcctggccaacctgagccgccaccagctgacccacactggagcccggccctaccagtgcctggactgtgggaagcgcttcacccagagcagcaacctgcagcagcaccggcggctgcacctgcggcctgtggcctttgcccgggccccccggctgcccatcaccggcctgtacaacaagagcccctactactgcggcacctgtggccgctggttccgggccatggccggcctgcggctgcaccagagggtgcacgcccgggcccggaccctgaccctgcagcccccaagaagccccagccctgcccctcctcctcctcctgagccccagcagaccatcatgtgcacagagctgggggagaccatcgccatcatcgagaccagccagcccctggccctggaggacaccctgcagctgtgccaggccgccctgggcgccagcgaggccggcggcctgctgcagctggacacagcctttgtgtag

SEQ ID NO: 176888 - DNA, 1983 bp, Artificial Sequence
  Description of Artificial Sequence: Synthetic coding sequence
atggcccacgccctggtgaccttcagagatgtggccatcgacttcagccagaaggagtgggagtgcctggacaccacccagaggaagctgtacagagatgtgatgctggagaactacaacaacctggtgtccctgggctacagcggcagcaagccagatgtgatcaccctgctggagcagggcaaggagccctgtgtggtggccagagatgtgacaggccggcagtgccccggcctgctgagccgccacaagaccaagaagctgagcagcgagaaggacatccacgagatcagcctgagcaaggagagcatcatcgagaagagcaagaccctgcggctgaagggcagcatcttcagaaatgagtggcagaacaagtcagaatttgagggccagcagggcctgaaggagaggagcatcagccagaagaagatcgtgtccaagaagatgagcacagacaggaagaggcccagcttcaccctgaaccagaggatccacaacagcgagaagagctgtgacagccacctggtgcagcacggcaagattgacagtgatgtgaagcatgactgcaaggaatgtggcagcaccttcaacaacgtgtaccagctgaccctgcaccagaagatccacactggagagaagagctgcaagtgtgagaagtgtgggaaggtgttcagccacagctaccagctgaccctgcaccagcgcttccacactggagagaagccctatgagtgccaggagtgtgggaagaccttcaccctgtacccccagctgaacagacaccagaagatccacacaggcaagaagccctacatgtgcaagaagtgtgacaagggcttcttcagccggctggagctgacccagcacaagaggatccacacaggcaagaagagctatgagtgcaaggaatgtgggaaggtgttccagctgatcttctacttcaaggagcacgagcgcatccacacaggcaagaagccctatgagtgcaaggaatgtgggaaggccttctctgtgtgtggccagctgaccaggcaccagaagatccacactggagtgaagccctatgagtgcaaggaatgtgggaagaccttccggctgtccttctacctgacagagcacaggaggacccacgccggcaagaagccctatgagtgcaaggaatgtgggaagagcttcaacgtgcggggccagctgaacagacacaagaccatccacacaggcatcaagccctttgcctgcaaggtgtgtgagaaggccttctcctacagcggggacctgcgggtgcacagccgcatccacactggagagaagccctatgagtgcaaggaatgtgggaaggccttcatgctgcggtctgtgctgacagagcaccagaggctgcacactggagtgaagccctatgagtgcaaggaatgtgggaagaccttccgggtgcgcagccagatcagcctgcacaagaagatccacacagatgtgaagccctacaagtgtgtgcgctgtgggaagaccttccgcttcggcttctacctgacagagcaccagaggatccacactggagagaagccctacaagtgcaaggaatgtgggaaggccttcatccggcggggcaacctgaaggagcacctgaagatccacagcggcctgaagccctatgactgcaaggaatgtgggaagagcttcagccggcggggccagttcacagagcaccagaagatccacactggagtgaagccctacaagtgcaaggaatgtgggaaggccttcagccgctctgtggacctgcgcatccaccagaggatccacactggagagaagccctatgagtgcaagcagtgtgggaaggccttccggctgaacagccacctgacagagcaccagaggatccacactggagagaagccctatgagtgcaaggtgtgcaggaaggccttccggcagtacagccacctgtaccagcaccagaagacccacaacgtcatctag

SEQ ID NO: 176889 - DNA, 1887 bp, Artificial Sequence
  Description of Artificial Sequence: Synthetic coding sequence
atggcccacgccctggtgaccttcagagatgtggccatcgacttcagccagaaggagtgggagtgcctggacaccacccagaggaagctgtacagagatgtgatgctggagaactacaacaacctggtgtccctgggcctgctgagccgccacaagaccaagaagctgagcagcgagaaggacatccacgagatcagcctgagcaaggagagcatcatcgagaagagcaagaccctgcggctgaagggcagcatcttcagaaatgagtggcagaacaagtcagaatttgagggccagcagggcctgaaggagaggagcatcagccagaagaagatcgtgtccaagaagatgagcacagacaggaagaggcccagcttcaccctgaaccagaggatccacaacagcgagaagagctgtgacagccacctggtgcagcacggcaagattgacagtgatgtgaagcatgactgcaaggaatgtggcagcaccttcaacaacgtgtaccagctgaccctgcaccagaagatccacactggagagaagagctgcaagtgtgagaagtgtgggaaggtgttcagccacagctaccagctgaccctgcaccagcgcttccacactggagagaagccctatgagtgccaggagtgtgggaagaccttcaccctgtacccccagctgaacagacaccagaagatccacacaggcaagaagccctacatgtgcaagaagtgtgacaagggcttcttcagccggctggagctgacccagcacaagaggatccacacaggcaagaagagctatgagtgcaaggaatgtgggaaggtgttccagctgatcttctacttcaaggagcacgagcgcatccacacaggcaagaagccctatgagtgcaaggaatgtgggaaggccttctctgtgtgtggccagctgaccaggcaccagaagatccacactggagtgaagccctatgagtgcaaggaatgtgggaagaccttccggctgtccttctacctgacagagcacaggaggacccacgccggcaagaagccctatgagtgcaaggaatgtgggaagagcttcaacgtgcggggccagctgaacagacacaagaccatccacacaggcatcaagccctttgcctgcaaggtgtgtgagaaggccttctcctacagcggggacctgcgggtgcacagccgcatccacactggagagaagccctatgagtgcaaggaatgtgggaaggccttcatgctgcggtctgtgctgacagagcaccagaggctgcacactggagtgaagccctatgagtgcaaggaatgtgggaagaccttccgggtgcgcagccagatcagcctgcacaagaagatccacacagatgtgaagccctacaagtgtgtgcgctgtgggaagaccttccgcttcggcttctacctgacagagcaccagaggatccacactggagagaagccctacaagtgcaaggaatgtgggaaggccttcatccggcggggcaacctgaaggagcacctgaagatccacagcggcctgaagccctatgactgcaaggaatgtgggaagagcttcagccggcggggccagttcacagagcaccagaagatccacactggagtgaagccctacaagtgcaaggaatgtgggaaggccttcagccgctctgtggacctgcgcatccaccagaggatccacactggagagaagccctatgagtgcaagcagtgtgggaaggccttccggctgaacagccacctgacagagcaccagaggatccacactggagagaagccctatgagtgcaaggtgtgcaggaaggccttccggcagtacagccacctgtaccagcaccagaagacccacaacgtcatctag

SEQ ID NO: 176890 - DNA, 1887 bp, Artificial Sequence; identical to SEQ ID NO: 176889
  Description of Artificial Sequence: Synthetic coding sequence

SEQ ID NO: 176891 - DNA, 1983 bp, Artificial Sequence; identical to SEQ ID NO: 176888
  Description of Artificial Sequence: Synthetic coding sequence

SEQ ID NO: 176892 - DNA, 1500 bp, Artificial Sequence
  Description of Artificial Sequence: Synthetic coding sequence
atggcccagggcctggtgaccttcagagatgtggccatcgagttcagcctggaggagtggaagtgcctggagcccgcccagagggacctgtaccgggaggtgaccctggagaactttggccacctggccagcctgggcctgagcatcagcaagccagatgtggtgtccctgctggagcagggcaaggagccctggatgattgccaatgatgtgacaggcccctggtgcccagacctggagagccgctgtgagaagttcctgcagaaggacatctttgagatcggggccttcaactgggagatcatggagagcctgaagtgcagcgacctggagggcagtgacttccgggctgactgggagtgtgagggccagtttgagcggcaggtgaatgaggagtgctacttcaagcaggtgaatgtgacctacggccacatgcctgtgttccagcaccacaccagccacacagtgcggcagagccgggagaccggggagaagctgatggagtgccatgaatgtgggaaggccttcagccggggcagccacctgatccagcaccagaagatccacactggagagaagcccttcggctgcaaggaatgtgggaaggccttcagccgggccagccacctggtgcagcaccagaggatccacactggagagaagccctatgactgcaaggactgtgggaaggccttcggccgcaccagcgagctgatcctgcaccagaggctgcacactggagtgaagccctatgagtgcaaggaatgtgggaagaccttccggcagcacagccagctgatcctgcaccagaggacccacactggagagaagccctacgtgtgcaaggactgtgggaaggccttcatccggggcagccagctgactgtgcaccggcgcatccacactggagcccggccctatgagtgcaaggaatgtgggaaggccttccggcagcacagccagctgactgtgcaccagaggatccacactggagagaagccctatgagtgcaaggaatgtgggaagggcttcatccacagcagcgaggtgaccaggcaccagaggatccacagcggggagaagccctatgagtgcaaggaatgtgggaaggccttccggcagcacgcccagctgaccaggcaccagagggtgcacactggagaccggccctatgagtgcaaggactgtgggaaggccttcagccgcagcagctacctgatccagcaccagaggatccacactggagacaagccctatgagtgcaaggaatgtgggaaggccttcatccgggtgtcccagctgacccaccaccagaggatccacacctgtgagaagccctatgagtgcagagaatgtggcatggccttcatccgcagcagccagctgacagagcaccagaggatccaccctggcatcaagccctatgagtgcagagaatgtggccaggccttcatcctgggcagccagctgattgagcactaccgcatccacactggatag

SEQ ID NO: 176893 - DNA, 1620 bp, Artificial Sequence
  Description of Artificial Sequence: Synthetic coding sequence
atgaggcggggcccctgggagcgctggagcctggccagccaccggctggatgctggcctgtgcacctgcccccgggaggagagccgggagatccgggccggccagatcgtgctgaaggccatggcccagggcctggtgaccttcagagatgtggccatcgagttcagcctggaggagtggaagtgcctggagcccgcccagagggacctgtaccgggaggtgaccctggagaactttggccacctggccagcctgggcctgagcatcagcaagccagatgtggtgtccctgctggagcagggcaaggagccctggatgattgccaatgatgtgacaggcccctggtgcccagacctggagagccgctgtgagaagttcctgcagaaggacatctttgagatcggggccttcaactgggagatcatggagagcctgaagtgcagcgacctggagggcagtgacttccgggctgactgggagtgtgagggccagtttgagcggcaggtgaatgaggagtgctacttcaagcaggtgaatgtgacctacggccacatgcctgtgttccagcaccacaccagccacacagtgcggcagagccgggagaccggggagaagctgatggagtgccatgaatgtgggaaggccttcagccggggcagccacctgatccagcaccagaagatccacactggagagaagcccttcggctgcaaggaatgtgggaaggccttcagccgggccagccacctggtgcagcaccagaggatccacactggagagaagccctatgactgcaaggactgtgggaaggccttcggccgcaccagcgagctgatcctgcaccagaggctgcacactggagtgaagccctatgagtgcaaggaatgtgggaagaccttccggcagcacagccagctgatcctgcaccagaggacccacactggagagaagccctacgtgtgcaaggactgtgggaaggccttcatccggggcagccagctgactgtgcaccggcgcatccacactggagcccggccctatgagtgcaaggaatgtgggaaggccttccggcagcacagccagctgactgtgcaccagaggatccacactggagagaagccctatgagtgcaaggaatgtgggaagggcttcatccacagcagcgaggtgaccaggcaccagaggatccacagcggggagaagccctatgagtgcaaggaatgtgggaaggccttccggcagcacgcccagctgaccaggcaccagagggtgcacactggagaccggccctatgagtgcaaggactgtgggaaggccttcagccgcagcagctacctgatccagcaccagaggatccacactggagacaagccctatgagtgcaaggaatgtgggaaggccttcatccgggtgtcccagctgacccaccaccagaggatccacacctgtgagaagccctatgagtgcagagaatgtggcatggccttcatccgcagcagccagctgacagagcaccagaggatccaccctggcatcaagccctatgagtgcagagaatgtggccaggccttcatcctgggcagccagctgattgagcactaccgcatccacactggatag

SEQ ID NO: 176894 - DNA, 1500 bp, Artificial Sequence; identical to SEQ ID NO: 176892
  Description of Artificial Sequence: Synthetic coding sequence

SEQ ID NO: 176895 - DNA, 2061 bp, Artificial Sequence
  Description of Artificial Sequence: Synthetic coding sequence
atgacagagagccagggcaccgtgaccttcaaggatgtggccatcgacttcacccaggaggagtggaagaggctggaccctgcccagaggaagctgtacagaaatgtgatgctggagaactacaacaacctgatcaccgtgggctaccccttcaccaagccagatgtgatcttcaagctggagcaggaggaggagccctgggtgatggaggaggaggtgctgcggcggcactggcagggcgagatctggggcgtggatgagcaccagaagaaccaggaccggctgctgcggcaggtggaggtgaagttccagaagaccctgacagaggagaagggaaatgaatgccagaagaagtttgccaacgtgttccccctgaacagcgacttcttccccagccgccacaacctgtatgaatatgacctgtttgggaagtgcctggagcacaactttgactgccacaacaacgtgaagtgcctgatgaggaaggagcactgtgagtacaatgaacctgtgaagagctatggcaacagcagcagccactttgtgatcacccccttcaagtgcaaccactgtgggaagggcttcaaccagaccctggacctgatccgccacctgcgcatccacactggagagaagccctatgaatgtagcaactgcaggaaggccttcagccacaaggagaagctgatcaagcactacaagatccacagccgggagcagagctacaagtgcaatgaatgtgggaaggccttcatcaagatgagcaacctgatccgccaccagaggatccacactggagagaagccctatgcctgcaaggaatgtgagaagagcttcagccagaagagcaacctgattgaccacgagaagatccacactggagagaagccctatgaatgtaatgaatgtgggaaggccttcagccagaagcagagcctcatcgcccaccagaaggtgcacactggagagaagccctatgcctgcaatgaatgtgggaaggccttcccccgcatcgccagcctggccctgcacatgaggagccacactggagagaagccctacaagtgtgacaagtgtgggaaggccttcagccagttctccatgctgatcatccacgtgcgcatccacactggagagaagccctatgaatgtaatgaatgtgggaaggccttcagccagagcagcgccctgactgtgcacatgaggagccacactggagagaagccctatgagtgcaaggagtgcaggaaggccttcagccacaagaagaacttcatcacccaccagaagatccacacccgggagaagccctatgaatgtaatgaatgtgggaaggccttcatccagatgagcaacctggtgcgccaccagaggatccacactggagagaagccctacatctgcaaggaatgtgggaaggccttcagccagaagagcaacctgattgcccacgagaagatccacagcggggagaagccctatgaatgtaatgaatgtgggaaggccttcagccagaagcagaacttcatcacccaccagaaggtgcacactggagagaagccctatgactgcaatgaatgtgggaaggccttcagccagatcgccagcctgaccctgcacctgcggagccacactggagagaagccctatgaatgtgacaagtgtgggaaggccttcagccagtgcagcctgctgaacctgcacatgaggagccacactggagagaagccctacgtgtgcaatgaatgtgggaaggccttcagccagaggaccagcctcatcgtgcacatgaggggccacactggagagaagccctatgagtgcaacaagtgtgggaaggccttcagccagagcagcagcctgaccatccacatccggggccacactggagagaagccctttgactgcagcaaatgtgggaaggccttcagccagatcagcagcctgaccctgcacatgaggaagcacactggagagaagccctaccactgcattgaatgtgggaaggccttcagccagaagagccacctggtgcgccaccagaggatccacacccactag

SEQ ID NO: 176896 - DNA, 1029 bp, Artificial Sequence
  Description of Artificial Sequence: Synthetic coding sequence
atgaggagccacactggagagaagccctacaagtgtgacaagtgtgggaaggccttcagccagttctccatgctgatcatccacgtgcgcatccacactggagagaagccctatgaatgtaatgaatgtgggaaggccttcagccagagcagcgccctgactgtgcacatgaggagccacactggagagaagccctatgagtgcaaggagtgcaggaaggccttcagccacaagaagaacttcatcacccaccagaagatccacacccgggagaagccctatgaatgtaatgaatgtgggaaggccttcatccagatgagcaacctggtgcgccaccagaggatccacactggagagaagccctacatctgcaaggaatgtgggaaggccttcagccagaagagcaacctgattgcccacgagaagatccacagcggggagaagccctatgaatgtaatgaatgtgggaaggccttcagccagaagcagaacttcatcacccaccagaaggtgcacactggagagaagccctatgactgcaatgaatgtgggaaggccttcagccagatcgccagcctgaccctgcacctgcggagccacactggagagaagccctatgaatgtgacaagtgtgggaaggccttcagccagtgcagcctgctgaacctgcacatgaggagccacactggagagaagccctacgtgtgcaatgaatgtgggaaggccttcagccagaggaccagcctcatcgtgcacatgaggggccacactggagagaagccctatgagtgcaacaagtgtgggaaggccttcagccagagcagcagcctgaccatccacatccggggccacactggagagaagccctttgactgcagcaaatgtgggaaggccttcagccagatcagcagcctgaccctgcacatgaggaagcacactggagagaagccctaccactgcattgaatgtgggaaggccttcagccagaagagccacctggtgcgccaccagaggatccacacccactag

SEQ ID NO: 176897 - DNA, 1584 bp, Artificial Sequence
  Description of Artificial Sequence: Synthetic coding sequence
atgaggaaggagcactgtgagtacaatgaacctgtgaagagctatggcaacagcagcagccacttcgtcatcacccccttcaagtgcaaccactgtgggaagggcttcaaccagaccctggacctgatccgccacctgcgcatccacactggagagaagccctatgagtgcagcaactgcaggaaggccttcagccacaaggagaagctgatcaagcactacaagatccacagccgggagcagagctacaagtgcaatgaatgtgggaaggccttcatcaagatgagcaacctgatccgccaccagaggatccacactggagagaagccctatgcctgcaaggaatgtgagaagagcttcagccagaagagcaacctgattgaccacgagaagatccacactggagagaagccctatgagtgcaatgaatgtgggaaggccttcagccagaagcagagcctgattgcccaccagaaggtgcacactggagagaagccctatgcctgcaatgaatgtgggaaggccttccccagaattgccagcctggccctgcacatgaggagccacactggagagaagccctacaagtgtgacaagtgtgggaaggccttcagccagttctccatgctgatcatccacgtgcgcatccacactggagagaagccctatgagtgcaatgaatgtgggaaggccttcagccagagcagcgccctgactgtgcacatgaggagccacactggagagaagccctatgagtgcaaggaatgtaggaaggccttcagccacaagaagaacttcatcacccaccagaagatccacacccgggagaagccctatgagtgcaatgaatgtgggaaggccttcatccagatgagcaacctggtgcgccaccagaggatccacactggagagaagccctacatctgcaaggaatgtgggaaggccttcagccagaagagcaacctgattgcccacgagaagatccacagcggggagaagccctatgagtgcaatgaatgtgggaaggccttcagccagaagcagaacttcatcacccaccagaaggtgcacactggagagaagccctatgactgcaatgaatgtgggaaggccttcagccagatcgccagcctgaccctgcacctgcggagccacactggagagaagccctatgaatgtgacaagtgtgggaaggccttcagccagtgcagcctgctgaacctgcacatgaggagccacactggagagaagccctacgtgtgcaatgaatgtgggaaggccttcagccagaggaccagcctgattgtgcacatgaggggccacactggagagaagccctatgagtgcaacaagtgtgggaaggccttcagccagagcagcagcctgaccatccacatccggggccacactggagagaagccctttgactgcagcaaatgtgggaaggccttcagccagatcagcagcctgaccctgcacatgaggaagcacactggagagaagccctaccactgcattgaatgtgggaaggccttcagccagaagagccacctggtgcgccaccagaggatccacacccactag

SEQ ID NO: 176898 - DNA, 1551 bp, Artificial Sequence
  Description of Artificial Sequence: Synthetic coding sequence
atgtttgagcagctgaagcccatcgagccccgggactgctggagggaggcccgggtgaagaagaagcctgtgacctttgaagatgtggccgtgaacttcacccaggaggagtgggactgcctggatgccagccagagggtgctgtaccaggatgtgatgtctgagaccttcaagaacctgacctctgtggcccgcatcttcctgcacaagccagagctgatcaccaagctggagcaggaggaggagcagtggagggagtttgtgcacctgcccaacacagagggcctgtctgagggcaagaagaaggagctgcgggagcagcaccccagcctgagagatgagggcaccagtgatgacaaggtgttcctggcctgccgcggggccggccagtgccccctgagcgccccagctggcaccatggacaggaccagggtgctgcaggccagccaggccggcccccccttcttctgctacacctgtgggaagtgcttcagccgccgcagctacctgtacagccaccagtttgtgcacaaccccaagctgaccaacagctgcagccagtgtgggaagctgttccgcagccccaagagcctgagctaccacaggaggatgcacctgggggagcggcccttctgctgcaccctgtgtgacaagacctactgtgatgccagcggcctgagccgccaccggcgggtgcacctgggctaccggccccacagctgcagcgtgtgtgggaagagcttccgggaccagagcgagctgaagaggcaccagaagatccaccagaaccaggagcctgtggatggcaaccaggagtgcaccctgcgcatccctggcacccaggccgagttccagacccccatcgcccggagccagaggagcatccagggcctgctggatgtgaaccacgcccctgtggcccggagccaggagcccatcttcagaacagagggccccatggcccagaaccaggcctctgtgctgaagaaccaggcccctgtgaccaggacccaggcccccatcaccggcaccctgtgccaggatgcccggagcaacagccaccctgtgaagcccagccggctgaatgtgttctgctgcccccactgcagcctgaccttcagcaagaagagctacctgagccgccaccagaaggcccacctgacagagccccccaactactgcttccactgcagcaagagcttcagcagcttcagccggctggtgcgccaccagcagacccactggaagcagaagagctacctgtgccccatctgtgacctgagctttggagagaaggagggcctgatggaccactggaggggctacaagggcaaggacctgtgccagagcagccaccacaagtgcagggtcatcctgggccagtggctgggcttcagccatgatgtgcccaccatggccggggaggagtggaagcatggaggagaccagagccccccacgcatccacacccccaggagaagaggcctgcgggagaaggcctgcaagggggacaagaccaaggaggccgtgtccatcctgaagcacaagtag

SEQ ID NO: 176899 - DNA, 1551 bp, Artificial Sequence; identical to SEQ ID NO: 176898
  Description of Artificial Sequence: Synthetic coding sequence

SEQ ID NO: 176900 - DNA, 1551 bp, Artificial Sequence; identical to SEQ ID NO: 176898
  Description of Artificial Sequence: Synthetic coding sequence

SEQ ID NO: 176901 - DNA, 1551 bp, Artificial Sequence; identical to SEQ ID NO: 176898
  Description of Artificial Sequence: Synthetic coding sequence

SEQ ID NO: 176902 - DNA, 636 bp, Artificial Sequence
  Description of Artificial Sequence: Synthetic coding sequence
tgagcccggagccaggagcccatcttcagaacagagggccccatggcccagaaccaggcctctgtgctgaagaaccaggcccctgtgaccaggacccaggcccccatcaccggcaccctgtgccaggatgcccggagcaacagccaccctgtgaagcccagccggctgaatgtgttctgctgcccccactgcagcctgaccttcagcaagaagagctacctgagccgccaccagaaggcccacctgacagagccccccaactactgcttccactgcagcaagagcttcagcagcttcagccggctggtgcgccaccagcagacccactggaagcagaagagctacctgtgccccatctgtgacctgagctttggagagaaggagggcctgatggaccactggaggggctacaagggcaaggacctgtgccagagcagccaccacaagtgcagggtcatcctgggccagtggctgggcttcagccatgatgtgcccaccatggccggggaggagtggaagcacggcggggaccagagccccccacgcatccacaccccaagaagaagaggcctgcgggagaaggcctgcaagggggacaagaccaaggaggccgtgtccatcctgaagcacaagtag

SEQ ID NO: 176903 - DNA, 1551 bp, Artificial Sequence; identical to SEQ ID NO: 176898
  Description of Artificial Sequence: Synthetic coding sequence

SEQ ID NO: 176904 - DNA, 1551 bp, Artificial Sequence; identical to SEQ ID NO: 176898
  Description of Artificial Sequence: Synthetic coding sequence

SEQ ID NO: 176905 - DNA, 1551 bp, Artificial Sequence; identical to SEQ ID NO: 176898
  Description of Artificial Sequence: Synthetic coding sequence

SEQ ID NO: 176906 - DNA, 1551 bp, Artificial Sequence; identical to SEQ ID NO: 176898
  Description of Artificial Sequence: Synthetic coding sequence

SEQ ID NO: 176907 - DNA, 1611 bp, Artificial Sequence
  Description of Artificial Sequence: Synthetic coding sequence
atgtttgagcagctgaagcccatcgagcctgtgcagaagaccctgccctgggtgggggaggtggccgccaccctgcaggaggccatgaagagggactgctggagggaggcccgggtgaagaagaagcctgtgacctttgaagatgtggccgtgaacttcacccaggaggagtgggactgcctggatgccagccagagggtgctgtaccaggatgtgatgtctgagaccttcaagaacctgacctctgtggcccgcatcttcctgcacaagccagagctgatcaccaagctggagcaggaggaggagcagtggagggagtttgtgcacctgcccaacacagagggcctgtctgagggcaagaagaaggagctgcgggagcagcaccccagcctgagagatgagggcaccagtgatgacaaggtgttcctggcctgccgcggggccggccagtgccccctgagcgccccagctggcaccatggacaggaccagggtgctgcaggccagccaggccggcccccccttcttctgctacacctgtgggaagtgcttcagccgccgcagctacctgtacagccaccagtttgtgcacaaccccaagctgaccaacagctgcagccagtgtgggaagctgttccgcagccccaagagcctgagctaccacaggaggatgcacctgggggagcggcccttctgctgcaccctgtgtgacaagacctactgtgatgccagcggcctgagccgccaccggcgggtgcacctgggctaccggccccacagctgcagcgtgtgtgggaagagcttccgggaccagagcgagctgaagaggcaccagaagatccaccagaaccaggagcctgtggatggcaaccaggagtgcaccctgcgcatccctggcacccaggccgagttccagacccccatcgcccggagccagaggagcatccagggcctgctggatgtgaaccacgcccctgtggcccggagccaggagcccatcttcagaacagagggccccatggcccagaaccaggcctctgtgctgaagaaccaggcccctgtgaccaggacccaggcccccatcaccggcaccctgtgccaggatgcccggagcaacagccaccctgtgaagcccagccggctgaatgtgttctgctgcccccactgcagcctgaccttcagcaagaagagctacctgagccgccaccagaaggcccacctgacagagccccccaactactgcttccactgcagcaagagcttcagcagcttcagccggctggtgcgccaccagcagacccactggaagcagaagagctacctgtgccccatctgtgacctgagctttggagagaaggagggcctgatggaccactggaggggctacaagggcaaggacctgtgccagagcagccaccacaagtgcagggtcatcctgggccagtggctgggcttcagccatgatgtgcccaccatggccggggaggagtggaagcatggaggagaccagagccccccacgcatccacacccccaggagaagaggcctgcgggagaaggcctgcaagggggacaagaccaaggaggccgtgtccatcctgaagcacaagtag

SEQ ID NO: 176908 - DNA, 1551 bp, Artificial Sequence; identical to SEQ ID NO: 176898
  Description of Artificial Sequence: Synthetic coding sequence

SEQ ID NO: 176909 - DNA, 1356 bp, Artificial Sequence
  Description of Artificial Sequence: Synthetic coding sequence
gctgggggcagccctgagagcctgctcttcttccagaagcctgtgacctttgaagatgtggccgtgaacttcacccaggaggagtgggactgcctggatgccagccagagggtgctgtaccaggatgtgatgtctgagaccttcaagaacctgacctctgtggcccgcatcttcctgcacaagccagagctgatcaccaagctggagcaggaggaggagcagtggagggagaccagggtgctgcaggccagccaggccggcccccccttcttctgctacacctgtgggaagtgcttcagcagaagaagctacctgtacagccaccagtttgtgcacaaccccaagctgaccaacagctgcagccagtgtgggaagctgttccgcagccccaagagcctgagctaccacaggaggatgcacctgggggagcggcccttctgctgcaccctgtgtgacaagacctactgtgatgccagcggcctgagccgccacagaagagtgcacctgggctaccggccccacagctgcagcgtgtgtgggaagagcttccgggaccagagcgagctgaagaggcaccagaagatccaccagaaccaggagcctgtggatggcaaccaggagtgcaccctgcgcatccctggcacccaggccgagttccagacccccatcgcccggagccagaggagcatccagggcctgctggatgtgaaccacgcccctgtggcccggagccaggagcccatcttcagaacagagggccccatggcccagaaccaggcctctgtgctgaagaaccaggcccctgtgaccaggacccaggcccccatcaccggcaccctgtgccaggatgcccggagcaacagccaccctgtgaagcccagccggctgaatgtgttctgctgcccccactgcagcctgaccttcagcaagaagagctacctgagccgccaccagaaggcccacctgacagagccccccaactactgcttccactgcagcaagagcttcagcagcttcagccggctggtgcgccaccagcagacccactggaagcagaagagctacctgtgccccatctgtgacctgagctttggagagaaggagggcctgatggaccactggaggggctacaagggcaaggacctgtgccagagcagccaccacaagtgcagggtcatcctgggccagtggctgggcttcagccatgatgtgcccaccatggccggggaggagtggaagcacggcggggaccagagccccccacgcatccacaccccaagaagaagaggcctgcgggagaaggcctgcaagggggacaagaccaaggaggccgtgtccatcctgaagcacaagtag

SEQ ID NO: 176910 - DNA, 1551 bp, Artificial Sequence; identical to SEQ ID NO: 176898
  Description of Artificial Sequence: Synthetic coding sequence

SEQ ID NO: 176911 - DNA, 1611 bp, Artificial Sequence; identical to SEQ ID NO: 176907
  Description of Artificial Sequence: Synthetic coding sequence

SEQ ID NO: 176912 - DNA, 1611 bp, Artificial Sequence; identical to SEQ ID NO: 176907
  Description of Artificial Sequence: Synthetic coding sequence

SEQ ID NO: 176913 - DNA, 1611 bp, Artificial Sequence; identical to SEQ ID NO: 176907
  Description of Artificial Sequence: Synthetic coding sequence

SEQ ID NO: 176914 - DNA, 1611 bp, Artificial Sequence; identical to SEQ ID NO: 176907
  Description of Artificial Sequence: Synthetic coding sequence

SEQ ID NO: 176915 - DNA, 1551 bp, Artificial Sequence; identical to SEQ ID NO: 176898
  Description of Artificial Sequence: Synthetic coding sequence

SEQ ID NO: 176916 - DNA, 1551 bp, Artificial Sequence; identical to SEQ ID NO: 176898
  Description of Artificial Sequence: Synthetic coding sequence

SEQ ID NO: 176917 - DNA, 1611 bp, Artificial Sequence; identical to SEQ ID NO: 176907
  Description of Artificial Sequence: Synthetic coding sequence

SEQ ID NO: 176918 - DNA, 1551 bp, Artificial Sequence; identical to SEQ ID NO: 176898
  Description of Artificial Sequence: Synthetic coding sequence

SEQ ID NO: 176919 - DNA, 1551 bp, Artificial Sequence; identical to SEQ ID NO: 176898
  Description of Artificial Sequence: Synthetic coding sequence

SEQ ID NO: 176920 - DNA, 1611 bp, Artificial Sequence; identical to SEQ ID NO: 176907
  Description of Artificial Sequence: Synthetic coding sequence

SEQ ID NO: 176921 - DNA, 1725 bp, Artificial Sequence
  Description of Artificial Sequence: Synthetic coding sequence
atggctgctgctgtgccccggcggcccacccagggcaccgtgacctttgaagatgtggccgtgaacttcagccaggaggagtggtgcctgctgtctgaggcccagcgctgcctgtacagagatgtgatgctggagaacctggccctgatcagcagcctgggctgctggtgtggcagcaaggatgaggaggccccctgcaagcagaggatctctgtgcagcgggagagccagagcaggacccccagggctggggtgagccccaagaaggcccacccctgtgagatgtgtggcctcatcctggaggatgtgttccactttgctgaccaccaggagacccaccacaagcagaagctgaacagaagtggggcctgtgggaagaacctggatgacacagcctacctgcaccagcaccagaagcagcacatcggggagaagttctacaggaagtctgtgcgggaggccagctttgtgaagaagaggaagctgcgggtgtcccaggagccctttgtgttccgggagtttgggaaggatgtgctgcccagcagcggcctgtgccaggaggaggccgctgtggagaagacagacagcgagaccatgcacggcccccccttccaggagggcaagaccaactacagctgtgggaagaggaccaaggccttcagcaccaagcacagcgtcatcccccaccagaagctgttcaccagagatggctgctacgtgtgcagcgactgtgggaagagcttcagccgctacgtgtccttcagcaaccaccagagggaccacacagccaagggcccctatgactgtggagaatgtgggaagagctacagcaggaagagcagcctcatccagcaccagagggtgcacacaggccagacagcctacccctgtgaagaatgtgggaagagcttcagccagaagggcagcctcatcagccaccagctggtgcacactggagagggcccctatgagtgcagagaatgtgggaagagctttggccagaagggcaacctgatccagcaccagcagggccacactggagagcgggcctaccactgtggagaatgtgggaagagcttccggcagaagttctgcttcatcaaccaccagagggtgcacactggagagcggccctacaagtgtggagaatgtgggaagagctttggccagaagggcaacctggtgcaccaccagaggggccacactggagagcggccctatgagtgcaaggaatgtgggaagagcttccgctaccgcagccacctgacagagcaccagaggctgcacactggagagcggccctacaactgcagagaatgtgggaagctgttcaacaggaagtaccacctgctggtgcatgagcgggtgcacactggagagcggccctatgcctgtgaggtgtgtgggaagctgtttggaaacaagcacagcgtgaccatccaccagaggatccacactggagagcggccctatgagtgcagtgaatgtgggaagagcttcctgagcagcagcgccctgcacgtgcacaagagggtgcacagcggccagaagccctacaagtgcagtgaatgtgggaagagcttcagcgagtgcagcagcctcatcaagcaccggcgcatccacactggagagcggccctatgagtgcaccaagtgtgggaagaccttccagaggagcagcaccctgctgcaccaccagagcagccacaggaggaaggccctgtag

SEQ ID NO: 176922 - DNA, 3804 bp, Artificial Sequence
  Description of Artificial Sequence: Synthetic coding sequence
atgggagacatgaagaccccagactttgatgacctgctggccgcctttgacatcccagaccccaccagcctggatgccaaggaggccatccagacccccagcgaggagaatgaaagccccctgaagcccccaggcatctgcatggatgaatctgtgtccctgagccacagcggcagcgccccagatgtgcctgctgtgtctgtgattgtgaagaacaccagccggcaggagagctttgaagctgagaaggaccacatcacccccagcctgctgcacaacggcttccggggcagtgacctgcccccagacccccacaactgtgggaagtttgacagcaccttcatgaatggagacagcgcccggagcttccctgggaagctggagccccccaagtctgagcccctgcccaccttcaaccagttcagccccatcagcagccctgagcctgaggaccccatcaaggacaatggcttcggcatcaagcccaagcacagcgacagctacttccccccacccctgggctgtggggctgtgggcggccctgtgctggaggccctggccaagtttcctgtgcctgagctgcacatgtttgaccacttctgcaagaaggagcccaagccagagcccctgcccctgggcagccagcaggagcacgagcagagcggccagaacacagtggagccccacaaggaccctgatgccacccgcttcttcggggaggccctggagttcaacagccaccccagcaacagcatcggggagagcaagggcctggcccgggagctgggcacctgcagctctgtgcccccccggcagaggctgaagccagcccacagcaagctgagcagctgtgtggccgccctggtggccctgcaggccaagagggtggcctctgtgaccaaggaggaccagcccggccacaccaaggacctgagcggccccaccaaggagagcagcaagggcagccccaagatgcccaagagccccaagagccccaggagccccctggaggccaccaggaagagcatcaagcccagcgacagccccaggagcatctgcagcgacagcagcagcaagggcagccccagcgtggccgccagcagccccccagccatccccaaggtgcgcatcaagaccatcaagaccagcagcggggagatcaagaggacagtgacccgcatcctgcctgaccctgatgaccccagcaagagccctgtgggcagccccctgggcagcgccatcgccgaggcccccagcgagatgcctggagatgaggtgcctgtggaggagcacttccctgaggccggcaccaacagcggcagcccccagggcgccaggaaaggagatgagagcatgaccaaggccagtgacagcagcagccccagctgcagcagcggcccccgggtgcccaagggagctgcccctggcagccagacaggcaagaagcagcagagcacagccctgcaggccagcaccctggccccagccaacctgctgcccaaggctgtgcacctggccaacctgaacctggtgccccacagcgtggccgcctctgtgacagccaagagctctgtgcagaggaggagccagccccagctgacccagatgtctgtgcccctggtgcaccaggtgaagaaggccgcccccctgattgtggaggtgttcaacaaggtgctgcacagcagcaaccctgtgcccctgtatgcccccaacctgagccccccagctgacagccgcatccacgtgcctgccagcggctactgctgcctggagtgtggagatgcctttgccctggagaagagcctgagccagcactacggccgccgctctgtgcacatcgaggtgctgtgcaccctgtgcagcaagaccctgctcttcttcaacaagtgcagcctgctgcggcatgcccgggaccacaagagcaagggcctggtgatgcagtgcagccagctgctggtgaagcccatctctgctgaccagatgtttgtgtctgcccctgtgaacagcacagccccagctgccccagcccccagcagcagccccaagcacggcctgaccagcggcagcgccagccccccacctccagccctgcccctgtacccagaccctgtgcggctcatccgctacagcatcaagtgcctggagtgccacaagcagatgagggactacatggtgctggccgcccacttccagaggaccacagaggagacagagggcctgacctgccaggtgtgccagatgctgctgcccaaccagtgcagcttctgtgcccaccagaggatccacgcccacaagagcccctactgctgcccagaatgtggggtgctgtgccgcagcgcctacttccagacccacgtgaaggagaactgcctgcactacgccaggaaggtgggctaccgctgcatccactgcggcgtggtgcacctgaccctggccctgctgaagagccacatccaggagcggcactgccaggtgttccacaagtgtgccttctgccccatggccttcaagacagccagcagcacagctgaccacagcgccacccagcaccccacccagccccaccggcccagccagctgatctacaagtgcagctgtgagatggtgttcaacaagaagaggcacatccagcagcacttctaccagaatgtgtccaagacccaggtgggcgtcttcaagtgcccagagtgccccctgctgtttgtgcagaagccagagctgatgcagcacgtgaagagcacccatggagtgcccagaaatgtggatgagctgagcagcctgcagagcagcgctgacaccagcagcagccggcccggcagccgggtgcccacagagcccccagccacctctgtggccgcccggagcagcagcctgcccagcggccgctggggccggcctgaggcccaccggcgggtggaggcccggccccggctgaggaacacaggctggacctgccaggagtgccaggagtgggtgcctgaccgggagagctatgtgagccacatgaagaagagccacggccgcaccctgaagcgctacccctgccggcagtgtgagcagagcttccacacccccaacagcctgaggaagcacatccggaacaaccacgacacagtgaagaagttctacacctgtggctactgcacagaggacagccccagcttcccccggcccagcctgctggagagccacatcagcctgatgcacggcatccggaacccagacctgagccagaccagcaaggtgaagcccccaggcggccacagcccccaggtgaaccacctgaagaggcctgtgtctggagtgggagatgcccctggcaccagcaatggagccaccgtgagcagcaccaagaggcacaagagcctcttccagtgtgccaagtgcagctttgccacagattctggcctggagttccagagccacatcccccagcaccaggtggacagcagcacagcccagtgcctgctgtgtggcctgtgctacaccagcgccagcagcctgagccgccacctgttcatcgtgcacaaggtgcgggaccaggaggaggaggaggaggaggaggccgctgctgctgagatggctgtggaggtggccgagcctgaggagggcagcggggaggaggtgcccatggagaccagagaaaatggcctggaggagtgtgccggggagcccctgtctgctgaccctgaggcccggcggctgctgggccctgccccagaagatgatggcggccacaatgaccacagccagccccaggccagccaggaccaggacagccacaccctgagcccccaggtgtag

SEQ ID NO: 176923 - DNA, 3804 bp, Artificial Sequence; identical to SEQ ID NO: 176922
  Description of Artificial Sequence: Synthetic coding sequence

SEQ ID NO: 176924 - DNA, 2379 bp, Artificial Sequence
  Description of Artificial Sequence: Synthetic coding sequence
atggccgccatcaacccctgggcctcctggggcgccctgacagaccagagctggggcatgacagctgtggacccctgggcctcctgggccctgtgcccccagtacccagcctggcacgtggagggcagcctggaggagggccggcgggccaccggcctgcctgctgcccaggtgcaggagcctgtgaccttcaaggatgtggccgtggacttcacccaggaggagtggggccagctggacctggtgcagaggaccctgtacagagatgtgatgctggagacctacggccacctgctgtctgtgggcaaccagatcgccaagccagaggtgatcagcctgctggagcagggcgaggagccctggagcgtggagcaggcctgcccccagaggacctgcccagagtgggtgaggaacctggagagcaaggccctgatcccagcccagagcatctttgaggaggagcagagccacggcatgaagctggagcgctacatctgggatgacccctggttcagccggctggaggtgctgggctgcaaggaccagctggagatgtaccacatgaaccagagcacagccatgaggcagatggtgttcatgcagaagcaggtgctgagccagaggagcagcgagttctgtggcctgggcgctgagttcagccagaacctgaactttgtgcccagccagagggtgtcccagatcgagcacttctacaagccagacacccacgcccagagctggaggtgtgacagcgccatcatgtatgctgacaaggtgacctgtgagaacaatgactatgacaagacagtgtaccagagcatccagcccatctacccagcccgcatccagacaggagacaacctcttcaagtgcacagatgctgtgaagagcttcaaccacatcatccactttggagaccacaagggcatccacactggagagaagctgtatgagtacaaggagtgccaccagatcttcaaccagagccccagcttcaatgagcacccccggctgcacgtgggggagaaccagtacaactacaaggagtatgagaacatcttctacttcagcagcttcatggagcaccagaagattggaacagtggagaaggcctacaagtacaatgagtgggagaaggtgtttggctatgacagcttcctgacccagcacaccagcacctacacagctgagaagccctatgactacaatgaatgtggcaccagcttcatctggagcagctacctgatccagcacaagaagacccacactggagagaagccctatgaatgtgacaagtgtgggaaggtgttcaggaacagaagtgccctgaccaagcatgagaggacccacacaggcatcaagccctatgagtgcaacaagtgtgggaaggccttctcctggaacagccacctgattgtgcacaagaggatccacactggagagaagccctacgtgtgcaatgaatgtgggaagagcttcaactggaacagccacctgattggccaccagaggacccacactggagagaagccctttgaatgtacagaatgtgggaagagcttctcctggagcagccacctgattgcccacatgaggatgcacactggagagaagcccttcaagtgtgatgaatgtgagaaggccttccgggactacagcgccctgagcaagcatgagaggacccacagcggggccaagccctacaagtgcacagaatgtgggaagagcttctcctggagcagccacctgattgcccaccagaggacccacactggagagaagccctacaactgccaggagtgtgggaaggccttccgggagaggtctgccctgaccaagcatgagatcatccacagcggcatcaagccctatgagtgcaacaagtgtgggaagagctgcagccagatggcccacctggtgcgccaccagaggacccacactggagagaagccctatgagtgcaacaagtgtgggaagagcttcagccagagctgccacctggtggcccaccggcgcatccacactggagagaagccctacaagtgcaaccagtgtgagaggagcttcaactgcagcagccacctgattgcccacaggaggacccacactggagagaagccctaccgctgcaatgaatgtgggaaggccttcaatgaaagcagcagcctcatcgtgcacctgaggaaccacactggagagaagccctacaagtgcaaccactgtgagaaggccttctgcaagaacagcagcctcatcatccaccagaggatgcacagcggggagaagcgcttcatctgcagtgaatgtgggaaggccttcagcggccacagcgccctgctgcagcaccagaggaaccacagcgaggagaagctgaactag

SEQ ID NO: 176925 - DNA, 2109 bp, Artificial Sequence
  Description of Artificial Sequence: Synthetic coding sequence
atgctggagacctacggccacctgctgtctgtgggcaaccagatcgccaagccagaggtgatcagcctgctggagcagggcgaggagccctggagcgtggagcaggcctgcccccagaggacctgcccagagtgggtgaggaacctggagagcaaggccctgatcccagcccagagcatctttgaggaggagcagagccacggcatgaagctggagcgctacatctgggatgacccctggttcagccggctggaggtgctgggctgcaaggaccagctggagatgtaccacatgaaccagagcacagccatgaggcagatggtgttcatgcagaagcaggtgctgagccagaggagcagcgagttctgtggcctgggcgctgagttcagccagaacctgaactttgtgcccagccagagggtgtcccagatcgagcacttctacaagccagacacccacgcccagagctggaggtgtgacagcgccatcatgtatgctgacaaggtgacctgtgagaacaatgactatgacaagacagtgtaccagagcatccagcccatctacccagcccgcatccagacaggagacaacctcttcaagtgcacagatgctgtgaagagcttcaaccacatcatccactttggagaccacaagggcatccacactggagagaagctgtatgagtacaaggagtgccaccagatcttcaaccagagccccagcttcaatgagcacccccggctgcacgtgggggagaaccagtacaactacaaggagtatgagaacatcttctacttcagcagcttcatggagcaccagaagattggaacagtggagaaggcctacaagtacaatgagtgggagaaggtgtttggctatgacagcttcctgacccagcacaccagcacctacacagctgagaagccctatgactacaatgaatgtggcaccagcttcatctggagcagctacctgatccagcacaagaagacccacactggagagaagccctatgaatgtgacaagtgtgggaaggtgttcaggaacagaagtgccctgaccaagcatgagaggacccacacaggcatcaagccctatgagtgcaacaagtgtgggaaggccttctcctggaacagccacctgattgtgcacaagaggatccacactggagagaagccctacgtgtgcaatgaatgtgggaagagcttcaactggaacagccacctgattggccaccagaggacccacactggagagaagccctttgaatgtacagaatgtgggaagagcttctcctggagcagccacctgattgcccacatgaggatgcacactggagagaagcccttcaagtgtgatgaatgtgagaaggccttccgggactacagcgccctgagcaagcatgagaggacccacagcggggccaagccctacaagtgcacagaatgtgggaagagcttctcctggagcagccacctgattgcccaccagaggacccacactggagagaagccctacaactgccaggagtgtgggaaggccttccgggagaggtctgccctgaccaagcatgagatcatccacagcggcatcaagccctatgagtgcaacaagtgtgggaagagctgcagccagatggcccacctggtgcgccaccagaggacccacactggagagaagccctatgagtgcaacaagtgtgggaagagcttcagccagagctgccacctggtggcccaccggcgcatccacactggagagaagccctacaagtgcaaccagtgtgagaggagcttcaactgcagcagccacctgattgcccacaggaggacccacactggagagaagccctaccgctgcaatgaatgtgggaaggccttcaatgaaagcagcagcctcatcgtgcacctgaggaaccacactggagagaagccctacaagtgcaaccactgtgagaaggccttctgcaagaacagcagcctcatcatccaccagaggatgcacagcggggagaagcgcttcatctgcagtgaatgtgggaaggccttcagcggccacagcgccctgctgcagcaccagaggaaccacagcgaggagaagctgaactag

SEQ ID NO: 176926 - DNA, 1527 bp, Artificial Sequence
  Description of Artificial Sequence: Synthetic coding sequence
atggccgccatcaacccctgggcctcctggggcgccctgacagaccagagctggggcatgacagctgtggacccctgggcctcctgggccctgtgcccccagtacccagcctggcacgtggagggcagcctggaggagggccggcgggccaccggcctgcctgctgcccaggtgcaggagcctgtgaccttcaaggatgtggccgtggacttcacccaggaggagtggggccagctggacctggtgcagaggaccctgtacagagatgtgatgctggagacctacggccacctgctgtctgtgggcaaccagatcgccaagccagaggtgatcagcctgctggagcagggcgaggagccctggagcgtggagcaggcctgcccccagaggacctgcccagagtgggtgaggaacctggagagcaaggccctgatcccagcccagagcatctttgaggaggagcagagccacggcatgaagctggagcgctacatctgggatgacccctggttcagccggctggaggtgctgggctgcaaggaccagctggagatgtaccacatgaaccagagcacagccatgaggcagatggtgttcatgcagaagcaggtgctgagccagaggagcagcgagttctgtggcctgggcgctgagttcagccagaacctgaactttgtgcccagccagagggtgtcccagatcgagcacttctacaagccagacacccacgcccagagctggaggtgtgacagcgccatcatgtatgctgacaaggtgacctgtgagaacaatgactatgacaagacagtgtaccagagcatccagcccatctacccagcccgcatccagacaggagacaacctcttcaagtgcacagatgctgtgaagagcttcaaccacatcatccactttggagaccacaagggcatccacactggagagaagctgtatgagtacaaggagtgccaccagatcttcaaccagagccccagcttcaatgagcacccccggctgcacgtgggggagaaccagtacaactacaaggagtatgagaacatcttctacttcagcagcttcatggagcaccagaagattggaacagtggagaaggcctacaagtacaatgagtgggagaaggtgtttggctatgacagcttcctgacccagcacaccagcacctacacagctgagaagccctatgactacaatgaatgtggcaccagcttcatctggagcagctacctgatccagcacaagaagacccacactggagagaagccctatgaatgtgacaagtgtgggaaggtgttcaggaacagaagtgccctgaccaagcatgagaggacccacacaggcatcaagccctatgagtgcaacaagtgtgggaaggccttctcctggaacagccacctgattgtgcacaagaggatccacactggagagaagccctacgtgtgcaatgaatgtgggaagagcttcaactggaacagccacctgattggccaccagaggacccacactggatag

SEQ ID NO: 176927 - DNA, 2523 bp, Artificial Sequence
  Description of Artificial Sequence: Synthetic coding sequence
atgaaggaggacaagagcagcatccgggaggccatcagcaaggccaagagcacagccaacatcaagacagagcaggagggggaggccagcgagaagagcctgcacctgagcccccagcacatcacccaccagaccatgcccatcggccagaggggcagcgagcagggcaagagggtggagaacatcaatggcaccagctaccccagcctgcagcagaagaccaatgctgtgaagaagctgcacaagtgtgatgaatgtgggaagagcttcaagtacaacagccggctggtgcagcacaagatcatgcacactggagagaagagatatgaatgtgatgactgtggcggcaccttccgcagcagcagcagcctgcgggtgcacaagaggatccacactggagagaagccctacaagtgtgaagaatgtgggaaggcctacatgagctacagcagcctcatcaaccacaagagcacccacagcggggagaagaactgcaagtgtgatgaatgtgggaagagcttcaactacagctctgtgctggaccagcacaagaggatccacactggagagaagccctatgaatgtggagaatgtgggaaggccttcaggaacagcagcggcctgcgggtgcacaagaggatccacactggagagaagccctatgaatgtgacatctgtgggaagaccttcagcaacagcagcggcctgcgggtgcacaagaggatccacactggagagaagccctatgaatgtgatgaatgtgggaaggccttcatcacctgcaggaccctgctgaaccacaagagcatccactttggagacaagccctacaagtgtgatgaatgtgagaagagcttcaactacagcagcctgctgatccagcacaaggtgatccacactggagagaagccctatgaatgtgatgaatgtgggaaggccttcaggaacagcagcggcctgattgtgcacaagaggatccacactggagagaagccctacaagtgtgatgtgtgtgggaaggccttctcctacagcagcggcctggccgtgcacaagagcatccaccctgggaagaaggcccacgagtgcaaggaatgtgggaagagcttctcctacaacagcctgctgctgcagcacaggaccatccacactggagagcggccctacgtgtgtgatgtgtgtgggaagaccttcagaaataatgccggcctgaaggtgcaccggcggctgcacactggagagaagccctacaagtgtgatgtgtgtgggaaggcctacatcagccgcagcagcctgaagaaccacaagggcatccacctgggggagaagccctacaagtgcagctactgtgagaagagcttcaactacagcagcgccctggagcagcacaagaggatccacacccgggagaagcccttcggctgtgatgaatgtgggaaggccttcaggaacaacagcggcctgaaggtgcacaagaggatccacactggagagcggccctacaagtgtgaagaatgtgggaaggcctacatcagcctgagcagcctcatcaaccacaagtctgtgcaccctggagagaagcccttcaagtgtgatgaatgtgagaaggccttcatcacctaccgcaccctgaccaaccacaagaaggtgcacctgggggagaagccctacaagtgtgatgtgtgtgagaagagcttcaactacaccagcctgctgagccagcaccggcgggtgcacacccgggagaagccctatgaatgtgacagatgtgagaaggtgttcaggaacaacagcagcctgaaggtgcacaagaggatccacactggagagcggccctatgaatgtgatgtgtgtgggaaggcctacatcagccacagcagcctcatcaaccacaagagcacccaccctggccgcaccccccacacctgtgatgaatgtgggaaggccttcttcagcagcaggaccctcatcagccacaagagggtgcacctgggggagaagcccttcaagtgtgtggagtgtgggaagagcttctcctacagcagcctgctgagccagcacaagaggatccacactggagagaagccctacgtgtgtgacagatgtgggaaggccttcaggaacagcagcggcctgactgtgcacaagaggatccacactggagagaagccctatgaatgtgatgaatgtgggaaggcctacatcagccacagcagcctcatcaaccacaagtctgtgcaccagggcaagcagccctacaactgtgaatgtgggaagagcttcaactacagatctgtgctggaccagcacaagaggatccacacaggcaagaagccctaccgctgcaatgaatgtgggaaggccttcaacatccgcagcaacctgaccaagcacaagaggacccacactggagaggagagcctgaatgtcatctacgtgggcagctacagcggcaccagccagaagaggacctatgaaggaggaaatgccctggatggcggccgcatgaggatgcccctgtag

SEQ ID NO: 176928 - DNA, 1497 bp, Artificial Sequence
  Description of Artificial Sequence: Synthetic coding sequence
atgagctacagcagcctcatcaaccacaagagcacccacagcggggagaagaactgcaagtgtgatgaatgtgggaagagcttcaactacagctctgtgctggaccagcacaagaggatccacactggagagaagccctatgaatgtggagaatgtgggaaggccttcaggaacagcagcggcctgcgggtgcacaagaggatccacactggagagaagccctatgaatgtgacatctgtgggaagaccttcagcaacagcagcggcctgcgggtgcacaagaggatccacactggagagaagccctatgaatgtgatgaatgtgggaaggccttcatcacctgcaggaccctgctgaaccacaagagcatccactttggagacaagccctacaagtgtgatgaatgtgggaaggccttcaggaacaacagcggcctgaaggtgcacaagaggatccacactggagagcggccctacaagtgtgaagaatgtgggaaggcctacatcagcctgagcagcctcatcaaccacaagtctgtgcaccctggagagaagcccttcaagtgtgatgaatgtgagaaggccttcatcacctaccgcaccctgaccaaccacaagaaggtgcacctgggggagaagccctacaagtgtgatgtgtgtgagaagagcttcaactacaccagcctgctgagccagcaccggcgggtgcacacccgggagaagccctatgaatgtgacagatgtgagaaggtgttcaggaacaacagcagcctgaaggtgcacaagaggatccacactggagagcggccctatgaatgtgatgtgtgtgggaaggcctacatcagccacagcagcctcatcaaccacaagagcacccaccctggccgcaccccccacacctgtgatgaatgtgggaaggccttcttcagcagcaggaccctcatcagccacaagagggtgcacctgggggagaagcccttcaagtgtgtggagtgtgggaagagcttctcctacagcagcctgctgagccagcacaagaggatccacactggagagaagccctacgtgtgtgacagatgtgggaaggccttcaggaacagcagcggcctgactgtgcacaagaggatccacactggagagaagccctatgaatgtgatgaatgtgggaaggcctacatcagccacagcagcctcatcaaccacaagtctgtgcaccagggcaagcagccctacaactgtgaatgtgggaagagcttcaactacagatctgtgctggaccagcacaagaggatccacacaggcaagaagccctaccgctgcaatgaatgtgggaaggccttcaacatccgcagcaacctgaccaagcacaagaggacccacactggagaggagagcctgaatgtcatctacgtgggcagctacagcggcaccagccagaagaggacctatgaaggaggaaatgccctggatggcggccgcatgaggatgcccctgtag

SEQ ID NO: 176929 - DNA, 2703 bp, Artificial Sequence
  Description of Artificial Sequence: Synthetic coding sequence
atgagccacctgaagaccagcacagaagatgaggagcccacagaggagtatgaaaatgtgggcaatgctgccagcaagtggcccaaggtggaggaccccatgcctgagagcaaggtgggggacacctgtgtgtgggacagcaaggtggagaaccagcagaagaagcctgtggagaacaggatgaaggaggacaagagcagcatccgggaggccatcagcaaggccaagagcacagccaacatcaagacagagcaggagggggaggccagcgagaagagcctgcacctgagcccccagcacatcacccaccagaccatgcccatcggccagaggggcagcgagcagggcaagagggtggagaacatcaatggcaccagctaccccagcctgcagcagaagaccaatgctgtgaagaagctgcacaagtgtgatgaatgtgggaagagcttcaagtacaacagccggctggtgcagcacaagatcatgcacactggagagaagagatatgaatgtgatgactgtggcggcaccttccgcagcagcagcagcctgcgggtgcacaagaggatccacactggagagaagccctacaagtgtgaagaatgtgggaaggcctacatgagctacagcagcctcatcaaccacaagagcacccacagcggggagaagaactgcaagtgtgatgaatgtgggaagagcttcaactacagctctgtgctggaccagcacaagaggatccacactggagagaagccctatgaatgtggagaatgtgggaaggccttcaggaacagcagcggcctgcgggtgcacaagaggatccacactggagagaagccctatgaatgtgacatctgtgggaagaccttcagcaacagcagcggcctgcgggtgcacaagaggatccacactggagagaagccctatgaatgtgatgaatgtgggaaggccttcatcacctgcaggaccctgctgaaccacaagagcatccactttggagacaagccctacaagtgtgatgaatgtgagaagagcttcaactacagcagcctgctgatccagcacaaggtgatccacactggagagaagccctatgaatgtgatgaatgtgggaaggccttcaggaacagcagcggcctgattgtgcacaagaggatccacactggagagaagccctacaagtgtgatgtgtgtgggaaggccttctcctacagcagcggcctggccgtgcacaagagcatccaccctgggaagaaggcccacgagtgcaaggaatgtgggaagagcttctcctacaacagcctgctgctgcagcacaggaccatccacactggagagcggccctacgtgtgtgatgtgtgtgggaagaccttcagaaataatgccggcctgaaggtgcaccggcggctgcacactggagagaagccctacaagtgtgatgtgtgtgggaaggcctacatcagccgcagcagcctgaagaaccacaagggcatccacctgggggagaagccctacaagtgcagctactgtgagaagagcttcaactacagcagcgccctggagcagcacaagaggatccacacccgggagaagcccttcggctgtgatgaatgtgggaaggccttcaggaacaacagcggcctgaaggtgcacaagaggatccacactggagagcggccctacaagtgtgaagaatgtgggaaggcctacatcagcctgagcagcctcatcaaccacaagtctgtgcaccctggagagaagcccttcaagtgtgatgaatgtgagaaggccttcatcacctaccgcaccctgaccaaccacaagaaggtgcacctgggggagaagccctacaagtgtgatgtgtgtgagaagagcttcaactacaccagcctgctgagccagcaccggcgggtgcacacccgggagaagccctatgaatgtgacagatgtgagaaggtgttcaggaacaacagcagcctgaaggtgcacaagaggatccacactggagagcggccctatgaatgtgatgtgtgtgggaaggcctacatcagccacagcagcctcatcaaccacaagagcacccaccctggccgcaccccccacacctgtgatgaatgtgggaaggccttcttcagcagcaggaccctcatcagccacaagagggtgcacctgggggagaagcccttcaagtgtgtggagtgtgggaagagcttctcctacagcagcctgctgagccagcacaagaggatccacactggagagaagccctacgtgtgtgacagatgtgggaaggccttcaggaacagcagcggcctgactgtgcacaagaggatccacactggagagaagccctatgaatgtgatgaatgtgggaaggcctacatcagccacagcagcctcatcaaccacaagtctgtgcaccagggcaagcagccctacaactgtgaatgtgggaagagcttcaactacagatctgtgctggaccagcacaagaggatccacacaggcaagaagccctaccgctgcaatgaatgtgggaaggccttcaacatccgcagcaacctgaccaagcacaagaggacccacactggagaggagagcctgaatgtcatctacgtgggcagctacagcggcaccagccagaagaggacctatgaaggaggaaatgccctggatggcggccgcatgaggatgcccctgtag

SEQ ID NO: 176930 - DNA, 483 bp, Artificial Sequence
  Description of Artificial Sequence: Synthetic coding sequence
atgcctgagagcaaggtgggggacacctgtgtgtgggacagcaaggtggagaaccagcagaagaagcctgtggagaacaggatgaaggaggacaagagcagcatccgggaggccatcagcaaggccaagagcacagccaacatcaagacagagcaggagggggaggccagcgagaagagcctgcacctgagcccccagcacatcacccaccagaccatgcccatcggccagaggggcagcgagcagggcaagagggtggagaacatcaatggcaccagctaccccagcctgcagcagaagaccaatgctgtgaagaagctgcacaagtgtgatgaatgtgggaagagcttcaagtacaacagccggctggtgcagcacaagatcatgcacactggagagaagagatatgaatgtgatgactgtggcggcaccttccgcagcagcagcagcctgcgggtgcacaagaggatccacactggatag

SEQ ID NO: 176931 - DNA, 315 bp, Artificial Sequence
  Description of Artificial Sequence: Synthetic coding sequence
atgcctgagagcaaggtgggggacacctgtgtgtgggacagcaaggtggagaaccagcagaagaagcctgtggagaacaggatgaaggaggacaagagcagcatccgggaggccatcagcaaggccaagagcacagccaacatcaagacagagcaggagggggaggccagcgagaagagcctgcacctgagcccccagcacatcacccaccagaccatgcccatcggccagaggggcagcgagcagggcaagagggtggagaacatcaatggcaccagctaccccagcctgcagcagaagaccaatgctgtgtag

SEQ ID NO: 176932 - DNA, 237 bp, Artificial Sequence
  Description of Artificial Sequence: Synthetic coding sequence
atgcctgagagcaaggtgggggacacctgtgtgtgggacagcaaggtggagaaccagcagaagaagcctgtggagaacaggatgaaggaggacaagagcagcatccgggaggccatcagcaaggccaagagcacagccaacatcaagacagagcaggagggggaggccagcgagaagagcctgcacctgagcccccagcacatcacccaccagaccatgcccatcggccagaggtag

SEQ ID NO: 176933 - DNA, 2604 bp, Artificial Sequence
  Description of Artificial Sequence: Synthetic coding sequence
atgcctgagagcaaggtgggggacacctgtgtgtgggacagcaaggtggagaaccagcagaagaagcctgtggagaacaggatgaaggaggacaagagcagcatccgggaggccatcagcaaggccaagagcacagccaacatcaagacagagcaggagggggaggccagcgagaagagcctgcacctgagcccccagcacatcacccaccagaccatgcccatcggccagaggggcagcgagcagggcaagagggtggagaacatcaatggcaccagctaccccagcctgcagcagaagaccaatgctgtgaagaagctgcacaagtgtgatgaatgtgggaagagcttcaagtacaacagccggctggtgcagcacaagatcatgcacactggagagaagagatatgaatgtgatgactgtggcggcaccttccgcagcagcagcagcctgcgggtgcacaagaggatccacactggagagaagccctacaagtgtgaggagtgtgggaaggcctacatgagctacagcagcctcatcaaccacaagagcacccacagcggggagaagaactgcaagtgtgatgaatgtgggaagagcttcaactacagctctgtgctggaccagcacaagaggatccacactggagagaagccctatgaatgtggggagtgtgggaaggccttcaggaacagcagcggcctgcgggtgcacaagaggatccacactggagagaagccctatgaatgtgacatctgtgggaagaccttcagcaacagcagcggcctgcgggtgcacaagaggatccacactggagagaagccctatgaatgtgatgaatgtgggaaggccttcatcacctgcaggaccctgctgaaccacaagagcatccactttggagacaagccctacaagtgtgatgaatgtgagaagagcttcaactacagcagcctgctgatccagcacaaggtgatccacactggagagaagccctatgaatgtgatgaatgtgggaaggccttcaggaacagcagcggcctcatcgtgcacaagaggatccacactggagagaagccctacaagtgtgatgtgtgtgggaaggccttctcctacagcagcggcctggccgtgcacaagagcatccaccctgggaagaaggcccacgagtgcaaggaatgtgggaagagcttctcctacaacagcctgctgctgcagcacaggaccatccacactggagagcggccctacgtgtgtgatgtgtgtgggaagaccttcaggaacaatgccggcctgaaggtgcaccggcggctgcacactggagagaagccctacaagtgtgatgtgtgtgggaaggcctacatcagccgcagcagcctgaagaaccacaagggcatccacctgggggagaagccctacaagtgcagctactgtgagaagagcttcaactacagcagcgccctggagcagcacaagaggatccacacccgggagaagcccttcggctgtgatgaatgtgggaaggccttcaggaacaacagcggcctgaaggtgcacaagaggatccacactggagagcggccctacaagtgtgaggagtgtgggaaggcctacatcagcctgagcagcctcatcaaccacaagtctgtgcaccctggagagaagcccttcaagtgtgatgaatgtgagaaggccttcatcacctaccgcaccctgaccaaccacaagaaggtgcacctgggggagaagccctacaagtgtgatgtgtgtgagaagagcttcaactacaccagcctgctgagccagcacagaagagtgcacacccgggagaagccctatgaatgtgacagatgtgagaaggtgttcaggaacaacagcagcctgaaggtgcacaagaggatccacactggagagcggccctatgaatgtgatgtgtgtgggaaggcctacatcagccacagcagcctcatcaaccacaagagcacccaccctggccgcaccccccacacctgtgatgaatgtgggaaggccttcttcagcagcaggaccctcatcagccacaagagggtgcacctgggggagaagcccttcaagtgtgtggagtgtgggaagagcttctcctacagcagcctgctgagccagcacaagaggatccacactggagagaagccctacgtgtgtgacagatgtgggaaggccttcaggaacagcagcggcctgactgtgcacaagaggatccacactggagagaagccctatgaatgtgatgaatgtgggaaggcctacatcagccacagcagcctcatcaaccacaagtctgtgcaccagggcaagcagccctacaactgtgaatgtgggaagagcttcaactacagatctgtgctggaccagcacaagaggatccacacaggcaagaagccctaccgctgcaatgaatgtgggaaggccttcaacatccgcagcaacctgaccaagcacaagaggacccacactggagaggagagcctgaatgtcatctacgtgggcagctacagcggcaccagccagaagaggacctatgagggcggcaatgccctggatggcggccgcatgaggatgcccctgtag

SEQ ID NO: 176934 - DNA, 1386 bp, Artificial Sequence
  Description of Artificial Sequence: Synthetic coding sequence
atggattctgtggcctttgaagatgtggccgtgaacttcaccctggaggagtgggccctgctggaccccagccagaagaacctgtacagagatgtgatgagggagaccttcaggaacctggcctctgtgggcaagcagtgggaggaccagaacatcgaggaccccttcaagatccccaggaggaacatcagccacatccctgagcggctgtgtgagagcaaggagggcggccagggcgaggagaccttcagccagatcccagatggcatcctgaacaagaagaccccaggagtgaagccctgtgagagctctgtgtgtggggaggtgggcatgggccccagcagcctgaacagacacatccgggaccacacaggccgggagcccaatgagtaccaggagtatggcaagaagagctacaccaggaaccagtgtggccgggccctgagctaccaccgctccttccctgtgcgggagaggacccaccctgggggcaagccctatgactgcaaggaatgtggggagaccttcatcagcctggtgtccatcagaagacacatgctgacccacagaggaggagtgccctacaagtgcaaggtgtgtgggaaggcctttgactaccccagcctcttccgcatccacgagaggagccacactggagagaagccctatgagtgcaagcagtgtgggaaggccttcagctgcagcagctacatccgcatccacgagaggacccacactggagacaagccctatgagtgcaagcagtgtgggaaggccttcagctgcagcaagtacatccgcatccacgagaggacccacactggagagaagccctatgagtgcaagcagtgtgggaaggccttccgctgtgccagctctgtgcgcagccatgagaggacccacactggagagaagctgtttgagtgcaaggaatgtgggaaggccctgacctgcctggcctctgtgagaagacacatgatcaagcacactggaaatggcccctacaagtgcaaggtgtgtgggaaggcctttgacttccccagcagcttccgcatccacgagaggacccacactggagagaagccctatgactgcaagcagtgtgggaaggccttcagctgcagcagcagcttcaggaagcatgagcgcatccacactggagagaagccctacaagtgcaccaagtgtgggaaggccttcagccgcagcagctacttccgcatccacgagaggacccacactggagagaagccctatgagtgcaagcagtgtgggaaggccttcagccgcagcacctacttccgggtgcatgagaagatccacactggagagaagccctatgagaaccccaaccccaatgcctctgtggtgcctgtgctgtcctag

SEQ ID NO: 176935 - DNA, 3168 bp, Artificial Sequence
  Description of Artificial Sequence: Synthetic coding sequence
atggtgggcagccacgccgacatggccccagccagcacagctgagggcgctggggagaagccaggccctgctgccccagccccagctgcccagtatgaatgtggggagtgtgggaagagcttccgctggagcagccggctgctgcaccaccagaggacccacactggagagcggccctacaagtgcccagactgccccaaggccttcaagggcagcagcgccctgctgtaccaccagaggggccacactggagagcggccctaccagtgcccagactgccccaaggccttcaagaggagcagcctgctgcagatccacaggtctgtgcacacaggcctgcgggccttcatctgtggccagtgtggcctggccttcaagtggagcagccactaccagtaccacctgcggcagcacactggagagcggccctacccctgcccagactgccccaaggccttcaagaacagcagcagcctgcggcggcaccgccacgtgcacactggagagcggccctacacctgtggggtgtgtgggaagagcttcacccagagcaccaacctgcggcagcaccagagggtgcacactggagagcggcccttccgctgccccctgtgccccaagaccttcacccacagcagcaacctgctgctgcaccagaggacccacggggccgccccagcccctggaacagccagcgctgcccccccaccccagagccgggagcccgggaaggtgtttgtgtgtgatgcctacctgcagaggcacctgcagccccacagccccccagcccccccagcccctcctcctcctcctcctcctgtggtgcctgagctgttcctggccgctgctgagaccaccgtggagctggtgtaccgctgtgatggctgtgagcagggcttcagcagcgaggagctgctgctggagcaccagccctgccccggcccagatgctgccccccagccccaggaggccccagctgaggcccccaaggctgaccagccccccagccccctgccccagcccccacctcctgctgctgccccagcccctggctttgcctgcctgccctgtgggaagagcttcagaacagtggccggcctgagccgccaccagcacagccacggggctgctgggggccaggccttccgctgtggcagctgtgatggcagcttcccccagctggccagcctgctggcccaccagcagtgccacgtggaggaggccgccgccggccggcccccaccccaggccgaggccgctgaggtgacctgcccccaggagcccctggccccagctgcccctgtgcccccacctcctccttctgccccagccagcgctgagcggccctacaagtgtgccgagtgtgggaagagcttcaagggcagcagcggcctgcgctaccacctgcgggaccacactggagagcggccctaccagtgtggggagtgtgggaaggccttcaagaggagcagcctgctggccatccaccagagggtgcacacaggcctgcgggccttcacctgtggccagtgtggcctgaccttcaagtggagcagccactaccagtaccacctgcggctgcacagcggggagcggccctatgcctgtggggagtgtgggaaggccttcaggaacaccagctgcctgcggcggcaccgccacgtgcacactggagagcggccccacgcctgtggggtgtgtgggaagagctttgcccagaccagcaacctgcggcagcaccagagggtgcacactggagagcggcccttccgctgccccctgtgccccaagaccttcacccacagcagcaacctgctgctgcaccagaggacccacagcgctgagcggcccttcacctgccccatctgtggccggggctttgtgatggccgcctacctgcagaggcacctgcggacccacgccccagccaacaccccacccagcaccacagccccagctgctggcccccagcccccagcccccctggccgccgcccgggcccccccagccacccaggatgtgcacgtgctgccccacctgcaggccaccctgagcctggaggtggccggcggcacagcccaggcccccagcctgggccctgctgcccccaacagccagaccttcctgctggtgcagacagcccagggcctgcagctgatccccagctctgtgcagccccccaccccacctcctcctccagccccacccaagctgatcctgctgcccagcagcagcgctggggccggcggcggccgggcccggcagggccccagggctgtgggcaaggccggccagggcgccggcgtggtgtggctgcccggccctgggggcctgggcgtgcagggcgccgccagcgctggggccagcggcaccggccagagcctcatcgtgctgcagaatgtgggcggcggggaggccggcccccaggagatgtctggagtgcagctgcagcccctgcggcctgcccctgaggtgaccaccgtgcagctgcagcctgcccaggaggtgaccaccgtgcagctgcagcctgcccaggaggtgaccaccgtgcagctgcagcctgcccaggaggtgaccaccgtgcagctgcagcctgtggccggccagctgagcaacagcagcggcggcgctgtggccacagaggcccccaacctgctggtggtgcagagcggggctgctgaggagctgctgaccggccctggccctggagaggccggagatggagaggccagcactggagtggtgcaggatgtgctgtttgagaccctgcagacagatgagggcctgcagagcgtgctggtgctgagcggggctgatggagagcagacccggctgtgtgtgcaggaggtggagaccctgcccccaggcctgacagagcccccagccactggacctcctggccagaagctgctgatcatccgcagcgccccagccacagagctgctggacagcagcaacacaggaggcggcacagccaccctgcagctgctggcccccccacccagcggccctgccagcggccctgctggcctgcccggggccccagccagccagatggtgcaggtggtgcctgctggagctggccctggggtgatgaccccccagggcctgcccagcatccagatcgtgcagaccctgcctgctgtgcagctggtgcacaccttctag

SEQ ID NO: 176936 - DNA, 1602 bp, Artificial Sequence
  Description of Artificial Sequence: Synthetic coding sequence
atggaccgctaccagggcaaccaggacagagtgctgcggcaggtgaccgtcatcagccgggagaccctgacagatgagatgggcagcaagtacagcgccttcggcaagatgttcaaccgctgcacagacctggcccccctgagccagaagttccacaagtttgacagctgtgagaacagcctgaagagcaacagcgacctgctgaactacaacagaagctatgccaggaagaaccccaccaagcgcttccgctgtggccggccccccaagtacaatgccagctgcagcgtgcctgagaaggagggcttcatccacacaggcatggagccctatggagacagccagtgtgagaaggtgctgagccacaagcaggcccacgtgcagtacaagaagttccaggcccgggagaagcccaacgtgtgcagcatgtgtgggaaggccttcatcaagaagagccagctgatcatccaccagaggatccacactggagagaagccctacgtgtgtggggactgcaggaaggccttcagcgagaagagccacctgattgtgcaccagaggatccacactggagagaagccctatgagtgcaccaagtatggccgggccttcagcaggaagagccccttcaccgtgcaccagagggtgcacactggagagaagccctatgagtgctttgaatgtcccaaggccttcagccagaagagccacctgatcatccaccagagggtgcacacccgggagaagccctttgagtgcagtgaatgtaggaaggccttctgtgagatgagccacctgttcatccaccagatcacccacacaggcaagaagccctatgagtgcacagaatgtgggaagaccttccccaggaagacccagctgatcatccaccagaggacccacactggagagaagccctacaagtgtggagaatgtgggaagaccttctgccagcagagccacctgattggccaccagaggatccacactggagagaagccctacgtgtgcacagactgtgggaaggccttcagccagaagagccacctgaccggccaccagaggctgcacactggagagaagccctacatgtgcacagaatgtgggaagagcttcagccagaagagccccctcatcatccaccagaggatccacactggagagaagccctaccagtgtggagaatgtgggaagaccttcagccagaagagcctgctgatcatccacctgcgggtgcacactggagagaagccctatgagtgcacagaatgtggccgggccttcagcctgaagagccacctgatcctgcaccagaggggccacactggagagaagccctatgagtgcagtgaatgtgggaaggccttctgtgggaagagccccctcatcatccaccagaagacccacccccgggagaagaccccagaatgtgccgagagcggcatgaccttcttctggaagagccagatgatcacctaccagaggaggcacactggagagaagcccagccgctgcagcgactgtgggaaggccttctgccagcacgtgtacttcaccggccaccagaacccctacaggaaggacaccctgtacatctgctag

SEQ ID NO: 176937 - DNA, 1974 bp, Artificial Sequence
  Description of Artificial Sequence: Synthetic coding sequence
atgattgagagccaggagcctgtgacctttgaagatgtggccgtggacttcacccaggaggagtggcagcagctgaacccagcccagaagaccctgcacagagatgtgatgctggagacctacaaccacctggtgtctgtgggctgcagcggcatcaagccagatgtgatcttcaagctggagcacggcaaggacccctggatcattgaaagtgagctgagccgctggatctacccagacagagtgaagggcctggagagcagccagcagatcatctctggagagctgctcttccagcgggagatcctggagcgggcccccaaggacaacagcctgtacagcgtgctgaagatctggcacatcgacaaccagatggaccgctaccagggcaaccaggacagagtgctgcggcaggtgaccgtcatcagccgggagaccctgacagatgagatgggcagcaagtacagcgccttcggcaagatgttcaaccgctgcacagacctggcccccctgagccagaagttccacaagtttgacagctgtgagaacagcctgaagagcaacagcgacctgctgaactacaacagaagctatgccaggaagaaccccaccaagcgcttccgctgtggccggccccccaagtacaatgccagctgcagcgtgcctgagaaggagggcttcatccacacaggcatggagccctatggagacagccagtgtgagaaggtgctgagccacaagcaggcccacgtgcagtacaagaagttccaggcccgggagaagcccaacgtgtgcagcatgtgtgggaaggccttcatcaagaagagccagctgatcatccaccagaggatccacactggagagaagccctacgtgtgtggggactgcaggaaggccttcagcgagaagagccacctgattgtgcaccagaggatccacactggagagaagccctatgagtgcaccaagtatggccgggccttcagcaggaagagccccttcaccgtgcaccagagggtgcacactggagagaagccctatgagtgctttgaatgtcccaaggccttcagccagaagagccacctgatcatccaccagagggtgcacacccgggagaagccctttgagtgcagtgaatgtaggaaggccttctgtgagatgagccacctgttcatccaccagatcacccacacaggcaagaagccctatgagtgcacagaatgtgggaagaccttccccaggaagacccagctgatcatccaccagaggacccacactggagagaagccctacaagtgtggagaatgtgggaagaccttctgccagcagagccacctgattggccaccagaggatccacactggagagaagccctacgtgtgcacagactgtgggaaggccttcagccagaagagccacctgaccggccaccagaggctgcacactggagagaagccctacatgtgcacagaatgtgggaagagcttcagccagaagagccccctcatcatccaccagaggatccacactggagagaagccctaccagtgtggagaatgtgggaagaccttcagccagaagagcctgctgatcatccacctgcgggtgcacactggagagaagccctatgagtgcacagaatgtggccgggccttcagcctgaagagccacctgatcctgcaccagaggggccacactggagagaagccctatgagtgcagtgaatgtgggaaggccttctgtgggaagagccccctcatcatccaccagaagacccacccccgggagaagaccccagaatgtgccgagagcggcatgaccttcttctggaagagccagatgatcacctaccagaggaggcacactggagagaagcccagccgctgcagcgactgtgggaaggccttctgccagcacgtgtacttcaccggccaccagaacccctacaggaaggacaccctgtacatctgctag

SEQ ID NO: 176938 - DNA, 645 bp, Artificial Sequence
  Description of Artificial Sequence: Synthetic coding sequence
atgattgagagccaggagcctgtgacctttgaagatgtggccgtggacttcacccaggaggagtggcagcagctgaacccagcccagaagaccctgcacagagatgtgatgctggagacctacaaccacctggtgtctgtgggctgcagcggcatcaagccagatgtgatcttcaagctggagcacggcaaggacccctggatcattgaaagtgagctgagccgctggatctacccagacagagtgaagggcctggagagcagccagcagatcatctctggagagctgctcttccagcgggagatcctggagcgggcccccaaggacaacagcctgtacagcgtgctgaagatctggcacatcgacaaccagatggaccgctaccagggcaaccaggacagagtgctgcggcaggtgaccgtcatcagccgggagaccctgacagatgagatgggcagcaagtacagcgccttcggcaagatgttcaaccgctgcacagacctggcccccctgagccagaagttccacaagtttgacagctgtgagaacagcctgaagagcaacagcgacctgctgaactacaacagaagctatgccaggaagaaccccaccaagcgcttccgctgtggccggccccccaagtag

SEQ ID NO: 176939 - DNA, 1932 bp, Artificial Sequence
  Description of Artificial Sequence: Synthetic coding sequence
atgattgagagccaggaggagtggcagcagctgaacccagcccagaagaccctgcacagagatgtgatgctggagacctacaaccacctggtgtctgtgggctgcagcggcatcaagccagatgtgatcttcaagctggagcacggcaaggacccctggatcattgaaagtgagctgagccgctggatctacccagacagagtgaagggcctggagagcagccagcagatcatctctggagagctgctcttccagcgggagatcctggagcgggcccccaaggacaacagcctgtacagcgtgctgaagatctggcacatcgacaaccagatggaccgctaccagggcaaccaggacagagtgctgcggcaggtgaccgtcatcagccgggagaccctgacagatgagatgggcagcaagtacagcgccttcggcaagatgttcaaccgctgcacagacctggcccccctgagccagaagttccacaagtttgacagctgtgagaacagcctgaagagcaacagcgacctgctgaactacaacagaagctatgccaggaagaaccccaccaagcgcttccgctgtggccggccccccaagtacaatgccagctgcagcgtgcctgagaaggagggcttcatccacacaggcatggagccctatggagacagccagtgtgagaaggtgctgagccacaagcaggcccacgtgcagtacaagaagttccaggcccgggagaagcccaacgtgtgcagcatgtgtgggaaggccttcatcaagaagagccagctgatcatccaccagaggatccacactggagagaagccctacgtgtgtggggactgcaggaaggccttcagcgagaagagccacctgattgtgcaccagaggatccacactggagagaagccctatgagtgcaccaagtatggccgggccttcagcaggaagagccccttcaccgtgcaccagagggtgcacactggagagaagccctatgagtgctttgaatgtcccaaggccttcagccagaagagccacctgatcatccaccagagggtgcacacccgggagaagccctttgagtgcagtgaatgtaggaaggccttctgtgagatgagccacctgttcatccaccagatcacccacacaggcaagaagccctatgagtgcacagaatgtgggaagaccttccccaggaagacccagctgatcatccaccagaggacccacactggagagaagccctacaagtgtggagaatgtgggaagaccttctgccagcagagccacctgattggccaccagaggatccacactggagagaagccctacgtgtgcacagactgtgggaaggccttcagccagaagagccacctgaccggccaccagaggctgcacactggagagaagccctacatgtgcacagaatgtgggaagagcttcagccagaagagccccctcatcatccaccagaggatccacactggagagaagccctaccagtgtggagaatgtgggaagaccttcagccagaagagcctgctgatcatccacctgcgggtgcacactggagagaagccctatgagtgcacagaatgtggccgggccttcagcctgaagagccacctgatcctgcaccagaggggccacactggagagaagccctatgagtgcagtgaatgtgggaaggccttctgtgggaagagccccctcatcatccaccagaagacccacccccgggagaagaccccagaatgtgccgagagcggcatgaccttcttctggaagagccagatgatcacctaccagaggaggcacactggagagaagcccagccgctgcagcgactgtgggaaggccttctgccagcacgtgtacttcaccggccaccagaacccctacaggaaggacaccctgtacatctgctag

SEQ ID NO: 176940 - DNA, 5937 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggccccttcatgaggcctggctccatgggcctgccccgcttctacccagctggccgggcccggggcatcccccacagatttgctggccacgagagctaccagaacatgggcccccagaggatgaatgtgcaggtgacccagcacaggacagacccccggctgaccaaggagaagctggacttccacgaggcccagcagaagaagggcaagccccacggcagccgctgggatgatgagccccacatcagcgcctctgtggccgtgaagcagagctctgtgacccaggtgacagagcagagccccaaggtgcagagccgctacaccaaggagagcgccagcagcatcctggccagctttggcctgagcaatgaagacctggaggagctgagccgctacccagatgagcagctgaccccagagaacatgcccctcatcctgcgggacatccgcatgaggaagatgggccggcggctgcccaacctgcccagccagagcaggaacaaggagaccctgggcagcgaggccgtgagcagcaatgtgattgattatggccacgccagcaaatatggctacacagaggaccccctggaggtgcgcatctatgaccctgagatccccacagatgaggtggagaatgagttccagagccagcagaacatcagcgcctctgtgcccaaccccaacgtcatctgcaacagcatgtttcctgtggaggatgtgttccggcagatggacttccctggagagagcagcaacaacagaagcttcttctctgtggagagcggcaccaagatgagcggcctgcacatcagcggcggccagagcgtgctggagcccatcaagtctgtgaaccagagcatcaaccagacagtgtcccagaccatgagccagagcctcatccccccatccatgaaccagcagcccttcagcagcgagctgatcagctctgtgtcccagcaggagcgcatcccccatgagcctgtgatcaacagcagcaatgtgcacgtgggcagccggggcagcaagaagaactaccagagccaggccgacatccccatccgcagcccctttggaattgtgaaggcctcctggctgcccaagttcagccatgctgatgcccagaagatgaagaggctgcccacccccagcatgatgaatgactactatgctgccagcccccgcatcttcccccacctgtgcagcctgtgcaatgtggagtgcagccacctgaaggactggatccagcaccagaacaccagcacccacatcgagagctgccggcagctgcggcagcagtacccagactggaaccctgagatcctgcccagcagaagaaatgaaggcaacagaaaagaaaatgagaccccaagaagaagaagccacagccccagcccccggcgcagcagaagaagcagcagcagccaccgcttccgccgcagccgcagccccatgcactacatgtaccggcccaggagccgcagcccccgcatctgccaccgcttcatcagccgctaccgcagccgcagccgcagccgcagcccctaccgcatccggaaccccttccggggcagccccaagtgcttccgctctgtgtccccagagaggatgagccgccgctctgtgcgcagcagtgacaggaagaaggccctggaggatgtggtgcagaggagcggccatggaacagagttcaacaagcagaagcacctggaggccgctgacaagggccacagccctgcccagaagcccaagaccagcagcggcaccaagcccagcgtgaagcccaccagcgccaccaagagtgacagcaacctgggcggccacagcatccgctgcaagagcaagaacctggaggatgacaccctgtctgagtgcaagcaggtgtctgacaaggctgtgtccctgcagaggaagctgaggaaggagcagagcctgcactacggctctgtgctgctgatcacagagctgcctgaagatggctgcacagaagaagatgtgaggaagctgttccagccctttgggaaggtgaatgatgtgctgattgtgccctacaggaaggaggcctacctggagatggagttcaaggaggccatcacagccatcatgaagtacatcgagaccacccccctgaccatcaagggcaagtctgtgaagatctgtgtgcctgggaagaagaaggcccagaacaaggaggtgaagaagaagaccctggagagcaagaaggtgtctgccagcaccctgaagagagatgctgatgccagcaaggctgtggagatcgtgaccagcaccagcgctgccaagacaggccaggccaaggcctctgtggccaaggtgaacaagagcacaggcaagagcgccagctctgtgaagtctgtggtgacagtggccgtgaagggcaacaaggccagcatcaagacagccaagagcggcggcaagaagagcctggaggccaagaagacaggaaatgtgaagaacaaggacagcaacaagcctgtgaccatcccagaaaattctgagatcaagaccagcattgaggtgaaggccacagagaactgtgccaaggaggccatcagtgatgctgccctggaggccacagaaaatgagcccctgaacaaggagacagaggagatgtgtgtgatgctggtgagcaacctgcccaacaagggctacagcgtggaggaggtgtatgacctggccaagccctttggaggcctgaaggacatcctgatcctgagcagccacaagaaggcctacatcgagatcaacaggaaggctgctgagagcatggtgaagttctacacctgcttccctgtgctgatggatggcaaccagctgagcatctccatggcccctgagaacatgaacatcaaggatgaggaggccatcttcatcaccctggtgaaggaaaatgaccctgaggccaacatcgacaccatctatgacagatttgtgcacctggacaacctgcctgaagatggcctgcagtgtgtgctgtgtgtgggcctgcagtttgggaaggtggaccaccacgtgttcatcagcaacagaaacaaggccatcctgcagctggacagccctgagagcgcccagagcatgtacagcttcctgaagcagaacccccagaacatcggggaccacatgctgacctgcagcctgagccccaagattgacctgcctgaggtgcagatcgagcatgaccctgagctggagaaggagagccctggcctgaagaacagccccattgatgaaagtgaggtgcagacagccacagacagccccagcgtgaagcccaatgagctggaggaggagagcacccccagcatccagacagagaccctggtgcagcaggaggagccctgtgaggaggaggccgagaaggccacctgtgacagcgactttgctgtggagaccctggagctggagacccagggcgaggaggtgaaggaggagatccccctggtggccagcgcctctgtgtccattgagcagttcacagaaaatgcagaagaatgtgccctgaaccagcagatgttcaacagcgacctggagaagaagggagctgagatcatcaaccccaagacagccctgctgcccagcgacagcgtgtttgctgaggagaggaacctgaagggcatcctggaggagagccccagcgaggccgaggacttcatcagcggcatcacccagaccatggtggaggccgtggccgaggtggagaagaatgagaccgtgtctgagatcctgcccagcacctgcatcgtgaccctggtgcccggcatccccactggagatgagaagacagtggacaagaagaacatcagcgagaagaagggcaacatggatgagaaggaggagaaggagttcaacaccaaggagaccaggatggacctgcagatcggcacagagaaggccgagaagaatgaaggaaggatggatgctgagaaggtggagaagatggccgccatgaaggagaagccagctgagaacaccctcttcaaggcctaccccaacaagggcgtgggccaggccaacaagccagatgagaccagcaagaccagcatcctggccgtgtctgatgtgagcagcagcaagcccagcatcaaggccgtcatcgtgagcagccccaaggccaaggccaccgtgtccaagacagagaaccagaagagcttccccaagtctgtgccccgggaccagatcaatgctgagaagaagctgagcgccaaggagtttggcctgctgaagcccaccagcgcccggagcggcctggccgagagcagcagcaagttcaagcccacccagagcagcctgacccggggcggcagcggccgcatcagcgccctgcagggcaagctgagcaagctggactacagagacatcaccaagcagagccaggagacagaggcccggcccagcatcatgaagagagatgacagcaacaacaagaccctggccgagcagaacaccaagaaccccaagagcaccaccggccgcagcagcaagagcaaggaggagcccctcttccccttcaacctggatgaatttgtgacagtggatgaagtcatcgaggaggtgaaccccagccaggccaagcagaaccccctgaagggcaagaggaaggagaccctgaagaatgtgcccttcagcgagctgaacctgaagaagaagaagggcaagaccagcaccccccggggcgtggagggggagctgagctttgtgaccctggatgagatcggggaggaggaggatgctgctgcccacctggcccaggccctggtgacagtggatgaggtgattgatgaggaggagctgaacatggaggagatggtgaagaacagcaacagcctcttcaccctggatgagctgattgaccaggatgactgcatcagccacagcgagcccaaggatgtgacagtgctgtctgtggccgaggagcaggacctgctgaagcaggagcggctggtgacagtggatgagatcggggaggtggaggagctgcccctgaatgaatctgctgacatcacctttgccaccctgaacaccaagggaaatgaaggagacacagtgcgggacagcatcggcttcatcagcagccaggtgcctgaggaccccagcaccctggtgacagtggatgagatccaggatgacagcagtgacctgcacctggtgaccctggatgaggtgacagaagaagatgaggacagcctggccgacttcaacaacctgaaggaggagctgaactttgtgacagtggatgaggtgggggaggaggaggatggagacaatgacctgaaggtggagctggcccagagcaagaatgaccaccccacagacaagaagggcaacaggaagaagagagctgtggacaccaagaagaccaagctggagagcctgagccaggtgggccctgtgaatgaaaatgtgatggaggaggacctgaagaccatgattgagcggcacctgacagccaagacccccaccaagagggtgcgcatcggcaagaccctgcccagcgagaaggctgtggtgacagagcccgccaagggggaggaggccttccagatgtctgaggtggatgaggagagcggcctgaaggacagcgagcctgagaggaagaggaagaagacagaggacagcagcagcggcaagtctgtggccagtgatgtgcctgaggagctggacttcctggtgcccaaggccggcttcttctgccccatctgcagcctcttctacagcggggagaaggccatgaccaaccactgcaagagcaccaggcacaagcagaacacagagaagttcatggccaagcagaggaaggagaaggagcagaatgaggccgaggagaggagcagcaggtag

SEQ ID NO: 176941 - DNA, 3420 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggccccttcatgaggcctggctccatgggcctgccccgcttctacccagctggccgggcccggggcatcccccacagatttgctggccacgagagctaccagaacatgggcccccagaggatgaatgtgcaggtgacccagcacaggacagacccccggctgaccaaggagaagctggacttccacgaggcccagcagaagaagggcaagccccacggcagccgctgggatgatgagccccacatcagcgcctctgtggccgtgaagcagagctctgtgacccaggtgacagagcagagccccaaggtgcagagccgctacaccaaggagagcgccagcagcatcctggccagctttggcctgagcaatgaagacctggaggagctgagccgctacccagatgagcagctgaccccagagaacatgcccctcatcctgcgggacatccgcatgaggaagatgggccggcggctgcccaacctgcccagccagagcaggaacaaggagaccctgggcagcgaggccgtgagcagcaatgtgattgattatggccacgccagcaaatatggctacacagaggaccccctggaggtgcgcatctatgaccctgagatccccacagatgaggtggagaatgagttccagagccagcagaacatcagcgcctctgtgcccaaccccaacgtcatctgcaacagcatgtttcctgtggaggatgtgttccggcagatggacttccctggagagagcagcaacaacagaagcttcttctctgtggagagcggcaccaagatgagcggcctgcacatcagcggcggccagagcgtgctggagcccatcaagtctgtgaaccagagcatcaaccagacagtgtcccagaccatgagccagagcctcatccccccatccatgaaccagcagcccttcagcagcgagctgatcagctctgtgtcccagcaggagcgcatcccccatgagcctgtgatcaacagcagcaatgtgcacgtgggcagccggggcagcaagaagaactaccagagccaggccgacatccccatccgcagcccctttggaattgtgaaggcctcctggctgcccaagttcagccatgctgatgcccagaagatgaagaggctgcccacccccagcatgatgaatgactactatgctgccagcccccgcatcttcccccacctgtgcagcctgtgcaatgtggagtgcagccacctgaaggactggatccagcaccagaacaccagcacccacatcgagagctgccggcagctgcggcagcagtacccagactggaaccctgagatcctgcccagcagaagaaatgaaggcaacagaaaagaaaatgagaccccaagaagaagaagccacagccccagcccccggcgcagcagaagaagcagcagcagccaccgcttccgccgcagccgcagccccatgcactacatgtaccggcccaggagccgcagcccccgcatctgccaccgcttcatcagccgctaccgcagccgcagccgcagccgcagcccctaccgcatccggaaccccttccggggcagccccaagtgcttccgctctgtgtccccagagaggatgagccgccgctctgtgcgcagcagtgacaggaagaaggccctggaggatgtggtgcagaggagcggccatggaacagagttcaacaagcagaagcacctggaggccgctgacaagggccacagccctgcccagaagcccaagaccagcagcggcaccaagcccagcgtgaagcccaccagcgccaccaagagtgacagcaacctgggcggccacagcatccgctgcaagagcaagaacctggaggatgacaccctgtctgagtgcaagcaggtgtctgacaaggctgtgtccctgcagaggaagctgaggaaggagcagagcctgcactacggctctgtgctgctgatcacagagctgcctgaagatggctgcacagaagaagatgtgaggaagctgttccagccctttgggaaggtgaatgatgtgctgattgtgccctacaggaaggaggcctacctggagatggagttcaaggaggccatcacagccatcatgaagtacatcgagaccacccccctgaccatcaagggcaagtctgtgaagatctgtgtgcctgggaagaagaaggcccagaacaaggaggtgaagaagaagaccctggagagcaagaaggtgtctgccagcaccctgaagagagatgctgatgccagcaaggctgtggagatcgtgaccagcaccagcgctgccaagacaggccaggccaaggcctctgtggccaaggtgaacaagagcacaggcaagagcgccagctctgtgaagtctgtggtgacagtggccgtgaagggcaacaaggccagcatcaagacagccaagagcggcggcaagaagagcctggaggccaagaagacaggaaatgtgaagaacaaggacagcaacaagcctgtgaccatcccagaaaattctgagatcaagaccagcattgaggtgaaggccacagagaactgtgccaaggaggccatcagtgatgctgccctggaggccacagaaaatgagcccctgaacaaggagacagaggagatgtgtgtgatgctggtgagcaacctgcccaacaagggctacagcgtggaggaggtgtatgacctggccaagccctttggaggcctgaaggacatcctgatcctgagcagccacaagaaggcctacatcgagatcaacaggaaggctgctgagagcatggtgaagttctacacctgcttccctgtgctgatggatggcaaccagctgagcatctccatggcccctgagaacatgaacatcaaggatgaggaggccatcttcatcaccctggtgaaggaaaatgaccctgaggccaacatcgacaccatctatgacagatttgtgcacctggacaacctgcctgaagatggcctgcagtgtgtgctgtgtgtgggcctgcagtttgggaaggtggaccaccacgtgttcatcagcaacagaaacaaggccatcctgcagctggacagccctgagagcgcccagagcatgtacagcttcctgaagcagaacccccagaacatcggggaccacatgctgacctgcagcctgagccccaagattgacctgcctgaggtgcagatcgagcatgaccctgagctggagaaggagcggctgtggctgagcaagaccctgcgcatcctgaaggccctgctggtggaggtgcccaacctgaagaggagccactacttccacctgatctggatgaacctgctgctgtggatgaggctgtag

SEQ ID NO: 176942 - DNA, 2445 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggccccttcatgaggcctggctccatgggcctgccccgcttctacccagctggccgggcccggggcatcccccacagatttgctggccacgagagctaccagaacatgggcccccagaggatgaatgtgcaggtgacccagcacaggacagacccccggctgaccaaggagaagctggacttccacgaggcccagcagaagaagggcaagccccacggcagccgctgggatgatgagccccacatcagcgcctctgtggccgtgaagcagagctctgtgacccaggtgacagagcagagccccaaggtgcagagccgctacaccaaggagagcgccagcagcatcctggccagctttggcctgagcaatgaagacctggaggagctgagccgctacccagatgagcagctgaccccagagaacatgcccctcatcctgcgggacatccgcatgaggaagatgggccggcggctgcccaacctgcccagccagagcaggaacaaggagaccctgggcagcgaggccgtgagcagcaatgtgattgattatggccacgccagcaaatatggctacacagaggaccccctggaggtgcgcatctatgaccctgagatccccacagatgaggtggagaatgagttccagagccagcagaacatcagcgcctctgtgcccaaccccaacgtcatctgcaacagcatgtttcctgtggaggatgtgttccggcagatggacttccctggagagagcagcaacaacagaagcttcttctctgtggagagcggcaccaagatgagcggcctgcacatcagcggcggccagagcgtgctggagcccatcaagtctgtgaaccagagcatcaaccagacagtgtcccagaccatgagccagagcctcatccccccatccatgaaccagcagcccttcagcagcgagctgatcagctctgtgtcccagcaggagcgcatcccccatgagcctgtgatcaacagcagcaatgtgcacgtgggcagccggggcagcaagaagaactaccagagccaggccgacatccccatccgcagcccctttggaattgtgaaggcctcctggctgcccaagttcagccatgctgatgcccagaagatgaagaggctgcccacccccagcatgatgaatgactactatgctgccagcccccgcatcttcccccacctgtgcagcctgtgcaatgtggagtgcagccacctgaaggactggatccagcaccagaacaccagcacccacatcgagagctgccggcagctgcggcagcagtacccagactggaaccctgagatcctgcccagcagaagaaatgaaggcaacagaaaagaaaatgagaccccaagaagaagaagccacagccccagcccccggcgcagcagaagaagcagcagcagccaccgcttccgccgcagccgcagccccatgcactacatgtaccggcccaggagccgcagcccccgcatctgccaccgcttcatcagccgctaccgcagccgcagccgcagccgcagcccctaccgcatccggaaccccttccggggcagccccaagtgcttccgctctgtgtccccagagaggatgagccgccgctctgtgcgcagcagtgacaggaagaaggccctggaggatgtggtgcagaggagcggccatggaacagagttcaacaagcagaagcacctggaggccgctgacaagggccacagccctgcccagaagcccaagaccagcagcggcaccaagcccagcgtgaagcccaccagcgccaccaagagtgacagcaacctgggcggccacagcatccgctgcaagagcaagaacctggaggatgacaccctgtctgagtgcaagcaggtgtctgacaaggctgtgtccctgcagaggaagctgaggaaggagcagagcctgcactacggctctgtgctgctgatcacagagctgcctgaagatggctgcacagaagaagatgtgaggaagctgttccagccctttgggaaggtgaatgatgtgctgattgtgccctacaggaaggaggcctacctggagatggagttcaaggaggccatcacagccatcatgaagtacatcgagaccacccccctgaccatcaagggcaagtctgtgaagatctgtgtgcctgggaagaagaaggcccagaacaaggaggtgaagaagaagaccctggagagcaagaaggtgtctgccagcaccctgaagagagatgctgatgccagcaaggctgtggagatcgtgaccagcaccagcgctggcctgctgcccactggaggcggcaacaactacccccagatcgtgctggcccctggcctgtgccactag

SEQ ID NO: 176943 - DNA, 2643 bp, Artificial Sequence
  Description of Artificial Sequence: Synthetic coding sequence
atgcccagagatggagtgcctgctggcaacaccaccccagctgctgcccaggccgccgcccagagcccagattctgccacagctggggccccccaggtgctggacagcctgaagcgctacccagactggaaccctgagatcctgcccagcagaagaaatgaaggcaacagaaaagaaaatgagacccccaggagaagaagccacagccccagccccaggaggagccgccgcagcagcagcagccaccgcttcagaagaagccgcagccccatgcactacatgtaccggcccaggagccgcagcccccgcatctgccaccgcttcatcagccgctaccgcagccgcagccgcagccgcagcccctaccgcatccggaaccccttccggggcagccccaagtgcttccgctctgtgtccccagagaggatgagcagaagatctgtgcgcagcagtgacaggaagaaggccctggaggatgtggtgcagaggagcggccacggcacagagttcaacaagcagaagcacctggaggccgctgacaagggccacagccctgcccagaagcccaagaccagcagcggcaccaagcccagcgtgaagcccaccagcgccaccaagagtgacagcaacctgggcggccacagcatccgctgcaagagcaagaacctggaggatgacaccctgtctgagtgcaagcaggtgtctgacaaggctgtgtccctgcagaggaagctgaggaaggagcagagcctgcactacggctctgtgctgctgatcacagagctgcctgaagatggctgcacagaggaggatgtgaggaagctgttccagccctttgggaaggtgaatgatgtgctgattgtgccctacaggaaggaggcctacctggagatggagttcaaggaggccatcacagccatcatgaagtacatcgagaccacccccctgaccatcaagggcaagtctgtgaagatctgtgtgcctgggaagaagaaggcccagaacaaggaggtgaagaagaagaccctggagagcaagaaggtgtctgccagcaccctgaagagagatgctgatgccagcaaggctgtggagatcgtgaccagcaccagcgctgccaagacaggccaggccaaggcctctgtggccaaggtgaacaagagcacaggcaagagcgccagctctgtgaagtctgtggtgacagtggccgtgaagggcaacaaggccagcatcaagacagccaagagcggcggcaagaagagcctggaggccaagaagacaggaaatgtgaagaacaaggacagcaacaagcctgtgaccatccctgagaacagcgagatcaagaccagcattgaggtgaaggccacagagaactgtgccaaggaggccatcagtgatgctgccctggaggccacagaaaatgagcccctgaacaaggagacagaggagatgtgtgtgatgctggtgagcaacctgcccaacaagggctacagcgtggaggaggtgtatgacctggccaagccctttggaggcctgaaggacatcctgatcctgagcagccacaagaaggcctacatcgagatcaacaggaaggctgctgagagcatggtgaagttctacacctgcttccctgtgctgatggatggcaaccagctgagcatctccatggcccctgagaacatgaacatcaaggatgaggaggccatcttcatcaccctggtgaaggaaaatgaccctgaggccaacatcgacaccatctatgacagatttgtgcacctggacaacctgcctgaagatggcctgcagtgtgtgctgtgtgtgggcctgcagtttgggaaggtggaccaccacgtgttcatcagcaacagaaacaaggccatcctgcagctggacagccctgagagcgcccagagcatgtacagcttcctgaagcagaacccccagaacattggagaccacatgctgacctgcagcctgagccccaagattgacctgcctgaggtgcagattgaacatgaccctgagctggagaaggagagccctggcctgaagaacagccccattgatgagagcgaggtgcagacagccacagacagccccagcgtgaagcccaatgagctggaggaggagagcacccccagcatccagacagagaccctggtgcagcaggaggagccctgtgaggaggaggccgagaaggccacctgtgacagcgactttgctgtggagaccctggagctggagacccagggcgaggaggtgaaggaggagatccccctggtggccagcgcctctgtgtccattgagcagttcacagaaaatgctgaggagtgtgccctgaaccagcagatgttcaacagcgacctggagaagaagggagctgagatcatcaaccccaagacagccctgctgcccagcgacagcgtgtttgctgaggagaggaacctgaagggcatcctggaggagagccccagcgaggccgaggacttcatcagcggcatcacccagaccatggtggaggccgtggccgaggtggagaagaatgaaacagtgtctgagatcctgcccagcacctgcatcgtgaccctggtgcccggcatccccactggagatgagaagacagtggacaagaagaacatctcctag

SEQ ID NO: 176944 - DNA, 2757 bp, Artificial Sequence
  Description of Artificial Sequence: Synthetic coding sequence
atggacagcccccccctgaaggccctgaacagcaacagcatctacttcctgctgctcttccactgcatgctgatcagcgaggtgcagatcgagcatgaccctgagctggagaaggagagccctggcctgaagaacagccccattgatgaaagtgaggtgcagacagccacagacagccccagcgtgaagcccaatgagctggaggaggagagcacccccagcatccagacagagaccctggtgcagcaggaggagccctgtgaggaggaggccgagaaggccacctgtgacagcgactttgctgtggagaccctggagctggagacccagggcgaggaggtgaaggaggagatccccctggtggccagcgcctctgtgtccattgagcagttcacagaaaatgcagaagaatgtgccctgaaccagcagatgttcaacagcgacctggagaagaagggagctgagatcatcaaccccaagacagccctgctgcccagcgacagcgtgtttgctgaggagaggaacctgaagggcatcctggaggagagccccagcgaggccgaggacttcatcagcggcatcacccagaccatggtggaggccgtggccgaggtggagaagaatgagaccgtgtctgagatcctgcccagcacctgcatcgtgaccctggtgcccggcatccccactggagatgagaagacagtggacaagaagaacatcagcgagaagaagggcaacatggatgagaaggaggagaaggagttcaacaccaaggagaccaggatggacctgcagatcggcacagagaaggccgagaagaatgaaggaaggatggatgctgagaaggtggagaagatggccgccatgaaggagaagccagctgagaacaccctcttcaaggcctaccccaacaagggcgtgggccaggccaacaagccagatgagaccagcaagaccagcatcctggccgtgtctgatgtgagcagcagcaagcccagcatcaaggccgtcatcgtgagcagccccaaggccaaggccaccgtgtccaagacagagaaccagaagagcttccccaagtctgtgccccgggaccagatcaatgctgagaagaagctgagcgccaaggagtttggcctgctgaagcccaccagcgcccggagcggcctggccgagagcagcagcaagttcaagcccacccagagcagcctgacccggggcggcagcggccgcatcagcgccctgcagggcaagctgagcaagctggactacagagacatcaccaagcagagccaggagacagaggcccggcccagcatcatgaagagagatgacagcaacaacaagaccctggccgagcagaacaccaagaaccccaagagcaccaccggccgcagcagcaagagcaaggaggagcccctcttccccttcaacctggatgaatttgtgacagtggatgaagtcatcgaggaggtgaaccccagccaggccaagcagaaccccctgaagggcaagaggaaggagaccctgaagaatgtgcccttcagcgagctgaacctgaagaagaagaagggcaagaccagcaccccccggggcgtggagggggagctgagctttgtgaccctggatgagatcggggaggaggaggatgctgctgcccacctggcccaggccctggtgacagtggatgaggtgattgatgaggaggagctgaacatggaggagatggtgaagaacagcaacagcctcttcaccctggatgagctgattgaccaggatgactgcatcagccacagcgagcccaaggatgtgacagtgctgtctgtggccgaggagcaggacctgctgaagcaggagcggctggtgacagtggatgagatcggggaggtggaggagctgcccctgaatgaatctgctgacatcacctttgccaccctgaacaccaagggaaatgaaggagacacagtgcgggacagcatcggcttcatcagcagccaggtgcctgaggaccccagcaccctggtgacagtggatgagatccaggatgacagcagtgacctgcacctggtgaccctggatgaggtgacagaagaagatgaggacagcctggccgacttcaacaacctgaaggaggagctgaactttgtgacagtggatgaggtgggggaggaggaggatggagacaatgacctgaaggtggagctggcccagagcaagaatgaccaccccacagacaagaagggcaacaggaagaagagagctgtggacaccaagaagaccaagctggagagcctgagccaggtgggccctgtgaatgaaaatgtgatggaggaggacctgaagaccatgattgagcggcacctgacagccaagacccccaccaagagggtgcgcatcggcaagaccctgcccagcgagaaggctgtggtgacagagcccgccaagggggaggaggccttccagatgtctgaggtggatgaggagagcggcctgaaggacagcgagcctgagaggaagaggaagaagacagaggacagcagcagcggcaagtctgtggccagtgatgtgcctgaggagctggacttcctggtgcccaaggccggcttcttctgccccatctgcagcctcttctacagcggggagaaggccatgaccaaccactgcaagagcaccaggcacaagcagaacacagagaagttcatggccaagcagaggaaggagaaggagcagaatgaggccgaggagaggagcagcaggtag

SEQ ID NO: 176945 - DNA, 5937 bp, Artificial Sequence; identical to SEQ ID NO: 176940
  Description of Artificial Sequence: Synthetic coding sequence

SEQ ID NO: 176946 - DNA, 90 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggatag

SEQ ID NO: 176947 - DNA, 594 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggccccttcatgaggcctggctccatgggcctgccccgcttctacccagctggccgggcccggggcatcccccacagatttgctggccacgagagctaccagaacatgggcccccagaggatgaatgtgcaggtgacccagcacaggacagacccccggctgaccaaggagaagctggacttccacgaggcccagcagaagaagggcaagccccacggcagccgctgggatgatgagccccacatcagcgcctctgtggccgtgaagcagagctctgtgacccaggtgacagagcagagccccaaggtgcagagccgctacaccaaggagagcgccagcagcatcctggccagctttggcctgagcaatgaagacctggaggagctgagccgctacccagatgagcagctgaccccagagaacatgcccctcatcctgcgggacatccgcatgaggaagatgggccggcggctgcccaacctgcccagccagagcaggaacaaggagtag

SEQ ID NO: 176948 - DNA, 111 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggccccttcatgaggcctggcagctag

SEQ ID NO: 176949 - DNA, 189 bp, Artificial Sequence
  Description of Artificial Sequence: Synthetic coding sequence
atgagccggccccgcttcaaccccaggggggacttccccctgcagaggccccgggcccccaaccccagcggcatgaggcctcctggccccttcatgaggcctggctccatgggcctgccccgcttctacccagctggccgggcccggggcatcccccacagatttgctggccacgagagctaccagtag

SEQ ID NO: 176950 - DNA, 189 bp, Artificial Sequence; identical to SEQ ID NO: 176949
  Description of Artificial Sequence: Synthetic coding sequence

SEQ ID NO: 176951 - DNA, 1758 bp, Artificial Sequence
  Description of Artificial Sequence: Synthetic coding sequence
atggacagcccccccctgaaggccctgaacagcaacagcatctacttcctgctgctcttccactgcatgctgatcagcgaggtgcagatcgagcatgaccctgagctggagaaggagagccctggcctgaagaacagccccattgatgaaagtgaggtgcagacagccacagacagccccagcgtgaagcccaatgagctggaggaggagagcacccccagcatccagacagagaccctggtgcagcaggaggagccctgtgaggaggaggccgagaaggccacctgtgacagcgactttgctgtggagaccctggagctggagacccagggcgaggaggtgaaggaggagatccccctggtggccagcgcctctgtgtccattgagcagttcacagaaaatgcagaagaatgtgccctgaaccagcagatgttcaacagcgacctggagaagaagggagctgagatcatcaaccccaagacagccctgctgcccagcgacagcgtgtttgctgaggagaggaacctgaagggcatcctggaggagagccccagcgaggccgaggacttcatcagcggcatcacccagaccatggtggaggccgtggccgaggtggagaagaatgagaccgtgtctgagatcctgcccagcacctgcatcgtgaccctggtgcccggcatccccactggagatgagaagacagtggacaagaagaacatcagcgagaagaagggcaacatggatgagaaggaggagaaggagttcaacaccaaggagaccaggatggacctgcagatcggcacagagaaggccgagaagaatgaaggaaggatggatgctgagaaggtggagaagatggccgccatgaaggagaagccagctgagaacaccctcttcaaggcctaccccaacaagggcgtgggccaggccaacaagccagatgagaccagcaagaccagcatcctggccgtgtctgatgtgagcagcagcaagcccagcatcaaggccgtcatcgtgagcagccccaaggccaaggccaccgtgtccaagacagagaaccagaagagcttccccaagtctgtgccccgggaccagatcaatgctgagaagaagctgagcgccaaggagtttggcctgctgaagcccaccagcgcccggagcggcctggccgagagcagcagcaagttcaagcccacccagagcagcctgacccggggcggcagcggccgcatcagcgccctgcagggcaagctgagcaagctggactacagagacatcaccaagcagagccaggagacagaggcccggcccagcatcatgaagagagatgacagcaacaacaagaccctggccgagcagaacaccaagaaccccaagagcaccaccggccgcagcagcaagagcaaggaggagcccctcttccccttcaacctggatgaatttgtgacagtggatgaagtcatcgaggaggtgaaccccagccaggccaagcagaaccccctgaagggcaagaggaaggagaccctgaagaatgtgcccttcagcgagctgaacctgaagaagaagaagggcaagaccagcaccccccggggcgtggagggggagctgagctttgtgaccctggatgagatcggggaggaggaggatgctgctgcccacctggcccaggccctggtgacagtggatgaggtgattgatgaggaggagctgaacatggaggagatggtgaagttcaagttcaccttctacatcagatag

SEQ ID NO: 176952 - DNA, 3075 bp, Artificial Sequence
  Description of Artificial Sequence: Synthetic coding sequence
atgcccagagatggagtgcctgctggcaacaccaccccagctgctgcccaggccgccgcccagagcccagattctgccacagctggggccccccaggtgctggacagcctgaagagatttgtgctcttcctggagaactttgcccccctggtgaacagcctgaacctgggcatcgccaaccccctgctgctgggccccagccccctgcactttgcccagatcaagacccagctggccctgcagcagctgaatgctgtggccagccacggcagcaccccaccctacaccctgctgaaccaggccttcctgaagatcgccatgagccggccccgcttcaaccccaggggggacttccccctgcagaggccccgggcccccaaccccagcggcatgaggcctcctggccccttcatgaggcctggctccatgggcctgccccgcttctacccagctggccgggcccggggcatcccccacagatttgctggccacgagagctaccagaacatgggcccccagaggatgaatgtgcaggtgacccagcacaggacagacccccggctgaccaaggagaagctggacttccacgaggcccagcagaagaagggcaagccccacggcagccgctgggatgatgagccccacatcagcgcctctgtggccgtgaagcagagctctgtgacccaggtgacagagcagagccccaaggtgcagagccgctacaccaaggagagcgccagcagcatcctggccagctttggcctgagcaatgaagacctggaggagctgagccgctacccagatgagcagctgaccccagagaacatgcccctcatcctgcgggacatccgcatgaggaagatgggccggcggctgcccaacctgcccagccagagcaggaacaaggagaccctgggcagcgaggccgtgagcagcaatgtgattgattatggccacgccagcaaatatggctacacagaggaccccctggaggtgcgcatctatgaccctgagatccccacagatgaggtggagaatgagttccagagccagcagaacatcagcgcctctgtgcccaaccccaacgtcatctgcaacagcatgtttcctgtggaggatgtgttccggcagatggacttccctggagagagcagcaacaacagaagcttcttctctgtggagagcggcaccaagatgagcggcctgcacatcagcggcggccagagcgtgctggagcccatcaagtctgtgaaccagagcatcaaccagacagtgtcccagaccatgagccagagcctcatccccccatccatgaaccagcagcccttcagcagcgagctgatcagctctgtgtcccagcaggagcgcatcccccatgagcctgtgatcaacagcagcaatgtgcacgtgggcagccggggcagcaagaagaactaccagagccaggccgacatccccatccgcagcccctttggaattgtgaaggcctcctggctgcccaagttcagccatgctgatgcccagaagatgaagaggctgcccacccccagcatgatgaatgactactatgctgccagcccccgcatcttcccccacctgtgcagcctgtgcaatgtggagtgcagccacctgaaggactggatccagcaccagaacaccagcacccacatcgagagctgccggcagctgcggcagcagtacccagactggaaccctgagatcctgcccagcagaagaaatgaaggcaacagaaaagaaaatgagaccccaagaagaagaagccacagccccagcccccggcgcagcagaagaagcagcagcagccaccgcttccgccgcagccgcagccccatgcactacatgtaccggcccaggagccgcagcccccgcatctgccaccgcttcatcagccgctaccgcagccgcagccgcagccgcagcccctaccgcatccggaaccccttccggggcagccccaagtgcttccgctctgtgtccccagagaggatgagccgccgctctgtgcgcagcagtgacaggaagaaggccctggaggatgtggtgcagaggagcggccatggaacagagttcaacaagcagaagcacctggaggccgctgacaagggccacagccctgcccagaagcccaagaccagcagcggcaccaagcccagcgtgaagcccaccagcgccaccaagagtgacagcaacctgggcggccacagcatccgctgcaagagcaagaacctggaggatgacaccctgtctgagtgcaagcaggtgtctgacaaggctgtgtccctgcagaggaagctgaggaaggagcagagcctgcactacggctctgtgctgctgatcacagagctgcctgaagatggctgcacagaagaagatgtgaggaagctgttccagccctttgggaaggtgaatgatgtgctgattgtgccctacaggaaggaggcctacctggagatggagttcaaggaggccatcacagccatcatgaagtacatcgagaccacccccctgaccatcaagggcaagtctgtgaagatctgtgtgcctgggaagaagaaggcccagaacaaggaggtgaagaagaagaccctggagagcaagaaggtgtctgccagcaccctgaagagagatgctgatgccagcaaggctgtggagatcgtgaccagcaccagcgctgagagcgtggaccagacccagcagctggtgcccctggtgaggaacacagcccgggaccatgatggcaccccagaaaatgaaggagaggagaccgtgcagagcgccctgtttggcttccagtatgatgccagtgaccacaccatggcctggctgggccccaacacagtgcctgaggtgaaggagatgatcctgcaggacccccagctgcagaccacccagctgccccagaccacccaggccccagacatcacctggggcatgctgaagaagaccacctacaaggccgagcagatcctgctgcagacccagaagcccttcaccccagacaacctcttcctggccctgctgtctggagatgccaagccagaatatgagcagtag

SEQ ID NO: 176953 - DNA, 1317 bp, Artificial Sequence
  Description of Artificial Sequence: Synthetic coding sequence
atgcaggccgaggacaggagccagtttggatctgctgctgagatgctgtctgagcagacagctgccctgggcaccggctgggagagcatgaatgtgcagctggatggagctgagccccaggtggagcggggcagccaggaggagcggccctggaggacagtgcccggccccctggagcacctgtgctgtgacctggaggaggagccccagagcctgcaggagaaggcccagagcgccccctgggtgcctgccatcccccaggagggcaacacaggagactgggagatggccgccgccctgctggccgccggcagccagggcctggtgaccatcaaggatgtgtccctgtgcttcagccaggaggagtggaggagcctggaccccagccagacagacttctacggggagtatgtgatgcaggagaactgtggcatcgtggtgtccctgcgcttccccatccccaagctggacatgctgagccagctggagggcggggaggagcagtgggtgcctgacccccaggacctggaggagcgggacatcctgcgggtgacctacacaggagatggcagcgagcatgaaggagacaccccagagctggaggccgagccccccaggatgctgagctctgtgtctgaagatactgtgctgtggaaccctgagcatgatgagagctgggacagcatgcccagcagcagccggggcatgctgctgggcccccccttcctgcaggaggacagcttcagcaacctgctgtgcagcacagagatggacagcctgctgcggccccacacctgcccccagtgtgggaagcagtttgtgtggggcagccacctggcccggcaccagcagacccacactggagagcggccctacagctgcctgaagtgtgagaagacctttggaagaagacaccacctgatccgccaccagaagacccacctgcatgacaagaccagccgctgcagtgaatgtgggaagaacttccgctgcaacagccacctggccagccaccagagggtgcatgctgagggcaagagctgcaagggccaggaggtgggggagagccctggcaccaggaagaggcagagggcccctcctgtgcccaagtgccacgtgtgcacagaatgtgggaagagctttggaagaagacaccacctggtgcgccactggctgacccacactggagagaagcccttccagtgcccccgctgtgagaagagctttggaaggaagcaccacctggacagacacctgctgacccaccagggccagagccccaggaacagctgggaccggggcaccagcgtcttctag

SEQ ID NO: 176954 - DNA, 1248 bp, Artificial Sequence
  Description of Artificial Sequence: Synthetic coding sequence
atgctgtctgagcagacagctgccctgggcaccggctgggagagcatgaatgtgcagctggatggagctgagccccaggtggagcggggcagccaggaggagcggccctggaggacagtgcccggccccctggagcacctgtgctgtgacctggaggaggagccccagagcctgcaggagaaggcccagagcgccccctgggtgcctgccatcccccaggagggcaacacaggagactgggagatggccgccgccctgctggccgccggcagccaggtgtcctctgccagcctgggcgtgtcctgtggccccatcacagctgcctttgtgctgctgagccaccagcccattgatgagctggcccacatgatcatcaatggcttccccatccccaagctggacatgctgagccagctggagggcggggaggagcagtgggtgcctgacccccaggacctggaggagcgggacatcctgcgggtgacctacacaggagatggcagcgagcacgagggggacaccccagagctggaggccgagccccccaggatgctgagctctgtgtctgaggacacagtgctgtggaaccctgagcatgatgagagctgggacagcatgcccagcagcagccggggcatgctgctgggcccccccttcctgcaggaggacagcttcagcaacctgctgtgcagcacagagatggacagcctgctgcggccccacacctgcccccagtgtgggaagcagtttgtgtggggcagccacctggcccggcaccagcagacccacactggagagcggccctacagctgcctgaagtgtgagaagaccttcggccgccgccaccacctgatccgccaccagaagacccacctgcatgacaagaccagccgctgcagtgaatgtgggaagaacttccgctgcaacagccacctggccagccaccagagggtgcacgccgagggcaagagctgcaagggccaggaggtgggggagagccctggcaccaggaagaggcagagggcccctcctgtgcccaagtgccacgtgtgcacagaatgtgggaagagctttggccgccgccaccacctggtgcgccactggctgacccacactggagagaagcccttccagtgcccccgctgtgagaagagctttggaaggaagcaccacctggacagacacctgctgacccaccagggccagagccccagaaattcctgggaccggggcacctctgtgttctag

SEQ ID NO: 176955 - DNA, 1317 bp, Artificial Sequence; identical to SEQ ID NO: 176953
  Description of Artificial Sequence: Synthetic coding sequence

SEQ ID NO: 176956 - DNA, 1275 bp, Artificial Sequence
  Description of Artificial Sequence: Synthetic coding sequence
atgctgtctgagcagacagctgccctgggcaccggctgggagagcatgaatgtgcagctggatggagctgagccccaggtggagcggggcagccaggaggagcggccctggaggacagtgcccggccccctggagcacctgtgctgtgacctggaggaggagccccagagcctgcaggagaaggcccagagcgccccctgggtgcctgccatcccccaggagggcaacacaggagactgggagatggccgccgccctgctggccgccggcagccagggcctggtgaccatcaaggatgtgtccctgtgcttcagccaggaggagtggaggagcctggaccccagccagacagacttctacggggagtatgtgatgcaggagaactgtggcatcgtggtgtccctgcgcttccccatccccaagctggacatgctgagccagctggagggcggggaggagcagtgggtgcctgacccccaggacctggaggagcgggacatcctgcgggtgacctacacaggagatggcagcgagcatgaaggagacaccccagagctggaggccgagccccccaggatgctgagctctgtgtctgaagatactgtgctgtggaaccctgagcatgatgagagctgggacagcatgcccagcagcagccggggcatgctgctgggcccccccttcctgcaggaggacagcttcagcaacctgctgtgcagcacagagatggacagcctgctgcggccccacacctgcccccagtgtgggaagcagtttgtgtggggcagccacctggcccggcaccagcagacccacactggagagcggccctacagctgcctgaagtgtgagaagacctttggaagaagacaccacctgatccgccaccagaagacccacctgcatgacaagaccagccgctgcagtgaatgtgggaagaacttccgctgcaacagccacctggccagccaccagagggtgcatgctgagggcaagagctgcaagggccaggaggtgggggagagccctggcaccaggaagaggcagagggcccctcctgtgcccaagtgccacgtgtgcacagaatgtgggaagagctttggaagaagacaccacctggtgcgccactggctgacccacactggagagaagcccttccagtgcccccgctgtgagaagagctttggaaggaagcaccacctggacagacacctgctgacccaccagggccagagccccaggaacagctgggaccggggcaccagcgtcttctag

SEQ ID NO: 176957 - DNA, 411 bp, Artificial Sequence
  Description of Artificial Sequence: Synthetic coding sequence
atgcaggccgaggacaggagccagtttggatctgctgctgagatgctgtctgagcagacagctgccctgggcaccggctgggagagcatgaatgtgcagctggatggagctgagccccaggtggagcggggcagccaggaggagcggccctggaggacagtgcccggccccctggagcacctgtgctgtgacctggaggaggagccccagagcctgcaggagaaggcccagagcgccccctgggtgcctgccatcccccaggagggcaacacaggagactgggagatggccgccgccctgctggccgccggcagccagggcctggtgaccatcaaggatgtgtccctgtgcttcagccaggaggagtggaggagcctggaccccagccagacagacttctacggggagtag

SEQ ID NO: 176958 - DNA, 324 bp, Artificial Sequence
  Description of Artificial Sequence: Synthetic coding sequence
atgctgtctgagcagacagctgccctgggcaccggctgggagagcatgaatgtgcagctggatggagctgagccccaggtggagcggggcagccaggaggagcggccctggaggacagtgcccggccccctggagcacctgtgctgtgacctggaggaggagccccagagcctgcaggagaaggcccagagcgccccctgggtgcctgccatcccccaggagggcaacacaggagactgggagatggccgccgccctgctggccgccggcagccagggcctggtgaccatcaaggatgtgtccctgtgcttcagccaggagtag

SEQ ID NO: 176959 - DNA, 234 bp, Artificial Sequence
  Description of Artificial Sequence: Synthetic coding sequence
atgctgtctgagcagacagctgccctgggcaccggctgggagagcatgaatgtgcagctggatggagctgagccccaggtggagcggggcagccaggaggagcggccctggaggacagtgcccggccccctggagcacctgtgctgtgacctggaggaggagccccagagcctgcaggagaaggcccagagcgccccctgggtgcctgccatcccccaggagggcaacacctag

SEQ ID NO: 176960 - DNA, 3984 bp, Artificial Sequence
  Description of Artificial Sequence: Synthetic coding sequence
atgaggagcttcctgcagcaggatgtgaacaagaccaagagccggctgaatgtgctgaatggcctggccaacaacatggatgacctgaagatcaacacagacatcaccggggccaaggaggagctgctggatgacaacaacttcatcagtgacaaggagagcggcgtgcacaagcccaaggactgccagaccagcttccagaagaacaacaccctgaccctgcctgaggagctgagcaaggacaagtcagaaaatgccctgagcggcggccagagcagcctcttcatccacgccggggcccccaccgtgtcctctgagaacttcatcctgcccaagggagctgctgtgaatggacctgtgagccacagcagcctgaccaagaccagcaacatgaacaagggctctgtgtccctgaccaccggccagcctgtggaccagcccaccacagagagctgcagcaccctgaaggtggccgctgacctgcagctgagcaccccccagaaggccagccagcaccaggtgctcttcctgctgagtgatgtggcccacgccaagaaccccacccacagcaacaagaagctgcccaccagcgcctctgtgggctgtgacatccagaacagcgtgggcagcaacatcaagagtgatggcaccctcatcaaccaggtggaggtgggggaggatggagaggacctgctggtgaaggatgactgtgtgaacacagtgacaggcatcagcagcggcacagatggcttccgctcagaaaatgacaccaactgggacccccagaaggagttcatccagttcctgatgaccaatgaggagaccgtggacaaggccccaccccacagcaagattggcctggagaagaagaggaagaggaagatggatgtgtccaagatcacccgctacacagaggactgcttcagtgacagcaactgtgtgcccaacaagagcaagatgcaggaggtggacttcctggagcagaatgaggagctgcaggccgtggacagccagaagtatgccctgagcaaggtgaagccagagagcacagatgaggacctggagagcgtggatgccttccagcacctgatctacaacccagacaagtgtggggaggagagcagccctgtgcacaccagcaccttcctgagcaacaccctgaagaagaagtgtgaggagagtgacagcgagagccctgccaccttcagcacagaggagcccagcttctacccctgcaccaagtgcaatgtgaacttccgggagaagaagcacctgcaccgccacatgatgtaccacctggatggcaacagccacttccgccacctgaatgtgccccggccctatgcctgccgggagtgtggccgcaccttccgggacaggaacagcctgctgaagcacatgatcatccaccaggagcggcggcagaagctgatggaggagatccgggagctgaaggagctgcaggatgagggccgcagcgcccggctgcagtgcccccagtgtgtgtttggcaccaactgccccaagacctttgtgcagcacgccaagacccatgagaaggacaagcgctactactgctgtgaggagtgcaacttcatggctgtgacagaaaatgagctggagtgccaccggggcatcgcccacggggctgtggtgaagtgccccatggtgaccagtgacatcgcccagaggaagacccagaagaagaccttcatgaaggacagcgtggtgggcagcagcaagaagagcgccacctacatctgcaagatgtgccccttcaccaccagcgccaagtctgtgctgaagaagcacacagagtacctgcacagcagcagctgtgtggacagctttggcagccccctgggcctggacaagaggaagaatgacatcctggaggagcctgtggacagcgacagcaccaagaccctgaccaagcagcagagcaccaccttccccaagaacagcgccctgaagcaggatgtgaagaggaccttcggcagcaccagccagagcagcagcttcagcaagatccacaagaggccccaccgcatccagaaggccaggaagagcatcgcccagagcggcgtgaacatgtgcaaccagaacagcagcccccacaagaatgtgaccatcaagagctctgtggaccagaagcccaagtacttccaccaggccgccaaggagaagagcaatgccaaggccaacagccactacctgtaccgccacaagtatgagaactacaggatgatcaagaagtctggagagagctaccctgtgcacttcaagaaggaggaggccagcagcctgaacagcctgcacctgttcagcagcagcagcaacagccacaacaacttcatcagtgacccccacaagccagatgccaagaggcctgagagcttcaaggaccaccggcgggtggccgtgaagagggtcatcaaggagagcaagaaggagagctctgtgggcggggaggacctggacagctacccagacttcctgcacaagatgacagtggtggtgctgcagaagctgaacagcgctgagaagaaggacagctatgaaacagaagatgagagctcctgggacaacgtggagctgggggactacaccacccaggccattgaagatgagacctacagcgacatcaaccaggagcacgtgaacctcttccccctcttcaagagcaaggtggagggccaggagcccggggagaatgccaccctgtcctatgaccagaatgatggcttctactttgagtactatgaggacaccggcagcaacaacttcctgcacgagatccatgacccccagcacctggagacagcagatgccagcctgagcaagcacagctctgtgttccactggacagacctgagcctggagaagaagagctgcccctactgcccagccacctttgagaccggggtgggcctgagcaaccacgtgcggggccacctgcacagagctggcctgtcctatgaggcccggcacgtggtgtccccagagcagatcgccaccagtgacaagatgcagcacttcaagaggacaggcaccggcacccctgtgaagagggtgaggaaggccatcgagaagtctgagaccaccagcgagcacacctgccagctgtgtggcggctggtttgacaccaagattggcctgagcaaccacgtgcggggccacctgaagaggctgggcaagaccaagtgggatgcccacaagagccccatctgtgtgctgaatgagatgatgcagaatgaggagaagtatgagaagatcctgaaggccctgaacagccgccgcatcatcccccggccctttgtggcccagaagctggccagcagtgatgacttcatcagccagaatgtcatccccctggaggcctacagaaatggcctgaagacagaggccctgtctgtgtctgccagcgaggaggagggcctgaacttcctgaatgaatatgatgagaccaagccagagctgcccagcggcaagaagaaccagagcctgaccctcatcgagctgctgaagaacaagaggatgggagaggagaggaacagcgccatcagcccccagaagatccacaaccagacagccaggaagagatttgtgcagaagtgtgtgctgcccctgaatgaagacagccccctgatgtaccagccccagaagatggacctgaccatgcacagcgccctggactgcaagcagaagaagagccgcagccgcagcggcagcaagaagaagatgctgaccctgccccatggagcagatgaggtgtacatcctgcgctgccgcttctgtggcctggtgttccggggccccctgtctgtgcaggaggactggatcaagcacctgcagaggcacatcgtgaatgccaacctgcccaggactggagctggcatggtggaggtgaccagcctgctgaagaagccagccagcatcacagagaccagcttcagcctgctgatggccgaggccgccagctag

SEQ ID NO: 176961 - DNA, 318 bp, Artificial Sequence
  Description of Artificial Sequence: Synthetic coding sequence
atgctgatccggcagaacctggccctggactgcaagcagaagaagagccgcagccgcagcggcagcaagaagaagatgctgaccctgccccatggagcagatgaggtgtacatcctgcgctgccgcttctgtggcctggtgttccggggccccctgtctgtgcaggaggactggatcaagcacctgcagaggcacatcgtgaatgccaacctgcccaggactggagctggcatggtggaggtgaccagcctgctgaagaagccagccagcatcacagagaccagcttcagcctgctgatggccgaggccgccagctag

SEQ ID NO: 176962 - DNA, 318 bp, Artificial Sequence; identical to SEQ ID NO: 176961
  Description of Artificial Sequence: Synthetic coding sequence

SEQ ID NO: 176963 - DNA, 3984 bp, Artificial Sequence; identical to SEQ ID NO: 176960
  Description of Artificial Sequence: Synthetic coding sequence

SEQ ID NO: 176964 - DNA, 1953 bp, Artificial Sequence
  Description of Artificial Sequence: Synthetic coding sequence
atgatgtaccacctggatggcaacagccacttccgccacctgaatgtgccccggccctatgcctgccgggagtgtggccgcaccttccgggacaggaacagcctgctgaagcacatgatcatccaccaggagcggcggcagaagctgatggaggagatccgggagctgaaggagctgcaggatgagggccgcagcgcccggctgcagtgcccccagtgtgtgtttggcaccaactgccccaagacctttgtgcagcacgccaagacccatgagaaggacaagcgctactactgctgtgaggagtgcaacttcatggctgtgacagaaaatgagctggagtgccaccggggcatcgcccacggggctgtggtgaagtgccccatggtgaccagtgacatcgcccagaggaagacccagaagaagaccttcatgaaggacagcgtggtgggcagcagcaagaagagcgccacctacatctgcaagatgtgccccttcaccaccagcgccaagtctgtgctgaagaagcacacagagtacctgcacagcagcagctgtgtggacagctttggcagccccctgggcctggacaagaggaagaatgacatcctggaggagcctgtggacagcgacagcaccaagaccctgaccaagcagcagagcaccaccttccccaagaacagcgccctgaagcaggatgtgaagaggaccttcggcagcaccagccagagcagcagcttcagcaagatccacaagaggccccaccgcatccagaaggccaggaagagcatcgcccagagcggcgtgaacatgtgcaaccagaacagcagcccccacaagaatgtgaccatcaagagctctgtggaccagaagcccaagtacttccaccaggccgccaaggagaagagcaatgccaaggccaacagccactacctgtaccgccacaagtatgagaactacaggatgatcaagaagtctggagagagctaccctgtgcacttcaagaaggaggaggccagcagcctgaacagcctgcacctgttcagcagcagcagcaacagccacaacaacttcatcagtgacccccacaagccagatgccaagaggcctgagagcttcaaggaccaccggcgggtggccgtgaagagggtcatcaaggagagcaagaaggagagctctgtgggcggggaggacctggacagctacccagacttcctgcacaagatgacagtggtggtgctgcagaagctgaacagcgctgagaagaaggacagctatgaaacagaagatgagagctcctgggacaacgtggagctgggggactacaccacccaggccattgaagatgagacctacagcgacatcaaccaggagcacgtgaacctcttccccctcttcaagagcaaggtggagggccaggagcccggggagaatgccaccctgtcctatgaccagaatgatggcttctactttgagtactatgaggacaccggcagcaacaacttcctgcacgagatccatgacccccagcacctggagacagcagatgccagcctgagcaagcacagctctgtgttccactggacagacctgagcctggagaagaagagctgcccctactgcccagccacctttgagaccggggtgggcctgagcaaccacgtgcggggccacctgcacagagctggcctgtcctatgaggcccggcacgtggtgtccccagagcagatcgccaccagtgacaagatgcagcacttcaagaggacaggcaccggcacccctgtgaagagggtgaggaaggccatcgagaagtctgagaccaccagcgagcacacctgccagctgtgtggcggctggtttgacaccaagattggcctgagcaaccacgtgcggggccacctgaagaggctgggcaagaccaagtgggatgcccacaagagccccatctgtgtgtag

SEQ ID NO: 176965 - DNA, 924 bp, Artificial Sequence
  Description of Artificial Sequence: Synthetic coding sequence
atgaggagcttcctgcagcaggatgtgaacaagaccaagagccggctgaatgtgctgaatggcctggccaacaacatggatgacctgaagatcaacacagacatcaccggggccaaggaggagctgctggatgacaacaacttcatcagtgacaaggagagcggcgtgcacaagcccaaggactgccagaccagcttccagaagaacaacaccctgaccctgcctgaggagctgagcaaggacaagtcagaaaatgccctgagcggcggccagagcagcctcttcatccacgccggggcccccaccgtgtcctctgagaacttcatcctgcccaagggagctgctgtgaatggacctgtgagccacagcagcctgaccaagaccagcaacatgaacaagggctctgtgtccctgaccaccggccagcctgtggaccagcccaccacagagagctgcagcaccctgaaggtggccgctgacctgcagctgagcaccccccagaaggccagccagcaccaggtgctcttcctgctgagtgatgtggcccacgccaagaaccccacccacagcaacaagaagctgcccaccagcgcctctgtgggctgtgacatccagaacagcgtgggcagcaacatcaagagtgatggcaccctcatcaaccaggtggaggtgggggaggatggagaggacctgctggtgaaggatgactgtgtgaacacagtgacaggcatcagcagcggcacagatggcttccgctcagaaaatgacaccaactgggacccccagaaggagttcatccagttcctgatgaccaatgaggagaccgtggacaaggccccaccccacagcaagattggcctggagaagaagaaggccaagaatggctgcaagcaggacaacagcctgtaccggggcctgctgtag

SEQ ID NO: 176966 - DNA, 1518 bp, Artificial Sequence
  Description of Artificial Sequence: Synthetic coding sequence
atgaccaaggcccaggagagcctgaccctggaggatgtggccgtggacttcacctgggaggagtggcagttcctgagccctgcccagaaggacctgtacagagatgtgatgctggagaactacagcaacctggtgtctgtgggctaccaggccggcaagccagatgccctgaccaagctggagcagggcgagcccctgtggaccctggaggatgagatccacagccctgcccaccctgagattgagaaggcagatgaccacctgcagcagcccctgcagaaccagaagatcctgaagaggacaggccagagatatgaacatggccgcaccctgaagagctacctgggcctgaccaaccagagccgccgctacaacaggaaggagcctgctgagttcaatggagatggagccttcctgcatgacaaccacgagcagatgcccacagaaattgagttccctgagagcaggaagcccatcagcaccaagagccagttcctgaagcaccagcagacccacaacatcgagaaggcccatgaatgtacagactgtgggaaggccttcctgaagaagagccagctgacagagcacaagaggatccacacaggcaagaagccccacgtgtgcagcctgtgtgggaaggccttctacaagaagtaccgcctgacagagcacgagcgggcccacagaggagagaagccccacggctgcagcctgtgtgggaaggccttctacaagcgctaccgcctgacagagcacgagcgggcccacaagggggagaagccctacggctgcagtgaatgtgggaaggccttccccaggaagtctgagctgacagagcaccagaggatccacacaggcatcaagccccaccagtgcagtgaatgtggccgggccttcagcaggaagagcctgctggtggtgcaccagaggacccacactggagagaagccccacacctgcagtgaatgtgggaagggcttcatccagaagggcaacctgaacatccaccagaggacccacactggagagaagccctacggctgcatcgactgtgggaaggccttcagccagaagagctgcctggtggcccaccagcgctaccacacaggcaagaccccatttgtgtgcccagaatgtggccagccctgcagccagaagagcggcctcatccgccaccagaagatccacagcggggagaagccctacaagtgcagcgactgtgggaaggccttcctgaccaagaccatgctgattgtgcaccacaggacccacactggagagcggccctacggctgtgatgaatgtgagaaggcctacttctacatgagctgcctggtgaagcacaagaggatccacagccgggagaagagaggagacagcgtgaaggtggagaaccccagcacagccagccacagcctgagccccagcgagcacgtgcagggcaagagccctgtgaacatggtgacagtggccatggtggccggccagtgtgaatttgcccacatcctgcacagctag

SEQ ID NO: 176967 - DNA, 1833 bp, Artificial Sequence
  Description of Artificial Sequence: Synthetic coding sequence
atgcccagcgcccggggcaagagcaagagcaaggcccccatcaccttcggggacctggccatctacttcagccaggaggagtgggagtggctgagccccatccagaaggacctgtatgaagatgtgatgctggagaactacagaaacctggtgtccctgggcctgtccttccggcggcccaacgtcatcaccctgctggagaagggcaaggccccctggatggtggagcctgtgagaagaagaagagccccagacagcggcagcaaatgtgagaccaagaagctgccccccaaccagtgcaacaagagcggccagagcatctgccagaagctggtgtctgcccagcagaaggcccccaccaggaagagcggctgcaacaagaacagcgtgctggtgaagcccaagaagggccacagcggcaagaagcccctgaagtgcaatgactgtgggaagaccttcagccgctccttcagcctgaagctgcaccagaacatccacactggagagaagccctttgaatgtagcaactgcaggaaggccttccggcagatcagcagcatcctgctgcaccagaggatccacagcggcaagaagagccatgagtgcaacaagtgtggggagagcttcaaccagaggaccaccctcatcctgcacatgagaattcatgatggcaaggagatcctggactgtgggaaggccctgagccagtgccagagcttcaacatccaccagaagatccacgtggtgggcaatgtgtgccagtgcaggaaatgtgggaaggccttcaaccagatgagcagcctgctgctgcacaagaagatccacaacgggaagaagacccacaagtacaacaagtgtggccggggcttcaagaagaagtctgtgtttgtggtgcacaagagaattcatgctggggagaagatcccagaaaatgccaaggccctgagccagagcctgcagcagaggagccaccacctggagaaccccttcaagtgcaggaaatgtgggaagctgttcaaccgcatcagccccctgatgctgcaccagaggatccacaccagcgagaagccctacaagtgtgacaagtgtgacaagttcttccggcggctgagcaccctcatcctgcacctgcgcatccacaatggagagaagctgtaccgctgcaacaagtgtgagaaggtgtgcaacagacacagcagcctcatccagcaccagaaggtgcacaccaagaagaagaagctgtttgagtgcaaggaatgtgggaagatgttttctggaacagccaacctgaagatccaccagaacatccacagcgaggagaagcccttcaagtgcaacaagtgcagcaaggtgtttggccggcagagcttcctgattgagcaccagaggatccacactggagagaagccctaccagtgtgaagaatgtgggaaggccttcagccaccgcatcagcctgaccaggcacaagaggatccacacagaagatcggccctatgaatgtgaccagtgtgggaaggccttcagccagagcgcccacctggcccagcacgagcgcatccacactggagagaagccctacacctgcaagacctgtgggaaggccttcagccagaggaccagcctcatcctgcacgagaggagccacactggagagaagccctatgagtgcaatgaatgtgggaaggccttcagcagcggcagtgacctgatccgccaccagaggagccacagcagcgagaagccctatgagtgcagcaaatgtgggaaggcctacagccgcagcagcagcctcatccgccaccagaacacccacagcgaggagaaggcctag

SEQ ID NO: 176968 - DNA, 2217 bp, Artificial Sequence
  Description of Artificial Sequence: Synthetic coding sequence
atgaggaccctggtgaatgccctgagcggcggcggccaggagatcaagccagagggcaaatgtgcccacaacggcatgtgcttccgctgtgaggaggtggccccagacacctgtgaggcctacccctacccaggcctggtggtgtctgtggccggcaaggagggccccaacccagaccacaagaggggcttcctggacctggcccaggagggcatccaggccctgccctaccagctgagcgcccacctgtctgtgtggaccctgaagggggaggagaggatgcccagcgcccggggcaagagcaagagcaaggcccccatcacctttggagacctggccatctacttcagccaggaggagtgggagtggctgagccccatccagaaggacctgtatgaagatgtgatgctggagaactacagaaacctggtgtccctgggcctgtccttcagaagacccaacgtcatcaccctgctggagaagggcaaggccccctggatggtggagcctgtgagaagaagaagagcccctgagctggtgacagtggccctcttcagcagctttggagaggtgatgttcagcaggatggtgctgatgctgatggatgtgtgccagtacctggtgattgatgagctggacagcggcagcaaatgtgagaccaagaagctgccccccaaccagtgcaacaagagcggccagagcatctgccagaagctggtgtctgcccagcagaaggcccccaccaggaagagcggctgcaacaagaacagcgtgctggtgaagcccaagaagggccacagcggcaagaagcccctgaagtgcaatgactgtgggaagaccttcagccgctccttcagcctgaagctgcaccagaacatccacactggagagaagccctttgaatgtagcaactgcaggaaggccttccggcagatcagcagcatcctgctgcaccagaggatccacagcggcaagaagagccatgagtgcaacaagtgtggggagagcttcaaccagaggaccaccctcatcctgcacatgagaattcatgatggcaaggagatcctggactgtgggaaggccctgagccagtgccagagcttcaacatccaccagaagatccacgtggtgggcaatgtgtgccagtgcaggaaatgtgggaaggccttcaaccagatgagcagcctgctgctgcacaagaagatccacaacgggaagaagacccacaagtacaacaagtgtggccggggcttcaagaagaagtctgtgtttgtggtgcacaagagaattcatgctggggagaagatcccagaaaatgccaaggccctgagccagagcctgcagcagaggagccaccacctggagaaccccttcaagtgcaggaaatgtgggaagctgttcaaccgcatcagccccctgatgctgcaccagaggatccacaccagcgagaagccctacaagtgtgacaagtgtgacaagttcttccggcggctgagcaccctcatcctgcacctgcgcatccacaatggagagaagctgtaccgctgcaacaagtgtgagaaggtgtgcaacagacacagcagcctcatccagcaccagaaggtgcacaccaagaagaagaagctgtttgagtgcaaggaatgtgggaagatgttttctggaacagccaacctgaagatccaccagaacatccacagcgaggagaagcccttcaagtgcaacaagtgcagcaaggtgtttggccggcagagcttcctgattgagcaccagaggatccacactggagagaagccctaccagtgtgaagaatgtgggaaggccttcagccaccgcatcagcctgaccaggcacaagaggatccacacagaagatcggccctatgaatgtgaccagtgtgggaaggccttcagccagagcgcccacctggcccagcacgagcgcatccacactggagagaagccctacacctgcaagacctgtgggaaggccttcagccagaggaccagcctcatcctgcacgagaggagccacactggagagaagccctatgagtgcaatgaatgtgggaaggccttcagcagcggcagtgacctgatccgccaccagaggagccacagcagcgagaagccctatgagtgcagcaaatgtgggaaggcctacagccgcagcagcagcctcatccgccaccagaacacccacagcgaggagaaggcctag

SEQ ID NO: 176969 - DNA, 975 bp, Artificial Sequence
  Description of Artificial Sequence: Synthetic coding sequence
aagaacagcgtgctggtgaagcccaagaagggccacagcggcaagaagcccctgaagtgcaatgactgtgggaagaccttcagccgctccttcagcctgaagctgcaccagaacatccacactggagagaagccctttgaatgtagcaactgcaggaaggccttccggcagatcagcagcatcctgctgcaccagaggatccacagcggcaagaagagccatgagtgcaacaagtgtggggagagcttcaaccagaggaccaccctcatcctgcacatgagaattcatgatggcaagaaccccttcaagtgcaggaaatgtgggaagctgttcaaccgcatcagccccctgatgctgcaccagaggatccacaccagcgagaagccctacaagtgtgaggagtgtgggaagatgttcagcggcacagccaacctgaagatccaccagaacatccacagcgaggagaagcccttcaagtgcaacaagtgcagcaaggtgtttggccggcagagcttcctgattgagcaccagaggatccacactggagagaagccctaccagtgtgaggagtgtgggaaggccttcagccaccgcatcagcctgaccaggcacaagaggatccacacagaggaccggccctatgaatgtgaccagtgtgggaaggccttcagccagagcgcccacctggcccagcacgagcgcatccacactggagagaagccctacacctgcaagacctgtgggaaggccttcagccagaggaccagcctcatcctgcacgagaggagccacactggagagaagccctatgaatgtaatgaatgtgggaaggccttcagcagcggcagtgacctgatccgccaccagaggagccacagcagcgagaagccctatgaatgttccaaatgtgggaaggcctacagccgcagcagcagcctcatccgccaccagaacacccacagcgaggagaagtag

SEQ ID NO: 176970 - DNA, 1179 bp, Artificial Sequence
  Description of Artificial Sequence: Synthetic coding sequence
atgagaattcatgatggcaaggagatcctggactgtgggaaggccctgagccagtgccagagcttcaacatccaccagaagatccacgtggtgggcaatgtgtgccagtgcaggaaatgtgggaaggccttcaaccagatgagcagcctgctgctgcacaagaagatccacaacgggaagaagacccacaagtacaacaagtgtggccggggcttcaagaagaagtctgtgtttgtggtgcacaagagaattcatgctggggagaagatcccagaaaatgccaaggccctgagccagagcctgcagcagaggagccaccacctggagaaccccttcaagtgcaggaaatgtgggaagctgttcaaccgcatcagccccctgatgctgcaccagaggatccacaccagcgagaagccctacaagtgtgacaagtgtgacaagttcttccggcggctgagcaccctcatcctgcacctgcgcatccacaatggagagaagctgtaccgctgcaacaagtgtgagaaggtgtgcaacagacacagcagcctcatccagcaccagaaggtgcacaccaagaagaagaagctgtttgagtgcaaggaatgtgggaagatgttttctggaacagccaacctgaagatccaccagaacatccacagcgaggagaagcccttcaagtgcaacaagtgcagcaaggtgtttggccggcagagcttcctgattgagcaccagaggatccacactggagagaagccctaccagtgtgaagaatgtgggaaggccttcagccaccgcatcagcctgaccaggcacaagaggatccacacagaagatcggccctatgaatgtgaccagtgtgggaaggccttcagccagagcgcccacctggcccagcacgagcgcatccacactggagagaagccctacacctgcaagacctgtgggaaggccttcagccagaggaccagcctcatcctgcacgagaggagccacactggagagaagccctatgagtgcaatgaatgtgggaaggccttcagcagcggcagtgacctgatccgccaccagaggagccacagcagcgagaagccctatgagtgcagcaaatgtgggaaggcctacagccgcagcagcagcctcatccgccaccagaacacccacagcgaggagaaggcctag

SEQ ID NO: 176971 - DNA, 1833 bp, Artificial Sequence; identical to SEQ ID NO: 176967
  Description of Artificial Sequence: Synthetic coding sequence

SEQ ID NO: 176972 - DNA, 1728 bp, Artificial Sequence
  Description of Artificial Sequence: Synthetic coding sequence
atggccatgagccaggagagcctgaccttcaaggatgtgtttgtggacttcaccctggaggagtggcagcagctggacagcgcccagaagaacctgtacagagatgtgatgctggagaactacagccacctggtgtctgtgggccacctggtgggcaagccagatgtgatcttccggctgggccctggagatgagagctggatggctgatggcggcacccctgtgaggacctgtgctgtgtgggaggtggatgagcagattgaccactacaaggagagccaggacaagttcctgtggcaggccgccttcatcggcaaggagaccctgaaggatgaaagtggccaggagtgcaagatctgcaggaagatcatctacctgaacacagactttgtgtctgtgaagcagaggctgcccaagtactacagctgggagcgctgcagcaagcaccacctgaacttcctgggccagaacagaagctatgtgaggaagaaggatgatggctgcaaggcctactggaaggtgtgcctgcactacaacctgcacaaggcccagcctgctgagcgcttctttgaccccaaccagaggggcaaggccctgcaccagaagcaggccctgaggaagagccagaggagccagacaggagagaagctgtacaagtgcacagaatgtgggaaggtgttcatccagaaggccaacctggtggtgcaccagaggacccacactggagagaagccctatgagtgctgtgaatgtgccaaggccttcagccagaagagcaccctcatcgcccaccagaggacccacactggagagaagccctatgaatgttctgaatgtgggaagaccttcatccagaagagcaccctcatcaagcaccagaggacccacactggagagaagccctttgtgtgtgacaagtgccccaaggccttcaagagcagctaccacctgatcagacatgagaagacccacatccggcaggccttctacaagggcatcaagtgcaccaccagcagcctcatctaccagaggatccacaccagcgagaagccccagtgcagcgagcacggcaaggccagtgatgagaagcccagccccaccaagcactggaggacccacaccaaggagaacatctatgagtgcagcaaatgtgggaagagcttccggggcaagagccacctgtctgtgcaccagaggatccacactggagagaagccctatgagtgcagcatctgtgggaagaccttcagcggcaagagccacctgtctgtgcaccacaggacccacactggagagaagccctatgagtgccgccgctgtgggaaggccttcggggagaagagcaccctgattgtgcaccagaggatgcacactggagagaagccctacaagtgcaatgaatgtgggaaggccttcagcgagaagagccccctcatcaagcaccagaggatccacactggagagcggccctatgagtgcacagactgcaagaaggccttcagcaggaagagcaccctcatcaagcaccagaggatccacactggagagaagccctacaagtgcagtgaatgtgggaaggccttctctgtgaagagcaccctgattgtgcaccacaggacccacactggagagaagccctatgagtgccgggactgtgggaaggccttcagcggcaagagcaccctcatcaagcaccagaggagccacactggagacaagaacctgtag

SEQ ID NO: 176973 - DNA, 1746 bp, Artificial Sequence
  Description of Artificial Sequence: Synthetic coding sequence
atggccatgagccaggagagcctgaccttcaaggatgtgtttgtggacttcaccctggaggagtggcagcagctggacagcgcccagaagaacctgtacagagatgtgatgctggagaactacagccacctggtgtctgtgggccacctggtgggcaagccagatgtgatcttccggctgggccctggagatgagagctggatggctgatggcggcacccctgtgaggacctgtgctggagaagatagacctgaggtgtgggaggtggatgagcagattgaccactacaaggagagccaggacaagttcctgtggcaggccgccttcatcggcaaggagaccctgaaggatgaaagtggccaggagtgcaagatctgcaggaagatcatctacctgaacacagactttgtgtctgtgaagcagaggctgcccaagtactacagctgggagcgctgcagcaagcaccacctgaacttcctgggccagaacagaagctatgtgaggaagaaggatgatggctgcaaggcctactggaaggtgtgcctgcactacaacctgcacaaggcccagcctgctgagcgcttctttgaccccaaccagaggggcaaggccctgcaccagaagcaggccctgaggaagagccagaggagccagacaggagagaagctgtacaagtgcacagaatgtgggaaggtgttcatccagaaggccaacctggtggtgcaccagaggacccacactggagagaagccctatgagtgctgtgaatgtgccaaggccttcagccagaagagcaccctcatcgcccaccagaggacccacactggagagaagccctatgaatgttctgaatgtgggaagaccttcatccagaagagcaccctcatcaagcaccagaggacccacactggagagaagccctttgtgtgtgacaagtgccccaaggccttcaagagcagctaccacctgatcagacatgagaagacccacatccggcaggccttctacaagggcatcaagtgcaccaccagcagcctcatctaccagaggatccacaccagcgagaagccccagtgcagcgagcacggcaaggccagtgatgagaagcccagccccaccaagcactggaggacccacaccaaggagaacatctatgagtgcagcaaatgtgggaagagcttccggggcaagagccacctgtctgtgcaccagaggatccacactggagagaagccctatgagtgcagcatctgtgggaagaccttcagcggcaagagccacctgtctgtgcaccacaggacccacactggagagaagccctatgagtgccgccgctgtgggaaggccttcggggagaagagcaccctgattgtgcaccagaggatgcacactggagagaagccctacaagtgcaatgaatgtgggaaggccttcagcgagaagagccccctcatcaagcaccagaggatccacactggagagcggccctatgagtgcacagactgcaagaaggccttcagcaggaagagcaccctcatcaagcaccagaggatccacactggagagaagccctacaagtgcagtgaatgtgggaaggccttctctgtgaagagcaccctgattgtgcaccacaggacccacactggagagaagccctatgagtgccgggactgtgggaaggccttcagcggcaagagcaccctcatcaagcaccagaggagccacactggagacaagaacctgtag

SEQ ID NO: 176974 - DNA, 3714 bp, Artificial Sequence
  Description of Artificial Sequence: Synthetic coding sequence
atgggagacatgaagaccccagactttgatgacctgctggccgcctttgacatcccagacattgatgccaatgaggccatccacagcggcccagaagaaaatgaaggacctgggggccctgggaagccagagcccggggtgggcagcgagagcgaggacacagctgctgccagcgctggagatggccctggggtgcctgcccaggccagtgaccacggcctgcccccaccagacatctctgtggtgtctgtgattgtgaagaacacagtgtgcccagagcagagcgaggccctggccggcggcagcgctggagatggagcccaggccgccggcgtgaccaaggagggccctgtgggcccccacaggatgcagaatggatttggcagccctgagcccagcctgcccggcaccccccacagccctgcccctccttctgggggcacctggaaggagaagggcatggagggcaagacccccctggacctgtttgcccacttcggccctgagcccggggaccacagcgaccccctgccccccagcgcccccagccccacccgggagggcgccctgaccccaccacccttccccagcagctttgagctggcccaggagaatggacctggcatgcagccccctgtgagcagcccccccctgggcgccctgaagcaggagagctgcagcccccaccacccccaggtgctggcccagcagggcagcggcagcagccccaaggccacagacatcccagccagcgccagccccccacctgtggccggcgtgcccttcttcaagcagagccctggccaccagagccccctggccagccccaaggtgcctgtgtgccagcccctgaaggaggaggatgatgatgagggccctgtggacaagagcagccctggcagcccccagagccccagcagtggagctgaggccgcagatgaggacagcaatgacagccctgccagcagcagcagccggcccctgaaggtgcgcatcaagaccatcaagaccagctgtggcaacatcaccaggacagtgacccaggtgcccagcgaccctgaccccccagcccccctggccgagggcgccttcctggccgaggccagcctgctgaagctgagccctgccacccccaccagcgagggccccaaggtggtgtctgtgcagctgggagatggcacccggctgaagggcaccgtgctgcctgtggccaccatccagaatgccagcacagccatgctgatggccgcctctgtggccaggaaggctgtggtgctgcccggcggcacagccaccagccccaagatgattgccaagaatgtgctgggcctggtgccccaggccctgcccaaggcagatggccgggccggcctgggcaccggcggccagaaggtgaatggagcctctgtggtgatggtgcagcccagcaagacagccaccggccccagcactggaggcggcaccgtcatcagcaggacccagagcagcctggtggaggccttcaacaagatcctgaacagcaagaacctgctgcctgcctaccggcccaacctgagccccccagctgaggccggcctggccctgcccccaacaggctaccgctgcctggagtgtggagatgccttcagcctggagaagagcctggcccggcactatgaccggcgctccatgagaattgaggtgacctgcaaccactgtgcccggcggctggtgttcttcaacaagtgcagcctgctgctgcacgcccgggagcacaaggacaagggcctggtgatgcagtgcagccacctggtgatgaggcctgtggccctggaccagatggtgggccagcctgacatcacccccctgctgcctgtggccgtgccccctgtgtctggccccctggccctgcctgccctgggcaaaggagagggcgccatcaccagcagcgccatcaccaccgtggccgctgaggcccctgtgctgcccctgagcacagagcccccagctgccccagccaccagcgcctacacctgcttccgctgcctggagtgcaaggagcagtgccgggacaaggccggcatggccgcccacttccagcagctgggccccccagcccctggggccaccagcaatgtgtgccccacctgccccatgatgctgcccaaccgctgcagcttcagcgcccaccagaggatgcacaagaacagacctcctcatgtgtgcccagaatgtggcggcaacttcctgcaggccaacttccagacccacctgcgggaggcctgcctgcacgtgtcccggcgggtgggctaccgctgccccagctgcagcgtggtgtttggaggagtgaacagcatcaagagccacatccagaccagccactgtgaggtgttccacaagtgccccatctgccccatggccttcaagagcggccccagcgcccacgcccacctgtacagccagcaccccagcttccagacccagcaggccaagctgatctacaagtgtgccatgtgtgacaccgtcttcacccacaagcccctgctgagcagccactttgaccagcacctgctgccccagagggtgtctgtgttcaagtgccccagctgccccctgctgtttgcccagaagaggaccatgctggagcacctgaagaacacccaccagagcggccgcctggaggagacagctgggaagggggccggcggggccctgctgacccccaagacagagcctgaggagctggccgtgtcccagggcggggccgccccagccacagaggagagcagcagcagcagcgaggaggaggaggtgcccagcagccctgagccccccaggcctgccaagaggccccggcgggagctgggcagcaagggcctgaagggcggcggcggcggccctgggggctggacctgtggcctgtgccacagctggttccctgagagagatgaatatgtggcccacatgaagaaggagcacggcaagtctgtgaagaagttcccctgccgcctgtgtgagaggagcttctgcagcgcccccagcctgcggagacatgtgcgggtgaaccacgagggcatcaagagggtgtacccctgccgctactgcacagagggcaagaggaccttcagcagccgcctcatcctggagaagcacgtgcaggtgagacatggcctgcagctgggcgcccagagccctggccggggcaccaccctggcccggggcagcagcgcccgggcccagggccctggcaggaagaggcggcagagcagtgacagctgcagcgaggagccagacagcaccaccccaccagccaagagcccccggggcggccctggcagcggcggccacggccccctgcgctaccgcagcagcagcagcacagagcagagcctgatgatgggcctgcgggtggaggatggagcccagcagtgcctggactgtggcctgtgctttgccagccctggcagcctgagccgccaccgcttcatcagccacaagaagagaagaggagtgggcaaggccagcgccctgggcctgggagatggagaggaggaggccccacccagcagaagtgaccctgatggaggagacagccccctgcctgccagcggcggccccctgacctgcaaggtgtgtgggaagagctgtgacagccccctgaacctgaagacccacttccgcacccacggcatggccttcatccgggcccggcagggcgctgtgggggacaactag

SEQ ID NO: 176975 - DNA, 3714 bp, Artificial Sequence; identical to SEQ ID NO: 176974
  Description of Artificial Sequence: Synthetic coding sequence

SEQ ID NO: 176976 - DNA, 3312 bp, Artificial Sequence
  Description of Artificial Sequence: Synthetic coding sequence
atgggagacatgaagaccccagactttgatgacctgctggccgcctttgacatcccagacattgatgccaatgaggccatccacagcggcccagaagaaaatgaaggacctgggggccctgggaagccagagcccggggtgggcagcgagagcgaggacacagctgctgccagcgctggagatggccctggggtgcctgcccaggccagtgaccacggcctgcccccaccagacatctctgtggtgtctgtgattgtgaagaacacagtgtgcccagagcagagcgaggccctggccggcggcagcgctggagatggagcccaggccgccggcgtgaccaaggagggccctgtgggcccccacaggatgcagaatggatttggcagccctgagcccagcctgcccggcaccccccacagccctgcccctccttctgggggcacctggaaggagaagggcatggagggcaagacccccctggacctgtttgcccacttcggccctgagcccggggaccacagcgaccccctgccccccagcgcccccagccccacccgggagggcgccctgaccccaccacccttccccagcagctttgagctggcccaggagaatggacctggcatgcagccccctgtgagcagcccccccctgggcgccctgaagcaggagagctgcagcccccaccacccccaggtgctggcccagcagggcagcggcagcagccccaaggccacagacatcccagccagcgccagccccccacctgtggccggcgtgcccttcttcaagcagagccctggccaccagagccccctggccagccccaaggtgcctgtgtgccagcccctgaaggaggaggatgatgatgagggccctgtggacaagagcagccctggcagcccccagagccccagcagtggagctgaggccgcagatgaggacagcaatgacagccctgccagcagcagcagccggcccctgaaggtgcgcatcaagaccatcaagaccagctgtggcaacatcaccaggacagtgacccaggtgcccagcgaccctgaccccccagcccccctggccgagggcgccttcctggccgaggccagcctgctgaagctgagccctgccacccccaccagcgagggccccaaggtggtgtctgtgcagctgggagatggcacccggctgaagggcaccgtgctgcctgtggccaccatccagaatgccagcacagccatgctgatggccgcctctgtggccaggaaggctgtggtgctgcccggcggcacagccaccagccccaagatgattgccaagaatgtgctgggcctggtgccccaggccctgcccaaggcagatggccgggccggcctgggcaccggcggccagaaggtgaatggagcctctgtggtgatggtgcagcccagcaagacagccaccggccccagcactggaggcggcaccgtcatcagcaggacccagagcagcctggtggaggccttcaacaagatcctgaacagcaagaacctgctgcctgcctaccggcccaacctgagccccccagctgaggccggcctggccctgcccccaacaggctaccgctgcctggagtgtggagatgccttcagcctggagaagagcctggcccggcactatgaccggcgctccatgagaattgaggtgacctgcaaccactgtgcccggcggctggtgttcttcaacaagtgcagcctgctgctgcacgcccgggagcacaaggacaagggcctggtgatgcagtgcagccacctggtgatgaggcctgtggccctggaccagatggtgggccagcctgacatcacccccctgctgcctgtggccgtgccccctgtgtctggccccctggccctgcctgccctgggcaaaggagagggcgccatcaccagcagcgccatcaccaccgtggccgctgaggcccctgtgctgcccctgagcacagagcccccagctgccccagccaccagcgcctacacctgcttccgctgcctggagtgcaaggagcagtgccgggacaaggccggcatggccgcccacttccagcagctgggccccccagcccctggggccaccagcaatgtgtgccccacctgccccatgatgctgcccaaccgctgcagcttcagcgcccaccagaggatgcacaagaacagacctcctcatgtgtgcccagaatgtggcggcaacttcctgcaggccaacttccagacccacctgcgggaggcctgcctgcacgtgtcccggcgggtgggctaccgctgccccagctgcagcgtggtgtttggaggagtgaacagcatcaagagccacatccagaccagccactgtgaggtgttccacaagtgccccatctgccccatggccttcaagagcggccccagcgcccacgcccacctgtacagccagcaccccagcttccagacccagcaggccaagctgatctacaagtgtgccatgtgtgacaccgtcttcacccacaagcccctgctgagcagccactttgaccagcacctgctgccccagagggtgtctgtgttcaagtgccccagctgccccctgctgtttgcccagaagaggaccatgctggagcacctgaagaacacccaccagagcggccgcctggaggagacagctgggaagggggccggcggggccctgctgacccccaagacagagcctgaggagctggccgtgtcccagggcggggccgccccagccacagaggagagcagcagcagcagcgaggaggaggaggtgcccagcagccctgagccccccaggcctgccaagaggccccggcgggagctgggcagcaagggcctgaagggcggcggcggcggccctgggggctggacctgtggcctgtgccacagctggttccctgagagagatgaatatgtggcccacatgaagaaggagcacggcaagtctgtgaagaagttcccctgccgcctgtgtgagaggagcttctgcagcgcccccagcctgcggagacatgtgcgggtgaaccacgagggcatcaagagggtgtacccctgccgcagcaagggccctggcctgcgggctgtgcccctgctgcccagctgccccctgcccttccaggtgctgcaccggggcaagacccacctgcagcagcccccagacccccgggagacctgccccggccctgcccggctggccgcctggggccctgtgccctggccaggggaccacctgggcagcggcttccagtgccagagccctggggcccggtctgagaccccacctgtgttctag

SEQ ID NO: 176977 - DNA, 2121 bp, Artificial Sequence
  Description of Artificial Sequence: Synthetic coding sequence
tgaacagtgctgcctgtggccaccatccagaatgccagcacagccatgctgatggccgcctctgtggccaggaaggctgtggtgctgcccggcggcacagccaccagccccaagatgattgccaagaatgtgctgggcctggtgccccaggccctgcccaaggcagatggccgggccggcctgggcactggaggccagaaggtgaatggagcctctgtggtgatggtgcagcccagcaagacagccaccggccccagcactggaggcggcaccgtcatcagcaggacccagagcagcctggtggaggccttcaacaagatcctgaacagcaagaacctgctgcctgcctaccggcccaacctgagccccccagctgaggccggcctggccctgccccccaccggctaccgctgcctggagtgtggagatgccttcagcctggagaagagcctggcccggcactatgacagaagatccatgagaattgaggtgacctgcaaccactgtgcccggcggctggtgttcttcaacaagtgcagcctgctgctgcacgcccgggagcacaaggacaagggcctggtgatgcagtgcagccacctggtgatgaggcctgtggccctggaccagatggtgggccagcctgacatcacccccctgctgcctgtggccgtgccccctgtgtctggccccctggccctgcctgccctgggcaagggggagggcgccatcaccagcagcgccatcaccaccgtggccgctgaggcccctgtgctgcccctgagcacagagcccccagctgccccagccaccagcgcctacacctgcttccgctgcctggagtgcaaggagcagtgccgggacaaggccggcatggccgcccacttccagcagctgggccccccagcccctggggccaccagcaatgtgtgccccacctgccccatgatgctgcccaaccgctgcagcttcagcgcccaccagaggatgcacaagaaccggcccccccacgtgtgcccagaatgtggcggcaacttcctgcaggccaacttccagacccacctgcgggaggcctgcctgcacgtgtccagaagagtgggctaccgctgccccagctgcagcgtggtgtttggaggagtgaacagcatcaagagccacatccagaccagccactgtgaggtgttccacaagtgccccatctgccccatggccttcaagagcggccccagcgcccacgcccacctgtacagccagcaccccagcttccagacccagcaggccaagctgatctacaagtgtgccatgtgtgacacagtgttcacccacaagcccctgctgagcagccactttgaccagcacctgctgccccagagggtgtctgtgttcaagtgccccagctgccccctgctgtttgcccagaagaggaccatgctggagcacctgaagaacacccaccagagcggccgcctggaggagacagctggaaaaggagctggaggagccctgctgacccccaagacagagcctgaggagctggccgtgtcccagggcggggccgccccagccacagaggagagcagcagcagcagcgaggaggaggaggtgcccagcagccctgagccccccaggcctgccaagaggccccggcgggagctgggcagcaagggcctgaagggcggcggcggcggccctgggggctggacctgtggcctgtgccacagctggttccctgagagagatgaatatgtggcccacatgaagaaggagcacggcaagtctgtgaagaagttcccctgccgcctgtgtgagaggagcttctgcagcgcccccagcctgcggcggcacgtgcgggtgaaccacgagggcatcaagagggtgtacccctgccgcagcaaaggacctggcctgcgggctgtgcccctgctgcccagctgccccctgcccttccaggtgctgcaccggggcaagacccacctgcagcagcccccagacccccgggagacctgccccggccctgcccggctggccgcctggggccctgtgccctggccaggggaccacctgggcagcggcttccagtgccagagccctggggcccggtctgagaccccacctgtgttctag

SEQ ID NO: 176978 - DNA, 450 bp, Artificial Sequence
  Description of Artificial Sequence: Synthetic coding sequence
atgccctgctgcagccaccggcgctgcagagaagatcctggcaccagcgagagccaggagatggaggagtgggccctgctggacatcagccagaggaagctgtacaaggaggtgatgctggagaccttcaggaacctgacctctgtgggcaagtcctggaaggaccagaacatcgagtatgagtaccagaaccccaggaggaacttccgcagcctgattgagaagaaggtgaatgagatcaaggatgacagccactgtggggagaccttcacccaggtgcctgatgaccggctgaacttccaggagaagaaggccagccctgagatcaagagctgtgacagctttgtgtgtggggaggtgggcctgggcaacagcagcttcaacatgaacatccggggggacatcggccacaaggcctatgagtaccaggagtatggccccaagccctag

SEQ ID NO: 176979 - DNA, 1701 bp, Artificial Sequence
  Description of Artificial Sequence: Synthetic coding sequence
atgccctgctgcagccaccggcgctgcagagaagatcctggcaccagcgagagccaggagatggaccctgtggcctttgatgatgtggccgtgaacttcacccaggaggagtgggccctgctggacatcagccagaggaagctgtacaaggaggtgatgctggagaccttcaggaacctgacctctgtgggcaagtcctggaaggaccagaacatcgagtatgagtaccagaaccccaggaggaacttccgcagcctgattgagaagaaggtgaatgagatcaaggatgacagccactgtggggagaccttcacccaggtgcctgatgaccggctgaacttccaggagaagaaggccagccctgagatcaagagctgtgacagctttgtgtgtggggaggtgggcctgggcaacagcagcttcaacatgaacatccggggggacatcggccacaaggcctatgagtaccaggagtatggccccaagccctgcaagtgccagcagcccaagaaggccttccgctaccaccccagcttccgcaccccccagagggaccacactggagagaagccctatgcctgcaaggaatgtgggaagaccttcatcagccacagcagcatccagagacatgtggtgatgcacagcggagatggcccctacaagtgcaagttctgtgggaaggccttccactgcctgagcctgtacctgatccacgagcgcatccacactggagagaagccctatgagtgcaagcagtgtgggaagagcttctcctacagcgccaccctgcgcatccacgagaggacccacactggagagaagccctatgagtgccagcagtgtgggaaggccttccacagcccccgctgctacagaagacatgagcgcatccacactggagagaaggcctaccagtgcaaggaatgtgggaaggccttcacctgcccccagtatgtgcgcatccacgagaggacccacagcaggaagaagccctatgaatgtacccagtgtgggaaggccctgagcagcctgaccagcttccagacccacatccgcatgcacagcggggagcggccctatgagtgcaagatctgtgggaagggcttctgcagcgccaacagcttccagagacatgagaagacccacagcggggagaagccctacaagtgcaagcagtgtgggaaggccttcatccacagcagcagcctgcgctaccacgagcgcatccacactggagagaagccctatgagtgcaagcagtgtgggaaggccttccgcagcagcagccacctgcagctgcacggccgcacccacactggagagaagccctatgagtgccaggagtgtgggaaggccttccgctccatgaagaacctgcagagccatgagaggacccagacccacgtgcgcatccacagcggggagcggccctacaagtgcaagctgtgtgggaagggcttctactgccccaagagcctgcagagacatgagaagacccacactggagagaagctgtatgagtgcaagcagtgtggggaggccttcagcagcagcagcagcttccgctaccacgagaggacccacactggagagaagccctacaagtgcaagcagtgtgggaaggccttccgggccgcctctgtgctgaggatgcacggccgcacccaccctgaggacaagccctatgagtgcaagcagtag

SEQ ID NO: 176980 - DNA, 2061 bp, Artificial Sequence
  Description of Artificial Sequence: Synthetic coding sequence
atggaggtggtgacctttggagatgtggccgtgcacttcagccgggaggagtggcagtgcctggaccccggccagagggccctgtaccgggaggtgatgctggagaaccacagctctgtggccggcctggccggcttcctggtgttcaagccagagctgatcagccggctggagcagggcgaggagccctgggtgctggacctgcagggcgctgagggcacagaggcccccaggaccagcaagacagacagcaccatcagaacagaaaatgagcaggcctgtgaggacatggacatcctgaagtctgagagctatggaacagtggtgcgcatcagcccccaggacttcccccagaaccctggctttggagatgtgtctgacagcgaggtgtggctggacagccacctgggcagccctggcctgaaggtgacaggcttcaccttccagaacaactgcctgaatgaggagaccgtggtgcccaagaccttcaccaaggatgccccccagggctgcaaggagctgggcagcagcggcctggactgccagcccctggagagccagggcgagagcgctgagggcatgagccagagatgtgaggagtgtgggaagggcatccgggccaccagtgacatcgccctgcactgggagatcaacacccagaagatcagccgctgccaggagtgccagaagaagctgagtgactgcctgcagggcaagcacaccaacaactgccacggggagaagccctatgaatgtgccgagtgtgggaaggtgttccggctgtgcagccagctgaaccagcaccagaggatccacactggagagaagcccttcaagtgcacagaatgtgggaaggccttccggctgagcagcaagctgatccagcaccagaggatccacactggagagaagccctaccgctgtgaggagtgtgggaaggccttcggccagagcagcagcctcatccaccaccagaggatccacactggagagcggccctacggctgccgggagtgtgggaaggccttcagccagcagagccagctggtgcgccaccagaggacccacactggagagcggccctacccctgcaaggaatgtgggaaggccttcagccagagcagcaccctggcccagcaccagaggatgcacactggagagaaggcccagatcctgaaggccagtgacagccccagcctggtggcccaccagagaattcatgctgtggagaagcccttcaagtgtgatgaatgtgggaaggccttccgctggatcagccggctgagccagcaccagctgatccacactggagagaagccctacaagtgcaacaagtgcaccaaggccttcggctgcagcagccgcctcatccgccaccagaggacccacactggagagaagcccttcaagtgtgatgaatgtgggaagggctttgtgcagggcagccacctgatccagcaccagaggatccacactggagagaagccctacgtgtgcaatgactgtgggaaggccttcagccagagcagcagcctcatctaccaccagaggatccacaagggggagaagccctatgagtgcctgcagtgtgggaaggccttctccatgagcacccagctgaccatccaccagagggtgcacactggagagcggccctacaagtgcaatgaatgtgggaaggccttcagccagaacagcaccctcttccagcaccagatcatccacgccggcgtgaagccctatgagtgcagtgaatgtgggaaggccttcagccgcagcagctacctgattgagcaccagaggatccacacccgggcccagtggttctatgaatatggaaatgccctggagggcagcacctttgtgtccaggaagaaggtgaacaccatcaagaagctgcaccagtgtgaggactgtgagaagatcttccgctggaggagccacctgatcatccaccagaggatccacactggagagaagccctacaagtgcaatgactgtgggaaggccttcaacagaagcagccggctgacccagcaccagaagatccacatgggctag

SEQ ID NO: 176981 - DNA, 2094 bp, Artificial Sequence
  Description of Artificial Sequence: Synthetic coding sequence
atgggcttcctgggctgctggtgtgtgtccttccaggaggtggtgacctttggagatgtggccgtgcacttcagccgggaggagtggcagtgcctggaccccggccagagggccctgtaccgggaggtgatgctggagaaccacagctctgtggccggcctggccggcttcctggtgttcaagccagagctgatcagccggctggagcagggcgaggagccctgggtgctggacctgcagggcgctgagggcacagaggcccccaggaccagcaagacagacagcaccatcagaacagaaaatgagcaggcctgtgaggacatggacatcctgaagtctgagagctatggcaccgtggtgcgcatcagcccccaggacttcccccagaaccctggctttggagatgtgtctgattctgaggtgtggctggacagccacctgggcagccctggcctgaaggtgacaggcttcaccttccagaacaactgcctgaatgaggagaccgtggtgcccaagaccttcaccaaggatgccccccagggctgcaaggagctgggcagcagcggcctggactgccagcccctggagagccagggcgagagcgctgagggcatgagccagagatgtgaagaatgtgggaagggcatccgggccaccagtgacatcgccctgcactgggagatcaacacccagaagatcagccgctgccaggagtgccagaagaagctgagtgactgcctgcagggcaagcacaccaacaactgccacggggagaagccctatgaatgtgctgaatgtgggaaggtgttccggctgtgcagccagctgaaccagcaccagaggatccacactggagagaagcccttcaagtgcacagaatgtgggaaggccttccggctgagcagcaagctgatccagcaccagaggatccacactggagagaagccctaccgctgtgaagaatgtgggaaggccttcggccagagcagcagcctcatccaccaccagaggatccacactggagagcggccctacggctgcagagaatgtgggaaggccttcagccagcagagccagctggtgcgccaccagaggacccacactggagagcggccctacccctgcaaggaatgtgggaaggccttcagccagagcagcaccctggcccagcaccagaggatgcacactggagagaaggcccagatcctgaaggccagtgacagccccagcctggtggcccaccagagaattcatgctgtggagaagcccttcaagtgtgatgaatgtgggaaggccttccgctggatcagccggctgagccagcaccagctgatccacactggagagaagccctacaagtgcaacaagtgcaccaaggccttcggctgcagcagccgcctcatccgccaccagaggacccacactggagagaagcccttcaagtgtgatgaatgtgggaaaggatttgtgcagggcagccacctgatccagcaccagaggatccacactggagagaagccctacgtgtgcaatgactgtgggaaggccttcagccagagcagcagcctcatctaccaccagaggatccacaagggggagaagccctatgaatgtctgcagtgtgggaaggccttctccatgagcacccagctgaccatccaccagagggtgcacactggagagcggccctacaagtgcaatgaatgtgggaaggccttcagccagaacagcaccctcttccagcaccagatcatccatgctggggtgaagccctatgaatgttctgaatgtgggaaggccttcagccgcagcagctacctgattgagcaccagaggatccacacccgggcccagtggttctatgaatatggaaatgccctggagggcagcacctttgtgtccaggaagaaggtgaacaccatcaagaagctgcaccagtgtgaggactgtgagaagatcttccgctggaggagccacctgatcatccaccagaggatccacactggagagaagccctacaagtgcaatgactgtgggaaggccttcaacagaagcagccggctgacccagcaccagaagatccacatgggctag

SEQ ID NO: 176982 - DNA, 447 bp, Artificial Sequence
  Description of Artificial Sequence: Synthetic coding sequence
atggaggtggtgacctttggagatgtggccgtgcacttcagccgggaggagtggcagtgcctggaccccggccagagggccctgtaccgggaggtgatgctggagaaccacagctctgtggccggcctggccggcttcctggtgttcaagccagagctgatcagccggctggagcagggcgaggagccctgggtgctggacctgcagggcgctgagggcacagaggcccccaggaccagcaagacaggcttcctgggccggcccaccatgggccaggagcccaggcacccccacgcccccccagccacccctgtgcccggcctgcccaagcactgcagccagaggctgaccctgcccccacctggcctgagcagcagccccctgggccacttcctggtgcatgaccaggacagaagaagaggcaccagcgccatctggatggtgtag

SEQ ID NO: 176983 - DNA, 2061 bp, Artificial Sequence; identical to SEQ ID NO: 176980
  Description of Artificial Sequence: Synthetic coding sequence

SEQ ID NO: 176984 - DNA, 1773 bp, Artificial Sequence
  Description of Artificial Sequence: Synthetic coding sequence
atggacatcctgaagtctgagagctatggaacagtggtgcgcatcagcccccaggacttcccccagaaccctggctttggagatgtgtctgacagcgaggtgtggctggacagccacctgggcagccctggcctgaaggtgacaggcttcaccttccagaacaactgcctgaatgaggagaccgtggtgcccaagaccttcaccaaggatgccccccagggctgcaaggagctgggcagcagcggcctggactgccagcccctggagagccagggcgagagcgctgagggcatgagccagagatgtgaggagtgtgggaagggcatccgggccaccagtgacatcgccctgcactgggagatcaacacccagaagatcagccgctgccaggagtgccagaagaagctgagtgactgcctgcagggcaagcacaccaacaactgccacggggagaagccctatgaatgtgccgagtgtgggaaggtgttccggctgtgcagccagctgaaccagcaccagaggatccacactggagagaagcccttcaagtgcacagaatgtgggaaggccttccggctgagcagcaagctgatccagcaccagaggatccacactggagagaagccctaccgctgtgaggagtgtgggaaggccttcggccagagcagcagcctcatccaccaccagaggatccacactggagagcggccctacggctgccgggagtgtgggaaggccttcagccagcagagccagctggtgcgccaccagaggacccacactggagagcggccctacccctgcaaggaatgtgggaaggccttcagccagagcagcaccctggcccagcaccagaggatgcacactggagagaaggcccagatcctgaaggccagtgacagccccagcctggtggcccaccagagaattcatgctgtggagaagcccttcaagtgtgatgaatgtgggaaggccttccgctggatcagccggctgagccagcaccagctgatccacactggagagaagccctacaagtgcaacaagtgcaccaaggccttcggctgcagcagccgcctcatccgccaccagaggacccacactggagagaagcccttcaagtgtgatgaatgtgggaagggctttgtgcagggcagccacctgatccagcaccagaggatccacactggagagaagccctacgtgtgcaatgactgtgggaaggccttcagccagagcagcagcctcatctaccaccagaggatccacaagggggagaagccctatgagtgcctgcagtgtgggaaggccttctccatgagcacccagctgaccatccaccagagggtgcacactggagagcggccctacaagtgcaatgaatgtgggaaggccttcagccagaacagcaccctcttccagcaccagatcatccacgccggcgtgaagccctatgagtgcagtgaatgtgggaaggccttcagccgcagcagctacctgattgagcaccagaggatccacacccgggcccagtggttctatgaatatggaaatgccctggagggcagcacctttgtgtccaggaagaaggtgaacaccatcaagaagctgcaccagtgtgaggactgtgagaagatcttccgctggaggagccacctgatcatccaccagaggatccacactggagagaagccctacaagtgcaatgactgtgggaaggccttcaacagaagcagccggctgacccagcaccagaagatccacatgggctag

SEQ ID NO: 176985 - DNA, 1470 bp, Artificial Sequence
  Description of Artificial Sequence: Synthetic coding sequence
atgaaggagctggaccccaagaatgacatcagcgaggacaagctgtctgtggtgggggaggccaccggcggccccaccagaaatggagcccggggccctggcagcgagggcgtgtgggagcccggctcctggccagagcggcccagaggagatgctggagctgagtgggagcccctgggcatcccccagggcaacaagctgctgggcggctctgtgcctgcctgccacgagctgaaggcctttgccaaccagggctgtgtgctggtgcccccccggctggatgaccccacagagaagggggcctgcccccctgtgcggcggggcaagaacttcagcagcaccagtgacctgagcaagccacccatgccctgtgaggagaagaagacctatgactgcagtgaatgtgggaaggccttcagccgcagcagcagcctcatcaagcaccagaggatccacactggagagaagccctttgaatgtgacacctgtgggaagcacttcatcgagaggagcagcctgaccatccaccagagggtgcacactggagagaagccctatgcctgtggggactgtgggaaggccttcagccagaggatgaacctgactgtgcaccagaggacccacactggagagaagccctacgtgtgtgatgtgtgtgggaaggccttcaggaagaccagcagcctgacccagcacgagcgcatccacactggagagaagccctatgcctgtggggactgtgggaaggccttcagccagaacatgcacctgattgtgcaccagaggacccacactggagagaagccctacgtgtgcccagaatgtggccgggccttcagccagaacatgcacctgacagagcaccagaggacccacactggagagaagccctatgcctgcaaggaatgtgggaaggccttcaacaagagcagcagcctgaccctgcaccagaggaaccacactggagagaagccctacgtgtgtggggagtgtgggaaggccttcagccagagcagctacctgatccagcaccagcgcttccacatcggcgtgaagccctttgaatgttctgaatgtgggaaggccttcagcaagaacagcagcctgacccagcaccagaggatccacactggagagaagccctatgagtgctacatctgcaagaagcacttcaccggccgcagcagcctcatcgtgcaccagatcgtgcacactggagagaagccctacgtgtgtggggagtgtgggaaggccttcagccagagcgcctacctgattgagcaccagaggatccacactggagagaagccctaccgctgtggccagtgtgggaagagcttcatcaagaacagcagcctgactgtgcaccagaggatccacactggagagaagccctaccgctgtggggagtgtgggaagaccttcagcaggaacaccaacctgaccaggcacctgcgcatccacacctag

SEQ ID NO: 176986 - DNA, 2286 bp, Artificial Sequence
  Description of Artificial Sequence: Synthetic coding sequence
atggattctgggggcggcagcctgggcctgcacaccccagacagcaggatggcccacaccatgatcatgcaggactttgtggccggcatggccggcacagcccacattgatggagaccacatcgtggtgtctgtgcctgaggccgtgctggtgtctgatgtggtgacagatgatggcatcaccctggaccacggcctggccgctgaggtggtgcacggccctgacatcatcacagaaacagatgtggtgacagagggcgtcatcgtgcctgaggccgtgctggaggctgatgtggccatcgaggaggacctggaggaggatgatggagaccacatcctgaccagcgagctgatcacagaaacagtgcgggtgcctgagcaggtgtttgtggccgacctggtgacaggccccaacggccacctggagcacgtggtgcaggactgtgtgtctggagtggacagccccaccatggtgtctgaggaggtgctggtgaccaacagcgacacagaaacagtcatccaggccgccggcggcgtgcccggcagcacagtgaccatcaagacagaagatgatgatgatgatgatgtgaagagcaccagcgaggactacctgatgatcagcctggatgatgtgggggagaagctggagcacatgggcaacacccccctgaagattggaagtgatggcagccaggaggatgccaaggaggatggctttggaagtgaggtgatcaaggtgtacatcttcaaggccgaggccgaggatgatgtggagattggaggaacagagatcgtgacagagagcgagtacaccagcggccacagcgtggccggcgtgctggaccagagcaggatgcagcgggagaagatggtgtacatggctgtgaaggacagcagccaggaggaggatgacatcagagatgaaagaagagtgtccagaagatatgaggactgccaggccagcggcaacaccctggacagcgccctggagagccgcagcagcacagctgcccagtacctgcagatctgtgatggcatcaacaccaacaaggtgctgaagcagaaggccaagaagagaagaagaggagagacccggcagtggcagacagctgtgatcattggaccagatggccagcccctgactgtgtacccctgccacatctgcaccaagaagttcaagagccggggcttcctgaagaggcacatgaagaaccacccagaccacctgatgaggaagaagtaccagtgcacagactgtgacttcaccaccaacaagaaggtgtccttccacaaccacctggagagccacaagctgatcaacaaggtggacaagacccatgagttcacagagtacacccggcgctaccgggaggccagccccctgagcagcaacaagctgatcctgcgggacaaggagcccaagatgcacaagtgcaagtactgtgactatgaaacagctgagcagggcctgctgaacagacacctgctggccgtgcacagcaagaacttcccccacgtgtgtgtggagtgtgggaagggcttccgccaccccagcgagctgaagaagcacatgaggacccacactggagagaagccctaccagtgccagtactgcatcttccgctgtgccgaccagagcaacctgaagacccacatcaagagcaagcacggcaacaacctgccctacaagtgtgagcactgcccccaggcctttggagatgagcgggagctgcagaggcacctggacctcttccagggccacaagacccaccagtgcccccactgtgaccacaagagcaccaacagcagtgacctgaagaggcacatcatctctgtgcacaccaaggacttcccccacaagtgtgaggtgtgtgacaagggcttccaccggcccagcgagctgaagaagcacagcgacatccacaagggcaggaagatccaccagtgccgccactgtgacttcaagaccagtgaccccttcatcctgagcggccacatcctgtctgtgcacaccaaggaccagcccctgaagtgcaagcgctgcaagaggggcttccggcagcagaatgagctgaagaagcacatgaagacccacactggaaggaagatctaccagtgtgagtactgtgagtacagcaccacagatgccagcggcttcaagagacatgtgatcagcatccacaccaaggactacccccaccgctgtgagttctgcaagaagggcttcagaagacccagcgagaagaaccagcacatcatgaggcaccacaaggaggccctgatgtag

SEQ ID NO: 176987 - DNA, 2286 bp, Artificial Sequence; identical to SEQ ID NO: 176986
  Description of Artificial Sequence: Synthetic coding sequence

SEQ ID NO: 176988 - DNA, 2310 bp, Artificial Sequence
  Description of Artificial Sequence: Synthetic coding sequence
atgcaggactttgtggccggcatggccggcacagcccacattgatggagaccacatcgtggtgtctgtgcctgaggccgtgctggtgtctgatgtggtgacagatgatggcatcaccctggaccacggcctggccgctgaggtggtgcacggccctgacatcatcacagaaacagatgtggtgacagagggcgtcatcgtgcctgaggccgtgctggaggctgatgtggccatcgaggaggacctggaggaggatgatggagaccacatcctgaccagcgagctgatcacagaaacagtgcgggtgcctgagcaggtgtttgtggccgacctggtgacaggccccaacggccacctggagcacgtggtgcaggactgtgtgtctggagtggacagccccaccatggtgtctgaggaggtgctggtgaccaacagcgacacagaaacagtcatccaggccgccggcggcgtgcccggcagcacagtgaccatcaagacagaagatgatgatgatgatgatgtgaagagcaccagcgaggactacctgatgatcagcctggatgatgtgggggagaagctggagcacatgggcaacacccccctgaagattggaagtgatggcagccaggaggatgccaaggaggatggctttggaagtgaggtgatcaaggtgtacatcttcaaggccgaggccgaggatgatgtggagattggaggaacagagatcgtgacagagagcgagtacaccagcggccacagcgtggccggcgtgctggaccagagcaggatgcagcgggagaagatggtgtacatggctgtgaaggacagcagccaggaggaggatgacatcagctgtgccgagattgctgatgaggtgtacatggaggtgattgtgggggaggaggagggcaccagcctgcctgagatccagctggaggacagtgatgtgaacaagacagtggtgcctgtggtgtgggccgccgcctacggcaacaccctggacagcgccctggagagccgcagcagcacagctgcccagtacctgcagatctgtgatggcatcaacaccaacaaggtgctgaagcagaaggccaagaagagaagaagaggagagacccggcagtggcagacagctgtgatcattggaccagatggccagcccctgactgtgtacccctgccacatctgcaccaagaagttcaagagccggggcttcctgaagaggcacatgaagaaccacccagaccacctgatgaggaagaagtaccagtgcacagactgtgacttcaccaccaacaagaaggtgtccttccacaaccacctggagagccacaagctgatcaacaaggtggacaagacccatgagttcacagagtacacccggcgctaccgggaggccagccccctgagcagcaacaagctgatcctgcgggacaaggagcccaagatgcacaagtgcaagtactgtgactatgaaacagctgagcagggcctgctgaacagacacctgctggccgtgcacagcaagaacttcccccacgtgtgtgtggagtgtgggaagggcttccgccaccccagcgagctgaagaagcacatgaggacccacactggagagaagccctaccagtgccagtactgcatcttccgctgtgccgaccagagcaacctgaagacccacatcaagagcaagcacggcaacaacctgccctacaagtgtgagcactgcccccaggcctttggagatgagcgggagctgcagaggcacctggacctcttccagggccacaagacccaccagtgcccccactgtgaccacaagagcaccaacagcagtgacctgaagaggcacatcatctctgtgcacaccaaggacttcccccacaagtgtgaggtgtgtgacaagggcttccaccggcccagcgagctgaagaagcacagcgacatccacaagggcaggaagatccaccagtgccgccactgtgacttcaagaccagtgaccccttcatcctgagcggccacatcctgtctgtgcacaccaaggaccagcccctgaagtgcaagcgctgcaagaggggcttccggcagcagaatgagctgaagaagcacatgaagacccacactggaaggaagatctaccagtgtgagtactgtgagtacagcaccacagatgccagcggcttcaagagacatgtgatcagcatccacaccaaggactacccccaccgctgtgagttctgcaagaagggcttcagaagacccagcgagaagaaccagcacatcatgaggcaccacaaggaggccctgatgtag

SEQ ID NO: 176989 - DNA, 1812 bp, Artificial Sequence
  Description of Artificial Sequence: Synthetic coding sequence
atgatcagcctggatgatgtgggggagaagctggagcacatgggcaacacccccctgaagattggaagtgatggcagccaggaggatgccaaggaggatggctttggaagtgaggtgatcaaggtgtacatcttcaaggccgaggccgaggatgatgtggagattggaggaacagagatcgtgacagagagcgagtacaccagcggccacagcgtggccggcgtgctggaccagagcaggatgcagcgggagaagatggtgtacatggctgtgaaggacagcagccaggaggaggatgacatcagctgtgccgagattgctgatgaggtgtacatggaggtgattgtgggggaggaggagggcaccagcctgcctgagatccagctggaggacagtgatgtgaacaagacagtggtgcctgtggtgtgggccgccgcctatggagatgaaagaagagtgtccagaagatatgaggactgccaggccagcggcaacaccctggacagcgccctggagagccgcagcagcacagctgcccagtacctgcagatctgtgatggcatcaacaccaacaaggtgctgaagcagaaggccaagaagagaagaagaggagagacccggcagtggcagacagctgtgatcattggaccagatggccagcccctgactgtgtacccctgccacatctgcaccaagaagttcaagagccggggcttcctgaagaggcacatgaagaaccacccagaccacctgatgaggaagaagtaccagtgcacagactgtgacttcaccaccaacaagaaggtgtccttccacaaccacctggagagccacaagctgatcaacaaggtggacaagacccatgagttcacagagtacacccggcgctaccgggaggccagccccctgagcagcaacaagctgatcctgcgggacaaggagcccaagatgcacaagtgcaagtactgtgactatgaaacagctgagcagggcctgctgaacagacacctgctggccgtgcacagcaagaacttcccccacgtgtgtgtggagtgtgggaagggcttccgccaccccagcgagctgaagaagcacatgaggacccacactggagagaagccctaccagtgccagtactgcatcttccgctgtgccgaccagagcaacctgaagacccacatcaagagcaagcacggcaacaacctgccctacaagtgtgagcactgcccccaggcctttggagatgagcgggagctgcagaggcacctggacctcttccagggccacaagacccaccagtgcccccactgtgaccacaagagcaccaacagcagtgacctgaagaggcacatcatctctgtgcacaccaaggacttcccccacaagtgtgaggtgtgtgacaagggcttccaccggcccagcgagctgaagaagcacagcgacatccacaagggcaggaagatccaccagtgccgccactgtgacttcaagaccagtgaccccttcatcctgagcggccacatcctgtctgtgcacaccaaggaccagcccctgaagtgcaagcgctgcaagaggggcttccggcagcagaatgagctgaagaagcacatgaagacccacactggaaggaagatctaccagtgtgagtactgtgagtacagcaccacagatgccagcggcttcaagagacatgtgatcagcatccacaccaaggactacccccaccgctgtgagttctgcaagaagggcttcagaagacccagcgagaagaaccagcacatcatgaggcaccacaaggaggccctgatgtag

SEQ ID NO: 176990 - DNA, 1611 bp, Artificial Sequence
  Description of Artificial Sequence: Synthetic coding sequence
atgggccccctgcagttcagagatgtggccatcgagttcagcctggaggagtggcactgcctggacacagcccagaggaacctgtacagaaatgtgatgctggagaactacagaaacctggtgttcctgggcatcgtggtgtccaagccagacctgatcacctgcctggagcagggcaagaagcccctgaccatgaagaagcatgagatggtggccaaccccagcgtgacctgcagccactttgcccgggacctgtggccagagcagagcatcaaggacagcttccagaaggtgaccctgcggcgctatgagaactacggccatgacaacctgcagttcaagaagggctgtgagagcgtggatgagtgcaaggtgcacaagaggggctacaacggcctgaaccagtacctgaccaccacccagagcaagatcttccagtgtgacaagtatgtgaaggtgatccacaagttcagcaacagcaacagacacaagatccgccacacaggcaagaagcccttcaagtgcattgaatgtgggaaggccttcaaccagagcagcaccctgaccacccacaagaagatccacactggagagaagcccttcaagtgtgaagaatgtgggaaggccttcaactggagcagccacctgaccacccacaagaggatccacactggagagaagcgctacaagtgtgaggactgtgggaaggccttcagccgcttctcctacctgacagcccacaagatcatccacagcggggagaagccctacaagtgtgaagaatgtgggaaggccttcaagaggagcagcaacctgaccacccacaagatcatccacactggagagaagccctacaagtgtgaagaatgtgggaaggccttcaagaggagcagcatcctgacagcccacaagatcatccacagcggggagaagccctacaagtgtgaagaatgtgggaaggccttcaagcaccccagcgtgctgaccacccacaagaggatccacactggagagaagccctacaagtgtgaagaatgtggccgggccttcaagtacttcagcagcctgaccacccacaagatcatccacagcggggagaagccctacaagtgtgaagaatgtgggaaggccttcaactggagcagccacctgaccacccacaagaggatccacactggagagaagccctacaagtgtgaagaatgtggggaggccttcaagtacagcagcagcctgaccacccacaagatcatccacacaggccagcagcccttcaagtgtgaagaatgtgggaaggccttcaagtgcttcagcatcctgaccacccacaagaggatccacactggagagaagccctacaagtgtgaagaatgtgggaaggccttcaacagcagcagccacctgacagcccacaagaggatccacactggagagaagccctacaagtgtgagcgctgtgggaaggccttcaagaggagcttcatcctgaccaggcacaagaggatccacactggagagaagccctacaagtgtgaagaatgtgggaagggcttcaagtgccccagcaccctgaccacccacaaggtgatccacactggagagaagctgtag

SEQ ID NO: 176991 - DNA, 1935 bp, Artificial Sequence
  Description of Artificial Sequence: Synthetic coding sequence
atggagatcccagcccctgagcctgagaagacagccctgagcagccaggaccctgccctgagcctgaaggagaacctggaggacatcagcggctggggcctgcctgaggcccggagcaaggagagcgtgtccttcaaggatgtggccgtggacttcacccaggaggagtggggccagctggacagcccccagagggccctgtacagagatgtgatgctggagaactaccagaacctgctggccctgggcccccccctgcacaagccagatgtgatcagccacctggagcggggggaggagccctggagcatgcagcgggaggtgccccggggcccctgcccagagtgggagctgaaggctgtgcccagccagcagcagggcatctgcaaggaggagcccgcccaggagcccatcatggagcggcccctgggcggggcccaggcctggggccggcaggccggggccctgcagaggagccaggccgccccctgggccccagccccagccatggtgtgggatgtgcctgtggaggagttccccctgcgctgccccctgtttgcccagcagagggtgcctgagggcggccccctgctggacaccaggaagaatgtgcaggccacagagggccgcaccaaggccccagcccggctgtgtgctggagaaaatgccagcaccccatctgagcctgagaagttcccccaggtgcggcggcagagaggagctggagctggggagggggagtttgtgtgtggggagtgtgggaaggccttccggcagagcagcagcctgaccctgcaccggcgctggcacagccgggagaaggcctacaagtgtgatgaatgtgggaaggccttcacctggagcaccaacctgctggagcaccggcgcatccacactggagagaagcccttcttctgtggggagtgtgggaaggccttcagctgccacagcagcctgaatgtgcaccagaggatccacactggagagcggccctacaagtgcagcgcctgtgagaaggccttcagctgcagcagcctgctgtccatgcacctgcgggtgcacactggagagaagccctaccgctgtggggagtgtgggaaggccttcaaccagaggacccacctgaccaggcaccaccgcatccacactggagagaagccctaccagtgtggcagctgtgggaaggccttcacctgccacagcagcctgactgtgcatgagaagatccacagcggggacaagcccttcaagtgcagcgactgtgagaaggccttcaacagccgcagccggctgaccctgcaccagaggacccacactggagagaagcccttcaagtgtgccgactgtgggaagggcttcagctgccacgcctacctgctggtgcaccggcgcatccacagcggggagaagcccttcaagtgcaatgaatgtgggaaggccttcagcagccacgcctacctgattgtgcaccggcgcatccacactggagagaagccctttgactgcagccagtgctggaaggccttcagctgccacagcagcctcatcgtgcaccagaggatccacactggagagaagccctacaagtgcagtgaatgtggccgggccttcagccagaaccactgcctgatcaagcaccagaagatccacagcggggagaagagcttcaagtgtgagaagtgtggggagatgttcaactggagcagccacctgacagagcaccagaggctgcacagcgagggcaagcccctggccatccagttcaacaagcacctgctgagcacctactacgtgcccggcagcctgctgggcgctggagatgctggcctgagagatgtggaccccattgatgccctggatgtggccaagctgctgtgtgtggtgcccccccgggccggcaggaacttcagcctgggcagcaagcccagaaattag

SEQ ID NO: 176992 - DNA, 1935 bp, Artificial Sequence; identical to SEQ ID NO: 176991
  Description of Artificial Sequence: Synthetic coding sequence

SEQ ID NO: 176993 - DNA, 1839 bp, Artificial Sequence
  Description of Artificial Sequence: Synthetic coding sequence
atggagatcccagcccctgagcctgagaagacagccctgagcagccaggaccctgccctgagcctgaaggagaacctggaggacatcagcggctggggcctgcctgaggcccggagcaaggagagcgtgtccttcaaggatgtggccgtggacttcacccaggaggagtggggccagctggacagcccccagagggccctgtacagagatgtgatgctggagaactaccagaacctgctggccctggagtgggagctgaaggctgtgcccagccagcagcagggcatctgcaaggaggagcccgcccaggagcccatcatggagcggcccctgggcggggcccaggcctggggccggcaggccggggccctgcagaggagccaggccgccccctgggccccagccccagccatggtgtgggatgtgcctgtggaggagttccccctgcgctgccccctgtttgcccagcagagggtgcctgagggcggccccctgctggacaccaggaagaatgtgcaggccacagagggccgcaccaaggccccagcccggctgtgtgctggagaaaatgccagcaccccatctgagcctgagaagttcccccaggtgcggcggcagagaggagctggagctggggagggggagtttgtgtgtggggagtgtgggaaggccttccggcagagcagcagcctgaccctgcaccggcgctggcacagccgggagaaggcctacaagtgtgatgaatgtgggaaggccttcacctggagcaccaacctgctggagcaccggcgcatccacactggagagaagcccttcttctgtggggagtgtgggaaggccttcagctgccacagcagcctgaatgtgcaccagaggatccacactggagagcggccctacaagtgcagcgcctgtgagaaggccttcagctgcagcagcctgctgtccatgcacctgcgggtgcacactggagagaagccctaccgctgtggggagtgtgggaaggccttcaaccagaggacccacctgaccaggcaccaccgcatccacactggagagaagccctaccagtgtggcagctgtgggaaggccttcacctgccacagcagcctgactgtgcatgagaagatccacagcggggacaagcccttcaagtgcagcgactgtgagaaggccttcaacagccgcagccggctgaccctgcaccagaggacccacactggagagaagcccttcaagtgtgccgactgtgggaagggcttcagctgccacgcctacctgctggtgcaccggcgcatccacagcggggagaagcccttcaagtgcaatgaatgtgggaaggccttcagcagccacgcctacctgattgtgcaccggcgcatccacactggagagaagccctttgactgcagccagtgctggaaggccttcagctgccacagcagcctcatcgtgcaccagaggatccacactggagagaagccctacaagtgcagtgaatgtggccgggccttcagccagaaccactgcctgatcaagcaccagaagatccacagcggggagaagagcttcaagtgtgagaagtgtggggagatgttcaactggagcagccacctgacagagcaccagaggctgcacagcgagggcaagcccctggccatccagttcaacaagcacctgctgagcacctactacgtgcccggcagcctgctgggcgctggagatgctggcctgagagatgtggaccccattgatgccctggatgtggccaagctgctgtgtgtggtgcccccccgggccggcaggaacttcagcctgggcagcaagcccagaaattag

SEQ ID NO: 176994 - DNA, 210 bp, Artificial Sequence
  Description of Artificial Sequence: Synthetic coding sequence
atggagatcccagcccctgagcctgagaagacagccctgagcagccaggaccctgccctgagcctgaaggagaacctggaggacatcagcggctggggcctgcctgaggcccggagcaagagcctggccctggtgacccaggccggcgtgcagtggaggaacctgggcagcctgcagcccccacccctgggcttcaagcagttctcctag

SEQ ID NO: 176995 - DNA, 1935 bp, Artificial Sequence
  Description of Artificial Sequence: Synthetic coding sequence
atggccgaggccgtggccgcccccatcagcccctggaccatggccgccaccatccaggccatggagaggaagattgagagccaggccgcccggctgctgagcctggagggccgcacaggcatggccgagaagaagctggccgactgtgagaagacagctgtggagtttggaaaccagctggagggcaagtgggccgtgctgggcaccctgctgcaggagtatggcctgctgcagaggcggctggagaatgtggagaacctgctgaggaacagaaacttctggatcctgcggctgcccccaggcagcaaaggagagagccccaaggagtggggcaagctggaggactggcagaaggagctgtacaagcacgtgatgaggggcaactatgagaccctggtgtccctggactatgccatcagcaagccagaggtgctgagccagatcgagcagggcaaggagccctgcaactggaggcggcccggccccaagatcccagatgtgcctgtggaccccagccctggcagcggcccccctgtgcctgccccagacctgctgatgcagatcaagcaggagggggagctgcagctgcaggagcagcaggccctgggcgtggaggcctgggccgccggccagcctgacatcggggaggagccctggggcctgagccagctggacagcggggccggggacatcagcacagatgccaccagcggcgtgcacagcaacttcagcaccaccatcccccccacctcctggcagacagacctgcccccccaccaccccagcagcgcctgcagtgatggcaccctgaagctgaacacagctgccagcacagaagatgtgaagatcgtcatcaagacagaggtgcaggaggaggaggtggtggccacccctgtgcaccccacagacctggaggcccacggcaccctgtttggacctggccaggccacccgcttcttccccagccctgcccaggagggcgcctgggagagccagggcagcagcttccccagccaggaccctgtgctgggcctgcgggagcccgcccggcctgagcgggacatgggagagctgagccctgctgtggcccaggaggagaccccacctggggactggctgtttggaggagtgcgctggggctggaacttccgctgcaagccccctgtgggcctgaaccccaggactggacctgagggcctgccctacagcagcccagacaatggagaggccatcctggaccccagccaggccccccggcccttcaatgagccctgcaagtacccaggccgcaccaagggcttcggccacaagccaggcctgaagaagcaccctgctgcccctcctgggggccggcccttcacctgtgccacctgtgggaagagcttccagctgcaggtgtccctgagcgcccaccagaggagctgtggggccccagatggcagcggccctggcactggaggcggcggcagcggcagcggcggcggcggcggcggcagcggcggcggcagcgccagagatggcagcgccctgcgctgtggggagtgtggccgctgcttcaccaggcctgcccacctgatccgccacaggatgctgcacactggagagcggcccttcccctgcacagaatgtgagaagcgcttcacagagaggagcaagctgattgaccactaccgcacccacactggagtgcggcccttcacctgcaccgtgtgtgggaagagcttcatcaggaaggaccacctgaggaagcaccagaggaaccacgccgccggggccaagaccccagcccggggccagcccctgcccaccccaccagcccccccagaccccttcaagagccctgccagcaagggccccctggccagcacagacctggtgacagactggacctgtggcctgtctgtgctgggccccacagatggaggagacatgtag

SEQ ID NO: 176996 - DNA, 1938 bp, Artificial Sequence
  Description of Artificial Sequence: Synthetic coding sequence
atggccgaggccgtggccgcccccatcagcccctggaccatggccgccaccatccaggccatggagaggaagattgagagccaggccgcccggctgctgagcctggagggccgcacaggcatggccgagaagaagctggccgactgtgagaagacagctgtggagtttggaaaccagctggagggcaagtgggccgtgctgggcaccctgctgcaggagtatggcctgctgcagaggcggctggagaatgtggagaacctgctgaggaacagaaacttctggatcctgcggctgcccccaggcagcaaaggagagagccccaaggagtggggcaagctggaggactggcagaaggagctgtacaagcacgtgatgaggggcaactatgagaccctggtgtccctggactatgccatcagcaagccagaggtgctgagccagatcgagcagggcaaggagccctgcaactggaggcggcccggccccaagatcccagatgtgcctgtggaccccagccctggcagcggcccccctgtgcctgccccagacctgctgatgcagatcaagcaggagggggagctgcagctgcaggagcagcaggccctgggcgtggaggcctgggccgccggccagcctgacatcggggaggagccctggggcctgagccagctggacagcggggccggggacatcagcacagatgccaccagcggcgtgcacagcaacttcagcaccaccatcccccccacctcctggcagacagacctgcccccccaccaccccagcagcgcctgcagtgatggcaccctgaagctgaacacagctgccagcacagaagcagatgtgaagatcgtcatcaagacagaggtgcaggaggaggaggtggtggccacccctgtgcaccccacagacctggaggcccacggcaccctgtttggacctggccaggccacccgcttcttccccagccctgcccaggagggcgcctgggagagccagggcagcagcttccccagccaggaccctgtgctgggcctgcgggagcccgcccggcctgagcgggacatgggagagctgagccctgctgtggcccaggaggagaccccacctggggactggctgtttggaggagtgcgctggggctggaacttccgctgcaagccccctgtgggcctgaaccccaggacaggccctgagggcctgccctacagcagcccagacaacggggaggccatcctggaccccagccaggccccccggcccttcaatgagccctgcaagtacccaggccgcaccaagggcttcggccacaagccaggcctgaagaagcaccctgctgcccctcctgggggccggcccttcacctgtgccacctgtgggaagagcttccagctgcaggtgtccctgagcgcccaccagaggagctgtggggccccagatggcagcggccctggcaccggcggcggcggcagcggcagcggcggcggcggcggcggcagcggcggcggcagcgccagagatggcagcgccctgcgctgtggagaatgtggccgctgcttcaccaggcctgcccacctgatccgccacaggatgctgcacactggagagcggcccttcccctgcacagaatgtgagaagcgcttcacagagaggagcaagctgattgaccactaccgcacccacactggagtgcggcccttcacctgcaccgtgtgtgggaagagcttcatcaggaaggaccacctgaggaagcaccagagaaatcatgctgctggggccaagaccccagcccggggccagcccctgcccaccccaccagcccccccagaccccttcaagagccctgccagcaagggccccctggccagcacagacctggtgacagactggacctgtggcctgtctgtgctgggccccacagatggaggagacatgtag

SEQ ID NO: 176997 - DNA, 2172 bp, Artificial Sequence
  Description of Artificial Sequence: Synthetic coding sequence
atgagcctgctgaaggagaggaagcccaagaagccccactacatcccccggcccccaggcaagcccttcaagtacaagtgcttccagtgccccttcacctgcaatgagaagagccacctgttcaaccacatgaagtatggcctgtgcaagaacagcatcaccctggtgtctgagcaggacagagtgcccaagtgccccaagagcaacagcctggaccccaagcagaccaaccagccagatgccacagccaagccagccagcagcaagtctgtggccaacggcctgagcgcctttgacagcaagctgcagcacagcagcgcccgggaggacatcaaggagaacctggagctgcaggcccggggcacccaccgctgcctgggccagaagccagccctgcaccgggccagcccctgcaagagccctgcccctgaggccgccctgggcgcccagcctgccctggagggcgccgcccggcccagcgcctttgtgcctgtgggggagcaccggctgaagggccctgacaatgctgaggcccctgagaccctggccctgcacaaccccacagccaaggctgtgtccttccacaccaagagcgccttccacaccccaggctacccctggaaggccggcagccccttcctgcccccagagttcccccacaagatcagcagcaccaagggcctgggcgccatcagcccctacatgcaccccaccatccctgagtacccaccccacttctacacagagcacggcctggccaccatctacagcccctacctgctggccggcagcagcccagaatgtgatgcccccctgctgtctgtgtatggcacccaggaccccaggcacttcctgccccaccctggccccatccccaagcacctggcccccagccctgccacctatgaccactaccgcttcttccagcagtaccccagcaacctgcccatcccctacggcttctacagacctgagagcgccttcagcagctatggcctgcggctgccccctgtgacaggcctgacccgggaccagagcagccacctgctggaggaggccaccctggtgtacccagccagcagccccagccggctgaaccccagcgaccccaacaggaagcacgtggagtttgagagccccatccctgaggccaaggacagcagcaaggccggccagagggacacagagggcagcaagatgagcccccgggccggcagcgctgccaccggcagccctggccggcccagccccacagacttcatgcagaccagccagacctgtgagggcctgtatgacctgagcaacaaggccgccagcagcgccctgggccgcctgtacccacctgagcagagcctgacagccttccggcctgtgaagaagagcacagaatgtctgcctgcccaggccgctgagaccacagctgagagccctgtgtccctgaatgtggtgaatggagaccccccagcccccactggaagtgccagcctggtgtctgaggccgcccccagcagcccagatgacagcagcggcatgggccccctgaacctgagcaagaagtctgagatcaacctggccgccacccatgagcccacctaccagggcagcccccaggccgagacagccagcttcagcgagctgcaggacctgcccctgaacctgtctgtgaaggacccctgcaacacccaggcccccaggcctgccttccctggccggcccagggctgctgagcctgctgctgctgtgccccagaagacaggaacagagggctctgaagatggccccagccaccctgagaccaagccaggcagcctggatggagatggagccccacccaccggccctggagaggaggccccagatgcctgtgctgtggacagcagcgaggagcagaagcagacagctgctgtggccctgtgccagctggccgcctacagccccaggaacatccgggtgggagatggagatgctgctgcccctgagcccgcctgccggcaggacacccccaccctgagctccatggagagccaggaggcccagtgtgacctgcggcccaagggccagaagaggaccagcctgagagatgctgggaagagccagcagggcgccaagaaggccaagctgcaggacacagcccgggtcttcaccctgcggcggcgggcccgggtgtcctag

SEQ ID NO: 176998 - DNA, 951 bp, Artificial Sequence
  Description of Artificial Sequence: Synthetic coding sequence
atgagccccagggctggcagcgctgccaccggcagccctggccggcccagccccacagacttcatgcagaccagccagacctgtgagggcctgtatgacctgagcaacaaggccgccagcagcgccctgggccgcctgtacccacctgagcagagcctgacagccttccggcctgtgaagaagagcacagagtgcctgcctgcccaggccgctgagaccacagctgagagccctgtgtccctgaatgtggtgaatggagaccccccagcccccaccggcagcgccagcctggtgtctgaggccgcccccagcagcccagatgacagcagcggcaagtctgagatcaacctggccgccacccatgagcccacctaccagggcagcccccaggccgagacagccagcttcagcgagctgcaggacctgcccctgaacctgtctgtgaaggacccctgcaacacccaggcccccaggcctgccttccctggccggcccagggctgctgagcctgctgctgctgtgccccagaagacaggaacagagggctctgaagatggccccagccaccctgagaccaagccaggcagcctggatggagatggagcccccccaactggacctggagaggaggccccagatgcctgtgctgtggacagcagcgaggagcagaagcagacagctgctgtggccctgtgccagctggccgcctacagccccaggaacatccgggtgggagatggagatgctgctgcccctgagcccgcctgccggcaggacacccccaccctgagctccatggagagccaggaggcccagtgtgacctgcggcccaagggccagaagaggaccagcctgagagatgctgggaagagccagcagggcgccaagaaggccaagctgcaggacacagcccgggtcttcaccctgcggcggcgggcccgggtgtcctag

SEQ ID NO: 176999 - DNA, 891 bp, Artificial Sequence
  Description of Artificial Sequence: Synthetic coding sequence
atgtacttcagccaggaggagtgggagctgctggaccccacccagaaggccctgtacaatgatgtgatgcaggagaactatgaaacagtcatcagcctggccctgtttgtgctgcccaagcccaaggtgatcagctgcctggagcagggcgaggagccctgggtgcaggtgtccccagagttcaaggacagcgctgggaagagccccaccggcctgaagctgaagaatgacacagagaaccaccagcctgtgtccctgagtgacctggagatccaggccagcgctggggtcatcagcaagaaggccaaggtgaaggtgccccagaagacagctgggaaggagaaccactttgacatgcaccgggtgggcaagtggcaccaggacttccctgtgaagaagaggaagaagctgagcacctggaagcaggagctgctgaagctgatggacagacacaagaaggactgtgcccgggagaagcccttcaagtgccaggagtgtgggaagaccttccgggtgtccagtgacctgatcaagcaccagaggatccacacagaggagaagccctacaagtgccagcagtgtgacaagcgcttccgctggagcagtgacctgaacaagcacctgaccacccaccagggcatcaagccctacaagtgctcctggtgtgggaagagcttcagccagaacaccaacctgcacacccaccagaggacccacactggagagaagcccttcacctgccatgaatgtgggaagaagttcagccagaacagccacctgatcaagcacaggaggacccacactggagagcagccctacacctgcagcatctgcagaagaaacttcagccgccgcagcagcctgctgcggcaccagaagctgcacctgtag

SEQ ID NO: 177000 - DNA, 891 bp, Artificial Sequence; identical to SEQ ID NO: 176999
  Description of Artificial Sequence: Synthetic coding sequence

SEQ ID NO: 177001 - DNA, 1248 bp, Artificial Sequence
  Description of Artificial Sequence: Synthetic coding sequence
atggccatgagggagctgaatgctgacagctgcagcagcccccagatgggcgccatgtgggagaccagcggctctgtgaaggagaacagcagccagagcaagaagtacagcaccaagattgagaacctgggccctgagagcgcctgccgccacttctggagcttccgctaccacgaggccaccggccccctggagaccatcagccagctgcagaagctgtgccaccagtggctgcggcctgagatccacagcaaggagcagatcctggagatgctggtgctggagcagttcctgagcatcctgcccaaggagacccagaactgggtgcagaagcaccacccccagaatgtgaagcaggccctggtgctggtggagttcctgcagcgggagccagatggcaccaagaatgaaagcctgctgacctttgaagatgtggccgtgtacttcagcgaggaggagtggcagctgctgaaccccctggagaagaccctgtacaatgatgtgatgcaggacatctatgaaacagtcatcagcctgggcctgaagctgaagaatgacacaggaaatgaccaccccatctctgtgtccaccagcgagatccagaccagcggctgtgaggtgtccaagaagaccaggatgaagatcgcccagaagaccatgggcagagaaaatcctggggacacccacagcgtgcagaagtggcaccgggccttccccaggaagaagaggaagaagccagccacctgcaagcaggagctgcccaagctgatggacctgcacggcaagggccccactggagagaagcccttcaagtgccaggagtgtgggaagagcttccgggtgtccagtgacctgatcaagcaccaccgcatccacactggagagaagccctacaagtgccagcagtgtgaccggcgcttccgctggagcagtgacctgaacaagcacttcatgacccaccagggcatcaagccctaccgctgctcctggtgtgggaagagcttcagccacaacaccaacctgcacacccaccagaggatccacactggagagaagcccttcaagtgtgatgaatgtgggaagcgcttcatccagaacagccacctgatcaagcaccagaggacccacactggagagcagccctacacctgcagcctgtgcaagaggaacttcagcagaagaagcagcctgctgcggcaccagaagctgcacagaagaagagaggcctgcctggtgagccccaactag

SEQ ID NO: 177002 - DNA, 1533 bp, Artificial Sequence
  Description of Artificial Sequence: Synthetic coding sequence
atggccatgagggagctgaatgctgacagctgcagcagcccccagatgggcgccatgtgggagaccagcggctctgtgaaggagaacagcagccagagcaagaagtacagcaccaagattgagaacctgggccctgagagcgcctgccgccacttctggagcttccgctaccacgaggccaccggccccctggagaccatcagccagctgcagaagctgtgccaccagtggctgcggcctgagatccacagcaaggagcagatcctggagatgctggtgctggagcagttcctgagcatcctgcccaaggagacccagaactgggtgcagaagcaccacccccagaatgtgaagcaggccctggtgctggtggagttcctgcagcgggagccagatggcaccaagaatgaggtgacagcccacgagctgggcaaggaggccgtgctgctgggcggcacagctgtggcccctggcttcaagtggaagccagctgagccccagcccatgggcgtcttccagaaggagtactggaacacctacagagtgctgcaggagcagctgggctggaacacccacaaggagacccagcctgtgtatgaaagagctgtgcatgaccagcagatgctggccctgtctgagcagaagaggatcaagcactggaagatggccagcaagctgatcctgcctgagagcctgagcctgctgacctttgaagatgtggccgtgtacttcagcgaggaggagtggcagctgctgaaccccctggagaagaccctgtacaatgatgtgatgcaggacatctatgagaccgtcatcagcctgggcctgaagctgaagaatgacacaggaaatgaccaccccatctctgtgtccaccagcgagatccagaccagcggctgtgaggtgtccaagaagaccaggatgaagatcgcccagaagaccatgggccgggagaaccctggggacacccacagcgtgcagaagtggcaccgggccttccccaggaagaagaggaagaagccagccacctgcaagcaggagctgcccaagctgatggacctgcacggcaagggccccaccggggagaagcccttcaagtgccaggagtgtgggaagagcttccgggtgtccagtgacctgatcaagcaccaccgcatccacactggagagaagccctacaagtgccagcagtgtgaccggcgcttccgctggagcagtgacctgaacaagcacttcatgacccaccagggcatcaagccctaccgctgctcctggtgtgggaagagcttcagccacaacaccaacctgcacacccaccagaggatccacactggagagaagcccttcaagtgtgatgaatgtgggaagcgcttcatccagaacagccacctgatcaagcaccagaggacccacactggagagcagccctacacctgcagcctgtgcaagaggaacttcagccgccgcagcagcctgctgcggcaccagaagctgcacagaagaagagaggcctgcctggtgagccccaactag

SEQ ID NO: 177003 - DNA, 1548 bp, Artificial Sequence
  Description of Artificial Sequence: Synthetic coding sequence
atggagagcctgggcctgcacacagtgaccctgagtgatggcaccacagcctacgtgcagcaggccgtgaagggggagaagctgctggagggccaggtgatccagctggaggatggcaccacagcctacatccaccaggtgacagtgcagaaggaggccctgagctttgaagatggccagcctgtgcagctggaggatggctccatggcctacatccacaggaccccccgggagggctatgaccccagcaccctggaggccgtgcagctggaggatggcagcacagcctacatccaccaccctgtggccgtgcccagcgagagcaccatcctggccgtgcagacagaggtgggcctggaggacctggccgcagaagatgatgagggcttcagcgcagatgctgtggtggccctggagcagtatgccagcaaggtgctgcatgacagccagatccccagaaatggcaagggccagcaggtgggggaccgggccttccgctgtggctacaagggctgcggccgcctgtacaccacagcccaccacctgaaggtgcatgagcgggcccacactggagaccggccctaccgctgtgacttccccagctgtgggaaggcctttgccaccggctacggcctgaagagccacgtgaggacccacactggagagaagccctacaagtgcccagaggagctgtgcagcaaggccttcaagaccagcggggacctgcagaagcacgtgaggacccacactggagagcggcccttccagtgcccctttgagggctgcggccgctccttcaccaccagcaacatcaggaaggtgcacgtgaggacccacactggagagcggccctacacctgcccagagccccactgcggccggggcttcaccagcgccaccaactacaagaaccacgtgcgcatccacactggagagaagccctacgtgtgcaccgtgcccggctgtgggaagcgcttcacagagtacagcagcctgtacaagcaccacgtggtgcacacccactgcaagccctacacctgcagcacctgtgggaagacctaccggcagaccagcaccctggccatgcacaagaggtctgcccacggggagctggaggccacagaggagagcgagcaggccctgtatgagcagcagcagctggaggccgccagcgctgctgaggagagccccccacccaagaggccccgcatcgcctacctgtctgaggtgaaggaggagagagatgacatcccagcccaggtggccatggtgacagaagaagatggagccccccaggtggccctgatcacccaggatggagcccagcaggtgaccatcatcaccagcggggctgtggtggccgaggacagctctgtggccagcctgcggcaccagcaggtggccctgctggccacagccaacggcacccacatcgctgtgcagctggaggagcagcagaccctggaggaggccatcaacgtggccacagctgccatgcagcagggcgctgtgaccctggagaccaccgtgtctgagagcggctgctag

SEQ ID NO: 177004 - DNA, 1713 bp, Artificial Sequence
  Description of Artificial Sequence: Synthetic coding sequence
atggagagcctgggcctgcacacagtgaccctgagtgatggcaccacagcctacgtgcagcaggccgtgaagggggagaagctgctggagggccaggtgatccagctggaggatggcaccacagcctacatccaccaggtgacagtgcagaaggaggccctgagctttgaagatggccagcctgtgcagctggaggatggctccatggcctacatccacaggaccccccgggagggctatgaccccagcaccctggaggccgtgcagctggaggatggcagcacagcctacatccaccaccctgtggccgtgcccagcgagagcaccatcctggccgtgcagacagaggtgggcctggaggacctggccgcagaagatgatgagggcttcagcgcagatgctgtggtggccctggagcagtatgccagcaaggtgctgcatgacagccagatccccagaaatggcaagggccagcaggtgggggaccgggccttccgctgtggctacaagggctgcggccgcctgtacaccacagcccaccacctgaaggtgcatgagcgggcccacactggagaccggccctaccgctgtgacttccccagctgtgggaaggcctttgccaccggctacggcctgaagagccacgtgaggacccacactggagagaagccctacaagtgcccagaggagctgtgcagcaaggccttcaagaccagcggggacctgcagaagcacgtgaggacccacactggagagcggcccttccagtgcccctttgagggctgcggccgctccttcaccaccagcaacatcaggaaggtgcacgtgaggacccacactggagagcggccctacacctgcccagagccccactgcggccggggcttcaccagcgccaccaactacaagaaccacgtgcgcatccacactggagagaagccctacgtgtgcaccgtgcccggctgtgggaagcgcttcacagagtacagcagcctgtacaagcaccacgtggtgcacacccactgcaagccctacacctgcagcacctgtgggaagacctaccggcagaccagcaccctggccatgcacaagaggtctgcccacggggagctggaggccacagaggagagcgagcaggccctgtatgagcagcagcagctggaggccgccagcgctgctgaggagagccccccacccaagaggccccgcatcgcctacctgtctgaggtgaaggaggagagagatgacatcccagcccaggtggccatggtgacagaagaagatggagccccccaggtggccctgatcacccaggatggagcccagcaggtgtccctgagccctgaggacctgcaggccctgggcagcgccatctccatggtgacccagcacggcagcaccaccctgaccatccccagcccagatgctgacctggccaccagcggcacccacacagtgaccatggtgtctgcagatggcacccagacccagcctgtgaccatcatcaccagcggggctgtggtggccgaggacagctctgtggccagcctgcggcaccagcaggtggccctgctggccacagccaacggcacccacatcgctgtgcagctggaggagcagcagaccctggaggaggccatcaacgtggccacagctgccatgcagcagggcgctgtgaccctggagaccaccgtgtctgagagcggctgctag

SEQ ID NO: 177005 - DNA, 1287 bp, Artificial Sequence
  Description of Artificial Sequence: Synthetic coding sequence
atggagagcctgggcctgcacacagtgaccctgagtgatggcaccacagcctacgtgcagcaggccgtgaagggggagaagctgctggagggccaggtgatccagctggaggatggcaccacagcctacatccaccaggtgacagtgcagaaggaggccctgagctttgaagatggccagcctgtgcagctggaggatggctccatggcctacatccacaggaccccccgggagggctatgaccccagcaccctggaggccgtgcagctggaggatggcagcacagcctacatccaccaccctgtggccgtgcccagcgagagcaccatcctggccgtgcagacagaggtgggcctggaggacctggccgcagaagatgatgagggcttcagcgcagatgctgtggtggccctggagcagtatgccagcaaggtgctgcatgacagccagatccccagaaatggcaagggccagcaggtgggggaccgggccttccgctgtggctacaagggctgcggccgcctgtacaccacagcccaccacctgaaggtgcatgagcgggcccacactggagaccggccctaccgctgtgacttccccagctgtgggaaggcctttgccaccggctacggcctgaagagccacgtgaggacccacactggagagaagccctacaagtgcccagaggagctgtgcagcaaggccttcaagaccagcggggacctgcagaagcacgtgaggacccacactggagagcggcccttccagtgcccctttgagggctgcggccgctccttcaccaccagcaacatcaggaaggtgcacgtgaggacccacactggagagcggccctacacctgcccagagccccactgcggccggggcttcaccagcgccaccaactacaagaaccacgtgcgcatccacactggagagaagccctacgtgtgcaccgtgcccggctgtgggaagcgcttcacagagtacagcagcctgtacaagcaccacgtggtgcacacccactgcaagccctacacctgcagcacctgtgggaagacctaccggcagaccagcaccctggccatgcacaagaggagcggccactgcggccacgccgcccggggctgtgaccccggggacaacagcgtgggggagtggctgctgagcccccggggcctgggccccaccccctgctggaggaagtgccacctgcacggccacagctgcccccagggcccccggctgtggctgacccaccggcgctggccccacaggagcctgggctag

SEQ ID NO: 177006 - DNA, 1635 bp, Artificial Sequence
  Description of Artificial Sequence: Synthetic coding sequence
atggagagcctgggcctgcacacagtgaccctgagtgatggcaccacagcctacgtgcagcaggccgtgaagggggagaagctgctggagggccaggtgatccagctggaggatggcaccacagcctacatccaccaggtgacagtgcagaaggagggctatgaccccagcaccctggaggccgtgcagctggaggatggcagcacagcctacatccaccaccctgtggccgtgcccagcgagagcaccatcctggccgtgcagacagaggtgggcctggaggacctggccgcagaagatgatgagggcttcagcgcagatgctgtggtggccctggagcagtatgccagcaaggtgctgcatgacagccagatccccagaaatggcaagggccagcaggtgggggaccgggccttccgctgtggctacaagggctgcggccgcctgtacaccacagcccaccacctgaaggtgcatgagcgggcccacactggagaccggccctaccgctgtgacttccccagctgtgggaaggcctttgccaccggctacggcctgaagagccacgtgaggacccacactggagagaagccctacaagtgcccagaggagctgtgcagcaaggccttcaagaccagcggggacctgcagaagcacgtgaggacccacactggagagcggcccttccagtgcccctttgagggctgcggccgctccttcaccaccagcaacatcaggaaggtgcacgtgaggacccacactggagagcggccctacacctgcccagagccccactgcggccggggcttcaccagcgccaccaactacaagaaccacgtgcgcatccacactggagagaagccctacgtgtgcaccgtgcccggctgtgggaagcgcttcacagagtacagcagcctgtacaagcaccacgtggtgcacacccactgcaagccctacacctgcagcacctgtgggaagacctaccggcagaccagcaccctggccatgcacaagaggtctgcccacggggagctggaggccacagaggagagcgagcaggccctgtatgagcagcagcagctggaggccgccagcgctgctgaggagagccccccacccaagaggccccgcatcgcctacctgtctgaggtgaaggaggagagagatgacatcccagcccaggtggccatggtgacagaagaagatggagccccccaggtggccctgatcacccaggatggagcccagcaggtgtccctgagccctgaggacctgcaggccctgggcagcgccatctccatggtgacccagcacggcagcaccaccctgaccatccccagcccagatgctgacctggccaccagcggcacccacacagtgaccatggtgtctgcagatggcacccagacccagcctgtgaccatcatcaccagcggggctgtggtggccgaggacagctctgtggccagcctgcggcaccagcaggtggccctgctggccacagccaacggcacccacatcgctgtgcagctggaggagcagcagaccctggaggaggccatcaacgtggccacagctgccatgcagcagggcgctgtgaccctggagaccaccgtgtctgagagcggctgctag

SEQ ID NO: 177007 - DNA, 1209 bp, Artificial Sequence
  Description of Artificial Sequence: Synthetic coding sequence
atggagagcctgggcctgcacacagtgaccctgagtgatggcaccacagcctacgtgcagcaggccgtgaagggggagaagctgctggagggccaggtgatccagctggaggatggcaccacagcctacatccaccaggtgacagtgcagaaggaggccctgagctttgaagatggccagcctgtgcagctggaggatggctccatggcctacatccacaggaccccccgggagggctatgaccccagcaccctggaggccgtgcagctggaggatggcagcacagcctacatccaccaccctgtggccgtgcccagcgagagcaccatcctggccgtgcagacagaggtgggcctggaggacctggccgcagaagatgatgagggcttcagcgcagatgctgtggtggccctggagcagtatgccagcaaggtgctgcatgacagccagatccccagaaatggcaagggccagcaggtgggggaccgggccttccgctgtggctacaagggctgcggccgcctgtacaccacagcccaccacctgaaggtgcatgagcgggcccacactggagaccggccctaccgctgtgacttccccagctgtgggaaggcctttgccaccggctacggcctgaagagccacgtgaggacccacactggagagaagccctacaagtgcccagaggagctgtgcagcaaggccttcaagaccagcggggacctgcagaagcacgtgaggacccacactggagagcggcccttccagtgcccctttgagggctgcggccgctccttcaccaccagcaacatcaggaaggtgcacgtgaggacccacactggagagcggccctacacctgcccagagccccactgcggccggggcttcaccagcgccaccaactacaagaaccacgtgcgcatccacactggagagaagccctacgtgtgcaccgtgcccggctgtgggaagcgcttcacagagtacagcagcctgtacaagcaccacgtggtgcacacccaccactgcggccacgccgcccggggctgtgaccccggggacaacagcgtgggggagtggctgctgagcccccggggcctgggccccaccccctgctggaggaagtgccacctgcacggccacagctgcccccagggcccccggctgtggctgacccaccggcgctggccccacaggagcctgggctag

SEQ ID NO: 177008 - DNA, 1023 bp, Artificial Sequence
  Description of Artificial Sequence: Synthetic coding sequence
atggagagcctgggcctgcacacagtgaccctgagtgatggcaccacagcctacgtgcagcaggccgtgaagggggagaagctgctggagggccaggtgatccagctggaggatggcaccacagcctacatccaccaggtgacagtgcagaaggaggccctgagctttgaagatggccagcctgtgcagctggaggatggctccatggcctacatccacaggaccccccgggagggctatgaccccagcaccctggaggccgtgcagctggaggatggcagcacagcctacatccaccaccctgtggccgtgcccagcgagagcaccatcctggccgtgcagacagaggtgggcctggaggacctggccgcagaagatgatgagggcttcagcgcagatgctgtggtggccctggagcagtatgccagcaaggtgctgcatgacagccagatccccagaaatggcaagggccagcaggtgggggaccgggccttccgctgtggctacaagggctgcggccgcctgtacaccacagcccaccacctgaaggtgcatgagcgggcccacactggagaccggccctaccgctgtgacttccccagctgtgggaaggcctttgccaccggctacggcctgaagagccacgtgaggacccacactggagagaagccctacaagtgcccagaggagctgtgcagcaaggccttcaagaccagcggggacctgcagaagcacgtgaggacccacactggagagcggcccttccagtgcccctttgagggctgcggccgctccttcaccaccagcaacatcaggaaggtgcacgtgaggacccacactggagagcggccctacacctgcccagagccccactgcggccggggcttcaccagcgccaccaactacaagaaccacgtgcgcatccacactggagagaagccctacgtgtgcaccgtgcccggctgtgggaagcgcttcacagagtacagcagcctgtacaagcaccacgtggtgcacacctag

SEQ ID NO: 177009 - DNA, 1638 bp, Artificial Sequence
  Description of Artificial Sequence: Synthetic coding sequence
atggactgtgtgatctttgaggaggtggccgtgaacttcaccccagaggagtgggccctgctggaccacgcccagaggagcctgtacagagatgtgatgctggagacctgcaggaacctggccagcctggactgctacatctacgtgaggaccagcggcagcagcagccagagagatgtgtttggaaatggcatcagcaatgatgaggagatcgtgaagttcaccggcagtgacagctggagcatctttggagagaactggaggtttgacaacacaggagaccagcaccagatcccccagaggcacctgcggagccagctgggccgcctgtgtgagagcaatgaaggccaccagtgtggggagaccctgagccagacagccaacctgctggtgcacaagagctaccccacagaggccaagcccagtgaatgtaccaagtgtgggaaggcctttgagaaccggcagaggagccacacaggccagaggccctgcaaggaatgtggccaggcctgcagctgcctgagctgccagagcccccccatgaagacccagacagtggagaagccctgcaactgccaggacagcaggacagcctctgtgacctacgtgaagagcctgagcagcaagaagagctatgagtgccagaagtgtgggaaggccttcatctgccccagcagcttccggggccacgtgaacagccaccacggccagaagacccacgcctgcaaggtgtgtgggaagaccttcatgtactacagctacctgaccaggcatgtgaggacccacactggagagaagccctatgagtgcaaggaatgtgggaaggccttcagctgccccagctacttccgggagcacgtgaggacccacactggagagaagccctatgagtgcaagcactgcggcaagagcttcagctgctacagcagcttccgggaccacgtgaggacccacactggagagaagccctgccagtgcaagcactgcggcaaggccttcacctgctacagcagcctgcgggagcacggccgcacccacagcggggagaagccctatgagtgcaaggaatgtgggaaggccttccgctaccccagcagcctgcgggcccacatgaggatgcacactggagagaagccctacgtgtgcaagcagtgtgggaaggccttcggctgccccacctacttccgccgccacgtgaagacccacagcggcgtgaagccctaccagtgcaaggaatgtgggaaggcctacagcttcagcagcagcctgcgcatccacgtgaggacccacactggagagaagccctttgagtgcaagcactgcggcaaggccttcagctgccacagcagcctgcgggagcacgtgaggacccacagcggggagaagccctatgagtgcaaccagtgtgggaaggccttcagccacgcccagtacttccagaagcacgtgcgcagccacagcggcgtgaagccctatgaatgtacagaatgtgggaaggcctacagctgcagcagcagcctgcgggtgcacgtgaggacccacactggagagcggccctatgagtgcaagcagtgtgggaagaccttccgctacctggccagcctgcaggcccacgtgaggacccatgctggggcctag

SEQ ID NO: 177010 - DNA, 1308 bp, Artificial Sequence
  Description of Artificial Sequence: Synthetic coding sequence
cggctgtgtgagagcaatgaaggccaccagtgtggggagaccctgagccagacagccaacctgctggtgcacaagagctaccccacagaggccaagcccagtgaatgtaccaagtgtgggaagaccttcatgtactacagctacctgaccaggcatgtgaggacccacactggagagaagccctatgagtgcaaggaatgtgggaaggccttcagctgccccagctacttccgggagcacgtgaggacccacactggagagaagccctatgagtgcaagcactgcggcaagagcttcagctgctacagcagcttccgggaccacgtgaggacccacactggagagaagccctgccagtgcaagcactgcggcaaggccttcacctgctacagcagcctgcgggagcacggccgcacccacagcggggagaagccctatgagtgcaaggaatgtgggaaggccttccgctaccccagcagcctgcgggcccacatgaggatgcacactggagagaagccctacgtgtgcaagcagtgtgggaaggccttcggctgccccacctacttccgccgccacgtgaagacccacagcggcgtgaagccctaccagtgcaaggaatgtgggaaggcctacagcttcagcagcagcctgcgcatccacgtgaggacccacactggagagaagccctttgagtgcaagcactgcggcaaggccttcagctgccacagcagcctgcgggagcacgtgaggacccacagcggggagaagccctatgagtgcaaccagtgtgggaaggccttcagccacgcccagtacttccagaagcacgtgcgcagccacagcggcgtgaagccctatgaatgtacagaatgtgggaaggcctacagctgcagcagcagcctgcgggtgcacgtgaggacccacactggagagcggccctatgagtgcaagcagtgtgggaagaccttctcctggcccagcgacctgcgggtgcacatgaggacccacagcggggagaagagatgtggctgcaagcagtgtgggaagagcttcagcagccccagcagcttcaagggccacatccgcacccacactggagagaagctgtacacctgccgggagtgtgggaaggtgttcagcagccccagctacttccgcacccaggtgcgcatccacatcggggagaagccctacgtgtgtgagcagaggggcaaggtgttctcctggagcagcagcttccggggccacctgcggacccacagccgggagaagccctatgagtgcaaggagtgcaccaaggccttctag

SEQ ID NO: 177011 - DNA, 1497 bp, Artificial Sequence
  Description of Artificial Sequence: Synthetic coding sequence
atgctggaggagggcgtgctgcccagccctggccctgccctgccccaggaggagaacacaggagaggagggcatggctgctggcctgctgacagctggcccccggggcagcaccttcttcagctctgtgacagtggcctttgcccaggagcgctggcgctgcctggtgtccaccccccgggaccgcttcaaggagggcatccctgggaagagccgcagcctggtgctgctgggcctgcctgtgtcccagcccggcatgaacagccagctggagcagcgggagggcgcctggatgctggagggggaggacctgcggagccccagccctggctggaagatcatcagcggcagccccccagagcaggccctgtctgaggccagcttccaggacccctgtgtggagatgcctcctggggacagcgaccacggcaccagtgacctggagaagagcttcaacctgcggcctgtgctgagcccccagcagagggtgcctgtggaggcccggcccaggaaatgtgagacccacacagagagcttcaagaacagcgagatcctgaagccccaccgggccaagccctatgcctgcaatgaatgtgggaaggccttctcctactgcagcagcctgagccagcaccagaagagccacactggagagaagccctatgagtgcagtgaatgtgggaaggccttcagccagagcagcagcctcatccagcaccagaggatccacactggagagaagccctacaagtgcagtgaatgtggccgggccttcagccagaatgccaacctgaccaagcaccagaggacccacactggagagaagccctaccgctgcagtgaatgtgagaaggccttcagtgactgcagcgccctggtgcagcaccagaggatccacactggagagaagccctatgagtgcagcgactgtgggaaggccttccgccacagcgccaacctgaccaaccaccagaggacccacactggagagaagccctacaagtgcagtgaatgtgggaaggccttctcctactgtgccgccttcatccagcaccagaggatccacactggagagaagccctaccgctgtgccgcctgtgggaaggccttcagccagagcgccaacctgaccaaccaccagaggacccacactggagagaagccctacaagtgcagtgaatgtgggaaggccttcagccagagcaccaacctgatcatccaccagaagacccacactggagagaagccctacaagtgcaatgaatgtgggaagttcttcagcgagagcagcgccctgatccgccaccacatcatccacactggagagaagccctatgagtgcaatgaatgtgggaaggccttcaaccagagcagcagcctgagccagcaccagaggatccacactggagtgaagccctatgagtgcagtgaatgtgggaaggccttccgctgcagcagcgcctttgtgcgccaccagaggctgcacgccggggagtag

SEQ ID NO: 177012 - DNA, 1425 bp, Artificial Sequence
  Description of Artificial Sequence: Synthetic coding sequence
atggctgctggcctgctgacagctggcccccggggcagcaccttcttcagctctgtgacagtggcctttgcccaggagcgctggcgctgcctggtgtccaccccccgggaccgcttcaaggagggcatccctgggaagagccgcagcctggtgctgctgggcctgcctgtgtcccagcccggcatgaacagccagctggagcagcgggagggcgcctggatgctggagggggaggacctgcggagccccagccctggctggaagatcatcagcggcagccccccagagcaggccctgtctgaggccagcttccaggacccctgtgtggagatgcctcctggggacagcgaccacggcaccagtgacctggagaagagcttcaacctgcggcctgtgctgagcccccagcagagggtgcctgtggaggcccggcccaggaaatgtgagacccacacagagagcttcaagaacagcgagatcctgaagccccaccgggccaagccctatgcctgcaatgaatgtgggaaggccttctcctactgcagcagcctgagccagcaccagaagagccacactggagagaagccctatgagtgcagtgaatgtgggaaggccttcagccagagcagcagcctcatccagcaccagaggatccacactggagagaagccctacaagtgcagtgaatgtggccgggccttcagccagaatgccaacctgaccaagcaccagaggacccacactggagagaagccctaccgctgcagtgaatgtgagaaggccttcagtgactgcagcgccctggtgcagcaccagaggatccacactggagagaagccctatgagtgcagcgactgtgggaaggccttccgccacagcgccaacctgaccaaccaccagaggacccacactggagagaagccctacaagtgcagtgaatgtgggaaggccttctcctactgtgccgccttcatccagcaccagaggatccacactggagagaagccctaccgctgtgccgcctgtgggaaggccttcagccagagcgccaacctgaccaaccaccagaggacccacactggagagaagccctacaagtgcagtgaatgtgggaaggccttcagccagagcaccaacctgatcatccaccagaagacccacactggagagaagccctacaagtgcaatgaatgtgggaagttcttcagcgagagcagcgccctgatccgccaccacatcatccacactggagagaagccctatgagtgcaatgaatgtgggaaggccttcaaccagagcagcagcctgagccagcaccagaggatccacactggagtgaagccctatgagtgcagtgaatgtgggaaggccttccgctgcagcagcgcctttgtgcgccaccagaggctgcacgccggggagtag

SEQ ID NO: 177013 - DNA, 1728 bp, Artificial Sequence
  Description of Artificial Sequence: Synthetic coding sequence
atggaccctgaagatgaaggagtggccggcgtgatgtctgtgggccccccagctgcccggctgcaggagcctgtgaccttcagagatgtggccgtggacttcacccaggaggagtggggccagctggaccccacccagaggatcctgtacagagatgtgatgctggagaccttcggccacctgctgagcatcggccctgagctgcccaagccagaggtgatcagccagctggagcagggcacagagctgtgggtggccgagcggggcaccacccagggctgccacccagcctgggagcccaggtctgagagccaggccagcaggaaggaggagggcctgcctgaggaggagcccagccacgtgacaggccgggagggcttccccacagatgccccctaccccaccaccctgggcaaggaccgggagtgccagagccagagcctggccctgaaggagcagaacaacctgaagcagctggagtttggcctgaaggaggcccctgtgcaggaccagggctacaagaccctgcggctgcgggagaactgtgtgctgagcagcagccccaaccccttccctgagatcagcagaggagagtacctgtacacctatgacagccagatcacagacagcgagcacaacagcagcctggtgtcccagcagacaggcagccctgggaagcagcccggggagaacagcgactgccaccgggacagcagccaggccatccccatcacagagctgaccaagagccaggtgcaggacaagccctacaagtgcacagactgtgggaagagcttcaaccacaatgcccacctgactgtgcacaagaggatccacactggagagcggccctacatgtgcaaggaatgtgggaaggccttcagccagaacagcagcctggtgcagcacgagcgcatccacactggagacaagccctacaagtgtgctgaatgtgggaagagcttctgccacagcacccacctgactgtgcaccggcgcatccacactggagagaagccctatgagtgccaggactgtggccgggccttcaaccagaacagcagcctgggccgccacaagaggacccacactggagagaagccctacacctgcagcgtgtgtgggaagagcttcagcaggaccacctgcctcttcctgcacctgcggacccacacagaggagcggccctatgagtgcaaccactgtgggaagggcttccgccacagcagcagcctggcccagcaccagaggaagcacgccggggagaagccctttgagtgccggcagaggctcatctttgagcagaccccagccctgaccaagcatgagtggacagaggccctgggctgtgacccccccctgagccaggatgagaggacccacagaagtgaccggcccttcaagtgcaaccagtgtgggaagtgcttcatccagagcagccacctgatccgccaccagatcacccacacccgggaggagcagccccacggccgcagcagaagaagagagcagagcagcagcaggaacagccacctggtgcagcaccagcaccccaacagcaggaagagcagcgctggaggagccaaggccggccagcctgagagccgggccctggccctgtttgacatccagaagatcatgcaggagaagaaccctgtgcacgtgattggagtggaggagcccagcgtgggcgcctccatgctgtttgacatccgggagagcacctag

SEQ ID NO: 177014 - DNA, 519 bp, Artificial Sequence
  Description of Artificial Sequence: Synthetic coding sequence
atggaccctgaagatgaaggagtggccggcgtgatgtctgtgggccccccagctgcccggctgcaggtgaccatcaccaccatcaccacagctgctggcagcggccaggccagccctgcccagacagaccccttcaccagcagaagagatgagagcggcacagctgtgaatgccctggacacctggggcaacagtgatgctggccggggcgtggtgacagtgctggccggccagaggggcggccgggacagcaaccaggcccctggccccaggatgaggatgctgcatgctgccctgagcagccctgcccccaggagcccctgccctggggcctgggcccagcccctgggcggcaatgatggcagccccaggacagaatgtgatgaaagtgaccaccagggccggcccctgcgggactgtggccgcacagctgtgcagggcggccagtgcctgcagggccacctggccatccgggcccccctgagccggcagagcggctgcggcctgtgcagcccctag

SEQ ID NO: 177015 - DNA, 873 bp, Artificial Sequence
  Description of Artificial Sequence: Synthetic coding sequence
atgtgcaaggaatgtgggaaggccttcagccagaacagcagcctggtgcagcacgagcgcatccacactggagacaagccctacaagtgtgccgagtgtgggaagagcttctgccacagcacccacctgactgtgcaccggcgcatccacactggagagaagccctatgagtgccaggactgtggccgggccttcaaccagaacagcagcctgggccgccacaagaggacccacactggagagaagccctacacctgcagcgtgtgtgggaagagcttcagcaggaccacctgcctcttcctgcacctgcggacccacacagaggagcggccctatgagtgcaaccactgtgggaagggcttccgccacagcagcagcctggcccagcaccagaggaagcatgctggggagaagccctttgaatgtcggcagaggctcatctttgagcagaccccagccctgaccaagcatgagtggacagaggccctgggctgtgacccccccctgagccaggatgagaggacccacagaagtgaccggcccttcaagtgcaaccagtgtgggaagtgcttcatccagagcagccacctgatccgccaccagatcacccacacccgggaggagcagccccacggccgcagcagaagaagagagcagagcagcagcaggaacagccacctggtgcagcaccagcaccccaacagcaggaagagcagcgctgggggcgccaaggccggccagcctgagagccgggccctggccctgtttgacatccagaagatcatgcaggagaagaaccctgtgcacgtgattggagtggaggagcccagcgtgggcgcctccatgctgtttgacatccgggagagcacctag

SEQ ID NO: 177016 - DNA, 822 bp, Artificial Sequence
  Description of Artificial Sequence: Synthetic coding sequence
atgagccccaagagagatggcctgggcactggagatggcctgcacagccaggtgctgcaggagcaggtgtccactggagacaacctgcatgaatgtgacagccagggccccagcaaggacaccctggtgcgggagggcaagacctacaagtgcaaggaatgtggcagcgtcttcaacaagaacagcctgctggtgcgccaccagcagatccacactggagtgaagccctatgagtgccaggagtgtgggaaggccttccctgagaaggtggactttgtgcggcccatgaggatccacactggagagaagccctgcaagtgtgtggagtgtgggaaggtgttcaacagaagaagccacctgctgtgctaccggcagatccacactggagagaagccctatgagtgcagtgaatgtgggaagaccttctcctaccacagcgtcttcatccagcaccgggtgacccacactggagagaagctgtttggctgcaaggaatgtgggaagaccttctactacaacagcagcctgaccaggcacatgaagatccacactggagagaagccctgcaagtgcagtgaatgtgggaagaccttcacctaccgcagcgtcttcttccgccacagcatgacccacacagctgggaagccctatgagtgcaaggaatgtgggaagggcttctactacagctacagcctgaccaggcacaccaggagccacactggagagaagccctatgagtgcctggagcacaggaaggactttggctaccacagcgcctttgcccagcagagcaagatccacagcggcggcaagaacctgtag

SEQ ID NO: 177017 - DNA, 822 bp, Artificial Sequence; identical to SEQ ID NO: 177016
  Description of Artificial Sequence: Synthetic coding sequence

SEQ ID NO: 177018 - DNA, 3630 bp, Artificial Sequence
  Description of Artificial Sequence: Synthetic coding sequence
atggagtgctactacatcgtcatcagcagcacccacctgagcaatggccacttcaggaacatcaagggcgtcttccggggccccctgagcaagaatggaaacaagaccctggactatgcagagaaggagaacaccatcgccaaggccctggaggacctgaaggccaacttctactgtgagctgtgtgacaagcagtactacaagcaccaggagtttgacaaccacatcaacagctatgaccacgcccacaagcagaggctgaaggagctgaagcagcgggagtttgccagaaatgtggccagcaagagcaggaaggatgagaggaagcaggagaaggccctgcagaggctgcacaagctggccgagctgaggaaggagaccgtgtgtgcccctggcagcggccccatgttcaagagcaccaccgtgacagtgcgggagaactgcaatgagatcagccagagggtggtggtggacagcgtgaacaaccagcaggacttcaagtacaccctcatccacagcgaggagaacaccaaggatgccaccaccgtggctgaagatcctgagagcgccaacaactacacagccaagaacaaccaggtgggggaccaggcccagggcatccaccgccacaagattggcttctcctttgccttccccaagaaggcctctgtgaagctggagagcagcgctgctgccttcagcgagtacagtgatgatgcctctgtgggcaagggcttcagcaggaagagcagatttgtgcccagcgcctgccacctgcagcagagcagccccacagatgtgctgctgagcagcgaggagaagaccaacagcttccaccccccagaggccatgtgccgggacaaggagaccgtgcagacccaggagatcaaggaggtgtcctctgagaaggatgccctgctgctgcccagcttctgcaagttccagctgcagctgagcagtgatgctgacaactgccagaacagcgtgcccctggccgaccagatccccctggagagcgtggtgatcaatgaagacatccctgtgtctggcaacagctttgagctgctgggcaacaagagcacagtgctggacatgagcaatgactgcatctctgtgcaggccaccacagaggagaatgtgaagcacaatgaggccagcaccacagaggtggagaacaagaatggacctgagaccctggcccccagcaacacagaggaggtgaacatcaccatccacaagaagaccaacttctgcaagaggcagtgtgagccctttgtgcctgtgctgaacaagcacaggagcacagtgctgcagtggcccagcgagatgctggtgtacaccaccaccaagcccagcatctcctacagctgcaaccccctgtgctttgacttcaagagcaccaaggtgaacaacaacctggacaagaacaagccagacctgaaggacctgtgcagccagcagaagcaggaggacatctgcatgggccccctgagtgactacaaggatgtgtccacagagggcctgacagattatgaaattggcagcagcaagaacaagtgcagccaggtgacccccctgctggctgatgacatcctgagcagcagctgtgacagcggcaagaatgaaaatacaggccagcgctacaagaacatcagctgcaagatccgggagacagagaagtacaacttcaccaagagccagatcaagcaggacaccctggatgagaagtacaacaagatccggctgaaggagacccatgagtactggttccacaagagcaggaggaagaagaagaggaagaagctgtgccagcaccaccacatggagaagaccaaggagagcgagacccgctgcaagatggaggctgaaaattcctacacagaaaatgctgggaagtacctgctggagcccatcagcgagaagcagtacctggccgctgagcagctgctggacagccaccagctgctggacaagaggcccaagtctgagagcatcagcctgagtgacaatgaggagatgtgcaagacctggaacacagagtacaacacctatgacaccatcagcagcaagaaccactgcaagaagaacaccatcctgctgaatggccagagcaatgccaccatgatccacagcggcaagcacaacctgacctacagcaggacctactgctgctggaagaccaagatgagcagctgcagccaggaccacaggagcctggtgctgcagaatgacatgaagcacatgagccagaaccaggccgtgaagaggggctacaacagcgtgatgaatgaaagtgagcgcttctacaggaagaggcggcagcacagccacagctacagcagtgatgagagcctgaaccggcagaaccacctgcctgaggagttcctgcggccccccagcacctctgtggccccctgcaagcccaagaagaagagaagaaggaagaggggccgcttccaccctggctttgagaccctggagctgaaggagaacacagactaccctgtgaaggacaacagcagcctgaaccccctggacaggctcatcagcgaggacaagaaggagaagatgaagccccaggaggtggccaagattgaaagaaattctgagcagaccaaccagctgaggaacaagctgtccttccaccccaacaacctgctgcccagcgagaccaacggggagacagagcacctggagatggagaccaccagcggggagctgagtgatgtgtccaatgaccccaccacctctgtgtgtgtggccagcgcccccaccaaggaggccatcgacaacaccctgctggagcacaaggagaggtctgagaacatcaacctgaatgagaagcagatccccttccaggtgcccaacattgaaagaaacttccggcagagccagcccaagagctacctgtgccactatgagctggccgaggccctgccccagggcaagatgaatgagacccccacagagtggctgcgctacaacagcggcatcctgaacacccagccccccctgcccttcaaggaggcccacgtgtctggccacacctttgtgacagctgagcagatcctggcccccctggccctgcctgagcaggccctgctgatccccctggagaaccacgacaagttcaagaatgtgccctgtgaggtgtaccagcacatcctgcagcccaacatgctggccaacaaggtgaagttcaccttccccccagctgccctgcccccacccagcacccccctgcagcccctgcccctgcagcagagcctgtgcagcacctctgtgaccaccatccaccacacagtgctgcagcagcacgccgctgctgctgctgctgctgctgctgctgctgctgctggcaccttcaaggtgctgcagccccaccagcagttcctgagccagatcccagccctgaccaggaccagcctgccccagctgtctgtgggccctgtgggcccccggctgtgccccggcaaccagcccacctttgtggccccaccccagatgcccatcatcccagcctctgtgctgcaccccagccacctggccttccccagcctgccccacgccctcttccccagcctgctgagcccccaccccaccgtcatccccctgcagcccctcttctag

SEQ ID NO: 177019 - DNA, 210 bp, Artificial Sequence
  Description of Artificial Sequence: Synthetic coding sequence
atgcctgccaatgaagatgccccccagcccggggagcacggcagcgcctgtgaggtgtctgtgtcctttgaagatgtgacagtggacttcagccgggaggagtggcagcagctggacagcacccagaggcggctgtaccaggatgtgatgctggagaactacagccacctgctgtctgtgggcaaggacaaccaccctgtgaagctgtag

SEQ ID NO: 177020 - DNA, 1986 bp, Artificial Sequence
  Description of Artificial Sequence: Synthetic coding sequence
atgcctgccaatgaagatgccccccagcccggggagcacggcagcgcctgtgaggtgtctgtgtcctttgaagatgtgacagtggacttcagccgggaggagtggcagcagctggacagcacccagaggcggctgtaccaggatgtgatgctggagaactacagccacctgctgtctgtgggctttgaggtgcccaagccagaggtgatcttcaagctggagcagggcgagggcccctggaccctggagggggaggccccccaccagagctgcagtgatggcaagtttggcatcaagcccagccagaggcgcatcagcggcaagagcaccttccacagcgagatggagggggaggacaccagagatgacagcctgtacagcatcctggaggagctgtggcaggatgctgagcagatcaagcgctgccaggagaagcacaacaagctgctgagcaggaccaccttcctgaacaagaagatcctgaacacagagtgggactatgagtacaaggactttgggaagtttgtgcaccccagccccaacctgatcctgagccagaagaggccccacaagagggacagctttgggaagagcttcaagcacaacctggacctgcacatccacaacaagagcaatgctgccaagaacctggacaagaccatcggccacggccaggtgttcacccagaacagcagctacagccaccacgagaacacccacactggagtgaagttctgtgagaggaaccagtgtgggaaggtgctgagcctgaagcacagcctgagccagaatgtgaagttccccatcggggagaaggccaacacctgcacagaatttgggaagatcttcacccagaggagccacttctttgccccccagaagatccacacagtggagaagccccatgagctgagcaaatgtgtgaatgtgttcacccagaagcccctgctgagcatctacctgcgggtgcacagagatgagaagctgtacatctgcaccaagtgtgggaaggccttcatccagaacagcgagctgatcatgcatgagaagacccacacccgggagaagccctacaagtgcaatgaatgtgggaagagcttcttccaggtgagcagcctgctgcggcaccagaccacccacactggagagaagctgtttgaatgttctgaatgtgggaagggcttcagcctgaacagcgccctgaacatccaccagaagatccacactggagagcggcaccacaagtgcagtgaatgtgggaaggccttcacccagaagagcaccctgaggatgcaccagaggatccacactggagagaggagctacatctgcacccagtgtggccaggccttcatccagaaggcccacctgattgcccaccagaggatccacactggagagaagccctatgaatgtagtgactgtgggaagagcttccccagcaagagccagctgcagatgcacaagaggatccacactggagagaagccctacatctgcacagaatgtgggaaggccttcaccaacagaagcaacctgaacacccaccagaagagccacactggagagaagagctacatctgtgccgagtgtgggaaggccttcacagacaggagcaacttcaacaagcaccagaccatccacactggagagaagccctacgtgtgtgccgactgtggccgggccttcatccagaagtctgagctgatcacccaccagaggatccacaccacagagaagccctacaagtgcccagactgtgagaagagcttcagcaagaagccccacctgaaggtgcaccagaggatccacactggagagaagccctacatctgtgccgagtgtgggaaggccttcacagacaggagcaacttcaacaagcaccagaccatccacactggagacaagccctacaagtgcagcgactgtgggaagggcttcacccagaagtctgtgctgtccatgcacaggaacatccacacctag

SEQ ID NO: 177021 - DNA, 312 bp, Artificial Sequence
  Description of Artificial Sequence: Synthetic coding sequence
atgcctgccaatgaagatgccccccagcccggggagcacggcagcgcctgtgaggtgtctgtgtcctttgaagatgtgacagtggacttcagccgggaggagtggcagcagctggacagcacccagaggcggctgtaccaggatgtgatgctggagaactacagccacctgctgtctgtgggctttgaggtgcccaagccagaggtgatcttcaagctggagcagggcgagggcccctggaccctggagggggaggccccccaccagagctgcagcggcatcagcacctactttgtgaccagcacagtgtag

SEQ ID NO: 177022 - DNA, 1986 bp, Artificial Sequence; identical to SEQ ID NO: 177020
  Description of Artificial Sequence: Synthetic coding sequence

SEQ ID NO: 177023 - DNA, 369 bp, Artificial Sequence
  Description of Artificial Sequence: Synthetic coding sequence
atgcctgccaatgaagatgccccccagcccggggagcacggcagcgcctgtgaggtgtctgtgtcctttgaagatgtgacagtggacttcagccgggaggagtggcagcagctggacagcacccagaggcggctgtaccaggatgtgatgctggagaactacagccacctgctgtctgtgggctttgaggtgcccaagccagaggtgatcttcaagctggagcagggcgagggcccctggaccctggagggggaggccccccaccagagctgcagtgatggcaagtttggcatcaagcccagccagaggcgcatcagcggcaagagcaccttccacagcgagatggagggggaggacaccctgtgctag

SEQ ID NO: 177024 - DNA, 1551 bp, Artificial Sequence
  Description of Artificial Sequence: Synthetic coding sequence
atgcacggcaggaaggatgatgcccagaagcagcctgtgaagaaccagctgggcctgaacccccagagccacctgcctgagctgcagctgttccaggccgagggcaagatctacaagtatgaccacatggagaagtctgtgaacagcagcagcctggtgtccccaccccagaggatcagcagcacagtgaagacccacatcagccacacctatgagtgcaactttgtggacagcctcttcacccagaaggagaaggccaacatcggcacagagcactacaagtgcagcgagcggggcaaggccttccaccagggcctgcacttcaccatccaccagatcatccacaccaaggagacccagttcaagtgtgacatctgtgggaagatcttcaacaagaagagcaacctggccagccaccagaggatccacactggagagaagccctacaagtgcaatgaatgtgggaaggtgttccacaacatgagccacctggcccagcaccggcgcatccacactggagagaagccctacaagtgcaatgaatgtgggaaggtgttcaaccagatcagccacctggcccagcaccagaggatccacactggagagaagccctacaagtgcaatgaatgtgggaaggtgttccaccagatcagccacctggcccagcacaggaccatccacactggagagaagccctatgagtgcaacaagtgtgggaaggtgttcagcaggaacagctacctggtgcagcacctgatcatccacactggagagaagccctaccgctgcaatgtgtgtgggaaggtgttccaccacatcagccacctggcccagcaccagaggatccacactggagagaagccctacaagtgcaatgaatgtgggaaggtgttcagccacaagagcagcctggtgaaccactggaggatccacactggagagaagccctacaagtgcaatgaatgtgggaaggtgttcagccacaagagcagcctggtgaaccactggaggatccacactggagagaagccctacaagtgcaatgaatgtgggaaggtgttcagcaggaacagctacctggcccagcacctgatcatccacgccggggagaagccctacaagtgtgatgaatgtgacaaggccttcagccagaacagccacctggtgcagcaccaccgcatccacactggagagaagccctacaagtgtgatgaatgtgggaaggtgttcagccagaacagctacctggcctaccactggaggatccacactggagagaaggcctacaagtgcaatgaatgtgggaaggtgtttggcctgaacagcagcctggcccaccacaggaagatccacactggagagaagcccttcaagtgcaatgaatgtgggaaggccttctccatgaggagcagcctgaccaaccaccacgccatccacactggagagaagcacttcaagtgcaatgaatgtgggaagctgttccgggacaacagctacctggtgcgccaccagcgcttccacgccggcaagaagagcaacacctgcaactag

SEQ ID NO: 177025 - DNA, 1467 bp, Artificial Sequence
  Description of Artificial Sequence: Synthetic coding sequence
atgcacggcaggaaggatgatgcccagaagcagcctgtgaagaaccagctgggcctgaacccccagagccacctgcctgagctgcagctgttccaggccgagggcaagatctacaagtatgaccacatggagaagtctgtgaacagcagcagcctggtgtccccaccccagaggatcagcagcacagtgaagacccacatcagccacacctatgagtgcaactttgtggacagcctcttcacccagaaggagaaggccaacatcggcacagagcactacaagtgcagcgagcggggcaaggccttccaccagggcctgcacttcaccatccaccagatcatccacaccaaggagacccagttcaagtgtgacatctgtgggaagatcttcaacaagaagagcaacctggccagccaccagaggatccacactggagagaagccctacaagtgcaatgaatgtgggaaggtgttccacaacatgagccacctggcccagcaccggcgcatccacactggagagaagccctacaagtgcaatgaatgtgggaaggtgttcaaccagatcagccacctggcccagcaccagaggatccacactggagagaagccctacaagtgcaatgaatgtgggaaggtgttccaccagatcagccacctggcccagcacaggaccatccacactggagagaagccctatgagtgcaacaagtgtgggaaggtgttcagcaggaacagctacctggtgcagcacctgatcatccacactggagagaagccctaccgctgcaatgtgtgtgggaaggtgttcagccacaagagcagcctggtgaaccactggaggatccacactggagagaagccctacaagtgcaatgaatgtgggaaggtgttcagccacaagagcagcctggtgaaccactggaggatccacactggagagaagccctacaagtgcaatgaatgtgggaaggtgttcagcaggaacagctacctggcccagcacctgatcatccacgccggggagaagccctacaagtgtgatgaatgtgacaaggccttcagccagaacagccacctggtgcagcaccaccgcatccacactggagagaagccctacaagtgtgatgaatgtgggaaggtgttcagccagaacagctacctggcctaccactggaggatccacactggagagaaggcctacaagtgcaatgaatgtgggaaggtgtttggcctgaacagcagcctggcccaccacaggaagatccacactggagagaagcccttcaagtgcaatgaatgtgggaaggccttctccatgaggagcagcctgaccaaccaccacgccatccacactggagagaagcacttcaagtgcaatgaatgtgggaagctgttccgggacaacagctacctggtgcgccaccagcgcttccacgccggcaagaagagcaacacctgcaactag

SEQ ID NO: 177026 - DNA, 1467 bp, Artificial Sequence; identical to SEQ ID NO: 177025
  Description of Artificial Sequence: Synthetic coding sequence

SEQ ID NO: 177027 - DNA, 1551 bp, Artificial Sequence; identical to SEQ ID NO: 177024
  Description of Artificial Sequence: Synthetic coding sequence

SEQ ID NO: 177028 - DNA, 1551 bp, Artificial Sequence; identical to SEQ ID NO: 177024
  Description of Artificial Sequence: Synthetic coding sequence

SEQ ID NO: 177029 - DNA, 1551 bp, Artificial Sequence; identical to SEQ ID NO: 177024
  Description of Artificial Sequence: Synthetic coding sequence

SEQ ID NO: 177030 - DNA, 1551 bp, Artificial Sequence; identical to SEQ ID NO: 177024
  Description of Artificial Sequence: Synthetic coding sequence

SEQ ID NO: 177031 - DNA, 5034 bp, Artificial Sequence
  Description of Artificial Sequence: Synthetic coding sequence
atggaggtgcctgagcccacctgcccagcccccccagcccgggaccagcctgcccccaccccaggccccccaggggcccctgggggccaggccagcccccacctgaccctgggccctgtgctgctgcccccagagcagggcctggccccacccaccgtcttcctgaaggccctgcccatccccctgtaccacacagtgcccccaggcggcctgcagccccgggcccccctggtgacaggcagcctggatggcggcaatgtgcccttcatcctgagccctgtgctgcagcctgagggccctggccccacccaggtgggcaagccagctgcccccaccctgactgtgaacatcgtgggcaccctgcctgtgctgagccctggcctgggccccaccctgggcagccctgggaaggtgagaaatgccggcaagtacctgtgcccccactgcggccgggactgcctgaagcccagcgtgctggagaagcacatccgcagccacactggagagcggcccttcccctgtgccacctgtggcatcgccttcaagacccagagcaacctgtacaagcacaggaggacccagacccacctgaacaacagccggctgagcagcgagagcgagggcgccggcggcggcctgctggaggagggggacaaggccggggagccccccaggcctgagggccgcggggagagccgctgccagggcatgcatgagggcgccagcgagcggcccctgagccctggggcccacgtgcccctgctggccaagaacctggatgtgaggacagaagctgccccctgccccggcagcgcctttgctgaccgggaggccccctgggacagcgcccccatggccagccctggcctgcctgctgccagcacccagccctggaggaagctgcctgagcagaagagccccacagctgggaagccctgtgccctgcagaggcagcaggccacagctgctgagaagccctgggatgccaaggcccctgagggccgcctgaggaaatgtgagagcacagacagcggctacctgagcagaagtgacagcgctgagcagccccacgccccctgcagccccctgcacagcctgtctgagcacagcgctgagagcgagggggagggcggccctggccctggccctggggtggccggggctgagcccggggcccgggaggccggcctggagctggagaagaagaggctggaggagcgcatcgcccagctgatcagccacaaccaggccgtggtggatgatgcccagctggacaacgtgcggcccaggaagacaggcctgagcaagcagggcagcattgacctgcccaccccctacacctacaaggacagcttccactttgacatccgggccctggagcctggaagaagaagagcccctggccctgtgcgcagcacctggaccccaccagacaagagccggcccctcttcttccacagcgtgcccacccagctgagcaccaccgtggagtgtgtgcctgtgaccaggagcaacagcctgccctttgtggagggcagcaggacctggctggagccccgggagccccgggacccctggagcaggacccagaagcccctgagccccaggcctggccctgcccggctgggctgccgcagcggcctgagcagcacagatgtgcccagcggccacccccgggccctggtgcggcaggccgctgtggaggacctgcccggcacccccatcggagatgccctggtgcctgctgaggacacagatgccaagaggacagctgcccgggaggccatggccggcaagggccgggccggcggcaggaaatgtggccagaggcggctgaagatgttcagccaggagaagtggcaggtgtatggagatgagaccttcaagaggatctaccagaagatgaaggccagcccccacggcggcaagaaggcccgggaggtgggcatgggcagcggggctgagctgggcttccccctgcagaaggaggccgccggcagcagcggcaccgtgcccacccaggacaggaggacccctgtgcatgaggacatctctgctggggccaccccagagccctggggcaaccccccagccctggaggccagcctggtgacagagcccaccaagcacggggagaccgtggcccggcggggggacagcgaccggccccgggtggaggaggccgtgagcagccctgccctgggcggccgggacagcccctgcagcggcagccgcagccccctggtgagccccaacggccgcctggagctgggctggcagatgcccccagcccctggccccctgaagggaggagatgtggaggcccccaggcctgtgtggccagaccccaagctggagggcggggcccggggcgtgggagatgtgcaggagacctgcctgtgggcccagacagtgctgcgctggcccagccggggcagcggggaggacaagctgcccagcgagaggaagaagctgaaggtggaggacctgcacagctggaagcagcctgagcctgtgtctgctgagacccctgggggccccacccagcctgccagcctgagcagccagaagcaggatgctgaccccggggaggtgcctgggggcagcaaggagagcgcccggcaggtgggggagcccctggagagcagcggggccagcctggccgccgcctctgtggccctgaagagggtgggcccccgggacaaggccacccccctgcaccctgctgccccagccccagctgagcaccccagcctggccaccccaccccaggccccccgggtgctgagcgccctggccgacaatgccttcagccccaagtacctgctgcggctgccccaggccgagacccccctgcccctgcccatcccctggggccccaggcacagccaggacagcctgtgcagcagcggctggccagaggagcgggccagctttgtgggcagcggcctgggcacccccctgagccccagccctgccagcggccccagccctggagaggccgacagcatcctggaggaccccagctgcagccggccccaggacggcaggaagggggcccagctgggcggggacaagggggacaggatggccaccagcaggcctgctgcccgggagctgcccatcagcgcccctggggccccccgggaggccaccagcagcccccccacccccacctgtgaggcccacctggtgcaggacatggagggggacagccaccgcatccaccggctgtgcatgggcagcaccctggcccgggcccggctgtctggagatgtgctgaacccctgggtgcccaactgggagctgggggagcccccaggaaatgcccctgaggaccccagcagcggccccctggtgggccctgacccctgcagccccctgcagcccggcagcttcctgacagccctgacccggccccagggcgtgcccccaggctggccagagctggccctgagcagccacagcggcaccagccgcagccacagcaccaggagcccccacagcacccagaaccccttccccagcctgaaggccgagccccggctgacctggtgctgcctgagccgctctgtgcccctgcctgctgagcagaaggccaaggccgcctctgtgtacctggccgtgcacttccctggcagcagcctgagagatgagggccccaacggccccccaggcagcaatggaggctggacctggaccagccctggagagggcggccctgcccagatgagcaagttctcctaccccaccgtgcctggggtgatgccccagcaccaggtgtctgagcctgagtggaagaagggcctgccctggagggccaagatgagccggggcaacagcaagcagaggaagctgaagatcaaccccaagcgctacaagggcaacttcctgcagagctgtgtgcagctgcgggccagccggctgcggacccccacctgggtgagaagaagaagccgccaccccccagccctggagggcctgaagccctgcaggaccccaggccagaccagcagcgagattgctggcctgaacctgcaggaggagcccagctgtgccaccagcgagagccccccctgctgcggcaaggaggagaagaaggagggggactgccggcagaccctgggcaccctgagcctgggcaccagcagccgcatcgtgcgggagatggacaagaggacagtgaaggacatcagccccagcgctggggagcacggggactgcaccacccacagcacagctgccaccagcggcctgagcctgcagagcgacacctgcctggccgtggtgaatgatgtgcccctgcccccaggcaagggcctggacctgggcctgctggagacccagctgctggccagccaggacagcgtgtccacagaccccaagccctacatcttcagtgatgcccagaggcccagcagctttggcagcaagggcaccttcccccaccacgacatcgccacctctgtggccgctgtgtgcatcagcctgcctgtgaggacagaccacatcgcccaggagatccacagcgctgagagccgggaccacagccagacagctggccgcaccctgaccagcagcagcccagacagcaaggtgacagaggagggccgggcccagaccctgctgcccggccggcccagcagcggccagaggatcagtgacagcgtgcccctggagagcacagagaagacccacctggagatcccagccagcggccccagcagcgccagcagccaccacaaggagggccgccacaagaccttcttccccagccggggccagtatggctgtggggagatgacagtgccctgccccagcctgggcagtgatggcaggaagaggcaggtgtctggcctcatcaccaggaaggacagcgtggtgcccagcaagccagagcagcccatcgagatccctgaggcccccagcaagagcctgaagaagaggagcctggagggcatgaggaagcagaccagggtggagttcagtgacaccagcagtgatgatgaggaccggctggtgattgagatctag

SEQ ID NO: 177032 - DNA, 264 bp, Artificial Sequence
  Description of Artificial Sequence: Synthetic coding sequence
atgggccccctgaccttcagagatgtggccatcgagttcagcctgaaggagtggcagtgcctggacacagcccagaggaacctgtacagaaatgtgatgctggagaactacagaaacctggtgttcctgggcatcaccgtgtccaagccagacctgatcacctgcctggagcagggcaaggaggcctggagcatgaagagacatgagatcatggtggccaagcccacagagagctacagcgtgacccagagcggcatgcagtag

SEQ ID NO: 177033 - DNA, 1788 bp, Artificial Sequence
  Description of Artificial Sequence: Synthetic coding sequence
atgggccccctgaccttcagagatgtggccatcgagttcagcctgaaggagtggcagtgcctggacacagcccagaggaacctgtacagaaatgtgatgctggagaactacagaaacctggtgttcctgggcatcaccgtgtccaagccagacctgatcacctgcctggagcagggcaaggaggcctggagcatgaagagacatgagatcatggtggccaagcccaccgtgatgtgcagccactttgcccaggacctgtggccagagcagaacatcaaggacagcttccagaaggtgaccctgaagagatatggcaagtgcagacatgagaacctgcccctgaggaagggctgtgagagcatggatgagtgcaagatgcacaagggcggctgcaatggcctgaaccagtgcctgacagccacccagagcaagatcttccagtgtgacaagtatgtgaaggtggcccacaagttcagcaacagcaacagacatgagatccgccacaccaagaagaagcccttcaagtgcaccaagtgtgggaagagctttggcatgatcagctgcctgacagagcacagccgcatccacaccagggtgaacttctacaagtgtgaggagtgtgggaaggccttcaactggagcagcaccctgaccaagcacaagaggatccacactggagagaagccctacaagtgtgaggagtgtgggaaggccttcaaccagagcagcaacctgatcaagcacaagaagatccacactggagagaagccctacaagtgtgaggagtgtgggaagaccttcaaccgcttcagcaccctgaccacccacaagatcatccacactggagagaagccctacaagtgcaaggaatgtgggaaggccttcaacagaagcagcaccctgaccacccacaggaagatccacactggagagaagccctacaagtgtgaggagtgtgggaaggccttcaagcagagcagcaacctgaccacccacaagatcatccacactggagagaagccctacaagtgcaagaagtgtgggaaggccttcaaccagagcgcccacctgaccacccatgaggtgatccacactggagagaagccctacaagtgtgagaagtgtgggaaggccttcaaccacttcagccacctgaccacccacaagatcatccacactggagagaagccctacaagtgcaaggaatgtgggaaggccttcaagcacagcagcaccctgaccaagcacaagatcatccacactggagagaagccctacaagtgcaaggaatgtgagaaggccttcaaccagagcagcaagctgacagagcacaagaagatccacactggagagaagccctatgaatgtgagaagtgtgggaaggccttcaaccagagcagcaacctgaccaggcacaagaagagccacacagaggagaagccctacaagtgtgaggagtgtgggaagggcttcaagtggcccagcaccctgaccatccacaagatcatccacactggagagaagccctacaagtgtgaggagtgtgggaaggccttcaaccagagcagcaagctgaccaagcacaagaagatccacactggagagaagccctacacctgtgaggagtgtgggaaggccttcaaccagagcagcaacctgaccaagcacaagaggatccacactggagagaagccctacaagtgtgaggagtgtgacaaggccttcaagtggagctctgtgctgaccaagcacaagatcatccacactggagagaagctgcagatctag

SEQ ID NO: 177034 - DNA, 1689 bp, Artificial Sequence
  Description of Artificial Sequence: Synthetic coding sequence
atgggccccctgaccttcagagatgtggccatcgagttcagcctgaaggagtggcagtgcctggacacagcccagaggaacctgtacagaaatgtgatgctggagaactacagaaacctggtgttcctggtgatgtgcagccactttgcccaggacctgtggccagagcagaacatcaaggacagcttccagaaggtgaccctgaagagatatggaaaatgtagacatgagaacctgcccctgaggaagggctgtgagagcatggatgagtgcaagatgcacaagggcggctgcaatggcctgaaccagtgcctgacagccacccagagcaagatcttccagtgtgacaagtatgtgaaggtggcccacaagttcagcaacagcaacagacatgagatccgccacaccaagaagaagcccttcaagtgcaccaagtgtgggaagagctttggcatgatcagctgcctgacagagcacagccgcatccacaccagggtgaacttctacaagtgtgaagaatgtgggaaggccttcaactggagcagcaccctgaccaagcacaagaggatccacactggagagaagccctacaagtgtgaagaatgtgggaaggccttcaaccagagcagcaacctgatcaagcacaagaagatccacactggagagaagccctacaagtgtgaagaatgtgggaagaccttcaaccgcttcagcaccctgaccacccacaagatcatccacactggagagaagccctacaagtgcaaggaatgtgggaaggccttcaacagaagcagcaccctgaccacccacaggaagatccacactggagagaagccctacaagtgtgaagaatgtgggaaggccttcaagcagagcagcaacctgaccacccacaagatcatccacactggagagaagccctacaagtgcaagaagtgtgggaaggccttcaaccagagcgcccacctgaccacccatgaagtcatccacactggagagaagccctacaagtgtgagaagtgtgggaaggccttcaaccacttcagccacctgaccacccacaagatcatccacactggagagaagccctacaagtgcaaggaatgtgggaaggccttcaagcacagcagcaccctgaccaagcacaagatcatccacactggagagaagccctacaagtgcaaggaatgtgagaaggccttcaaccagagcagcaagctgacagagcacaagaagatccacactggagagaagccctatgaatgtgagaagtgtgggaaggccttcaaccagagcagcaacctgaccaggcacaagaagagccacacagaggagaagccctacaagtgtgaagaatgtgggaagggcttcaagtggcccagcaccctgaccatccacaagatcatccacactggagagaagccctacaagtgtgaagaatgtgggaaggccttcaaccagagcagcaagctgaccaagcacaagaagatccacactggagagaagccctacacctgtgaagaatgtgggaaggccttcaaccagagcagcaacctgaccaagcacaagaggatccacactggagagaagccctacaagtgtgaagaatgtgacaaggccttcaagtggagctctgtgctgaccaagcacaagatcatccacactggagagaagctgcagatctag

SEQ ID NO: 177035 - DNA, 1413 bp, Artificial Sequence
  Description of Artificial Sequence: Synthetic coding sequence
atgcacaagggcggctgcaatggcctgaaccagtgcctgacagccacccagagcaagatcttccagtgtgacaagtatgtgaaggtggcccacaagttcagcaacagcaacagacatgagatccgccacaccaagaagaagcccttcaagtgcaccaagtgtgggaagagctttggcatgatcagctgcctgacagagcacagccgcatccacaccagggtgaacttctacaagtgtgaagaatgtgggaaggccttcaactggagcagcaccctgaccaagcacaagaggatccacactggagagaagccctacaagtgtgaagaatgtgggaaggccttcaaccagagcagcaacctgatcaagcacaagaagatccacactggagagaagccctacaagtgtgaagaatgtgggaagaccttcaaccgcttcagcaccctgaccacccacaagatcatccacactggagagaagccctacaagtgcaaggaatgtgggaaggccttcaacagaagcagcaccctgaccacccacaggaagatccacactggagagaagccctacaagtgtgaagaatgtgggaaggccttcaagcagagcagcaacctgaccacccacaagatcatccacactggagagaagccctacaagtgcaagaagtgtgggaaggccttcaaccagagcgcccacctgaccacccatgaagtcatccacactggagagaagccctacaagtgtgagaagtgtgggaaggccttcaaccacttcagccacctgaccacccacaagatcatccacactggagagaagccctacaagtgcaaggaatgtgggaaggccttcaagcacagcagcaccctgaccaagcacaagatcatccacactggagagaagccctacaagtgcaaggaatgtgagaaggccttcaaccagagcagcaagctgacagagcacaagaagatccacactggagagaagccctatgaatgtgagaagtgtgggaaggccttcaaccagagcagcaacctgaccaggcacaagaagagccacacagaggagaagccctacaagtgtgaagaatgtgggaagggcttcaagtggcccagcaccctgaccatccacaagatcatccacactggagagaagccctacaagtgtgaagaatgtgggaaggccttcaaccagagcagcaagctgaccaagcacaagaagatccacactggagagaagccctacacctgtgaagaatgtgggaaggccttcaaccagagcagcaacctgaccaagcacaagaggatccacactggagagaagccctacaagtgtgaagaatgtgacaaggccttcaagtggagctctgtgctgaccaagcacaagatcatccacactggagagaagctgcagatctag

SEQ ID NO: 177036 - DNA, 1806 bp, Artificial Sequence
  Description of Artificial Sequence: Synthetic coding sequence
atgggccccctggagttcagagatgtggccatcgagttcagcctggaggagtggcactgcctggacacagcccagcagaacctgtacagagatgtgatgctggagaactaccgccacctggtgttcctgggcatcgtggtgaccaagccagacctgatcacctgcctggagcagggcaagaagcccttcaccgtgaagagacatgagatgattgccaagagccctgtgatgtgcttccactttgcccaggacctgtgcccagagcagagcctgaaggacagcttccagaaggtgattgtgaccaggtatgagaagcgggagtatggcaacctggagctgaagaagggctgtgagagcgtggatgagggcaaggtgcacaagaggggctacaacggcctgaaccagtgcctgacagccacccagagcaaggtgttccagtgtgacacctacgtgaaggtgagccacatcttcagcaacagcaacagacacaagatccgggacaccgggaagaagcccttcaagtgcattgaatgtgggaaggccttcaaccagagcagcaccctggccacccacaagaagatccacactggagagatcacctgcaagtgtgaagaatgtgggaaggccttcaacagaagcagccacctgaccagccacaagaggatccacactggagagaagcgctacaagtgtgaggactgtgggaaggagctgaagtacagcagcaccctgacagcccacaagaggatccacactggagagaagcgctacaagtgtgaggactgtgggaaggagctgaagtacagcagcaccctgacagcccacaagaggatccacactggagagaagccctacaagtgtgacaagtgtggccgggccttcatcagcagcagcatcctgtatgtgcacaagatcagccacacagaggagaagccctacaagtgtgaagaatgtgggaaggccttcaagctgagcagcatcctgagcacccacaagaggatccacactggagagaagccctacaagtgtgaagaatgtgggaaggccttcagaagaagcctggtgctgcggacccacaagaggatccacactggagagaagccctacaagtgtgacaagtgtgggaaggccttcatcagcagcagcctgctgtacaagcacaagatcagccacagcgagaagaagccctacaagtgtgaagaatgtgggaaggccttcaagaggagcagcaccctgaccatccacaagatcagccacacagaggagaagccctacaagtgccaggagtgtgacaaggtgttcaagaggagcagcgccctgagcacccacaagatcatccacagcggggagaagccctacaagtgtgaagaatgtgggaaggccttcaagaggagcagcaacctgaccacccacaagatcagccacacagaggagaagctgtacaagtgccaggagtgtgacaaggccttcaagtacagcagcgccctgagcacccacaagatcatccacagcggggagaacccctacaagtgtgaagaatgtgggaaggccttcaagaggagctctgtgctgagcaagcacaagatcatccacactggagccaagccctacaagtgtgaagaatgtgggaaggccttcaagaggagcagccagctgaccagccacaagatcagccacactggagagaagccctacaagtgtgaagaatgtgggaaggccttcaacctgagcagtgacctgaacacccacaagaggatccacatcggccagaaggcctacatcgtgaagaacatggccaacctgtag

SEQ ID NO: 177037 - DNA, 369 bp, Artificial Sequence
  Description of Artificial Sequence: Synthetic coding sequence
atgaggaagcacatcaaggagcgggagctgagcctgatggagcagatcaaggagttcatcctggagaggaacaccatgaatgtgcccaccgtgggcaagcccttcagcggccgccacagcctgctgagcatccgggagttcaccctgggccgcagccccatgaatgtgatgaatgtgggggagcccagcgagaagaagcccacctgcatgatcatccgggagttcatcctggagaagaaccccatcctggtgagaaatgtgggcaagaccagcgctgaggtgcagctgctgctgaacacccgggagttcatcctggagatcaacagcaggaaccgggagatcaaggagtttgctgagtgcttctcctag

SEQ ID NO: 177038 - DNA, 1911 bp, Artificial Sequence
  Description of Artificial Sequence: Synthetic coding sequence
atggcccccaggcctcccacagctgccccccaggagagcgtgaccttcaaggatgtgtctgtggacttcacccaggaggagtggtaccacgtggaccctgcccagaggagcctgtacagagatgtgatgctggagaactacagccacctggtgtccctgggctaccaggtgtccaagccagaggtgatcttcaagctggagcagggcgaggagccctggatcagcgagggggagatccagaggcccttctacccagactggaagaccaggcctgaggtgaagagcagccacctgcagcaggatgtgtctgaggtgagccactgcacccatgacctgctgcacgccaccctggaggacagctgggatgtgagcagccagctggaccggcagcaggagaactggaagaggcacctgggcagcgaggccagcacccagaagaagatcatcaccccccaggagaactttgagcagaacaagtttggagagaacagccggctgaacaccaacctggtgacccagctgaacatcccagcccgcatccggcccagtgaatgtgagaccctgggcagcaacctgggccacaatgctgacctgctgaatgaaaacaacatcctggccaagaagaagccctacaagtgtgacaagtgcaggaaggccttcatccacaggagcagcctgaccaagcatgagaagacccacaagggggagggcgccttccccaatggaacagaccagggcatctacccaggcaagaagcaccatgaatgtacagactgtgggaagaccttcctgtggaagacccagctgacagagcaccagaggatccacactggagagaagccctttgaatgtaatgtgtgtgggaaggccttccgccacagcagcagcctgggccagcatgaaaatgcccacactggagagaagccctaccagtgcagcctgtgtgggaaggccttccagaggagcagcagcctggtgcagcaccagaggatccacactggagagaagccctaccgctgcaacctgtgtggccgctccttcagacatggcaccagcctgacccagcacgaggtgacccacagcggggagaagcccttccagtgcaaggaatgtgggaaggccttcagccgctgcagcagcctggtgcagcacgagaggacccacactggagagaagccctttgaatgttccatctgtggccgggccttcggccagagccccagcctgtacaagcacatgaggatccacaagaggggcaagccctaccagagcagcaactacagcattgacttcaagcacagcaccagcctgacccaggatgagagcaccctgacagaggtgaagagctaccactgcaatgactgtggggaggacttcagccacatcacagacttcacagaccaccagaggatccacacagctgagaacccctatgactgtgagcaggccttcagccagcaggccatcagccaccctggagagaagccctaccagtgcaatgtgtgtgggaaggccttcaagaggagcaccagcttcatcgagcaccaccgcatccacactggagagaagccctatgagtgcaatgaatgtggggaggccttcagccgccgcagcagcctgacccagcacgagaggacccacactggagagaagccctatgagtgcatcgactgtgggaaggccttcagccagagcagcagcctcatccagcacgagaggacccacactggagagaagccctatgagtgcaatgaatgtggccgggccttcaggaagaagaccaacctgcatgaccaccagaggatccacactggagagaagccctacagctgcaaggaatgtgggaagaacttcagccgcagcagcgccctgaccaagcaccagaggatccacaccaggaacaagctgtag

SEQ ID NO: 177039 - DNA, 3576 bp, Artificial Sequence
  Description of Artificial Sequence: Synthetic coding sequence
atgcctggcaccccaggcagcctggagatgggcctgctgaccttcagagatgtggccatcgagttcagccctgaggagtggcagtgcctggacacagcccagcagaacctgtacagaaatgtgatgctggagaactacagaaacctggccttcctgggcatcgccctgagcaagccagacctgatcacctacctggagcagggcaaggagccctggaacatgaagcagcacgagatggtggatgagcccaccggcatctgcccccacttcccccaggacttctggccagagcagagcatggaggacagcttccagaaggtgctgctgaggaaatatgagaagtgtggccacgagaacctgcagctgaggaagggctgcaagtctgtggatgagtgcaaggtgcacaaggagggctacaacaagctgaaccagtgcctgaccacagcccagagcaaggtgttccagtgtgggaagtacctgaaggtgttctacaagttcctgaacagcaacagacacaccatccgccacacaggcaagaagtgcttcaagtgcaagaagtgtgtgaagagcttctgcatccggctgcacaagacccagcacaagtgtgtgtacatcacagagaagagctgcaagtgcaaggaatgtgagaagaccttccactggagcagcaccctgaccaaccacaaggagatccacacagaggacaagccctacaagtgtgaggagtgtgggaaggccttcaagcagctgagcaccctgaccacccacaagatcatctgtgccaaggagaagatctacaagtgtgaggagtgtgggaaggccttcctgtggagcagcaccctgaccaggcacaagaggatccacactggagagaagccctacaagtgtgaggagtgtgggaaggccttcagccacagcagcaccctggccaagcacaagaggatccacactggagagaagccctacaagtgtgaggagtgtgggaaggccttcagccgcagcagcaccctggccaagcacaagaggatccacactggagagaagccctacaagtgcaaggaatgtgggaaggccttcagcaacagcagcaccctggccaaccacaagatcacccacacagaggagaagccctacaagtgcaaggaatgtgacaaggccttcaagaggctgagcaccctgaccaagcacaagatcatccatgctggggagaagctgtacaagtgtgaggagtgtgggaaggccttcaacagaagcagcaacctgaccatccacaagttcatccacactggagagaagccctacaagtgtgaggagtgtgggaaggccttcaactggagcagcagcctgaccaagcacaagcgcttccacacccgggagaagcccttcaagtgcaaggaatgtgggaaggccttcatctggagcagcaccctgaccaggcacaagaggatccacactggagagaagccctacaagtgtgaggagtgtgggaaggccttccggcagagcagcaccctgaccaagcacaagatcatccacactggagagaagccctacaagtttgaggagtgtgggaaggccttccggcagagcctgaccctgaacaagcacaagatcatccacagccgggagaagccctacaagtgcaaggaatgtgggaaggccttcaagcagttcagcaccctgaccacccacaagatcatccatgctgggaagaagctgtacaagtgtgaggagtgtgggaaggccttcaaccacagcagcagcctgagcacccacaagatcatccacactggagagaagagctacaagtgtgaggagtgtgggaaggccttcctgtggagcagcaccctgcggcggcacaagaggatccacactggagagaagccctacaagtgtgaggagtgtgggaaggccttcagccacagcagcgccctggccaagcacaagaggatccacactggagagaagccctacaagtgcaaggaatgtgggaaggccttcagcaacagcagcaccctggccaaccacaagatcacccacacagaggagaagccctacaagtgcaaggaatgtgacaagaccttcaagaggctgagcaccctgaccaagcacaagatcatccatgctggggagaagctgtacaagtgtgaggagtgtgggaaggccttcaacagaagcagcaacctgaccatccacaagttcatccacactggagagaagccctacaagtgtgaggagtgtgggaaggccttcaactggagcagcagcctgaccaagcacaagaggatccacacccgggagaagcccttcaagtgcaaggaatgtgggaaggccttcatctggagcagcaccctgaccaggcacaagaggatccacactggagagaagccctacaagtgtgaggagtgtgggaaggccttcagccgcagcagcaccctgaccaagcacaagaccatccacactggagagaagccctacaagtgcaaggaatgtgggaaggccttcaagcacagcagcgccctggccaagcacaagatcatccatgctggggagaagctgtacaagtgtgaggagtgtgggaaggccttcaaccagagcagcaacctgaccacccacaagatcatccacaccaaggagaagcccagcaagtctgaggagtgtgacaaggccttcatctggagcagcaccctgacagagcacaagaggatccacacccgggagaagacctacaagtgtgaggagtgtgggaaggccttcagccagcccagccacctgaccacccacaagaggatgcacactggagagaagccctacaagtgtgaggagtgtgggaaggccttcagccagagcagcaccctgaccacccacaagatcatccacactggagagaagccctacaagtgtgaggagtgtgggaaggccttcaggaagagcagcaccctgacagagcacaagatcatccacactggagagaagccctacaagtgtgaggagtgtgggaaggccttcagccagagcagcaccctgaccaggcacaccaggatgcacactggagagaagccctacaagtgtgaggagtgtgggaaggccttcaacagaagcagcaagctgaccacccacaagatcatccacactggagagaagccctacaagtgtgaggagtgtgggaaggccttcatcagcagcagcaccctgaatggccacaagaggatccacacccgggagaagccctacaagtgtgaggagtgtgggaaggccttcagccagagcagcaccctgaccaggcacaagaggctgcacactggagagaagccctacaagtgtggggagtgtgggaaggccttcaaggagagcagcgccctgaccaagcacaagatcatccacactggagagaagccctacaagtgtgagaagtgtgggaaggccttcaaccagagcagcatcctgaccaaccacaagaagatccacaccatcacccctgtgatccccctgctgtgggaggccgaggccggcggcagccggggccaggagatggagaccatcctggccaacacagtgaagcccctgctgtactag

SEQ ID NO: 177040 - DNA, 3480 bp, Artificial Sequence
  Description of Artificial Sequence: Synthetic coding sequence
atgcctggcaccccaggcagcctggagatgggcctgctgaccttcagagatgtggccatcgagttcagccctgaggagtggcagtgcctggacacagcccagcagaacctgtacagaaatgtgatgctggagaactacagaaacctggccttcctgggcatctgcccccacttcccccaggacttctggccagagcagagcatggaggacagcttccagaaggtgctgctgaggaaatatgagaagtgtggccacgagaacctgcagctgaggaagggctgcaagtctgtggatgagtgcaaggtgcacaaggagggctacaacaagctgaaccagtgcctgaccacagcccagagcaaggtgttccagtgtgggaagtacctgaaggtgttctacaagttcctgaacagcaacagacacaccatccgccacacaggcaagaagtgcttcaagtgcaagaagtgtgtgaagagcttctgcatccggctgcacaagacccagcacaagtgtgtgtacatcacagagaagagctgcaagtgcaaggaatgtgagaagaccttccactggagcagcaccctgaccaaccacaaggagatccacacagaggacaagccctacaagtgtgaggagtgtgggaaggccttcaagcagctgagcaccctgaccacccacaagatcatctgtgccaaggagaagatctacaagtgtgaggagtgtgggaaggccttcctgtggagcagcaccctgaccaggcacaagaggatccacactggagagaagccctacaagtgtgaggagtgtgggaaggccttcagccacagcagcaccctggccaagcacaagaggatccacactggagagaagccctacaagtgtgaggagtgtgggaaggccttcagccgcagcagcaccctggccaagcacaagaggatccacactggagagaagccctacaagtgcaaggaatgtgggaaggccttcagcaacagcagcaccctggccaaccacaagatcacccacacagaggagaagccctacaagtgcaaggaatgtgacaaggccttcaagaggctgagcaccctgaccaagcacaagatcatccatgctggggagaagctgtacaagtgtgaggagtgtgggaaggccttcaacagaagcagcaacctgaccatccacaagttcatccacactggagagaagccctacaagtgtgaggagtgtgggaaggccttcaactggagcagcagcctgaccaagcacaagcgcttccacacccgggagaagcccttcaagtgcaaggaatgtgggaaggccttcatctggagcagcaccctgaccaggcacaagaggatccacactggagagaagccctacaagtgtgaggagtgtgggaaggccttccggcagagcagcaccctgaccaagcacaagatcatccacactggagagaagccctacaagtttgaggagtgtgggaaggccttccggcagagcctgaccctgaacaagcacaagatcatccacagccgggagaagccctacaagtgcaaggaatgtgggaaggccttcaagcagttcagcaccctgaccacccacaagatcatccatgctgggaagaagctgtacaagtgtgaggagtgtgggaaggccttcaaccacagcagcagcctgagcacccacaagatcatccacactggagagaagagctacaagtgtgaggagtgtgggaaggccttcctgtggagcagcaccctgcggcggcacaagaggatccacactggagagaagccctacaagtgtgaggagtgtgggaaggccttcagccacagcagcgccctggccaagcacaagaggatccacactggagagaagccctacaagtgcaaggaatgtgggaaggccttcagcaacagcagcaccctggccaaccacaagatcacccacacagaggagaagccctacaagtgcaaggaatgtgacaagaccttcaagaggctgagcaccctgaccaagcacaagatcatccatgctggggagaagctgtacaagtgtgaggagtgtgggaaggccttcaacagaagcagcaacctgaccatccacaagttcatccacactggagagaagccctacaagtgtgaggagtgtgggaaggccttcaactggagcagcagcctgaccaagcacaagaggatccacacccgggagaagcccttcaagtgcaaggaatgtgggaaggccttcatctggagcagcaccctgaccaggcacaagaggatccacactggagagaagccctacaagtgtgaggagtgtgggaaggccttcagccgcagcagcaccctgaccaagcacaagaccatccacactggagagaagccctacaagtgcaaggaatgtgggaaggccttcaagcacagcagcgccctggccaagcacaagatcatccatgctggggagaagctgtacaagtgtgaggagtgtgggaaggccttcaaccagagcagcaacctgaccacccacaagatcatccacaccaaggagaagcccagcaagtctgaggagtgtgacaaggccttcatctggagcagcaccctgacagagcacaagaggatccacacccgggagaagacctacaagtgtgaggagtgtgggaaggccttcagccagcccagccacctgaccacccacaagaggatgcacactggagagaagccctacaagtgtgaggagtgtgggaaggccttcagccagagcagcaccctgaccacccacaagatcatccacactggagagaagccctacaagtgtgaggagtgtgggaaggccttcaggaagagcagcaccctgacagagcacaagatcatccacactggagagaagccctacaagtgtgaggagtgtgggaaggccttcagccagagcagcaccctgaccaggcacaccaggatgcacactggagagaagccctacaagtgtgaggagtgtgggaaggccttcaacagaagcagcaagctgaccacccacaagatcatccacactggagagaagccctacaagtgtgaggagtgtgggaaggccttcatcagcagcagcaccctgaatggccacaagaggatccacacccgggagaagccctacaagtgtgaggagtgtgggaaggccttcagccagagcagcaccctgaccaggcacaagaggctgcacactggagagaagccctacaagtgtggggagtgtgggaaggccttcaaggagagcagcgccctgaccaagcacaagatcatccacactggagagaagccctacaagtgtgagaagtgtgggaaggccttcaaccagagcagcatcctgaccaaccacaagaagatccacaccatcacccctgtgatccccctgctgtgggaggccgaggccggcggcagccggggccaggagatggagaccatcctggccaacacagtgaagcccctgctgtactag

SEQ ID NO: 177041 - DNA, 1761 bp, Artificial Sequence
  Description of Artificial Sequence: Synthetic coding sequence
atgggccccctgaccttcagagatgtgaagattgagttcagcctggaggagtggcagtgcctggacacagcccagaggaacctgtacagagatgtgatgctggagaactacagaaacctggtgttcctgggcattgctgtgtccaagccagacctgatcacctggctggagcagggcaaggagccctggaacctgaagagacatgagatggtggacaagacccctgtgatgtgcagccactttgcccaggatgtgtggccagagcacagcatcaaggacagcttccagaaggtgatcctgcggacctacggcaagtatggccacgagaacctgcagctgaggaaggaccacaagtctgtggatgcctgcaaggtgtacaagggcggctacaacggcctgaaccagtgcctgaccaccacagacagcaagatcttccagtgtgacaagtatgtgaaggtgttccacaagttccccaacgtgaacagaaacaagatccgccacacaggcaagaagcccttcaagtgcaagaacagaggcaagagcttctgcatgctgagccagctgacccagcacaagaagatccacacccgggagtacagctacaagtgtgaagaatgtgggaaggccttcaactggagcagcaccctgaccaagcacaagatcatccacactggagagaagccctacaagtgtgaagaatgtgggaaggccttcaacagaagcagcaacctgaccaagcacaagatcatccacactggagagaagccctacaagtgtgaagaatgtgggaaggccttcaacagaagcagcaccctgaccaagcacaagaggatccacacagaggagaagccctacaagtgtgaagaatgtgggaaggccttcaaccagttcagcatcctgaacaagcacaagaggatccacatggaggacaagccctacaagtgtgaagaatgtgggaaggccttccgggtcttcagcatcctgaagaagcacaagatcatccacactggagagaagccctacaagtgtgaagaatgtgggaaggccttcaaccagttcagcaacctgaccaagcacaagatcatccacactggagagaagccctacaagtgtgatgaatgtgggaaggccttcaaccagagcagcaccctgaccaagcacaagaggatccacactggagagaagccctacaagtgtgaagaatgtgggaaggccttcaagcagagcagcaccctgacagagcacaagatcatccacactggagagaagccctacaagtgtgagaagtgtgggaaggccttctcctggagcagcgccttcaccaagcacaagaggaaccacatggaggacaagccctacaagtgtgaagaatgtgggaaggccttctctgtgttcagcaccctgaccaagcacaagatcatccacacccgggagaagccctacaagtgtgaagaatgtgggaaggccttcaaccagagcagcatcttcaccaagcacaagatcatccacacagagggcaagagctacaagtgtgagaagtgtggaaatgccttcaaccagagcagcaacctgacagccaggaagatcatctacaccggggagaagccctacaagtatgaagaatgtgacaaggccttcaacaagttcagcaccctcatcacccaccagatcatctacaccggggagaagccctgcaagcatgaatgtggccgggccttcaacaagagcagcaactacaccaaggagaagctgcagacctag

SEQ ID NO: 177042 - DNA, 1665 bp, Artificial Sequence
  Description of Artificial Sequence: Synthetic coding sequence
atgggccccctgaccttcagagatgtgaagattgagttcagcctggaggagtggcagtgcctggacacagcccagaggaacctgtacagagatgtgatgctggagaactacagaaacctggtgttcctggtgatgtgcagccactttgcccaggatgtgtggccagagcacagcatcaaggacagcttccagaaggtgatcctgcggacctacggcaagtatggccacgagaacctgcagctgaggaaggaccacaagtctgtggatgcctgcaaggtgtacaagggcggctacaacggcctgaaccagtgcctgaccaccacagacagcaagatcttccagtgtgacaagtatgtgaaggtgttccacaagttccccaacgtgaacagaaacaagatccgccacacaggcaagaagcccttcaagtgcaagaacagaggcaagagcttctgcatgctgagccagctgacccagcacaagaagatccacacccgggagtacagctacaagtgtgaagaatgtgggaaggccttcaactggagcagcaccctgaccaagcacaagatcatccacactggagagaagccctacaagtgtgaagaatgtgggaaggccttcaacagaagcagcaacctgaccaagcacaagatcatccacactggagagaagccctacaagtgtgaagaatgtgggaaggccttcaacagaagcagcaccctgaccaagcacaagaggatccacacagaggagaagccctacaagtgtgaagaatgtgggaaggccttcaaccagttcagcatcctgaacaagcacaagaggatccacatggaggacaagccctacaagtgtgaagaatgtgggaaggccttccgggtcttcagcatcctgaagaagcacaagatcatccacactggagagaagccctacaagtgtgaagaatgtgggaaggccttcaaccagttcagcaacctgaccaagcacaagatcatccacactggagagaagccctacaagtgtgatgaatgtgggaaggccttcaaccagagcagcaccctgaccaagcacaagaggatccacactggagagaagccctacaagtgtgaagaatgtgggaaggccttcaagcagagcagcaccctgacagagcacaagatcatccacactggagagaagccctacaagtgtgagaagtgtgggaaggccttctcctggagcagcgccttcaccaagcacaagaggaaccacatggaggacaagccctacaagtgtgaagaatgtgggaaggccttctctgtgttcagcaccctgaccaagcacaagatcatccacacccgggagaagccctacaagtgtgaagaatgtgggaaggccttcaaccagagcagcatcttcaccaagcacaagatcatccacacagagggcaagagctacaagtgtgagaagtgtggaaatgccttcaaccagagcagcaacctgacagccaggaagatcatctacaccggggagaagccctacaagtatgaagaatgtgacaaggccttcaacaagttcagcaccctcatcacccaccagatcatctacaccggggagaagccctgcaagcatgaatgtggccgggccttcaacaagagcagcaactacaccaaggagaagctgcagacctag

SEQ ID NO: 177043 - DNA, 1554 bp, Artificial Sequence
  Description of Artificial Sequence: Synthetic coding sequence
atggtggacaagacccctgtgatgtgcagccactttgcccaggatgtgtggccagagcacagcatcaaggacagcttccagaaggtgatcctgcggacctacggcaagtatggccacgagaacctgcagctgaggaaggaccacaagtctgtggatgcctgcaaggtgtacaagggcggctacaacggcctgaaccagtgcctgaccaccacagacagcaagatcttccagtgtgacaagtatgtgaaggtgttccacaagttccccaacgtgaacagaaacaagatccgccacacaggcaagaagcccttcaagtgcaagaacagaggcaagagcttctgcatgctgagccagctgacccagcacaagaagatccacacccgggagtacagctacaagtgtgaggagtgtgggaaggccttcaactggagcagcaccctgaccaagcacaagatcatccacactggagagaagccctacaagtgtgaggagtgtgggaaggccttcaacagaagcagcaacctgaccaagcacaagatcatccacactggagagaagccctacaagtgtgaggagtgtgggaaggccttcaacagaagcagcaccctgaccaagcacaagaggatccacacagaggagaagccctacaagtgtgaggagtgtgggaaggccttcaaccagttcagcatcctgaacaagcacaagaggatccacatggaggacaagccctacaagtgtgaggagtgtgggaaggccttccgggtcttcagcatcctgaagaagcacaagatcatccacactggagagaagccctacaagtgtgaggagtgtgggaaggccttcaaccagttcagcaacctgaccaagcacaagatcatccacactggagagaagccctacaagtgtgatgaatgtgggaaggccttcaaccagagcagcaccctgaccaagcacaagaggatccacactggagagaagccctacaagtgtgaggagtgtgggaaggccttcaagcagagcagcaccctgacagagcacaagatcatccacactggagagaagccctacaagtgtgagaagtgtgggaaggccttctcctggagcagcgccttcaccaagcacaagaggaaccacatggaggacaagccctacaagtgtgaggagtgtgggaaggccttcagcgtcttcagcaccctgaccaagcacaagatcatccacacccgggagaagccctacaagtgtgaggagtgtgggaaggccttcaaccagagcagcatcttcaccaagcacaagatcatccacacagagggcaagagctacaagtgtgagaagtgtggaaatgccttcaaccagagcagcaacctgacagccaggaagatcatctacacaggagagaagccctacaagtatgaggagtgtgacaaggccttcaacaagttcagcaccctcatcacccaccagatcatctacacaggagagaagccctgcaagcatgaatgtggccgggccttcaacaagagcagcaactacaccaaggagaagctgcagacctag

SEQ ID NO: 177044 - DNA, 1863 bp, Artificial Sequence
  Description of Artificial Sequence: Synthetic coding sequence
atgggccccctgcagttcagagatgtggccatcgagttcagcctggaggagtggcactgcctggacacagcccagaggaacctgtacagaaatgtgatgctggagaactacagcaacctggtgttcctgggcatcgtggtgtccaagccagacctgattgcccacctggagcagggcaagaagcccctgaccatgaagagacatgagatggtggccaaccccagcgtcatctgcagccactttgcccaggacctgtggccagagcagaacatcaaggacagcttccagaaggtgatcctgcggcgctatgagaagaggggccacggcaacctgcagctgatcaagagatgtgagagcgtggatgagtgcaaggtgcacactggaggctacaacggcctgaaccagtgcagcaccaccacccagagcaaggtgttccagtgtgacaagtatggcaaggtgttccacaagttcagcaacagcaacagacacaacatccgccacacagagaagaagcccttcaagtgcattgaatgtgggaaggccttcaaccagttcagcaccctcatcacccacaagaagatccacactggagagaagccctacatctgtgaagaatgtgggaaggccttcaagtacagcagcgccctgaacacccacaagaggatccacactggagagaagccctacaagtgtgacaagtgtgacaaggccttcatcgccagcagcaccctgagcaagcatgagatcatccacacaggcaagaagccctacaagtgtgaagaatgtgggaaggccttcaaccagagcagcaccctgaccaagcacaagaagatccacactggagagaagccctacaagtgtgaagaatgtgggaaggccttcaaccagagcagcaccctgaccaagcacaagaagatccacactggagagaagccctacgtgtgtgaagaatgtgggaaggccttcaagtacagccgcatcctgaccacccacaagaggatccacactggagagaagccctacaagtgcaacaagtgtgggaaggccttcatcgccagcagcaccctgagcagacatgagttcatccacatgggcaagaagcactacaagtgtgaagaatgtgggaaggccttcatctggagctctgtgctgaccaggcacaagagggtgcacactggagagaagccctacaagtgtgaagaatgtgggaaggccttcaagtacagcagcaccctgagcagccacaagaggagccacactggagagaagccctacaagtgtgaagaatgtgggaaggcctttgtggccagcagcaccctgagcaagcatgagatcatccacacaggcaagaagccctacaagtgtgaagaatgtgggaaggccttcaaccagagcagcagcctgaccaagcacaagaagatccacactggagagaagccctacaagtgtgaagaatgtgggaaggccttcaaccagagcagcagcctgaccaagcacaagaagatccacactggagagaagccctacaagtgtgaagaatgtgggaaggccttcaaccagagcagcaccctcatcaagcacaagaagatccacacccgggagaagccctacaagtgtgaagaatgtgggaaggccttccacctgagcacccacctgaccacccacaagatcctgcacactggagagaagccctaccgctgcagagaatgtgggaaggccttcaaccacagcgccaccctgagcagccacaagaagatccacagcggggagaagccctatgaatgtgacaagtgtgggaaggccttcatcagccccagcagcctgagcagacatgagatcatccacactggagagaagccctag

SEQ ID NO: 177045 - DNA, 1779 bp, Artificial Sequence
  Description of Artificial Sequence: Synthetic coding sequence
atgggccccctgcagttcagagatgtggccatcgagttcagcctggaggagtggcactgcctggacacagcccagaggaacctgtacagaaatgtgatgctggagaactacagcaacctggtgttcctgggcatcgtggtgtccaagccagacctgattgcccacctggagcagggcaagaagcccctgaccatgaagagacatgagatggtggccaaccccagcgtcatctgcagccactttgcccaggacctgtggccagagcagaacatcaaggacagcttccagaaggtgatcctgcggcgctatgagaagaggggccacggcaacctgcagctgatcaagagatgtgagagcgtggatgagtgcaaggtgcacactggaggctacaacggcctgaaccagtgcagcaccaccacccagagcaaggtgttccagtgtgacaagtatggcaaggtgttccacaagttcagcaacagcaacagacacaacatccgccacacagagaagaagcccttcaagtgcattgaatgtgggaaggccttcaaccagttcagcaccctcatcacccacaagaagatccacactggagagaagccctacatctgtgaagaatgtgggaaggccttcaagtacagcagcgccctgaacacccacaagaggatccacactggagagaagccctacaagtgtgacaagtgtgacaaggccttcatcgccagcagcaccctgagcaagcatgagatcatccacacaggcaagaagccctacaagtgtgaagaatgtgggaaggccttcaaccagagcagcaccctgaccaagcacaagaagatccacactggagagaagccctacaagtgtgaagaatgtgggaaggccttcaaccagagcagcaccctgaccaagcacaagaagatccacactggagagaagccctacgtgtgtgaagaatgtgggaaggccttcaagtacagccgcatcctgaccacccacaagaggatccacactggagagaagccctacaagtgcaacaagtgtgggaaggccttcatcgccagcagcaccctgagcagacatgagttcatccacatgggcaagaagcactacaagtgtgaagaatgtgggaaggccttcatctggagctctgtgctgaccaggcacaagagggtgcacactggagagaagccctacaagtgtgaagaatgtgggaaggcctttgtggccagcagcaccctgagcaagcatgagatcatccacacaggcaagaagccctacaagtgtgaagaatgtgggaaggccttcaaccagagcagcagcctgaccaagcacaagaagatccacactggagagaagccctacaagtgtgaagaatgtgggaaggccttcaaccagagcagcagcctgaccaagcacaagaagatccacactggagagaagccctacaagtgtgaagaatgtgggaaggccttcaaccagagcagcaccctcatcaagcacaagaagatccacacccgggagaagccctacaagtgtgaagaatgtgggaaggccttccacctgagcacccacctgaccacccacaagatcctgcacactggagagaagccctaccgctgcagagaatgtgggaaggccttcaaccacagcgccaccctgagcagccacaagaagatccacagcggggagaagccctatgaatgtgacaagtgtgggaaggccttcatcagccccagcagcctgagcagacatgagatcatccacactggagagaagccctag

SEQ ID NO: 177046 - DNA, 183 bp, Artificial Sequence
  Description of Artificial Sequence: Synthetic coding sequence
atggtggccaaccccagcgtcatctgcagccactttgcccaggacctgtggccagagcagaacatcaaggacagcttccagaaggtgatcctgcggcgctatgagaagaggggccacggcaacctgcagctgatcaagagatgtgagagcaccccatctgagaaggagaagaagaagaagtag

SEQ ID NO: 177047 - DNA, 1719 bp, Artificial Sequence
  Description of Artificial Sequence: Synthetic coding sequence
atgcctggccccctgggcagcctggagatgggcgtgctgaccttcagagatgtggccctggagttcagcctggaggagtggcagtgcctggacacagcccagcagaacctgtacagaaatgtgatgctggagaactacagaaacctggtgtttgtgggcattgctgccagcaagccagacctgatcacctgcctggagcagggcaaggagccctggaatgtgaagagacatgagatggtgacagagccccctgtggtgtacagctactttgcccaggacctgtggcccaagcagggcaagaagaactacttccagaaggtgatcctgcggacctacaagaagtgtggccgggagaacctgcagctgaggaagtactgcaagtccatggatgagtgcaaggtgcacaaggagtgctacaacggcctgaaccagtgcctgaccaccacccagaacaagatcttccagtatgacaagtatgtgaaggtgttccacaagttcagcaacagcaacagacacaagattggccacacaggcaagaagagcttcaagtgcaaggaatgtgagaagagcttctgcatgctgagccacctggcccagcacaagaggatccacagcggggagaagccctacaagtgcaaggaatgtgggaaggcctacaatgaggccagcaacctgagcacccacaagaggatccacacaggcaagaagccctacaagtgtgaggagtgtgggaaggccttcaaccggctgagccacctgaccacccacaagatcatccacacaggcaagaagccctacaagtgtgaggagtgtgggaaggccttcaaccagagcgccaacctgaccacccacaagaggatccacactggagagaagccctacaagtgtgaggagtgtggccgggccttcagccagagcagcaccctgacagcccacaagatcatccatgctggggagaagccctacaagtgtgaggagtgtgggaaggccttcagccagagcagcaccctgaccacccacaagatcatccacactggagagaagttctacaagtgtgaggagtgtgggaaggccttcagccggctgagccacctgaccacccacaagaggatccacagcggggagaagccctacaagtgtgaggagtgtgggaaggccttcaagcagagcagcaccctgaccacccacaagagaattcatgctggggagaagttctacaagtgtgaggtgtgcagcaaggccttcagccgcttcagccacctgaccacccacaagaggatccacactggagagaagccctacaagtgtgaggagtgtgggaaggccttcaacctgagcagccagctgaccacccacaagatcatccacactggagagaagccctacaagtgtgaggagtgtgggaaggccttcaaccagagcagcaccctgagcaagcacaaggtgatccacactggagagaagccctacaagtgtgaggagtgtgggaaggccttcaaccagagcagccacctgaccacccacaagatgatccacactggagagaagccctacaagtgtgaggagtgtgggaaggccttcaacaacagcagcatcctgaacagacacaagatgatccacactggagagaagctgtacaagccagagagctgcaacaatgcctgtgacaacatcgccaagatcagcaagtacaagaggaactgtgccggggagaagtag

SEQ ID NO: 177048 - DNA, 3114 bp, Artificial Sequence
  Description of Artificial Sequence: Synthetic coding sequence
atgtccttctggagcgagaagtgcaccaggctcatcctgtatgacctgaagatcgccctgaagaatggcagcctgaccttctgggatgtgaccatcgagtttgccctggaggagtggcagtgcctggacatggcccagcagaacctgtacagaaatgtgatgctggagaactacagaaacctggtgttcctgggcattgctgtgtccaagctggacctgatcacctgcctgaagcagggcaaggagccctggaacatgaagagacatgagatggtgaccaagccccctgtgatcagcagccacttcacccaggacttctggccagaccagagcatcaaggacagcttccaggagatcatcctgcggacctacgcccgctgtggccacaagaacctgcggctgaggaaggactgtgagagcgtgaatgaaggcaagatgcatgaggaggcctacaacaagctgaaccagtgctggaccaccacccagggcaagatcttccagtgcaacaagtatgtgaaggtgttccacaagtacagcaacagcaaccgctacaagatcatccacacaggcaagaagccctacaagtgtgaggagtgtgggaaggccttcaagcagagcagccacctgaccaggcacaaggccatccacactggagagaagccctacaagtgtgaggagtgtgggaaggccttcaaccacttcagcgccctgaggaagcaccagatcatccacacaggcaagaagccctacaagtgtgaggagtgtgggaaggccttcagccagagcagcaccctgaggaagcatgagatcatccacacagaggagaagccctacaagtatgaggagtgtgggaaggccttcagcaacctgagcgccctgaggaagcatgagatcatccacacaggccagaagccctacaagtgtgaggagtgtgggaaggccttcaagtggagcagcaagctgactgtgcacaaggtgatccacacagctgagaagccctgcaagtgtgaggagtgtgggaaggccttcaagcgcttcagcgccctgaggaagcacaagatcatccacacaggcaagcagccctacaagtgtgaggagtgcagcaaggccttcagcaacttcagcgccctgaggaagcatgagatcatccacactggagagaagccctacaagtgtgaggagtgtgggaaggccttcaagtggagcagcaagctgactgtgcacaaggtgatccacatggaggagaagccctgcaagtgtgaggagtgtgggaaggccttcaagcacttcagcgccctgaggaagcacaagatcatccacacaggcaagaagccctacaagtgtgaggagtgtgggaaggccttcaacaacagcagcaccctgatgaagcacaagatcatccacacaggcaagaagccctacaagtgtgaggagtgtgggaaggccttcaagcagagcagccacctgaccaggcacaaggccatccacactggagagaagccctacaagtgtgaggagtgtgggaaggccttcaaccacttcagcgccctgaggaagcaccagatcatccacacaggcaagaagccctacaagtgtgaggagtgtgggaaggccttcagccagagcagcaccctgaggaagcatgagatcatccacactggagagaagccctacaagtgtgaggagtgtgggaaggccttcaagtggagcagccacctgaccaggcacaaggtgatccacacagaggagaagccctacaagtgtgaggagtgtgggaaggccttcaaccacttcagcgccctgaggaagcacaagatcatccacacaggcaagaagccctacaagtgtgaggagtgtgggaaggccttcagccagagcagcaccctgaggaagcatgagatcatccacactggagagaagccctacaagtgtgaggagtgtgggaaggccttcaagtggagcagcaagctgactgtgcacaaggtgatccacacagctgagaagccctgcaagtgtgaggagtgtgggaaggccttcaagcacttcagcgccctgaggaagcacaagatcatccacacaggcaagaagccctacaagtgtgaggagtgtgggaaggccttcaacaacagcagcaccctgaggaagcatgagatcatccacactggagagaagagctacaagtgtgaggagtgtgccctgaggaagcatgagatcatccacacaggcaagaagccctacaagtgtgaggagtgtgggaaggccttcaacaacagcagcaccctgaggaagcacaagatcatctacacaggcaagaagccctacaagtgtgaggagtgtgggaaggccttcaagcagagcagccacctgaccaggcacaaggctgtgcacactggagagaagccctacaagtgtggggagtgtgggaaggccttcaacaacagcagcaccctgaagaagcacaagctgatccacacccgggagaagagctacaagtgtgaggagtgtgggaaggccttcagcaacttcagcgccctgaggaagcacaagatcatccacactggagagaagccctacaagtgtgaggagtgtgaatgtgggaaggccttcaacaacagcagcaccctgatgaagcacaagatcatccacactggagagaagccctacaagtgtgaggagtgtgggaagggcttcaacaacttcagcaccctgatgaagcacaagatcatccacactggagagaagccctacaagtgtgaggagtgtgggaaggccttcaagcagagcagccacctgaccaagcacaagagcatccacactggagagaagccctacaagtgtgaggagcggggcaaggccttcagccacttcagccggctgaccaagcaccgcatcatccacacaggcaagaagccctacaagtgtgaggagtgtggggagaagccctacaagtgtgaggagtgtgggaaggccttcaaccagagcagccacctgacccagcacaagaccatccacactggaggcaagacctacaagtgtgaggagtgtgggaaggccttcaaccacctgagcgccctgaccaagcacaagatcatccacactggagagaagccctag

SEQ ID NO: 177049 - DNA, 3021 bp, Artificial Sequence
  Description of Artificial Sequence: Synthetic coding sequence
atgagcaggaggaagcagagcaacccccggcagatcaagaggagcctgggggacatggaggcccgggaggaggtgcagctggtgggcgccagccacatggagcagaaggccacagcccctgaggcccccagccccccatctgcagatgtgaacagccccccacccctgcccccacccaccagccctgggggccccaaggagctggagggccaggagcctgagccccggcccacagaggaggagcccggcagcccctggagcggcccagatgagctggagcctgtggtgcaggacggccagaggcgcatccgggcccggctgagcctggccaccggcctgtcctggggccccttccacggctctgtgcagacccgggccagcagcccccggcaggccgagcccagccctgccctgaccctgctgctggtggatgaggcctgctggctgcggaccctgccccaggccctgacagaagctgaggccaacacagagatccacaggaaggatgatgccctgtggtgccgggtgaccaagcctgtgcctgctgggggcctgctgtctgtgctgctgacagctgagccccacagcaccccaggccaccctgtgaagaaggagcctgctgagcccacctgcccagccccagcccatgacctgcagctgctgccccagcaggccggcatggccagcatcctggccacagctgtgatcaacaaggatgtgttcccctgcaaggactgtggcatctggtacagaagtgagaggaacctgcaggcccacctgctgtactactgtgccagccggcagggcaccggcagccctgctgctgctgccacagatgagaagcccaaggagacctacccaaatgaaagagtgtgccccttcccccagtgcaggaagagctgccccagcgccagcagcctggagatccacatgaggagccacagcggggagcggccctttgtgtgcctgatctgcctgagcgccttcaccaccaaggccaactgtgagcggcacctgaaggtgcacacagacaccctgtctggagtgtgccacagctgtggcttcatcagcaccacccgggacatcctgtacagccacctggtgaccaaccacatggtgtgccagcccggcagcaaaggagagatctacagccctggagctggccacccagccaccaagctgcccccagacagcctgggcagcttccagcagcagcacacagccctgcagggccccctggccagcgctgacctgggcctggcccccacccccagccctggcctggacaggaaggccctggccgaggccaccaacggggaggcccgggcagagcccctggcccagaatggaggcagcagcgagcccccagctgcccccaggagcatcaaggtggaggccgtggaggagcctgaggccgcccccatcctgggccctggagagcccggcccccaggcccccagcaggacccccagccccaggagccctgccccagcccgggtgaaggccgagctgagcagccccaccccaggcagcagccctgtgcctggagagctgggcctggccggggccctcttcctgccccagtatgtgtttggaccagatgctgcccccccagccagcgagatcctggccaagatgtctgagctggtgcacagccggctgcagcagggcgctggggccggggccggcggggcccagacaggcctcttccctggggcccccaagggggccacctgctttgaatgtgagatcaccttcagcaatgtgaacaactactacgtgcacaagaggctgtactgcagcggcagaagagccccagaagatgccccagctgcccggcggcccaaggcccctcctggccctgcccgggcccctcctggccagcctgctgagccagatgcccccaggagcagccctggccctggggcccgggaggagggcgctgggggcgccgccaccccagaagatggagctgggggccggggcagcgagggcagccagagccctggcagctctgtggatgatgctgaagatgaccccagcaggaccctgtgtgaggcctgcaacatccgcttcagcagacatgagacctacacagtgcacaagcgctactactgtgccagcagacatgaccccccaccaagaagacctgctgcccctcctggccccccaggccctgctgcccccccagcccccagccctgctgcccctgtgaggaccaggagaagaaggaagctgtatgagctgcatgctgctggggcccctcctcctcctcctcctggccacgccccagcccctgagagccccaggcctggcagcggcagcggcagcggccctggcctggccccagcccggagccctggccctgctgctgatggccccatcgacctgagcaagaagccccggcggcccctgcccggggccccagccccagccctggccgactaccacgagtgcacagcctgccgggtgtccttccacagcctggaggcctacctggcccacaagaagtacagctgcccagctgcccctcctcctggggccctgggcctgcctgctgctgcctgcccctactgcccccccaacggccctgtgcggggggacctgctggagcacttccggctggcccacggcctgctgctgggcgcccccctggccggccctggggtggaggcccggaccccagctgaccggggccccagccctgccccagccccagctgccagcccccagcccggcagccggggccccagagatggcctgggccctgagccccaggagcccccacctggccccccacccagccctgctgctgcccctgaggccgtgcccccacctccagcccctccttcctacagcgacaagggcgtgcagacccccagcaagggcaccccagcccccctgcccaacggcaaccaccgctactgccgcctgtgcaacatcaagttcagcagcctgagcaccttcatcgcccacaagaagtactactgcagcagccatgctgctgagcacgtgaagtag

SEQ ID NO: 177050 - DNA, 2649 bp, Artificial Sequence
  Description of Artificial Sequence: Synthetic coding sequence
atgtactactgcagcggccggcagcgggaggccgcccctgtgtctgaagaaaatgaagattctgcccaccagatcagcagcctgtgccccttcccccagtgcaccaagagcttcagcaatgcccgggccctggagatgcacctgaacagccacagcggcgtgaagatggaggagttcctgcccccaggggccagcctgaagtgcaccgtgtgcagctacacagctgacagcgtcatcaacttccaccagcacctgttcagccacctgacccaggccgccttccgctgcaaccactgccacttcggcttccagacccagcgggagctgctgcagcaccaggagctgcacgtgcccagcggcaagctgccccgggagagtgacatggagcacagccccagcgccacagaggacagcctgcagcctgccacagacctgctgaccaggtctgagctgccccagagccagaaggccatgcagaccaaggatgccagcagtgacacagagctggacaagtgtgagaagaagacccagctgttcctgaccaaccagaggcctgagatccagcccaccaccaacaagcagagcttctcctacaccaagatcaagtctgagcccagcagcccccggctggccagcagccctgtgcagcccaacatcggccccagcttccctgtgggccccttcctgagccagttctccttcccccaggacatcaccatggtgccccaggccagcgagatcctggccaagatgtctgagctggtgcaccggcggctgcggcacggcagcagcagctacccacctgtgatctacagccccctgatgcccaagggggccacctgctttgagtgcaacatcaccttcaacaacctggacaactacctggtgcacaagaagcactactgcagcagccgctggcagcagatggccaagagccctgagttccccagcgtgtctgagaagatgcctgaggccctgagccccaacacaggccagaccagcatcaacctgctgaacccagctgcccacagcgctgaccctgagaaccccctgctgcagaccagctgcatcaacagcagcacagtgctggacctgattggccccaatggaaaaggacatgacaaggacttcagcacccagaccaagaagctgagcaccagcagcaacaatgatgacaagatcaatggcaagcctgtggatgtgaagaaccccagcgtgcccctggtggatggagagagtgaccccaacaagaccacctgtgaggcctgcaacatcaccttcagcagacatgagacctacatggtgcacaagcagtactactgtgccaccaggcatgacccccccctgaagaggtctgccagcaacaaggtgcctgccatgcagaggaccatgaggaccaggaagaggaggaagatgtatgagatgtgcctgcctgagcaggagcagaggcctcccctggtgcagcagcgcttcctggatgtggccaacctgaacaacccctgcaccagcacccaggagcccacagagggcctgggggagtgctaccacccccgctgtgacatcttccctggcatcgtgtccaagcacctggagaccagcctgaccatcaacaagtgtgtgcctgtgtccaaatgtgacaccacccacagctctgtgtcctgcctggagatggatgtgcccatcgacctgagcaagaagtgcctgagccagagcgagaggaccaccaccagccccaagaggctgctggactaccacgagtgcaccgtgtgcaagatctccttcaacaaggtggagaactacctggcccacaagcagaacttctgccctgtgacagcccaccagagaaatgacctgggccagctggatggcaaggtgttccccaaccctgagagcgagaggaacagcccagatgtgtcctatgaaagaagcatcatcaagtgtgagaagaatggaaacctgaagcagcccagccccaatggaaacctcttcagcagccacctggccaccctgcagggcctgaaggtgttttctgaggccgcccagctgattgccaccaaggaggagaacagacacctgttcctgccccagtgcctgtacccaggggccatcaagaaggccaagggagctgaccagctgagcccctactacggcatcaagcccagcgactacatcagcggcagcctggtgatccacaacacagacatcgagcagagcagaaatgcagaaaatgaaagccccaagggccaggccagcagcaatggctgtgccgccctgaagaaggacagcctgcccctgctgcccaagaacagaggcatggtgattgtgaatggaggcctgaagcaggatgagaggcctgctgccaacccccagcaggagaacatcagccagaacccccagcatgaagatgaccacaagagccccagctggatcagcgagaaccccctggccgccaatgaaaatgtgtccccaggcatccccagcgctgaggagcagctgagcagcatcgccaagggcgtgaatggcagcagccaggcccccaccagcggcaagtactgccgcctgtgtgacatccagttcaacaacctgagcaacttcatcacccacaagaagttctactgcagcagccatgctgctgagcacgtgaagtag

SEQ ID NO: 177051 - DNA, 3456 bp, Artificial Sequence
  Description of Artificial Sequence: Synthetic coding sequence
atgagcaggaggaagcagagcaagccccggcagatcaagaggcccctggaggatgccattgaagatgaggaggaggagtgccccagcgaggagacagacatcatcagcaaaggagacttccccctggaggagagcttcagcacagaatttggacctgagaacctgagctgtgaggaggtggagtacttctgcaacaagggagatgatgagggcatccaggagacagctgagagtgatggagacacccagagcgagaagccaggccagcccggggtggagacagatgactgggatggccctggagagctggaggtgttccagaaggatggagagaggaagatccagagccggcagcagctgcctgtgggcaccacctggggccccttccctgggaagatggacctgaacaacaacagcctgaagaccaaggcccaggtgcccatggtgctgacagctggccccaagtggctgctggatgtgacctggcagggcgtggaggacaacaagaacaactgcatcgtgtacagcaaaggaggccagctgtggtgcaccaccaccaaggccatcagcgagggggaggagctgattgcctttgtggtggactttgacagccggctgcaggccgccagccagatgaccctgacagagggcatgtacccagcccggctgctggacagcatccagctgctgccccagcaggccgccatggccagcatcctgcccacagccatcgtgaacaaggacatcttcccctgcaagagctgtggcatctggtacagaagtgaaagaaacctgcaggcccacctgatgtactactgcagcggccggcagcgggaggccgcccctgtgtctgaggagaatgaagacagcgcccaccagatcagcagcctgtgccccttcccccagtgcaccaagagcttcagcaatgcccgggccctggagatgcacctgaacagccacagcggcgtgaagatggaggagttcctgcccccaggggccagcctgaagtgcaccgtgtgcagctacacagctgacagcgtcatcaacttccaccagcacctgttcagccacctgacccaggccgccttccgctgcaaccactgccacttcggcttccagacccagcgggagctgctgcagcaccaggagctgcacgtgcccagcggcaagctgccccgggagagtgacatggagcacagccccagcgccacagaggacagcctgcagcctgccacagacctgctgaccaggtctgagctgccccagagccagaaggccatgcagaccaaggatgccagcagtgacacagagctggacaagtgtgagaagaagacccagctgttcctgaccaaccagaggcctgagatccagcccaccaccaacaagcagagcttctcctacaccaagatcaagtctgagcccagcagcccccggctggccagcagccctgtgcagcccaacatcggccccagcttccctgtgggccccttcctgagccagttctccttcccccaggacatcaccatggtgccccaggccagcgagatcctggccaagatgtctgagctggtgcaccggcggctgcggcacggcagcagcagctacccacctgtgatctacagccccctgatgcccaagggggccacctgctttgagtgcaacatcaccttcaacaacctggacaactacctggtgcacaagaagcactactgcagcagccgctggcagcagatggccaagagccctgagttccccagcgtgtctgagaagatgcctgaggccctgagccccaacacaggccagaccagcatcaacctgctgaacccagctgcccacagcgctgaccctgagaaccccctgctgcagaccagctgcatcaacagcagcacagtgctggacctgattggccccaacgggaagggccatgacaaggacttcagcacccagaccaagaagctgagcaccagcagcaacaatgatgacaagatcaacgggaagcctgtggatgtgaagaaccccagcgtgcccctggtggatggagagagtgaccccaacaagaccacctgtgaggcctgcaacatcaccttcagcagacatgagacctacatggtgcacaagcagtactactgtgccaccaggcatgacccccccctgaagaggtctgccagcaacaaggtgcctgccatgcagaggaccatgaggaccaggaagaggaggaagatgtatgagatgtgcctgcctgagcaggagcagaggcctcccctggtgcagcagcgcttcctggatgtggccaacctgaacaacccctgcaccagcacccaggagcccacagagggcctgggggagtgctaccacccccgctgtgacatcttccctggcatcgtgtccaagcacctggagaccagcctgaccatcaacaagtgtgtgcctgtgtccaaatgtgacaccacccacagctctgtgtcctgcctggagatggatgtgcccatcgacctgagcaagaagtgcctgagccagagcgagaggaccaccaccagccccaagaggctgctggactaccatgaatgtactgtgtgcaagatctccttcaacaaggtggagaactacctggcccacaagcagaacttctgccctgtgacagcccaccagagaaatgacctgggccagctggatggcaaggtgttccccaaccctgagagcgagaggaacagcccagatgtgtcctatgaaagaagcatcatcaagtgtgagaagaatggaaacctgaagcagcccagccccaacggcaacctcttcagcagccacctggccaccctgcagggcctgaaggtgttcagcgaggccgcccagctgattgccaccaaggaggagaacagacacctgttcctgccccagtgcctgtacccaggggccatcaagaaggccaagggagctgaccagctgagcccctactacggcatcaagcccagcgactacatcagcggcagcctggtgatccacaacacagacatcgagcagagcagaaatgcagaaaatgaaagccccaagggccaggccagcagcaatggctgtgccgccctgaagaaggacagcctgcccctgctgcccaagaacagaggcatggtgattgtgaatggaggcctgaagcaggatgagaggcctgctgccaacccccagcaggagaacatcagccagaacccccagcatgaagatgaccacaagagccccagctggatcagcgagaaccccctggccgccaatgaaaatgtgtccccaggcatccccagcgctgaggagcagctgagcagcatcgccaagggcgtgaatggcagcagccaggcccccaccagcggcaagtactgccgcctgtgtgacatccagttcaacaacctgagcaacttcatcacccacaagaagttctactgcagcagccacgccgctgagcacgtgaagtag

SEQ ID NO: 177052 - DNA, 3060 bp, Artificial Sequence
  Description of Artificial Sequence: Synthetic coding sequence
atggacctgaacaacaacagcctgaagaccaaggcccaggtgcccatggtgctgacagctggccccaagtggctgctggatgtgacctggcagggcgtggaggacaacaagaacaactgcatcgtgtacagcaaaggaggccagctgtggtgcaccaccaccaaggccatcagcgagggggaggagctgattgcctttgtggtggactttgacagccggctgcaggccgccagccagatgaccctgacagagggcatgtacccagcccggctgctggacagcatccagctgctgccccagcaggccgccatggccagcatcctgcccacagccatcgtgaacaaggacatcttcccctgcaagagctgtggcatctggtacagaagtgaaagaaacctgcaggcccacctgatgtactactgcagcggccggcagcgggaggccgcccctgtgtctgaggagaatgaagacagcgcccaccagatcagcagcctgtgccccttcccccagtgcaccaagagcttcagcaatgcccgggccctggagatgcacctgaacagccacagcggcgtgaagatggaggagttcctgcccccaggggccagcctgaagtgcaccgtgtgcagctacacagctgacagcgtcatcaacttccaccagcacctgttcagccacctgacccaggccgccttccgctgcaaccactgccacttcggcttccagacccagcgggagctgctgcagcaccaggagctgcacgtgcccagcggcaagctgccccgggagagtgacatggagcacagccccagcgccacagaggacagcctgcagcctgccacagacctgctgaccaggtctgagctgccccagagccagaaggccatgcagaccaaggatgccagcagtgacacagagctggacaagtgtgagaagaagacccagctgttcctgaccaaccagaggcctgagatccagcccaccaccaacaagcagagcttctcctacaccaagatcaagtctgagcccagcagcccccggctggccagcagccctgtgcagcccaacatcggccccagcttccctgtgggccccttcctgagccagttctccttcccccaggacatcaccatggtgccccaggccagcgagatcctggccaagatgtctgagctggtgcaccggcggctgcggcacggcagcagcagctacccacctgtgatctacagccccctgatgcccaagggggccacctgctttgagtgcaacatcaccttcaacaacctggacaactacctggtgcacaagaagcactactgcagcagccgctggcagcagatggccaagagccctgagttccccagcgtgtctgagaagatgcctgaggccctgagccccaacacaggccagaccagcatcaacctgctgaacccagctgcccacagcgctgaccctgagaaccccctgctgcagaccagctgcatcaacagcagcacagtgctggacctgattggccccaacgggaagggccatgacaaggacttcagcacccagaccaagaagctgagcaccagcagcaacaatgatgacaagatcaacgggaagcctgtggatgtgaagaaccccagcgtgcccctggtggatggagagagtgaccccaacaagaccacctgtgaggcctgcaacatcaccttcagcagacatgagacctacatggtgcacaagcagtactactgtgccaccaggcatgacccccccctgaagaggtctgccagcaacaaggtgcctgccatgcagaggaccatgaggaccaggaagaggaggaagatgtatgagatgtgcctgcctgagcaggagcagaggcctcccctggtgcagcagcgcttcctggatgtggccaacctgaacaacccctgcaccagcacccaggagcccacagagggcctgggggagtgctaccacccccgctgtgacatcttccctggcatcgtgtccaagcacctggagaccagcctgaccatcaacaagtgtgtgcctgtgtccaaatgtgacaccacccacagctctgtgtcctgcctggagatggatgtgcccatcgacctgagcaagaagtgcctgagccagagcgagaggaccaccaccagccccaagaggctgctggactaccatgaatgtactgtgtgcaagatctccttcaacaaggtggagaactacctggcccacaagcagaacttctgccctgtgacagcccaccagagaaatgacctgggccagctggatggcaaggtgttccccaaccctgagagcgagaggaacagcccagatgtgtcctatgaaagaagcatcatcaagtgtgagaagaatggaaacctgaagcagcccagccccaacggcaacctcttcagcagccacctggccaccctgcagggcctgaaggtgttcagcgaggccgcccagctgattgccaccaaggaggagaacagacacctgttcctgccccagtgcctgtacccaggggccatcaagaaggccaagggagctgaccagctgagcccctactacggcatcaagcccagcgactacatcagcggcagcctggtgatccacaacacagacatcgagcagagcagaaatgcagaaaatgaaagccccaagggccaggccagcagcaatggctgtgccgccctgaagaaggacagcctgcccctgctgcccaagaacagaggcatggtgattgtgaatggaggcctgaagcaggatgagaggcctgctgccaacccccagcaggagaacatcagccagaacccccagcatgaagatgaccacaagagccccagctggatcagcgagaaccccctggccgccaatgaaaatgtgtccccaggcatccccagcgctgaggagcagctgagcagcatcgccaagggcgtgaatggcagcagccaggcccccaccagcggcaagtactgccgcctgtgtgacatccagttcaacaacctgagcaacttcatcacccacaagaagttctactgcagcagccacgccgctgagcacgtgaagtag

SEQ ID NO: 177053 - DNA, 3060 bp, Artificial Sequence; identical to SEQ ID NO: 177052
  Description of Artificial Sequence: Synthetic coding sequence

SEQ ID NO: 177054 - DNA, 2418 bp, Artificial Sequence
  Description of Artificial Sequence: Synthetic coding sequence
atggatgaagatggcctggagctgcagcaggagcccaacagcttctttgatgccactggagcagatggcacccacatggatggagaccagatcgtggtggaggtgcaggagaccgtgtttgtgtctgatgtggtggacagcgacatcaccgtgcacaactttgtgcctgatgatcctgattctgtggtgatccaggatgtgattgaagatgtggtgattgaagatgtgcagtgcccagacatcatggaggaggctgatgtgtctgagaccgtcatcatccctgagcaggtgctggacagtgatgtgacagaggaggtgtccctggcccactgcaccgtgcctgatgatgtgctggccagtgacatcaccagcgcctccatgtccatgcctgagcacgtgctgactggagacagcatccacgtgtctgatgtgggccacgtgggccacgtgggccacgtggagcacgtggtgcatgacagcgtggtggaggccgagatcgtgacagaccccctgaccacagatgtggtgtctgaggaggtgctggtggccgactgtgccagcgaggccgtgattgatgccaacggcatccctgtggaccagcaggatgatgacaagggcaactgtgaggactacctgatgatcagcctggatgatgctgggaagattgaacatgatggcagcagcggcatgaccatggacacagagagcgagattgacccctgcaaggtggatggcacctgcccagaggtgatcaaggtgtacatcttcaaggctgaccccggggaggatgacctgggcggcaccgtggacatcgtggagagcgagccagaaaatgaccacggcgtggagctgctggaccagaacagcagcatccgggtgccccgggagaagatggtgtacatgacagtgaatgacagccagccagaagatgaggacctgaatgtggccgagattgctgatgaggtgtacatggaggtgattgtgggggaggaggatgctgctgctgctgctgctgctgctgctgtgcatgagcagcagatggatgacaatgagatcaagaccttcatgcccatcgcctgggccgccgcctacggcaacaacagtgatggcatcgagaacagaaatggaacagccagcgccctgctgcacattgatgaatctgctggcctgggccgcctggccaagcagaagcccaagaagagaagaagaccagacagccggcagtaccagacagccatcatcattggaccagatggccaccccctgactgtgtacccctgcatgatctgtgggaagaagttcaagagccggggcttcctgaagaggcacatgaagaaccaccctgagcacctggccaagaagaagtaccgctgcacagactgtgactacaccaccaacaagaagatcagcctgcacaaccacctggagagccacaagctgaccagcaaggccgagaaggccattgaatgtgatgaatgtgggaagcacttcagccacgccggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaagaagcacatgaggatccacactggagagaagccctaccagtgccagtactgtgagtacagatctgctgacagcagcaacctgaagacccacgtgaagaccaagcacagcaaggagatgcccttcaagtgtgacatctgcctgctgaccttcagtgacaccaaggaggtgcagcagcacgccctgatccaccaggagagcaagacccaccagtgcctgcactgtgaccacaagagcagcaacagcagtgacctgaagaggcacatcatctctgtgcacaccaaggactacccccacaagtgtgacatgtgtgacaagggcttccaccggcccagcgagctgaagaagcacgtggccgcccacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagagcgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttccggcggcccagcgagaagaaccagcacatcatgaggcaccacaaggaggtgggcctgccctag

SEQ ID NO: 177055 - DNA, 2268 bp, Artificial Sequence
  Description of Artificial Sequence: Synthetic coding sequence
atggatgaagatggcctggagctgcagcaggagcccaacagcttctttgatgccactggagcagatggcacccacatggatggagaccagatcgtggtggaggtgcaggagaccgtgtttgtgtctgatgtggtggacagcgacatcaccgtgcacaactttgtgcctgatgatcctgattctgtggtgatccaggatgtgattgaagatgtggtgattgaagatgtgcagtgcccagacatcatggaggaggctgatgtgtctgagaccgtcatcatccctgagcaggtgctggacagtgatgtgacagaggaggtgtccctggcccactgcaccgtgcctgatgatgtgctggccagtgacatcaccagcgcctccatgtccatgcctgagcacgtgctgactggagacagcatccacgtgtctgatgtgggccacgtgggccacgtgggccacgtggagcacgtggtgcatgacagcgtggtggaggccgagatcgtgacagaccccctgaccacagatgtggtgtctgaggaggtgctggtggccgactgtgccagcgaggccgtgattgatgccaacggcatccctgtggaccagcaggatgatgacaagggcaactgtgaggactacctgatgatcagctgtggcaccgtggacatcgtggagagcgagccagaaaatgaccacggcgtggagctgctggaccagaacagcagcatccgggtgccccgggagaagatggtgtacatgacagtgaatgacagccagccagaagatgaggacctgaatgtggccgagattgctgatgaggtgtacatggaggtgattgtgggggaggaggatgctgctgctgctgctgctgctgctgctgtgcatgagcagcagatggatgacaatgagatcaagaccttcatgcccatcgcctgggccgccgcctacggcaacaacagtgatggcatcgagaacagaaatggaacagccagcgccctgctgcacattgatgaatctgctggcctgggccgcctggccaagcagaagcccaagaagagaagaagaccagacagccggcagtaccagacagccatcatcattggaccagatggccaccccctgactgtgtacccctgcatgatctgtgggaagaagttcaagagccggggcttcctgaagaggcacatgaagaaccaccctgagcacctggccaagaagaagtaccgctgcacagactgtgactacaccaccaacaagaagatcagcctgcacaaccacctggagagccacaagctgaccagcaaggccgagaaggccattgaatgtgatgaatgtgggaagcacttcagccacgccggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaagaagcacatgaggatccacactggagagaagccctaccagtgccagtactgtgagtacagatctgctgacagcagcaacctgaagacccacgtgaagaccaagcacagcaaggagatgcccttcaagtgtgacatctgcctgctgaccttcagtgacaccaaggaggtgcagcagcacgccctgatccaccaggagagcaagacccaccagtgcctgcactgtgaccacaagagcagcaacagcagtgacctgaagaggcacatcatctctgtgcacaccaaggactacccccacaagtgtgacatgtgtgacaagggcttccaccggcccagcgagctgaagaagcacgtggccgcccacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagagcgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttccggcggcccagcgagaagaaccagcacatcatgaggcaccacaaggaggtgggcctgccctag

SEQ ID NO: 177056 - DNA, 2418 bp, Artificial Sequence; identical to SEQ ID NO: 177054
  Description of Artificial Sequence: Synthetic coding sequence

SEQ ID NO: 177057 - DNA, 2418 bp, Artificial Sequence; identical to SEQ ID NO: 177054
  Description of Artificial Sequence: Synthetic coding sequence

SEQ ID NO: 177058 - DNA, 99 bp, Artificial Sequence
  Description of Artificial Sequence: Synthetic coding sequence
atggatgaagatggcctggagctgcagcaggagcccaacagcttctttgatgccactggagcagatggcacccacatggatggagaccagatcgtgtag

SEQ ID NO: 177059 - DNA, 408 bp, Artificial Sequence
  Description of Artificial Sequence: Synthetic coding sequence
atggatgaagatggcctggagctgcagcaggagcccaacagcttctttgatgccactggagcagatggcacccacatggatggagaccagatcgtggtggaggtgcaggagaccgtgtttgtgtctgatgtggtggacagcgacatcaccgtgcacaactttgtgcctgatgatcctgattctgtggtgatccaggatgtgattgaagatgtggtgattgaagatgtgcagtgcccagacatcatggaggaggctgatgtgtctgagaccgtcatcatccctgagcaggtgctggacagtgatgtgacagaggaggtgtccctggcccactgcaccgtgcctgatgatgtgctggccagtgacatcaccagcgcctccatgtccatgcctgagcacgtgctgacctag

SEQ ID NO: 177060 - DNA, 1584 bp, Artificial Sequence
  Description of Artificial Sequence: Synthetic coding sequence
atggacacagaaagtgaaattgacccctgcaaggtggatggcacctgcccagaggtgatcaaggtgtacatcttcaaggctgaccctggagaagatgacctgggcggcaccgtggacatcgtggagagcgagccagaaaatgaccatggagtggagctgctggaccagaacagcagcatccgggtgccccgggagaagatggtgtacatgacagtgaatgacagccagccagaagatgaggacctgaatgtggccgagattgctgatgaggtgtacatggaggtgattgtgggggaggaggatgctgctgctgctgctgctgctgctgctgtgcatgagcagcagatggatgacaatgagatcaagaccttcatgcccatcgcctgggccgccgcctatgccatcatcattggaccagatggccaccccctgactgtgtacccctgcatgatctgtgggaagaagttcaagagccggggcttcctgaagaggcacatgaagaaccaccctgagcacctggccaagaagaagtaccgctgcacagactgtgactacaccaccaacaagaagatcagcctgcacaaccacctggagagccacaagctgaccagcaaggccgagaaggccattgaatgtgatgaatgtgggaagcacttcagccacgccggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaagaagcacatgaggatccacactggagagaagccctaccagtgccagtactgtgagtacagatctgctgacagcagcaacctgaagacccacgtgaagaccaagcacagcaaggagatgcccttcaagtgtgacatctgcctgctgaccttcagtgacaccaaggaggtgcagcagcacgccctgatccaccaggagagcaagacccaccagtgcctgcactgtgaccacaagagcagcaacagcagtgacctgaagaggcacatcatctctgtgcacaccaaggactacccccacaagtgtgacatgtgtgacaagggcttccaccggcccagcgagctgaagaagcacgtggccgcccacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagagcgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttccggcggcccagcgagaagaaccagcacatcatgaggcaccacaaggaggtgggcctgccctag

SEQ ID NO: 177061 - DNA, 789 bp, Artificial Sequence
  Description of Artificial Sequence: Synthetic coding sequence
atggatgaagatggcctggagctgcagcaggagcccaacagcttctttgatgccactggagcagatggcacccacatggatggagaccagatcgtggtggaggtgcaggagaccgtgtttgtgtctgatgtggtggacagcgacatcaccgtgcacaactttgtgcctgatgatcctgattctgtggtgatccaggatgtgattgaagatgtggtgattgaagatgtgcagtgcccagacatcatggaggaggctgatgtgtctgagaccgtcatcatccctgagcaggtgctggacagtgatgtgacagaggaggtgtccctggcccactgcaccgtgcctgatgatgtgctggccagtgacatcaccagcgcctccatgtccatgcctgagcacgtgctgactggagacagcatccacgtgtctgatgtgggccacgtgggccacgtgggccacgtggagcacgtggtgcatgacagcgtggtggaggccgagatcgtgacagaccccctgaccacagatgtggtgtctgaggaggtgctggtggccgactgtgccagcgaggccgtgattgatgccaacggcatccctgtggaccagcaggatgatgacaagggcaactgtgaggactacctgatgatcagctgcaacaacagtgatggcattgaaaatagaaatggaacagccagcgccctgctgcacattgatgagagcgctggcctgggccgcctggccaagcagaagcccaagaagagaagaagaccagacagccggcagtaccagacctag

SEQ ID NO: 177062 - DNA, 1731 bp, Artificial Sequence
  Description of Artificial Sequence: Synthetic coding sequence
atgaccatggacacagaaagtgaaattgacccctgcaaggtggatggcacctgcccagaggtgatcaaggtgtacatcttcaaggctgaccctggagaagatgacctgggcggcaccgtggacatcgtggagagcgagccagaaaatgaccatggagtggagctgctggaccagaacagcagcatccgggtgccccgggagaagatggtgtacatgacagtgaatgacagccagccagaagatgaggacctgaatgtggccgagattgctgatgaggtgtacatggaggtgattgtgggggaggaggatgctgctgctgctgctgctgctgctgctgtgcatgagcagcagatggatgacaatgagatcaagaccttcatgcccatcgcctgggccgccgcctacggcaacaacagtgatggcattgaaaatagaaatggaacagccagcgccctgctgcacattgatgagagcgctggcctgggccgcctggccaagcagaagcccaagaagagaagaagaccagacagccggcagtaccagacagccatcatcatcggcccagatggccaccccctgactgtgtacccctgcatgatctgtgggaagaagttcaagagccggggcttcctgaagaggcacatgaagaaccaccctgagcacctggccaagaagaagtaccgctgcacagactgtgactacaccaccaacaagaagatcagcctgcacaaccacctggagagccacaagctgaccagcaaggccgagaaggccattgaatgtgatgaatgtgggaagcacttcagccatgctggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaagaagcacatgaggatccacactggagagaagccctaccagtgccagtactgtgagtacagatctgctgacagcagcaacctgaagacccacgtgaagaccaagcacagcaaggagatgcccttcaagtgtgacatctgcctgctgaccttcagtgacaccaaggaggtgcagcagcacgccctgatccaccaggagagcaagacccaccagtgcctgcactgtgaccacaagagcagcaacagcagtgacctgaagaggcacatcatctctgtgcacaccaaggactacccccacaagtgtgacatgtgtgacaagggcttccaccggcccagcgagctgaagaagcacgtggccgcccacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagagcgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttcagaagacccagcgagaagaaccagcacatcatgaggcaccacaaggaggtgggcctgccctag

SEQ ID NO: 177063 - DNA, 2535 bp, Artificial Sequence
  Description of Artificial Sequence: Synthetic coding sequence
atggatgaagatggcctggagctgcagcaggagcccaacagcttctttgatgccacagacagagtgtccttctgccaccctggctggagcacagtggcccccagcggcagcacagccaccagcgccagccaggcccaggtgatctgcagcgccagccgggtgactggagccaccggggctgatggcacccacatggatggagaccagatcgtggtggaggtgcaggagaccgtgtttgtgtctgatgtggtggacagcgacatcaccgtgcacaactttgtgcctgatgatcctgacagcgtggtgatccaggatgtgattgaagatgtggtgattgaagatgtgcagtgcccagacatcatggaggaggctgatgtgtctgaaacagtcatcatccctgagcaggtgctggacagtgatgtgacagaggaggtgtccctggcccactgcaccgtgcctgatgatgtgctggccagtgacatcaccagcgcctccatgtccatgcctgagcacgtgctgaccggggacagcatccacgtgtctgatgtgggccacgtgggccacgtgggccacgtggagcacgtggtgcatgattctgtggtggaggccgagatcgtgacagaccccctgaccacagatgtggtgtctgaggaggtgctggtggccgactgtgccagcgaggccgtgattgatgccaacggcatccctgtggaccagcaggatgatgacaagggcaactgtgaggactacctgatgatcagcctggatgatgctgggaagattgaacatgatggcagcagcggcatgaccatggacacagaaagtgaaattgacccctgcaaggtggatggcacctgcccagaggtgatcaaggtgtacatcttcaaggctgaccctggagaagatgacctgggcggcaccgtggacatcgtggagagcgagccagaaaatgaccatggagtggagctgctggaccagaacagcagcatccgggtgccccgggagaagatggtgtacatgacagtgaatgacagccagccagaagatgaggacctgaatgtggccgagattgctgatgaggtgtacatggaggtgattgtgggggaggaggatgctgctgctgctgctgctgctgctgctgtgcatgagcagcagatggatgacaatgagatcaagaccttcatgcccatcgcctgggccgccgcctacggcaacaacagtgatggcattgaaaatagaaatggaacagccagcgccctgctgcacattgatgagagcgctggcctgggccgcctggccaagcagaagcccaagaagagaagaagaccagacagccggcagtaccagacagccatcatcatcggcccagatggccaccccctgactgtgtacccctgcatgatctgtgggaagaagttcaagagccggggcttcctgaagaggcacatgaagaaccaccctgagcacctggccaagaagaagtaccgctgcacagactgtgactacaccaccaacaagaagatcagcctgcacaaccacctggagagccacaagctgaccagcaaggccgagaaggccattgaatgtgatgaatgtgggaagcacttcagccatgctggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaagaagcacatgaggatccacactggagagaagccctaccagtgccagtactgtgagtacagatctgctgacagcagcaacctgaagacccacgtgaagaccaagcacagcaaggagatgcccttcaagtgtgacatctgcctgctgaccttcagtgacaccaaggaggtgcagcagcacgccctgatccaccaggagagcaagacccaccagtgcctgcactgtgaccacaagagcagcaacagcagtgacctgaagaggcacatcatctctgtgcacaccaaggactacccccacaagtgtgacatgtgtgacaagggcttccaccggcccagcgagctgaagaagcacgtggccgcccacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagagcgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttcagaagacccagcgagaagaaccagcacatcatgaggcaccacaaggaggtgggcctgccctag

SEQ ID NO: 177064 - DNA, 522 bp, Artificial Sequence
  Description of Artificial Sequence: Synthetic coding sequence
gggggctgcagccagtacctgctgctgtttgtggatgatgctgggaagattgaacatgatggcagcagcggcatgaccatggacacagaaagtgaaattgacccctgcaaggtggatggcacctgcccagaggtgatcaaggtgtacatcttcaaggctgaccctggagaagatgacctgggcggcaccgtggacatcgtggagagcgagccagaaaatgaccatggagtggagctgctggaccagaacagcagcatccgggtgccccgggagaagatggtgtacatgacagtgaatgacagccagccagaagatgaggacctgaatgtggccgagattgctgatgaggtgtacatggaggtgattgtgggggaggaggatgctgctgctgctgctgctgctgctgctgtgcatgagcagcagatggatgacaatgagatcaagaccttcatgcccatcgcctgggccgccgcctacggcaacaacagtgatggcattgaaaatagaaatggaacagcctag

SEQ ID NO: 177065 - DNA, 2406 bp, Artificial Sequence
  Description of Artificial Sequence: Synthetic coding sequence
atggatgaagatgaatttgagctgcagccccaggagcccaacagcttctttgatggcatcggggctgatgccacccacatggatggagaccagatcgtggtggagatccaggaggccgtgtttgtgagcaacatcgtggacagcgacatcaccgtgcacaactttgtgcctgatgatcctgacagcgtggtgatccaggatgtggtggaggatgtggtgattgaggaggatgtgcagtgcagcgacatcctggaggaggctgatgtgtctgaaaatgtcatcatccctgagcaggtgctggacagtgatgtgacagaggaggtgtccctgccccactgcaccgtgcctgatgatgtgctggccagtgacatcaccagcacctccatgtccatgcctgagcacgtgctgaccagcgagagcatgcacgtgtgtgacatcggccacgtggagcacatggtgcatgacagcgtggtggaggccgagatcatcacagaccccctgaccagtgacatcgtgtctgaggaggtgctggtggccgactgtgcccctgaggccgtgattgatgccagcggcatctctgtggaccagcaggacaatgacaaggccagctgtgaggactacctgatgatcagcctggatgatgctgggaagattgaacatgatggcagcactggagtgaccattgatgctgagagcgagatggacccctgcaaggtggacagcacctgcccagaggtgatcaaggtgtacatcttcaaggctgaccccggggaggatgacctgggcggcaccgtggacatcgtggagagcgagccagaaaatgaccacggcgtggagctgctggaccagaacagcagcatccgggtgccccgggagaagatggtgtacatgacagtgaatgacagccagcaggaggatgaggacctgaatgtggccgagattgctgatgaggtgtacatggaggtgattgtgggggaggaggatgctgctgtggccgctgctgctgctgctgtgcatgagcagcagattgatgaagatgagatgaagacctttgtgcccatcgcctgggccgccgcctacggcaacaacagtgatggcatcgagaacagaaatggaacagccagcgccctgctgcacattgatgaatctgctggcctgggccgcctggccaagcagaagcccaagaagaagaggaggccagacagccggcagtaccagacagccatcatcattggaccagatggccaccccctgactgtgtacccctgcatgatctgtgggaagaagttcaagagccggggcttcctgaagaggcacatgaagaaccaccctgagcacctggccaagaagaagtaccactgcacagactgtgactacaccaccaacaagaagatcagcctgcacaaccacctggagagccacaagctgaccagcaaggccgagaaggccattgaatgtgatgaatgtgggaagcacttcagccacgccggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaggaagcacatgaggatccacactggagagaagccctaccagtgccagtactgtgagtacagatctgctgacagcagcaacctgaagacccacatcaagaccaagcacagcaaggagatgcccttcaagtgtgacatctgcctgctgaccttcagtgacaccaaggaggtgcagcagcacaccctggtgcaccaggagagcaagacccaccagtgcctgcactgtgaccacaagagcagcaacagcagtgacctgaagagacatgtgatctctgtgcacaccaaggactacccccacaagtgtgagatgtgtgagaagggcttccaccggcccagcgagctgaagaagcacgtggccgtgcacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagaatgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttccggcggcccagcgagaagaaccagcacatcatgaggcaccacaaggaggtgggcctgccctag

SEQ ID NO: 177066 - DNA, 2406 bp, Artificial Sequence; identical to SEQ ID NO: 177065
  Description of Artificial Sequence: Synthetic coding sequence

SEQ ID NO: 177067 - DNA, 1833 bp, Artificial Sequence
  Description of Artificial Sequence: Synthetic coding sequence
atggatgaagatgaatttgagctgcagccccaggagcccaacagcttctttgatggcatcgtggatgatgctgggaagattgaacatgatggcagcactggagtgaccattgatgctgagagcgagatggacccctgcaaggtggacagcacctgcccagaggtgatcaaggtgtacatcttcaaggctgaccctggagaagatgacctgggcggcaccgtggacatcgtggagagcgagccagaaaatgaccatggagtggagctgctggaccagaacagcagcatccgggtgccccgggagaagatggtgtacatgacagtgaatgacagccagcaggaggatgaggacctgaatgtggccgagattgctgatgaggtgtacatggaggtgattgtgggggaggaggatgctgctgtggccgctgctgctgctgctgtgcatgagcagcagattgatgaagatgagatgaagacctttgtgcccatcgcctgggccgccgcctacggcaacaacagtgatggcattgaaaatagaaatggaacagccagcgccctgctgcacattgatgagagcgctggcctgggccgcctggccaagcagaagcccaagaagaagagaagaccagacagccggcagtaccagacagccatcatcatcggcccagatggccaccccctgactgtgtacccctgcatgatctgtgggaagaagttcaagagccggggcttcctgaagaggcacatgaagaaccaccctgagcacctggccaagaagaagtaccactgcacagactgtgactacaccaccaacaagaagatcagcctgcacaaccacctggagagccacaagctgaccagcaaggccgagaaggccattgaatgtgatgaatgtgggaagcacttcagccatgctggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaggaagcacatgaggatccacactggagagaagccctaccagtgccagtactgtgagtacagatctgctgacagcagcaacctgaagacccacatcaagaccaagcacagcaaggagatgcccttcaagtgtgacatctgcctgctgaccttcagtgacaccaaggaggtgcagcagcacaccctggtgcaccaggagagcaagacccaccagtgcctgcactgtgaccacaagagcagcaacagcagtgacctgaagagacatgtgatctctgtgcacaccaaggactacccccacaagtgtgagatgtgtgagaagggcttccaccggcccagcgagctgaagaagcacgtggccgtgcacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagaatgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttcagaagacccagcgagaagaaccagcacatcatgaggcaccacaaggaggtgggcctgccctag

SEQ ID NO: 177068 - DNA, 276 bp, Artificial Sequence
  Description of Artificial Sequence: Synthetic coding sequence
atggatgaagatgaatttgagctgcagccccaggagcccaacagcttctttgatggcatcggggctgatgccacccacatggatggagaccagatcgtggtggagatccaggaggccgtgtttgtgagcaacatcgtggacagcgacatcaccgtgcacaactttgtgcctgatgatcctgacagcgtggtgatccaggatgtggtggaggatgtggtgattgaggaggatgtgcagtgcagcgacatcctggaggaggctgatgtgtctgagtag

SEQ ID NO: 177069 - DNA, 2175 bp, Artificial Sequence
  Description of Artificial Sequence: Synthetic coding sequence
atggatggagaccagatcgtggtggagatccaggaggccgtgtttgtgagcaacatcgtggacagcgacatcaccgtgcacaactttgtgcctgatgatcctgacagcgtggtgatccaggatgtggtggaggatgtggtgattgaggaggatgtgcagtgcagcgacatcctggaggaggctgatgtgtctgaaaatgtcatcatccctgagcaggtgctggacagtgatgtgacagaggaggtgtccctgccccactgcaccgtgcctgatgatgtgctggccagtgacatcaccagcacctccatgtccatgcctgagcacgtgctgaccagcgagagcatgcacgtgtgtgacatcggccacgtggagcacatggtgcatgacagcgtggtggaggccgagatcatcacagaccccctgaccagtgacatcgtgtctgaggaggtgctggtggccgactgtgcccctgaggccgtgattgatgccagcggcatctctgtggaccagcaggacaatgacaaggccagctgtgaggactacctgatgatcagcctggatgatgctgggaagattgaacatgatggcagcactggagtgaccattgatgctgagagcgagatggacccctgcaaggtggacagcacctgcccagaggtgatcaaggtgtacatcttcaaggctgaccccggggaggatgacctgggcggcaccgtggacatcgtggagagcgagccagaaaatgaccacggcgtggagctgctggaccagaacagcagcatccgggtgccccgggagaagatggtgtacatgacagtgaatgacagccagcaggaggatgaggacctgagcaacaacagtgatggcattgaaaatagaaatggaacagccagcgccctgctgcacattgatgagagcgctggcctgggccgcctggccaagcagaagcccaagaagaagagaagaccagacagccggcagtaccagacagccatcatcatcggcccagatggccaccccctgactgtgtacccctgcatgatctgtgggaagaagttcaagagccggggcttcctgaagaggcacatgaagaaccaccctgagcacctggccaagaagaagtaccactgcacagactgtgactacaccaccaacaagaagatcagcctgcacaaccacctggagagccacaagctgaccagcaaggccgagaaggccattgaatgtgatgaatgtgggaagcacttcagccatgctggggccctcttcacccacaagatggtgcacaaggagaagggggccaacaagatgcacaagtgcaagttctgtgaatatgaaacagctgagcagggcctgctgaacagacacctgctggccgtgcacagcaagaacttcccccacatctgtgtggagtgtgggaagggcttccgccaccccagcgagctgaggaagcacatgaggatccacactggagagaagccctaccagtgccagtactgtgagtacagatctgctgacagcagcaacctgaagacccacatcaagaccaagcacagcaaggagatgcccttcaagtgtgacatctgcctgctgaccttcagtgacaccaaggaggtgcagcagcacaccctggtgcaccaggagagcaagacccaccagtgcctgcactgtgaccacaagagcagcaacagcagtgacctgaagagacatgtgatctctgtgcacaccaaggactacccccacaagtgtgagatgtgtgagaagggcttccaccggcccagcgagctgaagaagcacgtggccgtgcacaagggcaagaagatgcaccagtgccgccactgtgacttcaagattgctgacccctttgtgctgagccgccacatcctgtctgtgcacaccaaggacctgcccttccgctgcaagcgctgcaggaagggcttccggcagcagaatgagctgaagaagcacatgaagacccacagcggcaggaaggtgtaccagtgtgagtactgtgagtacagcaccacagatgccagcggcttcaagagacatgtgatcagcatccacaccaaggactacccccaccgctgtgagtactgcaagaagggcttcagaagacccagcgagaagaaccagcacatcatgaggcaccacaaggaggtgggcctgccctag

SEQ ID NO: 177070 - DNA, 1617 bp, Artificial Sequence
  Description of Artificial Sequence: Synthetic coding sequence
atggcccgggagctgtctgagagcacagccctggatgcccagagcacagaggaccagatggagctgctggtgatcaaggtggaggaggaggaggccggcttccccagcagcccagacctgggcagcgagggcagccgggagcgcttccggggcttccgctacccagaggccgccggcccccgggaggccctgagccggctgcgggagctgtgccggcagtggctgcagcctgagatgcacagcaaggagcagatcctggagctgctggtgctggagcagttcctgaccatcctgcccggcaacctgcagagctgggtgcgggagcagcaccctgagagcggggaggaggtggtggtgctgctggagtacctggagcggcagctggatgagcccgccccccaggtgtctggagtggaccagggccaggagctgctgtgctgcaagatggccctgctgaccccagcccctggcagccagagcagccagttccagctgatgaaggccctgctgaagcatgagagcgtgggcagccagcccctgcaggacagagtgctgcaggtgcctgtgctggcccacggcggctgctgccgggaggacaaggtggtggccagccggctgaccccagagagccagggcctgctgaaggtggaggatgtggccctgaccctgaccccagagtggacccagcaggacagcagccagggcaacctgtgcagagatgagaagcaggagaaccacggcagcctggtgtccctgggagatgagaagcagaccaagagccgggacctgcccccagctgaggagctgcctgagaaggagcacggcaagatcagctgccacctgagagaagatattgcccagatccccacctgtgccgaggccggggagcaggagggccgcctgcagaggaagcagaagaatgccactggaggccgccgccacatctgccatgaatgtgggaagagctttgcccagagcagcggcctgagcaagcaccggcgcatccacactggagagaagccctatgaatgtgaggagtgtgggaaggccttcatcggcagcagcgccctggtgatccaccagagggtgcacactggagagaagccctatgaatgtgaggagtgtgggaaggccttcagccacagcagtgacctgatcaagcaccagaggacccacactggagagaagccctatgaatgtgatgactgtgggaagaccttcagccagagctgcagcctgctggagcaccaccgcatccacactggagagaagccctaccagtgcagcatgtgtgggaaggccttccgccgcagcagccacctgctgcggcaccagaggatccacactggagacaagaatgtgcaggagcctgagcagggcgaggcctggaagagcaggatggagagccagctggagaatgtggagacccccatgagctacaagtgcaatgaatgtgagaggagcttcacccagaacacaggcctcatcgagcaccagaagatccacactggagagaagccctaccagtgcaatgcctgtgggaagggcttcacccgcatctcctacctggtgcagcaccagaggagccacgtgggcaagaacatcctgagccagtag

SEQ ID NO: 177071 - DNA, 1173 bp, Artificial Sequence
  Description of Artificial Sequence: Synthetic coding sequence
atggccctgctgaccccagcccctggcagccagagcagccagttccagctgatgaaggccctgctgaagcatgagagcgtgggcagccagcccctgcaggacagagtgctgcaggtgcctgtgctggcccacggcggctgctgccgggaggacaaggtggtggccagccggctgaccccagagagccagggcctgctgaaggtggaggatgtggccctgaccctgaccccagagtggacccagcaggacagcagccagggcaacctgtgcagagatgagaagcaggagaaccacggcagcctggtgtccctgggagatgagaagcagaccaagagccgggacctgcccccagctgaggagctgcctgagaaggagcacggcaagatcagctgccacctgagagaagatattgcccagatccccacctgtgccgaggccggggagcaggagggccgcctgcagaggaagcagaagaatgccactggaggccgccgccacatctgccatgaatgtgggaagagctttgcccagagcagcggcctgagcaagcaccggcgcatccacactggagagaagccctatgaatgtgaggagtgtgggaaggccttcatcggcagcagcgccctggtgatccaccagagggtgcacactggagagaagccctatgaatgtgaggagtgtgggaaggccttcagccacagcagtgacctgatcaagcaccagaggacccacactggagagaagccctatgaatgtgatgactgtgggaagaccttcagccagagctgcagcctgctggagcaccaccgcatccacactggagagaagccctaccagtgcagcatgtgtgggaaggccttccgccgcagcagccacctgctgcggcaccagaggatccacactggagacaagaatgtgcaggagcctgagcagggcgaggcctggaagagcaggatggagagccagctggagaatgtggagacccccatgagctacaagtgcaatgaatgtgagaggagcttcacccagaacacaggcctcatcgagcaccagaagatccacactggagagaagccctaccagtgcaatgcctgtgggaagggcttcacccgcatctcctacctggtgcagcaccagaggagccacgtgggcaagaacatcctgagccagtag

SEQ ID NO: 177072 - DNA, 1617 bp, Artificial Sequence; identical to SEQ ID NO: 177070
  Description of Artificial Sequence: Synthetic coding sequence

SEQ ID NO: 177073 - DNA, 537 bp, Artificial Sequence
  Description of Artificial Sequence: Synthetic coding sequence
atggcccgggagctgtctgagagcacagccctggatgcccagagcacagaggaccagatggagctgctggtgatcaaggtggaggaggaggaggccggcttccccagcagcccagacctgggcagcgagggcagccgggagcgcttccggggcttccgctacccagaggccgccggcccccgggaggccctgagccggctgcgggagctgtgccggcagtggctgcagcctgagatgcacagcaaggagcagatcctggagctgctggtgctggagcagttcctgaccatcctgcccggcaacctgcagagctgggtgcgggagcagcaccctgagagcggggaggaggtggtggtgctgctggagtacctggagcggcagctggatgagcccgccccccaggtggagaggacaggcctggtgtctgagcgctgtggcctcttccccccagagatcccagaccagagcgagggccacagcttcaacatccaggagttcttcatctccttcctgtaccgggagcccccctggcagtag

SEQ ID NO: 177074 - DNA, 993 bp, Artificial Sequence
  Description of Artificial Sequence: Synthetic coding sequence
cggcagcgcttccggggcttccgctacccagaggccgccggcccccgggaggccctgagccggctgcgggagctgtgtggccagtggctgcagcctgagatgcacagcaaggagcagatcctggagctgctggtgctggagcagttcctgaccatcctgcccggcaacctgcagagctgggtgcgggagcagcaccctgagagcggggaggaggtggtggtgctgctggagtacctggagcggcagctggatgagcccgccccccaggtggagaggacaggcctggtgtctgagcgctgtgcccggggcatccccctgcggagccgcagcagcagcagcctgtttgtgctggccttcctgccctggcagggcatcacccacagctgccggccctttgtggtgtctggaggagagatccagaccaagagccgggacctgccccctgtgaagaagctgcctgagaaggagcacggcaagatctgccacctgagagaagatattgcccagatccccacccacgccgaggccggggagcaggagggccgcctgcagaggaagcagaagaatgccatcggcagccgccgccactactgccatgaatgtgggaagagctttgcccagagcagcggcctgaccaagcaccggcgcatccacactggagagaagccctatgaatgtgaggactgtgggaagaccttcatcggcagcagcgccctggtgatccaccagagggtgcacactggagagaagccctatgaatgtgaggagtgtgggaaggtgttcagccacagcagcaacctgatcaagcaccagaggacccacactggagagaagccctatgaatgtgatgactgtgggaagaccttcagccagagctgcagcctgctggagcaccacaagatccacactggagagaagccctaccagtgcaacatgtgtgggaaggccttcagaagaaacagccacctgctgcggcaccagaggatccactag

SEQ ID NO: 177075 - DNA, 1638 bp, Artificial Sequence
  Description of Artificial Sequence: Synthetic coding sequence
atggcccgggagcccaggaagaatgctgccctggatgcccagagcgctgaggaccagacaggcctgctgactgtgaaggtggagaaggaggaggccagcgccctgacagctgaggtgcgggccccctgcagccctgcccggggccctgagaggagccggcagcgcttccggggcttccgctacccagaggccgccggcccccgggaggccctgagccggctgcgggagctgtgtggccagtggctgcagcctgagatgcacagcaaggagcagatcctggagctgctggtgctggagcagttcctgaccatcctgcccggcaacctgcagagctgggtgcgggagcagcaccctgagagcggggaggaggtggtggtgctgctggagtacctggagcggcagctggatgagcccgccccccaggtgcctgtgggggaccagggccaggagctgctgtgctgcaagatggccctgctgacccagacccagggcagccagagcagccagtgccagcccatgaaggccctcttcaagcatgagagcctgggcagccagcccctgcatgacagagtgctgcaggtgcccggcctggcccagggcggctgctgcagagaagatgccatggtggccagccggctgaccccaggcagccagggcctgctgaagatggaggatgtggccctgaccctgaccccaggctggacccagctggacagcagccaggtgaacctgtacagagatgagaagcaggagaaccacagcagcctggtgtccctgggcggggagatccagaccaagagccgggacctgccccctgtgaagaagctgcctgagaaggagcacggcaagatctgccacctgagagaagatattgcccagatccccacccacgccgaggccggggagcaggagggccgcctgcagaggaagcagaagaatgccatcggcagccgccgccactactgccatgaatgtgggaagagctttgcccagagcagcggcctgaccaagcaccggcgcatccacactggagagaagccctatgaatgtgaggactgtgggaagaccttcatcggcagcagcgccctggtgatccaccagagggtgcacactggagagaagccctatgaatgtgaggagtgtgggaaggtgttcagccacagcagcaacctgatcaagcaccagaggacccacactggagagaagccctatgaatgtgatgactgtgggaagaccttcagccagagctgcagcctgctggagcaccacaagatccacactggagagaagccctaccagtgcaacatgtgtgggaaggccttcagaagaaacagccacctgctgcggcaccagaggatccacggggacaagaatgtgcagaaccctgagcacggggagagctgggagagccagggccgcacagagagccagtgggagaacacagaggcccctgtgtcctacaagtgcaatgaatgtgagaggagcttcaccaggaacagaagcctgattgagcaccagaagatccacactggagagaagccctaccagtgtgacacctgtgggaagggcttcaccaggaccagctacctggtgcagcaccagaggagccacgtgggcaagaagaccctgagccagtag

SEQ ID NO: 177076 - DNA, 1173 bp, Artificial Sequence
  Description of Artificial Sequence: Synthetic coding sequence
atggccctgctgacccagacccagggcagccagagcagccagtgccagcccatgaaggccctcttcaagcatgagagcctgggcagccagcccctgcatgacagagtgctgcaggtgcccggcctggcccagggcggctgctgccgggaggatgccatggtggccagccggctgaccccaggcagccagggcctgctgaagatggaggatgtggccctgaccctgaccccaggctggacccagctggacagcagccaggtgaacctgtacagagatgagaagcaggagaaccacagcagcctggtgtccctgggcggggagatccagaccaagagccgggacctgccccctgtgaagaagctgcctgagaaggagcacggcaagatctgccacctgcgggaggacatcgcccagatccccacccatgctgaggccggggagcaggagggccgcctgcagaggaagcagaagaatgccatcggcagcagaagacactactgccatgaatgtgggaagagctttgcccagagcagcggcctgaccaagcaccggcgcatccacactggagagaagccctatgaatgtgaggactgtgggaagaccttcatcggcagcagcgccctggtgatccaccagagggtgcacactggagagaagccctatgaatgtgaagaatgtgggaaggtgttcagccacagcagcaacctgatcaagcaccagaggacccacactggagagaagccctatgaatgtgatgactgtgggaagaccttcagccagagctgcagcctgctggagcaccacaagatccacactggagagaagccctaccagtgcaacatgtgtgggaaggccttcagaagaaacagccacctgctgcggcaccagagaattcatggagacaagaatgtgcagaaccctgagcacggggagagctgggagagccagggccgcacagagagccagtgggagaacacagaggcccctgtgtcctacaagtgcaatgaatgtgagaggagcttcaccaggaacagaagcctcatcgagcaccagaagatccacactggagagaagccctaccagtgtgacacctgtgggaagggcttcaccaggaccagctacctggtgcagcaccagaggagccacgtgggcaagaagaccctgagccagtag

SEQ ID NO: 177077 - DNA, 501 bp, Artificial Sequence
  Description of Artificial Sequence: Synthetic coding sequence
cccacccacgccgaggccggggagcaggagggccgcctgcagaggaagcagaagaatgccatcggcagccgccgccactactgccatgaatgtgggaagagctttgcccagagcagcggcctgaccaagcaccggcgcatccacactggagagaagccctatgaatgtgaggactgtgggaagaccttcatcggcagcagcgccctggtgatccaccagagggtgcacactggagagaagccctatgaatgtgaggagtgtgggaaggtgttcagccacagcagcaacctgatcaagcaccagaggacccacactggagagaagccctatgaatgtgatgactgtgggaagaccttcagccagagctgcagcctgctggagcaccacaagatccacactggagagaagccctaccagtgcaacatgtgtgggaaggccttcagaagaaacagccacctgctgcggcaccagaggatccacgtggtgacagaaattgtgtag

SEQ ID NO: 177078 - DNA, 438 bp, Artificial Sequence
  Description of Artificial Sequence: Synthetic coding sequence
atggagttcccagacctgggcaagcactgcagcgagaagacctgcaagcagctggacttcctgcctgtgaagtgtgatgcctgcaagcaggacttctgcaaggaccacttcccctatgctgcccacaagtgcccctttgccttccagaaggatgtgcacgtgcctgtgtgccccctgtgcaacacccccatccctgtgaagaagggccagatcccagatgtggtggtgggggaccacatcgaccgggactgtgacagccaccctgggaagaagaaggagaagatcttcacctaccgctgcagcaaggagggctgcaagaagaaggagatgctgcagatggtgtgtgcccagtgccacggcaacttctgcatccagcaccgccaccccctggaccacagctgccgccacggcagccggcccaccatcaaggccggctag

SEQ ID NO: 177079 - DNA, 543 bp, Artificial Sequence
  Description of Artificial Sequence: Synthetic coding sequence
atggagttcccagacctgggcaagcactgcagcgagaagacctgcaagcagctggacttcctgcctgtgaagtgtgatgcctgcaagcaggacttctgcaaggaccacttcccctatgctgcccacaagtgcccctttgccttccagaaggatgtgcacgtgcctgtgtgccccctgtgcaacacccccatccctgtgaagaagggccagatcccagatgtggtggtgggggaccacatcgaccgggactgtgacagccaccctgggaagaagaaggagaagatcttcacctaccgctgcagcaaggagggctgcaagaagaaggagatgctgcagatggtgtgtgcccagtgccacggcaacttctgcatccagcaccgccaccccctggaccacagctgccgccacggcagccggcccaccatcaaggccggctgcagccccatgacagtgtctgagagccggcccctgggggacttcctgaccctggcccctgggggcctggcccagaggctgggctactggttcacccggctgatgtag

SEQ ID NO: 177080 - DNA, 774 bp, Artificial Sequence
  Description of Artificial Sequence: Synthetic coding sequence
atggagttcccagacctgggcgcccactgcagcgagcccagctgccagaggctggacttcctgcccctgaagtgtgatgcctgcagcggcatcttctgtgccgaccacgtggcctatgcccagcaccactgcggcagcgcctaccagaaggacatccaggtgcctgtgtgccccctgtgcaatgtgcctgtgcctgtggcccggggggagcccccagacagagctgtgggggagcacatcgaccgggactgccgcagtgaccctgcccagcagaagaggaagatcttcaccaacaagtgtgaaagagctggctgccggcagcgggagatgatgaagctgacctgtgagcgctgcagcaggaacttctgcatcaagcaccgccaccccctggaccatgactgcagcggggagggccaccccaccagccgggccggcctggccgccatcagccgggcccaggccgtggccagcaccagcacagtgcccagccccagccagaccatgcccagctgcaccagccccagccgggccaccaccaggagccccagctggacagcccctcctgtgattgccctgcagaatggcctgtctgaagatgaggccctgcagagggccctggagatgagcctggccgagaccaagccccaggtgcccagctgccaggaggaggaggacctggccctggcccaggccctgagcgccagcgaggccgagtaccagaggcagcaggcccagagccgcagcagcaagcccagcaactgcagcctgtgctag

SEQ ID NO: 177081 - DNA, 531 bp, Artificial Sequence
  Description of Artificial Sequence: Synthetic coding sequence
atggagttcccagacctgggcgcccactgcagcgagcccagctgccagaggctggacttcctgcccctgaagtgtgatgcctgcagcggcatcttctgtgccgaccacgtggcctatgcccagcaccactgcggcagcgcctaccagaaggacatccaggtgcctgtgtgccccctgtgcaatgtgcctgtgcctgtggcccggggggagcccccagacagagctgtgggggagcacatcgaccgggactgccgcagtgaccctgcccagcagaagaggaagatcttcaccaacaagtgtgaaagagctggctgccggcagcgggagatgatgaagctgacctgtgagcgctgcagcaggaacttctgcatcaagcaccgccaccccctggaccatgactgcagcggggagggccaccccaccagccgggccggcctggccgccatcagccgggcccaggccgtggccagcaccagcacagtgcccagccccagccagaccatgcccagctgcaccagccccagcaggtag

SEQ ID NO: 177082 - DNA, 774 bp, Artificial Sequence; identical to SEQ ID NO: 177080
  Description of Artificial Sequence: Synthetic coding sequence

SEQ ID NO: 177083 - DNA, 531 bp, Artificial Sequence; identical to SEQ ID NO: 177081
  Description of Artificial Sequence: Synthetic coding sequence

SEQ ID NO: 177084 - DNA, 153 bp, Artificial Sequence
  Description of Artificial Sequence: Synthetic coding sequence
atggagttcccagacctgggcgcccactgcagcgagcccagctgccagaggctggacttcctgcccctgaagtgtgatgcctgcagcggcatcttctgtgccgaccacgtggcctatgcccagcaccactgcggcagcgcctaccagaagtag

SEQ ID NO: 177085 - DNA, 678 bp, Artificial Sequence
  Description of Artificial Sequence: Synthetic coding sequence
atggagttcccagacctgggcgcccactgcagcgagcccagctgccagaggctggacttcctgcccctgaagtgtgatgcctgcagcggcatcttctgtgccgaccacgtggcctatgcccagcaccactgcggcagcgcctaccagaaggacatccaggtgcctgtgtgccccctgtgcaatgtgcctgtgcctgtggcccggggggagcccccagacagagctgtgggggagcacatcgaccgggactgccgcagtgaccctgcccagcagaagaggaagatcttcaccaacaagtgtgaaagagctggctgccggcagcgggagatgatgaagctgacctgtgagcgctgcagcaggaacttctgcatcaagcaccgccaccccctggaccatgactgcagcggggagggccaccccaccagccgggccggcctggccgccatcagccgggcccaggccgtggccagcaccagcacagtgcccagccccagccagaccatgcccagctgcaccagccccagccgggccaccaccaggagccccagctggacagcccctcctgtgattgccctgcagaatggcctggtgtcctgggccgaggtgggctggacagagaccaacacccagagggtgaagagcaaggatgctggcctgctgagcccctttgtggagtag

SEQ ID NO: 177086 - DNA, 684 bp, Artificial Sequence
  Description of Artificial Sequence: Synthetic coding sequence
atgggagatgctggcagcgagaggagcaaggcccccagcctgcccccacgctgcccctgtggcttctggggcagcagcaagaccatgaacctgtgcagcaagtgctttgctgacttccagaagaagcagccagatgatgacagcgcccccagcaccagcaacagccagagcgacctcttcagcgaggagaccaccagtgacaacaacaacaccagcatcaccacccccaccctgagccccagccagcagcccctgcccacagagctgaatgtgaccagccccagcaaggaggagtgtggcccctgcacagacacagcccacgtgtccctcatcacccccaccaagaggagctgtggcacagacagccagagtgaaaatgaggccagccctgtgaagaggccccggctgctggagaacacagagaggtctgaggagaccagccgcagcaagcagaagagcagaagacgctgcttccagtgccagaccaagctggagctggtgcagcaggagctgggcagctgccgctgtggctacgtgttctgcatgctgcaccggctgcctgagcagcacgactgcacctttgaccacatgggccggggccgggaggaggccatcatgaagatggtgaagctggacaggaaggtgggccgcagctgccagagaattggagagggctgcagctag

SEQ ID NO: 177087 - DNA, 642 bp, Artificial Sequence
  Description of Artificial Sequence: Synthetic coding sequence
atggcccaggagaccaaccagaccccaggccccatgctgtgcagcacaggctgcggcttctacggcaaccccaggaccaacggcatgtgcagcgtgtgctacaaggagcacctgcagaggcagcagaacagcggccgcatgagccccatgggcacagccagcggcagcaacagccccaccagtgacagcgcctctgtgcagagagctgacaccagcctgaacaactgtgagggcgccgccggcagcaccagcgagaagagcagaaatgtgcctgtggccgccctgcctgtgacccagcagatgacagagatgagcatcagccgggaggacaagatcaccacccccaagacagaggtgtctgagcctgtggtgacccagcccagccccagcgtgtcccagcccagcaccagccagagcgaggagaaggcccctgagctgcccaagcccaagaagaaccgctgcttcatgtgcaggaagaaggtgggcctgaccggctttgactgccgctgtggcaacctcttctgtggcctgcaccgctacagcgacaagcacaactgcccctatgactacaaggccgaggccgccgccaagatcagaaaagaaaatcctgtggtggtggccgagaagatccagaggatctag

SEQ ID NO: 177088 - DNA, 642 bp, Artificial Sequence; identical to SEQ ID NO: 177087
  Description of Artificial Sequence: Synthetic coding sequence

SEQ ID NO: 177089 - DNA, 636 bp, Artificial Sequence
  Description of Artificial Sequence: Synthetic coding sequence
atggccaagccagagcaggccgcagatggaggagtgcggggccgcggggcccggcccccagcccaggaggcccagaggagaagaagacaccctgtggtggtggcccgggacctggcccctggggtgcccggcagcctgcacagcacccagaagaacatggcccaggagaccaaccagaccccaggccccatgctgtgcagcacaggctgcggcttctacggcaaccccaggaccaacggcatgtgcagcgtgtgctacaaggagcacctgcagaggcagcagaacagcggccgcatgagccccatgggcacagccagcggcagcaacagccccaccagtgacagcgcctctgtgcagagagctgacaccagcctgaacaactgtgagggcgccgccggcagcaccagcgagaagagcagaaatgtgcctgtggccgccctgcctgtgacccagcagatgacagagatgagcatcagccgggaggacaagatcaccacccccaagacagaggtgtctgagcctgtggtgacccagcccagccccagcgtgtcccagcccagcaccagccagagcgaggagaaggcccctgagctgcccaagcccaagaagaaccgctgcttcatgtgcaggaagtag

SEQ ID NO: 177090 - DNA, 642 bp, Artificial Sequence; identical to SEQ ID NO: 177087
  Description of Artificial Sequence: Synthetic coding sequence

SEQ ID NO: 177091 - DNA, 642 bp, Artificial Sequence; identical to SEQ ID NO: 177087
  Description of Artificial Sequence: Synthetic coding sequence

SEQ ID NO: 177092 - DNA, 627 bp, Artificial Sequence
  Description of Artificial Sequence: Synthetic coding sequence
atggcccaggagaccaaccacagccaggtgcccatgctgtgcagcacaggctgcggcttctacggcaaccccaggaccaacggcatgtgcagcgtgtgctacaaggagcacctgcagaggcagaacagcagcaatggccgcatcagccccccagccacctctgtgagcagcctgtctgagagcctgcctgtgcagtgcacagatggctctgtgcctgaggcccagagcgccctggacagcaccagcagctccatgcagcccagccctgtgagcaaccagagcctgctgtctgagagcgtggccagcagccagctggacagcacctctgtggacaaggctgtgcctgagacagaagatgtgcaggcctctgtgtctgacacagcccagcagcccagcgaggagcagagcaagagcctggagaagcccaagcagaagaagaaccgctgcttcatgtgcaggaagaaggtgggcctgactggatttgagtgccgctgtggaaatgtgtactgcggcgtgcaccgctacagtgatgtgcacaactgcagctacaactacaaggcagatgctgctgagaagatcaggaaggagaaccctgtggtggtgggggagaagatccagaagatctag

SEQ ID NO: 177093 - DNA, 627 bp, Artificial Sequence; identical to SEQ ID NO: 177092
  Description of Artificial Sequence: Synthetic coding sequence

SEQ ID NO: 177094 - DNA, 591 bp, Artificial Sequence
  Description of Artificial Sequence: Synthetic coding sequence
atggcccaggagaccaaccacagccaggtgcccatgctgtgcagcacaggctgcggcttctacggcaaccccaggaccaacggcatgtgcagcgtgtgctacaaggagcacctgcagaggcagaacagcagcaatggccgcatcagcccccctgtgcagtgcacagatggctctgtgcctgaggcccagagcgccctggacagcaccagcagctccatgcagcccagccctgtgagcaaccagagcctgctgtctgagagcgtggccagcagccagctggacagcacctctgtggacaaggctgtgcctgagacagaagatgtgcaggcctctgtgtctgacacagcccagcagcccagcgaggagcagagcaagagcctggagaagcccaagcagaagaagaaccgctgcttcatgtgcaggaagaaggtgggcctgactggatttgagtgccgctgtggaaatgtgtactgcggcgtgcaccgctacagtgatgtgcacaactgcagctacaactacaaggcagatgctgctgagaagatcaggaaggagaaccctgtggtggtgggggagaagatccagaagatctag

SEQ ID NO: 177095 - DNA, 627 bp, Artificial Sequence; identical to SEQ ID NO: 177092
  Description of Artificial Sequence: Synthetic coding sequence

SEQ ID NO: 177096 - DNA, 627 bp, Artificial Sequence; identical to SEQ ID NO: 177092
  Description of Artificial Sequence: Synthetic coding sequence

SEQ ID NO: 177097 - DNA, 627 bp, Artificial Sequence; identical to SEQ ID NO: 177092
  Description of Artificial Sequence: Synthetic coding sequence

SEQ ID NO: 177098 - DNA, 2085 bp, Artificial Sequence
  Description of Artificial Sequence: Synthetic coding sequence
atggagaacaagagcctggagagcagccagacagacctgaagctggtggcccacccccgggccaagagcaaggtgtggaagtactttggatttgacaccaatgctgagggctgcatcctgcagtggaagaagatctactgccgcatctgcatggcccagatcgcctacagcggcaacaccagcaacctgagctaccacctggagaagaaccaccctgaggagttctgtgaatttgtgaagagcaacacagagcagatgagggaggcctttgccacagccttcagcaagctgaagccagagagcagccagcagcccggccaggatgccctggccgtgaaggccggccacggctatgacagcaagaagcagcaggagctgacagctgctgtgctgggcctcatctgtgagggcctgtacccagccagcatcgtggatgagcccaccttcaaggtgctgctgaagacagctgaccccaggtatgagctgcccagcaggaagtacatcagcaccaaggccatccctgagaagtatggagctgtgcgggaggtgatcctgaaggagctggccgaggccacctggtgtggcatcagcacagacatgtggaggtctgagaaccagaacagagcctacgtgaccctggccgcccacttcctgggcctgggcgcccccaactgcctgtccatgggcagccgctgcctgaagacctttgaggtgcctgaagaaaatacagctgagaccatcaccagggtgctgtatgaggtgttcatcgagtggggcatcagcgccaaggtgtttggagccaccaccaactacggcaaggacatcgtgaaggcctgcagcctgctggatgtggccgtgcacatgccctgcctgggccacaccttcaatgccggcatccagcaggccttccagctgcccaagctgggcgccctgctgagccgctgcaggaagctggtggagtacttccagcagagcgctgtggccatgtacatgctgtatgagaagcagaagcagcagaatgtggcccactgcatgctggtgagcaacagagtgtcctggtggggcagcaccctggccatgctgcagaggctgaaggagcagcagtttgtgattgctggggtgctggtggaggacagcaacaaccaccacctgatgctggaggccagcgagtgggccaccatcgagggcctggtggagctgctgcagcccttcaagcaggtggccgagatgctgagcgccagccgctaccccaccatctccatggtgaagcccctgctgcacatgctgctgaacaccaccctgaacatcaaggagacagacagcaaggagctgtccatggccaaggaggtgattgccaaggagctgagcaagacctaccaggagaccccagaaattgacatgttcctgaatgtggccaccttcctggacccccgctacaagaggctgcccttcctgagcgcctttgagcggcagcaggtggagaacagagtggtggaggaggccaagggcctgctggacaaggtgaaggatggcggctacagacctgctgaggacaagatcttccctgtgcctgaggagccccctgtgaagaagctgatgaggaccagcaccccacctccagccagcgtcatcaacaacatgctggccgagatcttctgccagacaggaggagtggaggaccaggaggagtggcacgcccaggtggtggaggagctgagcaacttcaagagccagaaggtgctgggcctgaatgaagaccccctgaagtggtggagcgaccggctggccctcttccccctgctgcccaaggtgctgcagaagtactggtgtgtgacagccaccagggtggcccctgagcggctgtttggcagcgctgccaacgtggtgtctgccaagaggaaccggctggccccagcccacgtggatgagcaggtgttcctgtatgaaaatgcccggtctggagctgaggccgagcctgaggaccaggatgaaggagagtggggcctggaccaggagcaggtgttcagcctgggagatggagtgtctgggggcttcttcggcatccgggacagcagcttcctgtag

SEQ ID NO: 177099 - DNA, 2085 bp, Artificial Sequence; identical to SEQ ID NO: 177098
  Description of Artificial Sequence: Synthetic coding sequence

SEQ ID NO: 177100 - DNA, 2085 bp, Artificial Sequence; identical to SEQ ID NO: 177098
  Description of Artificial Sequence: Synthetic coding sequence

SEQ ID NO: 177101 - DNA, 819 bp, Artificial Sequence
  Description of Artificial Sequence: Synthetic coding sequence
atggagaacaagagcctggagagcagccagacagacctgaagctggtggcccacccccgggccaagagcaaggtgtggaagtactttggatttgacaccaatgctgagggctgcatcctgcagtggaagaagatctactgccgcatctgcatggcccagatcgcctacagcggcaacaccagcaacctgagctaccacctggagaagaaccaccctgaggagttctgtgaatttgtgaagagcaacacagagcagatgagggaggcctttgccacagccttcagcaagctgaagccagagagcagccagcagcccggccaggatgccctggccgtgaaggccggccacggctatgacagcaagaagcagcaggagctgacagctgctgtgctgggcctcatctgtgagggcctgtacccagccagcatcgtggatgagcccaccttcaaggtgctgctgaagacagctgaccccaggtatgagctgcccagcaggaagtacatcagcaccaaggccatccctgagaagtatggagctgtgcgggaggtgatcctgaaggagctggccgaggccacctggtgtggcatcagcacagacatgtggaggtctgagaaccagaacagagcctacgtgaccctggccgcccacttcctgggcctgggcgcccccaactgcctgtccatgggcagccgctgcctgaagacctttgaggtgcctgaagaaaatacagctgagaccatcaccagggtgctgtatgaggtgttcatcgagtggggcatcagcgccaaggtgtttggagccaccaccaactatggatag

SEQ ID NO: 177102 - DNA, 3177 bp, Artificial Sequence
  Description of Artificial Sequence: Synthetic coding sequence
atgaggaggaagggccgctgccaccggggcagcgctgcccggcaccccagcagcccctgcagcgtgaagcacagccccacccgggagaccctgacctacgcccaggcccagaggatggtggagattgaaattgagggccgcctgcaccgcatcagcatctttgaccccctggagatcatcctggaggatgacctgacagcccaggagatgtctgagtgcaacagcaacaaggagaacagcgagaggcctcctgtgtgcctgcggaccaagaggcacaagaacaacagagtgaagaagaagaatgaggccctgcccagcgcccacggcaccccagccagcgccagcgccctgcctgagcccaaggtgcgcatcgtggagtacagccccccatctgccccccggcggccccctgtgtactacaagttcatcgagaagtctgctgaggagctggacaatgaggtggagtatgacatggatgaagaagattatgcctggctggagatcgtgaatgagaagaggaagggggactgtgtgcctgctgtgtcccagagcatgtttgagttcctgatggacagatttgagaaggagagccactgtgagaaccagaagcagggcgagcagcagagcctgattgatgaagatgctgtgtgctgcatctgcatggatggagagtgccagaacagcaatgtcatcctcttctgtgacatgtgcaacctggccgtgcaccaggagtgctacggcgtgccctacatccctgagggccagtggctgtgccgccactgcctgcagagccgggcccggcctgctgactgtgtgctgtgccccaacaagggcggggccttcaagaagacagatgatgaccgctggggccacgtggtgtgtgccctgtggatccctgaggtgggctttgccaacacagtgttcatcgagcccattgatggagtgaggaacatccccccagcccgctggaagctgacctgctacctgtgcaagcagaagggcgtgggcgcctgcatccagtgccacaaggccaactgctacacagccttccacgtgacctgtgcccagaaggccggcctgtacatgaagatggagcctgtgaaggagctgactggaggcggcaccaccttctctgtgaggaagacagcctactgtgatgtgcacaccccacctggctgcacccggcggcccctgaacatctatggagatgtggagatgaagaatggagtgtgcaggaaggagagctctgtgaagacagtgcgcagcaccagcaaggtgaggaagaaggccaagaaggccaagaaggccctggccgagccctgtgctgtgctgcccaccgtgtgtgccccctacatccccccccagaggctgaaccgcatcgccaaccaggtggccatccagaggaagaagcagtttgtggagcgggcccacagctactggctgctgaagaggctgagcagaaatggagcccccctgctgcggcggctgcagagcagcctgcagagccagaggagcagccagcagcgggagaatgatgaggagatgaaggccgccaaggagaagctgaagtactggcagaggctgcggcatgacctggagcgggcccggctgctgattgagctgctgaggaagcgggagaagctgaagcgggagcaggtgaaggtggagcaggtggccatggagctgcggctgacccccctgactgtgctgctgcggtctgtgctggaccagctgcaggacaaggaccctgcccgcatctttgcccagcctgtgtccctgaaggaggtgcctgactacctggaccacatcaagcaccccatggactttgccaccatgaggaagaggctggaggcccagggctacaagaacctgcatgaatttgaagaagattttgacctgatcatcgacaactgcatgaagtacaatgcccgggacaccgtcttctacagagctgctgtgcggctgcgggaccagggcggcgtggtgctgcggcaggcccggcgggaggtggacagcatcggcctggaggaggccagcggcatgcacctgcctgagaggcctgctgctgccccccggcggcccttctcctgggaggatgtggaccggctgctggaccctgccaacagagcccacctgggcctggaggagcagctgcgggagctgctggacatgctggacctgacctgtgccatgaagagcagcggcagccgcagcaagagggccaagctgctgaagaaggagatcgccctgctgaggaacaagctgagccagcagcacagccagcccctgcccactggacctggcctggagggctttgaggaggatggagctgccctgggccctgaggccggggaggaggtgctgccccggctggagaccctgctgcagcccaggaagaggagccgcagcacctgtggggacagcgaggtggaggaggagagccctgggaagaggctggatgctggcctgaccaatggatttggaggagcccggtctgagcaggagcccggcggcggcctgggcaggaaggccaccccaagaagaagatgtgccagcgagagcagcatcagcagcagcaacagccccctgtgtgacagcagcttcaatgcccccaagtgtggccggggcaagccagccctggtgcggcggcacaccctggaggacagaagtgagctgatcagctgcattgaaaatggaaattatgccaaggccgccagaattgctgctgaggtgggccagagctccatgtggatcagcacagatgctgctgcctctgtgctggagcccctgaaggtggtgtgggccaagtgcagcggctaccccagctacccagccctgatcatcgaccccaagatgccccgggtgcccggccaccacaacggggtgaccatcccagccccacccctggatgtgctgaagatcggggagcacatgcagaccaagagtgatgagaagctgttcctggtgctcttctttgacaacaagaggtcctggcagtggctgcccaagagcaagatggtgcccctgggcattgatgagaccatcgacaagctgaagatgatggagggcaggaacagcagcatcaggaaggctgtgcgcatcgcctttgaccgggccatgaaccacctgagccgggtgcatggagagcccaccagtgacctgagtgacattgattag

SEQ ID NO: 177103 - DNA, 2940 bp, Artificial Sequence
  Description of Artificial Sequence: Synthetic coding sequence
atgtctgtgtgcaccctgtctgtgcctgtgagcagcctgagccctggaagacgctgcaacaccttcagtgacagcggcatcctgggctgtgtgcccatcaacagcaacacagatgaggaggatgtggtggaggagaagatggtggccgagggcgtgaacaaggaggccaagcagcctgccaagaagaagaggaagaagggcctgcgcatcaagggcaagagaagaaggaagaagctgatcctggccaagaagttcagcaaggacctgggcagcggccggcctgtggctgatgccccagccctgctggccagcaatgaccctgagcaggatgaggagagcctgtttgagagcaacatcgagaagcagatctacctgcccagcacccgggccaagaccagcatcgtgtggcacttcttccacgtggacccccagtacacctggagggccatctgcaacctgtgtgagaagtctgtgtcccggggcaagccaggcagccacctgggcaccagcaccctgcagaggcacctgcaggcccggcacagcccccactggacccgggccaacaagtttggagtggccagcggggaggaggacttcaccctggatgtgtccctgagccccagcagcggcagcaatggcagctttgagtacatccccacagaccccctggatgacaacaggatgggcaagaagcatgacaagagcgccagtgatgccctgcgggcagagcggggccgcttcctgatcaagagcaacatcgtgaagcacgccctgatccctggcacccgggccaagaccagcgctgtgtggaacttcttctacacagacccccagcacatcagcagagctgtgtgcaacatctgcaagaggtctgtgtcccggggccggcccggcagccacctgggcaccagcaccctgcagaggcacctgcaggccacccaccccatccactgggccgtggccaacaaggacagcggggctgtggccaacggcctggatgaagctgagacagagaggagtgacctgctgagtgacaccctgcacggggagaagagcacaggcagccaggacctgacagctgaggacctgagtgacagcgacagtgatgagcccatgctggaggtggagaacagaagtgagagccccatccctgtggccgagcagggcaccctgatgagggcccaggagcgggagaccacctgctgcggcaaccctgtgagcagccacatcagccaggccatcatccagatgattgtggaggacatgcacccctacaactacttcagcaccccagccttccagcgcttcatgcagatcgtggccccagactaccgcctgcccagcgagacctacttcttcaccaaggctgtgccccagctgtatgactgtgtgcgggagaagatcttcctgaccctggagaatgtgcagagccagaagatccacctgactgtggacatctggacccatgaccccagcacagactacttcatcgtgacagtgcactgggtgtccctggagacagccagcttcctgaacaacggccgcatcccagacttcaggaagtgggccgtgctgtgtgtgacaggcctggccaaggactgcctgatcaccaacatcctgcaggagctgaatgaccagatcggcctgtggctgagccccaacttcctgatccccagcttcatcgtgtctgacaacagcagcaatgtggtgcacgccatcaaggatggcggcttcacccacgtgccctgcttcctgcactgcctgaacatggtgatccaggacttcttctgtgagcacaagagcattgagaacatgctggtggccgccaggaagacctgccaccacttcagccacagcgtgaaggcccggcagatcctgcaggagttccagaatgaccaccagctgccctggaagaacctgaagcaggatgaaacaggccactggatcagcaccttctacatgctgaagtggctgctggagcactgctacagcgtgcaccacagcctgggccgggccagcggcgtggtgctgaccagcctgcagtggaccctgatgacctacgtgtgtgacatcctgaagccctttgaggaggccacccagaaggtgtctgtgaagacagctggcctgaaccaggtgctgcccctcatccaccacctgctgctgagcctgcagaagctgcgggaggacttccaggtgcggggcatcacccaggccctgaacctggtggacagcctgagcctgaagctggagacagacaccctgctgagcgccatgctgaagagcaagccctgcatcctggccaccctgctggacccctgcttcaagaacagcctggaggacttcttcccccagggcgctgacctggagacctacaagcagttcctggccgaggaggtgtgcaactacatggagagcagccctgagatctgccagatccccaccagcgaggccagctgccccagcgtgacagtgggcgctgacagcttcaccagcagcctgaaggagggcaccagcagcagcggctctgtggacagcagcgctgtggacaacgtggccctgggcagcaagagcttcatgttccccagcgctgtggccgtggtggatgagtacttcaaggagaagtacagcgagttctctggaggagatgaccccctcatctactggcagaggaagatcagcatctggccagccctgacccaggtggccatccagtacctgagctgccccatgtgctcctggcagagcgagtgcatcttcaccaagaacagccacttccaccccaagcagatcatgagcctggactttgacaacatcgagcagctgatgttcctgaagatgaacctgaagaatgtgaactatgactacagcaccctggtgctgtcctgggaccctgagcagaatgaggtggtgcagagcagcgagaaggagatcctgccctag

SEQ ID NO: 177104 - DNA, 4938 bp, Artificial Sequence
  Description of Artificial Sequence: Synthetic coding sequence
atggaggagagcaagaccctgaagtctgagaaccacgagcccaagaagaatgtcatctgtgaggagagcaaggctgtgcaggtgattggcaaccagaccctgaaggccagaaatgacaagtctgtgaaggagattgagaacagcagccccaacagaaacagcagcaagaagaacaagcagaatgacatctgcatcgagaagacagaggtgaagagctgcaaggtgaatgctgccaacctgcccggccccaaggacctgggcctggtgctgcgggaccagagccactgcaaggccaagaagttccccaacagccctgtgaaggccgagaaggccaccatcagccaggccaagtctgagaaggccaccagcctgcaggccaaggccgagaagagccccaagagccccaacagcgtgaaggccgagaaggccagcagctaccagatgaagtctgagaaggtgcccagcagccctgctgaggccgagaagggccccagcctgctgctgaaggacatgaggcagaagacagagctgcagcagatcggcaagaagatccccagcagcttcacctctgtggacaaggtgaacatcgaggccgtgggcggggagaagtgtgccctgcagaacagccccaggagccagaagcagcagacctgcacagacaacacaggagacagtgatgacagcgccagcggcattgaagatgtgtctgatgacctgagcaagatgaagaatgatgagagcaacaaggagaacagcagcgagatggactacctggagaatgccaccgtgattgatgaaagtgccctgaccccagagcagaggctgggcctgaagcaggccgaggagcggctggagcgggaccacatcttccggctggagaagaggagccctgagtacaccaactgccgctacctgtgcaagctgtgcctgatccacatcgagaacatccagggcgcccacaagcacatcaaggagaagaggcacaagaagaacatcctggagaagcaggaggagagcgagctgcggagcctgcccccacccagccctgcccacctggccgccctgtctgtggccgtcatcgagctggccaaggagcacggcatcacagatgatgacctgcgggtgcggcaggagatcgtggaggagatgagcaaggtgatcaccaccttcctgcctgaatgttccctgcggctgtatggcagcagcctgaccaggtttgccctgaagagcagtgatgtgaacatcgacatcaagttcccccccaagatgaaccacccagacctgctgatcaaggtgctgggcatcctgaagaagaatgtgctgtatgtggatgtggagagtgacttccacgccaaggtgcctgtggtggtgtgccgggacaggaagagcggcctgctgtgccgggtgtctgctggaaatgacatggcctgcctgaccacagacctgctgacagccctgggcaagattgagcctgtgttcatccccctggtgctggccttccgctactgggccaagctgtgctacatcgacagccagacagatggcggcatccccagctactgctttgccctgatggtgatgttcttcctgcagcagaggaagccacccctgctgccctgcctgctgggctcctggattgagggctttgaccccaagaggatggatgacttccagctgaagggcatcgtggaggagaagtttgtgaagtgggagtgcaacagcagcagcgccacagagaagaacagcattgctgaggagaacaaggccaaggctgaccagcccaaggatgacaccaagaagacagaaacagacaaccagagcaatgccatgaaggagaagcacggcaagagccccctggccctggagacccccaacagagtgtccctgggccagctgtggctggagctgctgaagttctacaccctggactttgccctggaggagtatgtgatctgtgtgcgcatccaggacatcctgacccgggagaacaagaactggcccaagagaagaattgccatcgaggaccccttctctgtgaagagaaatgtggcccggagcctgaacagccagctggtgtatgaatatgtggtggagcgcttccgggccgcctaccgctactttgcctgcccccagaccaagggcggcaacaagagcacagtggacttcaagaagcgggagaagggcaagatcagcaacaagaagcctgtgaagagcaacaacatggccaccaacggctgcatcctgctgggggagaccacagagaagatcaatgctgagcgggagcagcctgtgcagtgtgatgagatggactgcaccagccagcgctgcatcatcgacaacaacaacctgctggtgaatgagctggactttgctgaccacggccaggacagcagcagcctgagcaccagcaagagcagcgagattgagcccaagctggacaagaagcaggatgacctggcccccagcgagacctgcctgaagaaggagctgagccagtgcaactgcatcgacctgagcaagagcccagaccctgacaagagcactggaacagactgccgcagcaacctggagacagagagcagccaccagagcgtgtgcacagacaccagcgccaccagctgcaactgcaaggccacagaagatgccagtgacctgaatgatgatgacaacctgcccacccaggagctgtactacgtgtttgacaagttcatcctgaccagcggcaagccacccaccatcgtgtgcagcatctgcaagaaggatggccacagcaagaatgactgcccagaggacttcaggaagattgacctgaagcccctgccccccatgaccaaccgcttccgggagatcctggacctggtgtgcaagcgctgctttgatgagctgagccccccctgcagcgagcagcacaaccgggagcagatcctgattggcctggagaagttcatccagaaggagtatgatgagaaggcccggctgtgcctgtttggcagcagcaagaatggatttggcttccgggacagcgacctggacatctgcatgaccctggagggccatgaaaatgctgagaagctgaactgcaaggagatcatcgagaacctggccaagatcctgaagaggcaccctggcctgaggaacatcctgcccatcaccacagccaaggtgcccatcgtgaagtttgagcacagaagaagtggcctggagggggacatcagcctgtacaacaccctggcccagcacaacaccaggatgctggccacctatgctgccatcgacccccgggtgcagtacctgggctacaccatgaaggtgtttgccaagagatgtgacattggagatgccagccggggcagcctgagcagctatgcctacatcctgatggtgctgtacttcctgcagcagaggaagccccctgtgattcctgtgctgcaggagatctttgatggcaagcagatcccccagaggatggtggatggctggaatgccttcttctttgacaagacagaggagctgaagaagaggctgcccagcctgggcaagaacacagagagcctgggggagctgtggctgggcctgctgcgcttctacacagaggagtttgacttcaaggagtatgtgatcagcatccggcagaagaagctgctgaccacctttgagaagcagtggaccagcaaatgtattgccatcgaggacccctttgacctgaaccacaacctgggcgccggcgtgtccaggaagatgaccaacttcatcatgaaggccttcatcaatggaaggaagctgtttggcacccccttctaccccctcatcggccgggaggccgagtacttctttgacagccgggtgctgacagatggagagctggccccaaatgaccgctgctgccgggtgtgtgggaagattggccactacatgaaggactgccccaagaggaagagcagcctgctcttccggctgaagaagaaggacagcgaggaggagaaggagggcaatgaggaggagaaggacagcagagatgtgctggacccccgggacctgcatgacacccgggacttccgggacccccgggacctgcgctgcttcatctgtggagatgctggccacgtgcggcgggagtgcccagaggtgaagctggcccggcagaggaacagctctgtggccgccgcccagctggtgaggaacctggtgaatgcccagcaggtggccggcagcgcccagcagcagggcgaccagagcatccgcacccggcagagcagcgagtgcagcgagagccccagctacagcccccagccccagcccttcccccagaacagcagccagagcgctgccatcacccagcccagcagccagcccggcagccagcccaagctgggccccccccagcagggcgcccagcccccccaccaggtgcagatgcccctgtacaacttcccccagagccccccagcccagtacagccccatgcacaacatgggcctgctgcccatgcaccccctgcagatcccagcccccagctggcccatccacggccctgtgatccacagcgcccctggcagcgcccccagcaacatcggcctgaatgaccccagcatcatctttgcccagcctgctgcccggcctgtggccatccccaacaccagccatgatggccactggcccaggacagtggcccccaacagcctggtgaacagcggggctgtgggcaacagcgagcccggcttccggggcctgaccccacccatcccctgggagcacgccccccggccccacttccccctggtgcctgcctcctggccctacggcctgcaccagaacttcatgcaccagggcaatgcccgcttccagcccaacaagcccttctacacccaggacagatgtgccacccggcgctgccgggagcgctgcccccaccccccaagaggaaatgtgtctgagtag

SEQ ID NO: 177105 - DNA, 4935 bp, Artificial Sequence
  Description of Artificial Sequence: Synthetic coding sequence
atggaggagagcaagaccctgaagtctgagaaccacgagcccaagaagaatgtcatctgtgaggagagcaaggctgtgcaggtgattggcaaccagaccctgaaggccagaaatgacaagtctgtgaaggagattgagaacagcagccccaacagaaacagcagcaagaagaacaagcagaatgacatctgcatcgagaagacagaggtgaagagctgcaaggtgaatgctgccaacctgcccggccccaaggacctgggcctggtgctgcgggaccagagccactgcaaggccaagaagttccccaacagccctgtgaaggccgagaaggccaccatcagccaggccaagtctgagaaggccaccagcctgcaggccaaggccgagaagagccccaagagccccaacagcgtgaaggccgagaaggccagcagctaccagatgaagtctgagaaggtgcccagcagccctgctgaggccgagaagggccccagcctgctgctgaaggacatgaggcagaagacagagctgcagcagatcggcaagaagatccccagcagcttcacctctgtggacaaggtgaacatcgaggccgtgggcggggagaagtgtgccctgcagaacagccccaggagccagaagcagcagacctgcacagacaacacaggagacagtgatgacagcgccagcggcattgaagatgtgtctgatgacctgagcaagatgaagaatgatgagagcaacaaggagaacagcagcgagatggactacctggagaatgccaccgtgattgatgaaagtgccctgaccccagagcagaggctgggcctgaagcaggccgaggagcggctggagcgggaccacatcttccggctggagaagaggagccctgagtacaccaactgccgctacctgtgcaagctgtgcctgatccacatcgagaacatccagggcgcccacaagcacatcaaggagaagaggcacaagaagaacatcctggagaagcaggaggagagcgagctgcggagcctgcccccacccagccctgcccacctggccgccctgtctgtggccgtcatcgagctggccaaggagcacggcatcacagatgatgacctgcgggtgcggcaggagatcgtggaggagatgagcaaggtgatcaccaccttcctgcctgaatgttccctgcggctgtatggcagcagcctgaccaggtttgccctgaagagcagtgatgtgaacatcgacatcaagttcccccccaagatgaaccacccagacctgctgatcaaggtgctgggcatcctgaagaagaatgtgctgtatgtggatgtggagagtgacttccacgccaaggtgcctgtggtggtgtgccgggacaggaagagcggcctgctgtgccgggtgtctgctggaaatgacatggcctgcctgaccacagacctgctgacagccctgggcaagattgagcctgtgttcatccccctggtgctggccttccgctactgggccaagctgtgctacatcgacagccagacagatggcggcatccccagctactgctttgccctgatggtgatgttcttcctgcagcagaggaagccacccctgctgccctgcctgctgggctcctggattgagggctttgaccccaagaggatggatgacttccagctgaagggcatcgtggaggagaagtttgtgaagtgggagtgcaacagcagcagcgccacagagaagaacagcattgctgaggagaacaaggccaaggctgaccagcccaaggatgacaccaagaagacagaaacagacaaccagagcaatgccatgaaggagaagcacggcaagagccccctggccctggagacccccaacagagtgtccctgggccagctgtggctggagctgctgaagttctacaccctggactttgccctggaggagtatgtgatctgtgtgcgcatccaggacatcctgacccgggagaacaagaactggcccaagagaagaattgccatcgaggaccccttctctgtgaagagaaatgtggcccggagcctgaacagccagctggtgtatgaatatgtggtggagcgcttccgggccgcctaccgctactttgcctgcccccagaccaagggcggcaacaagagcacagtggacttcaagaagcgggagaagggcaagatcagcaacaagaagcctgtgaagagcaacaacatggccaccaacggctgcatcctgctgggggagaccacagagaagatcaatgctgagcgggagcagcctgtgcagtgtgatgagatggactgcaccagccagcgctgcatcatcgacaacaacaacctgctggtgaatgagctggactttgctgaccacggccaggacagcagcagcctgagcaccagcaagagcagcgagattgagcccaagctggacaagaagcaggatgacctggcccccagcgagacctgcctgaagaaggagctgagccagtgcaactgcatcgacctgagcaagagcccagaccctgacaagagcactggaacagactgccgcagcaacctggagacagagagcagccaccagagcgtgtgcacagacaccagcgccaccagctgcaactgcaaggccacagaagatgccagtgacctgaatgatgatgacaacctgcccacccaggagctgtactacgtgtttgacaagttcatcctgaccagcggcaagccacccaccatcgtgtgcagcatctgcaagaaggatggccacagcaagaatgactgcccagaggacttcaggaagattgacctgaagcccctgccccccatgaccaaccgcttccgggagatcctggacctggtgtgcaagcgctgctttgatgagctgagccccccctgcagcgagcagcacaaccgggagcagatcctgattggcctggagaagttcatccagaaggagtatgatgagaaggcccggctgtgcctgtttggcagcagcaagaatggatttggcttccgggacagcgacctggacatctgcatgaccctggagggccatgaaaatgctgagaagctgaactgcaaggagatcatcgagaacctggccaagatcctgaagaggcaccctggcctgaggaacatcctgcccatcaccacagccaaggtgcccatcgtgaagtttgagcacagaagaagtggcctggagggggacatcagcctgtacaacaccctggcccagcacaacaccaggatgctggccacctatgctgccatcgacccccgggtgcagtacctgggctacaccatgaaggtgtttgccaagagatgtgacattggagatgccagccggggcagcctgagcagctatgcctacatcctgatggtgctgtacttcctgcagcagaggaagccccctgtgattcctgtgctgcaggagatctttgatggcaagcagatcccccagaggatggtggatggctggaatgccttcttctttgacaagacagaggagctgaagaagaggctgcccagcctgggcaagaacacagagagcctgggggagctgtggctgggcctgctgcgcttctacacagaggagtttgacttcaaggagtatgtgatcagcatccggcagaagaagctgctgaccacctttgagaagcagtggaccagcaaatgtattgccatcgaggacccctttgacctgaaccacaacctgggcgccggcgtgtccaggaagatgaccaacttcatcatgaaggccttcatcaatggaaggaagctgtttggcacccccttctaccccctcatcggccgggaggccgagtacttctttgacagccgggtgctgacagatggagagctggccccaaatgaccgctgctgccgggtgtgtgggaagattggccactacatgaaggactgccccaagaggaagagcctgctcttccggctgaagaagaaggacagcgaggaggagaaggagggcaatgaggaggagaaggacagcagagatgtgctggacccccgggacctgcatgacacccgggacttccgggacccccgggacctgcgctgcttcatctgtggagatgctggccacgtgagaagagaatgtcctgaggtgaagctggcccggcagaggaacagctctgtggccgccgcccagctggtgaggaacctggtgaatgcccagcaggtggccggcagcgcccagcagcagggcgaccagagcatccgcacccggcagagcagtgaatgttctgagagccccagctacagcccccagccccagcccttcccccagaacagcagccagagcgctgccatcacccagcccagcagccagcccggcagccagcccaagctgggccccccccagcagggcgcccagcccccccaccaggtgcagatgcccctgtacaacttcccccagagccccccagcccagtacagccccatgcacaacatgggcctgctgcccatgcaccccctgcagatcccagcccccagctggcccatccacggccctgtgatccacagcgcccctggcagcgcccccagcaacatcggcctgaatgaccccagcatcatctttgcccagcctgctgcccggcctgtggccatccccaacaccagccatgatggccactggcccaggacagtggcccccaacagcctggtgaacagcggggctgtgggcaacagcgagcccggcttccggggcctgaccccacccatcccctgggagcacgccccccggccccacttccccctggtgcctgcctcctggccctacggcctgcaccagaacttcatgcaccagggcaatgcccgcttccagcccaacaagcccttctacacccaggacagatgtgccacccggcgctgccgggagcgctgcccccaccccccaagaggaaatgtgtctgagtag

SEQ ID NO: 177106 - DNA, 264 bp, Artificial Sequence
  Description of Artificial Sequence: Synthetic coding sequence
atggaggagagcaagaccctgaagtctgagaaccacgagcccaagaagaatgtcatctgtgaggagagcaaggctgtgcaggtgattggcaaccagaccctgaaggccagaaatgacaagtctgtgaaggagattgagaacagcagccccaacagaaacagcagcaagaagaacaagcagaatgacatctgcatcgagaagacagaggtgaagagctgcaaggtgaatgctgccaacctgcccggccccaaggacctgggctag

SEQ ID NO: 177107 - DNA, 234 bp, Artificial Sequence
  Description of Artificial Sequence: Synthetic coding sequence
atggaggagagcaagaccctgaagtctgagaaccacgagcccaagaagaatgtcatctgtgaggagagcaaggctgtgcaggtgattggcaaccagaccctgaaggccagaaatgacaagtctgtgaaggagattgagaacagcagccccaacagaaacagcagcaagaagaacaagcagaatgacatctgcatcgagaagacagaggtgaagagctgcaaggtgaatgcctag

SEQ ID NO: 177108 - DNA, 1209 bp, Artificial Sequence
  Description of Artificial Sequence: Synthetic coding sequence
atggccagcatcatcgcccgggtgggcaacagccggcggctgaatgcccccctgcccccctgggcccacagcatgctgcggagcctgggccgcagcctgggccccatcatggcctccatggctgacaggaacatgaagctgttcagcggccgggtggtgcctgcccagggcgaggagacctttgagaactggctgacccaggtgaatggagtgctgcctgactggaacatgtctgaggaggagaagctgaagaggctgatgaagaccctgcggggccctgcccgggaggtgatgagggtgctgcaggccaccaaccccaacctgtctgtggccgacttcctgcgggccatgaagctggtgtttggagagagcgagagctctgtgacagcccacggcaagttcttcaacaccctgcaggcccagggcgagaaggccagcctgtatgtgatccggctggaggtgcagctgcagaatgccatccaggccggcatcatcgccgagaaggatgccaacagaacccggctgcagcagctgctgctgggcggggagctgagccgggacctgcggctgcggctgaaggacttcctgaggatgtatgccaatgagcaggagcggctgcccaacttcctggagctgatccgcatggtgcgggaggaggaggactgggatgatgccttcatcaagaggaagaggcccaagaggtctgagagcatggtggagagagctgtgtcccctgtggccttccagggcagcccccccatcgtcatcggcagcgctgactgcaacgtcatcgagattgatgacaccctggatgacagtgatgaagatgtgatcctggtggagagccaggacccccccctgcccagctggggcgccccacccctgcgggaccgggcccggccccaggatgaggtgctggtgattgacagcccccacaacagccgggcccagttccccagcaccagcggcggcagcggctacaagaacaacggccctggagagatgaggcgggccaggaagaggaagcacaccatccgctgcagctactgtggggaggagggccacagcaaggagacctgtgacaatgaaagtgacaaggcccaggtgtttgaaaatctcatcatcaccctgcaggagctgacccacacagagatggagaggagccgggtggcccctggagagtacaatgacttcagcgagcccctgtag

SEQ ID NO: 177109 - DNA, 1542 bp, Artificial Sequence
  Description of Artificial Sequence: Synthetic coding sequence
atggccgccagcagaaatggatttgaggccgtggaggccgagggcagcgctggctgccggggcagcagcggcatggaggtggtgctgcccctggaccctgctgtgcctgcccccctgtgcccccacggccccaccctgctgtttgtgaaggtgacccagggcaaggaggagacccggcgcttctacgcctgcagcgcctgccgggacaggaaggactgcaacttcttccagtgggaggatgagaagctgagcggggcccggctggccgcccgggaggcccacaacagacgctgccagccccccctgagcaggacccagtgtgtggagcgctacctgaagttcatcgagctgcccctgacccagaggaagttctgccagacctgccagcagctgctgctgcctgatgactggggccagcacagcgagcaccaggtgctgggcaatgtgtccatcacccagctgcggcggcccagccagctgctgtaccccctggagaacaagaagaccaatgcccagtacctgtttgctgacaggagctgccagttcctggtggacctgctgagcgccctgggcttcagaagagtgctgtgtgtgggcaccccccggctgcacgagctgatcaagctgacagccagcggggacaagaagagcaacatcaagagcctgctgctggacatcgacttccgctacagccagttctacatggaggacagcttctgccactacaacatgttcaaccaccacttctttgatggcaagacagccctggaggtgtgccgggccttcctgcaggaggacaagggggagggcatcatcatggtgacagatcctccatttggaggcctggtggagcccctggccatcaccttcaagaagctgattgccatgtggaaggagggccagagccaggatgacagccacaaggagctgcccatcttctggatcttcccctacttctttgagagccgcatctgccagttcttccccagcttccagatgctggactaccaggtggactatgacaaccacgccctgtacaagcacggcaagacaggcaggaagcagagccctgtgcgcatcttcaccaacatcccccccaacaagatcatcctgcccacagaggagggctaccgcttctgcagcccctgccagcgctacgtgtccctggagaaccagcactgtgagctgtgcaacagctgcaccagcaaggatggcaggaagtggaaccactgcttcctgtgcaagaagtgtgtgaagcccagctggatccactgcagcatctgcaaccactgtgctgtgcctgaccacagctgtgagggccccaagcacggctgcttcatctgtggggagctggaccacaagaggagcacctgccccaacatcgccaccagcaagagggccaacaaggctgtgaggaagcagaagcagaggaagagcaacaagatgaagatggagaccaccaagggccagagcatgaaccacaccagcgccaccaggaggaagaagagaagagagcgggcccaccagtacctgggcagctag

SEQ ID NO: 177110 - DNA, 384 bp, Artificial Sequence
  Description of Artificial Sequence: Synthetic coding sequence
atggaggtggtgctgcccctggaccctgctgtgcctgcccccctgtgcccccacggccccaccctgctgtttgtgaaggtgacccagggcaaggaggagacccggcgcttctacgcctgcagcgcctgccgggacaggaaggactgcaacttcttccagtgggaggatgagaagctgagcggggcccggctggccgcccgggaggcccacaacagacgctgccagccccccctgagcaggacccagtgtggccgctacctgaagttcatcgagctgcccctgacccagaggaagttctgccagacctgccagcagctgctgctgcctgatgactggggccagcacagcgagcaccagttctgggtgtgtgtgatcaccagctag

SEQ ID NO: 177111 - DNA, 1479 bp, Artificial Sequence
  Description of Artificial Sequence: Synthetic coding sequence
atggtgatcctgctgctgcagcacggggctgaccccaccctgattgatggagagggcttcagcagcatccacctggccgtgctcttccagcacatgcccatcatcgcctacctgatcagcaagggccagagcgtgaacatgacagatgtgaatggccagacccccctgatgctgagcgcccacaaggtgattggccctgagcccaccggcttcctgctgaagttcaaccccagcctgaatgtggtggacaagatccaccagaacacccccctgcactgggccgtggccgctggaaatgtgaatgctgtggacaagctgctggaggccggcagcagcctggacatccagaatgtgaagggggagacccccctggacatggccctgcagaacaagaaccagctgatcatccacatgctgaagacagaggccaagatgagggccaaccagaagttccggctgtggcgctggctgcagaagtgtgagctgttcctgctgctgatgctgagcgtcatcaccatgtgggccatcggctacatcctggacttcaacagcgacagctggctgctgaagggctgcctgctggtgaccctcttcttcctgaccagcctcttcccccgcttcctggtgggctacaagaacctggtgtacctgcccacagccttcctgctgagctctgtgttctggatcttcatgacctggttcatcctcttcttcccagacctggccggggcccccttctacttctccttcatcttcagcatcgtggccttcctgtacttcttctacaagacctgggccacagatcctggcttcaccaaggccagcgaggaggagaagaaggtgaacatcatcaccctggccgagaccggcagcctggacttccgcaccttctgcaccagctgcctgatcaggaagcccctgcggagcctgcactgccacgtgtgcaactgctgcgtggcccgctatgaccagcactgcctgtggacaggccgctgcattggatttggaaaccaccactactacatcttcttcctgttcttcctgtccatggtgtgtggctggatcatctacggcagcttcatctacctgagcagccactgtgccaccaccttcaaggaggatggcctgtggacctacctgaaccagatcgtggcctgcagcccctgggtgctgtacatcctgatgctggccaccttccacttctcctggagcaccttcctgctgctgaaccagctgttccagatcgccttcctgggcctgaccagccatgagcgcatcagcctgcagaagcagagcaagcacatgaagcagaccctgagcctgaggaagaccccctacaacctgggcttcatgcagaacctggccgacttcttccagtgtggctgcttcggcctggtgaagccctgtgtggtggactggaccagccagtacaccatggtgttccacccagcccgggagaaggtgctgcggtctgtgtag

SEQ ID NO: 177112 - DNA, 1869 bp, Artificial Sequence
  Description of Artificial Sequence: Synthetic coding sequence
atggagggccctggcctgggcagccagtgcaggaaccacagccacggcccccaccccccaggcttcggccgctatggcatctgtgcccacgagaacaaggagctggccaatgcccgggaggccctgcccctgattgaggacagcagcaactgtgacatcgtgaaggccacccagtatggcatctttgagcgctgcaaggagctggtggaggccggctatgatgtgcggcagcctgacaaggaaaatgtgtccctgctgcactgggccgccatcaacaaccggctggacctggtgaagttctacatcagcaaaggagctgtggtggaccagctgggcggggacctgaacagcacccccctgcactgggccatccggcagggccacctgcccatggtgatcctgctgctgcagcacggggctgaccccaccctgattgatggagagggcttcagcagcatccacctggccgtgctcttccagcacatgcccatcatcgcctacctgatcagcaagggccagagcgtgaacatgacagatgtgaatggccagacccccctgatgctgagcgcccacaaggtgattggccctgagcccaccggcttcctgctgaagttcaaccccagcctgaatgtggtggacaagatccaccagaacacccccctgcactgggccgtggccgctggaaatgtgaatgctgtggacaagctgctggaggccggcagcagcctggacatccagaatgtgaagggggagacccccctggacatggccctgcagaacaagaaccagctgatcatccacatgctgaagacagaggccaagatgagggccaaccagaagttccggctgtggcgctggctgcagaagtgtgagctgttcctgctgctgatgctgagcgtcatcaccatgtgggccatcggctacatcctggacttcaacagcgacagctggctgctgaagggctgcctgctggtgaccctcttcttcctgaccagcctcttcccccgcttcctggtgggctacaagaacctggtgtacctgcccacagccttcctgctgagctctgtgttctggatcttcatgacctggttcatcctcttcttcccagacctggccggggcccccttctacttctccttcatcttcagcatcgtggccttcctgtacttcttctacaagacctgggccacagatcctggcttcaccaaggccagcgaggaggagaagaaggtgaacatcatcaccctggccgagaccggcagcctggacttccgcaccttctgcaccagctgcctgatcaggaagcccctgcggagcctgcactgccacgtgtgcaactgctgcgtggcccgctatgaccagcactgcctgtggacaggccgctgcattggatttggaaaccaccactactacatcttcttcctgttcttcctgtccatggtgtgtggctggatcatctacggcagcttcatctacctgagcagccactgtgccaccaccttcaaggaggatggcctgtggacctacctgaaccagatcgtggcctgcagcccctgggtgctgtacatcctgatgctggccaccttccacttctcctggagcaccttcctgctgctgaaccagctgttccagatcgccttcctgggcctgaccagccatgagcgcatcagcctgcagaagcagagcaagcacatgaagcagaccctgagcctgaggaagaccccctacaacctgggcttcatgcagaacctggccgacttcttccagtgtggctgcttcggcctggtgaagccctgtgtggtggactggaccagccagtacaccatggtgttccacccagcccgggagaaggtgctgcggtctgtgtag

SEQ ID NO: 177113 - DNA, 564 bp, Artificial Sequence
  Description of Artificial Sequence: Synthetic coding sequence
atgaggcggggctggaagatggccctgagcggcggcctgcgctgctgcagaagagtgctgtcctgggtgcctgtgctggtgattgtgctggtggtgctgtggagctactatgcctacgtgtttgagctgtgcctggtgacagtgctgagccctgctgagaaggtgatctacctgatcctgtaccacgccatctttgtgttcttcacctggacctactggaagagcatcttcaccctgccccagcagcccaaccagaagttccacctgagctacacagacaaggagagatatgaaaatgaggagaggcctgaggtgcagaagcagatgctggtggacatggccaagaagctgcctgtgtacaccaggactggaagtggagctgtgcgcttctgtgaccgctgccacctgatcaagccagaccgctgccaccactgcagcgtgtgtgccatgtgtgtgctgaagatggaccaccactgcccctggggcaactaccctgtgtttgccctgagctccatgtccttcttcttcagcctgtggccagcctgcttcctgagcgccctgtag

SEQ ID NO: 177114 - DNA, 1014 bp, Artificial Sequence
  Description of Artificial Sequence: Synthetic coding sequence
atgaggcggggctggaagatggccctgagcggcggcctgcgctgctgcagaagagtgctgtcctgggtgcctgtgctggtgattgtgctggtggtgctgtggagctactatgcctacgtgtttgagctgtgcctggtgacagtgctgagccctgctgagaaggtgatctacctgatcctgtaccacgccatctttgtgttcttcacctggacctactggaagagcatcttcaccctgccccagcagcccaaccagaagttccacctgagctacacagacaaggagagatatgaaaatgaggagaggcctgaggtgcagaagcagatgctggtggacatggccaagaagctgcctgtgtacaccaggactggaagtggagctgtgcgcttctgtgaccgctgccacctgatcaagccagaccgctgccaccactgcagcgtgtgtgccatgtgtgtgctgaagatggaccaccactgcccctgggtgaacaactgcatcggcttcagcaactacaagttcttcctgcagttcctggcctacagcgtgctgtactgcctgtacatcgccaccaccgtcttctcctacttcatcaagtactggagaggagagctgcccagcgtgcgcagcaagttccacgtgctcttcctgctgtttgtggcctgcatgttctttgtgtccctggtgatcctgtttggctaccactgctggctggtgtccaggaacaagaccaccctggaggccttctgcacccctgtgttcaccagcggccctgagaagaatggcttcaacctgggcttcatcaagaacatccagcaggtgtttggagacaagaagaagttctggctgatccccatcggcagcagccctggagatggccacagcttccccatgaggtccatgaatgaaagccagaaccccctgctggccaatgaggagacctgggaggacaatgaagatgacaaccaggactacccagagggcagcagcagcctggccgtggagacagagacctag

SEQ ID NO: 177115 - DNA, 987 bp, Artificial Sequence
  Description of Artificial Sequence: Synthetic coding sequence
atgaggcggggctggaagatggccctgagcggcggcctgcgctgctgcagaagagtgctgtcctgggtgcctgtgctggtgattgtgctggtggtgctgtggagctactatgcctacgtgtttgagctgtgcctggtgatctacctgatcctgtaccacgccatctttgtgttcttcacctggacctactggaagagcatcttcaccctgccccagcagcccaaccagaagttccacctgagctacacagacaaggagagatatgaaaatgaggagaggcctgaggtgcagaagcagatgctggtggacatggccaagaagctgcctgtgtacaccaggacaggcagcggggctgtgcgcttctgtgaccgctgccacctgatcaagccagaccgctgccaccactgcagcgtgtgtgccatgtgtgtgctgaagatggaccaccactgcccctgggtgaacaactgcatcggcttcagcaactacaagttcttcctgcagttcctggcctacagcgtgctgtactgcctgtacatcgccaccaccgtcttctcctacttcatcaagtactggagaggagagctgcccagcgtgcgcagcaagttccacgtgctcttcctgctgtttgtggcctgcatgttctttgtgtccctggtgatcctgtttggctaccactgctggctggtgtccaggaacaagaccaccctggaggccttctgcacccctgtgttcaccagcggccctgagaagaatggcttcaacctgggcttcatcaagaacatccagcaggtgtttggagacaagaagaagttctggctgatccccatcggcagcagccctggagatggccacagcttccccatgaggtccatgaatgaaagccagaaccccctgctggccaatgaggagacctgggaggacaatgaagatgacaaccaggactacccagagggcagcagcagcctggccgtggagacagagacctag

SEQ ID NO: 177116 - DNA, 2022 bp, Artificial Sequence
  Description of Artificial Sequence: Synthetic coding sequence
atgcccaggagccctggcacccggctgaagccagccaagtacatccctgtggccacagctgctgccctgctggtgggcagcagcaccctcttctttgtgttcacctgcccctggctgaccagggctgtgtccccagctgtgcctgtgtacaacggcatcatcttcctgtttgtgctggccaacttctccatggccaccttcatggaccccggggtcttccccagggcagatgaagatgaggacaaggaggatgacttccgggcccccctgtacaagaatgtggatgtgcggggcatccaggtgaggatgaagtggtgtgccacctgccacttctaccggcccccacgctgcagccactgcagcgtgtgtgacaactgtgtggaggtgacaggcaagttccggggcggcgtgaaccccttcacccggggctgctgcggaaatgtggagcacgtgctgtgcagccccctggccccccgctacgtggtggagcccccccggctgcccctggccgtgtccctgaagccacccttcctgcggcctgagctgctggaccgggccgcccccctgaaggtgaagctgagtgacaatggcctgaaggccggcctgggccgcagcaagagcaagggcagcctggaccggctggatgagaagcccctggacctgggcccccccctgccccccaagattgaagctggcaccttcagcagtgacctgcagacccccaggcctggcagcgctgagagcgccctgtctgtgcagaggaccagcccccccaccccagccatgtacaagttccggcctgccttccccaccggccccaaggtgcccttctgtggccctggagagcaggtgcccggccctgacagcctgaccctgggagatgacagcatccgcagcctggactttgtgtctgagcccagcctggacctgcctgactatggccctgggggcctgcacgccgcctacccacccagcccccccctgagcgccagtgatgccttcagcggggccctgcggagcctgagcctgaaggccagcagccggcggggcggggaccacgtggccctgcagcccctgcggtctgagggcggcccccccaccccccacaggagcatctttgccccccacgccctgcccaacagaaatggcagcctgtcctatgacagcctgctgaaccctggcagccctgggggccacgcctgcccagcccaccctgctgtgggcgtggccggctaccacagcccctacctgcaccctggggccaccggggaccccccccggcccctgcccaggagcttcagccctgtgctgggcccccggccccgggagcccagccctgtgcgctatgacaacctgagcaggaccatcatggccagcatccaggagaggaaggaccgggaggagcgggagcggctgctgcggagccaggccgacagcctgtttggagacagcggcgtgtatgatgcccccagcagctacagcctgcagcaggcctctgtgctgtctgagggcccccggggccctgccctgcgctatggcagcagagatgacctggtggccggccctggctttggaggagccaggaacccagccctgcagaccagcctgagcagcctgagcagctctgtgtcccgggcccccaggaccagcagcagcagcctgcaggccgaccaggccagcagcaatgcccctggcccccggcccagcagcggcagccacaggagccctgcccggcagggcctgcccagccccccaggcaccccccacagccccagctatgccggccccaaggctgtggccttcatccacacagacctgcctgagcccccacccagcctgactgtgcagagggaccacccccagctgaagaccccacccagcaagctgaatggccagagccctggcctggcccggctgggccctgccactggacctcctggccccagcgccagccccaccaggcacaccctggtgaagaaggtgtctggagtgggcggcaccacctatgagatctctgtgtag

SEQ ID NO: 177117 - DNA, 2298 bp, Artificial Sequence
  Description of Artificial Sequence: Synthetic coding sequence
atgcccaggagccctggcacccggctgaagccagccaagtacatccctgtggccacagctgctgccctgctggtgggcagcagcaccctcttctttgtgttcacctgcccctggctgaccagggctgtgtccccagctgtgcctgtgtacaacggcatcatcttcctgtttgtgctggccaacttctccatggccaccttcatggaccccggggtcttccccagggcagatgaagatgaggacaaggaggatgacttccgggcccccctgtacaagaatgtggatgtgcggggcatccaggtgaggatgaagtggtgtgccacctgccacttctaccggcccccacgctgcagccactgcagcgtgtgtgacaactgtgtggaggactttgaccaccactgcccctgggtgaacaactgcattggaagaagaaactaccgctacttcttcctgttcctgctgagcctgagcgcccacatggtgggcgtggtggccttcggcctggtgtatgtgctgaaccacgccgagggcctgggcgccgcccacaccaccatcaccatggctgtgatgtgtgtggccggcctcttcttcatccctgtgattggcctgaccggcttccacgtggtgctggtgacccggggccgcaccaccaatgagcaggtgacaggcaagttccggggcggcgtgaaccccttcacccggggctgctgcggaaatgtggagcacgtgctgtgcagccccctggccccccgctacgtggtggagcccccccggctgcccctggccgtgtccctgaagccacccttcctgcggcctgagctgctggaccgggccgcccccctgaaggtgaagctgagtgacaatggcctgaaggccggcctgggccgcagcaagagcaagggcagcctggaccggctggatgagaagcccctggacctgggcccccccctgccccccaagattgaagctggcaccttcagcagtgacctgcagacccccaggcctggcagcgctgagagcgccctgtctgtgcagaggaccagcccccccaccccagccatgtacaagttccggcctgccttccccaccggccccaaggtgcccttctgtggccctggagagcaggtgcccggccctgacagcctgaccctgggagatgacagcatccgcagcctggactttgtgtctgagcccagcctggacctgcctgactatggccctgggggcctgcacgccgcctacccacccagcccccccctgagcgccagtgatgccttcagcggggccctgcggagcctgagcctgaaggccagcagccggcggggcggggaccacgtggccctgcagcccctgcggtctgagggcggcccccccaccccccacaggagcatctttgccccccacgccctgcccaacagaaatggcagcctgtcctatgacagcctgctgaaccctggcagccctgggggccacgcctgcccagcccaccctgctgtgggcgtggccggctaccacagcccctacctgcaccctggggccaccggggaccccccccggcccctgcccaggagcttcagccctgtgctgggcccccggccccgggagcccagccctgtgcgctatgacaacctgagcaggaccatcatggccagcatccaggagaggaaggaccgggaggagcgggagcggctgctgcggagccaggccgacagcctgtttggagacagcggcgtgtatgatgcccccagcagctacagcctgcagcaggcctctgtgctgtctgagggcccccggggccctgccctgcgctatggcagcagagatgacctggtggccggccctggctttggaggagccaggaacccagccctgcagaccagcctgagcagcctgagcagctctgtgtcccgggcccccaggaccagcagcagcagcctgcaggccgaccaggccagcagcaatgcccctggcccccggcccagcagcggcagccacaggagccctgcccggcagggcctgcccagccccccaggcaccccccacagccccagctatgccggccccaaggctgtggccttcatccacacagacctgcctgagcccccacccagcctgactgtgcagagggaccacccccagctgaagaccccacccagcaagctgaatggccagagccctggcctggcccggctgggccctgccactggacctcctggccccagcgccagccccaccaggcacaccctggtgaagaaggtgtctggagtgggcggcaccacctatgagatctctgtgtag

SEQ ID NO: 177118 - DNA, 2337 bp, Artificial Sequence
  Description of Artificial Sequence: Synthetic coding sequence
atgcccaggagccctggcacccggctgaagccagccaagtacatccctgtggccacagctgctgccctgctggtgggcagcagcaccctcttctttgtgttcacctgcccctggctgaccagggctgtgtccccagctgtgcctgtgtacaacggcatcatcttcctgtttgtgctggccaacttctccatggccaccttcatggaccccggggtcttccccagggcagatgaagatgaggacaaggaggatgacttccgggcccccctgtacaagaatgtggatgtgcggggcatccaggtgaggatgaagtggtgtgccacctgccacttctaccggcccccacgctgcagccactgcagcgtgtgtgacaactgtgtggaggactttgaccaccactgcccctgggtgaacaactgcattggaagaagaaactaccgctacttcttcctgttcctgctgagcctgagcgcccacatggtgggcgtggtggccttcggcctggtgtatgtgctgaaccacgccgagggcctgggcgccgcccacaccaccatcaccatggctgtgatgtgtgtggccggcctcttcttcatccctgtgattggcctgaccggcttccacgtggtgctggtgacccggggccgcaccaccaatgagcaggtgacaggcaagttccggggcggcgtgaaccccttcacccggggctgctgcggaaatgtggagcacgtgctgtgcagccccctggccccccgctacgtggtggagcccccccggctgcccctggccgtgtccctgaagccacccttcctgcggcctgagctgctggaccgggccgcccccctgaaggtgaagctgagtgacaatggcctgaaggccggcctgggccgcagcaagagcaagggcagcctggaccggctggatgagaagcccctggacctgggcccccccctgccccccaagattgaagctggcaccttcagcagtgacctgcagacccccaggcctggcagcgctgagagcgccctgtctgtgcagaggaccagcccccccaccccagccatgtacaagttccggcctgccttccccaccggccccaaggtgcccttctgtggccctggagagcaggtgcccggccctgacagcctgaccctgggagatgacagcatccgcagcctggactttgtgtctgagcccagcctggacctgcctgactatggccctgggggcctgcacgccgcctacccacccagcccccccctgagcgccagtgatgccttcagcggggccctgcggagcctgagcctgaaggccagcagccggcggggcggggaccacgtggccctgcagcccctgcggtctgagggcggcccccccaccccccacaggagcatctttgccccccacgccctgcccaacagaaatggcagcctgtcctatgacagcctgctgaaccctggcagccctgggggccacgcctgcccagcccaccctgctgtgggcgtggccggctaccacagcccctacctgcaccctggggccaccggggaccccccccggcccctgcccaggagcttcagccctgtgctgggcccccggccccgggagcccagccctgtgcgctatgacaacctgagcaggaccatcatggccagcatccaggagaggaaggaccgggaggagcgggagcggctgctgcggagccaggccgacagcctgtttggagacagcggcgtgtatgatgcccccagcagctacagcctgcagcaggcctctgtgctgtctgagggcccccggggccctgccctgcgctatggcagcagagatgacctggtggccggccctggctttggaggagccaggaacccagccctgcagaccagcctgagcagcctgagcagctctgtgtcccgggcccccaggaccagcagcagcagcctgcaggccgaccaggccagcagcaatgcccctggcccccggcccagcagcggcagccacaggagccctgcccggcagggcctgcccagccccccaggcaccccccacagccccagctatgccggccccaaggctgtggccttcatccacacagacctgcctgagcccccacccagcctgactgtgcagaggggccgcatcggcacctgcacccggggctggggcagaagaggccagccctgggtgcccccaggcctgcacctgtgccacctgggccggcctgaggacaggcctcccctgcgggccccctggagccaggccgccggggccccacccaggggggccatgtgccgcctgcacctggccgccagcagcctcttccccagcctgagcggcccctag

SEQ ID NO: 177119 - DNA, 1095 bp, Artificial Sequence
  Description of Artificial Sequence: Synthetic coding sequence
atgtctgtgatggtggtgaggaagaaggtgaccaggaagtgggagaagctgcccggcaggaacaccttctgctgtgatggccgggtgatgatggcccggcagaagggcatcttctacctgaccctcttcctgatcctgggcacctgcaccctcttctttgcctttgagtgccgctacctggccgtgcagctgagccctgccatccctgtgtttgctgccatgctgttcctgttctccatggccaccctgctgcggaccagcttcagtgaccccggggtcatcccccgggccctgcctgatgaggccgccttcatcgagatggagattgaggccaccaatggagctgtgccccagggccagaggcccccaccccgcatcaagaacttccagatcaacaaccagatcgtgaagctgaagtactgctacacctgcaagatcttccggcccccccgggccagccactgcagcatctgtgacaactgtgtggagagatttgaccaccactgcccctgggtgggcaactgtgtgggcaagaggaactaccgctacttctacctgttcatcctgagcctgagcctgctgaccatctacgtgtttgccttcaacatcgtgtatgtggccctgaagagcctgaagattggcttcctggagaccctgaaggagaccccaggcaccgtgctggaggtgctgatctgcttcttcaccctgtggagcgtggtgggcctgaccggcttccacaccttcctggtggccctgaaccagaccaccaatgaagacatcaagggctcctggacaggcaagaacagagtgcagaacccctacagccacggcaacatcgtgaagaactgctgtgaggtgctgtgtggccccctgccccccagcgtgctggaccggcggggcatcctgcccctggaggagagcggcagcaggcctcccagcacccaggagaccagcagcagcctgctgccccagagccctgcccccacagagcacctgaacagcaatgagatgcctgaggacagcagcaccccagaggagatgcctcctcctgagcccccagagcccccccaggaggccgctgaggccgagaagtag

SEQ ID NO: 177120 - DNA, 1095 bp, Artificial Sequence; identical to SEQ ID NO: 177119
  Description of Artificial Sequence: Synthetic coding sequence

SEQ ID NO: 177121 - DNA, 513 bp, Artificial Sequence
  Description of Artificial Sequence: Synthetic coding sequence
atgtctgtgatggtggtgaggaagaaggtgaccaggaagtgggagaagctgcccggcaggaacaccttctgctgtgatggccgggtgatgatggcccggcagaagggcatcttctacctgaccctcttcctgatcctgggcacctgcaccctcttctttgcctttgagtgccgctacctggccgtgcagctgagccctgccatccctgtgtttgctgccatgctgttcctgttctccatggccaccctgctgcggaccagcttcagtgaccccggggtcatcccccgggccctgcctgatgaggccgccttcatcgagatggagattgaggccaccaatggagctgtgccccagggccagaggcccccaccccgcatcaagaacttccagatcaacaaccagatcgtgaagctgaagtactgctacacctgcaagatcttccggcccccccgggccagccactgcagcatctgtgacaactgtgtggagagatttgaccaccactgcccctag

SEQ ID NO: 177122 - DNA, 585 bp, Artificial Sequence
  Description of Artificial Sequence: Synthetic coding sequence
tgactcttcctgatcctgggcacctgcaccctcttctttgcctttgagtgccgctacctggccgtgcagctgagccctgccatccctgtgtttgctgccatgctgttcctgttctccatggccaccctgctgcggaccagcttcagtgaccccggggtcatcccccgggccctgcctgatgaggccgccttcatcgagatggagattgaggccaccaatggagctgtgccccagggccagaggcccccaccccgcatcaagaacttccagatcaacaaccagatcgtgaagctgaagtactgctacacctgcaagatcttccggcccccccgggccagccactgcagcatctgtgacaactgtgtggagagcctgaagattggcttcctggagaccctgaaggagaccccaggcaccgtgctggaggtgctgatctgcttcttcaccctgtggagcgtggtgggcctgaccggcttccacaccttcctggtggccctgaaccagaccaccaatgaagacatcaagggctcctggacaggcaagaacagagtgcagaacccctacagccacggcaacatcgtgtag

SEQ ID NO: 177123 - DNA, 897 bp, Artificial Sequence
  Description of Artificial Sequence: Synthetic coding sequence
atggagcggggcatcagtgatgtgacagacaggaagctgaccatggaggaggaggaggccaagagaattgctgagatgggcaagcctgtgctgggggagcaccccaagctggaggtgatcatcgaggagagctatgagttcaagaccaccgtggacaagctgatcaagaagaccaacctggccctggtggtgggcacccacagctggagggaccagttcatggaggccatcaccgtgtctgctgctggagatgaagatgaagatgagagcggggaggagcggctgcccagctgctttgattatgtgatgcacttcctgactgtgttctggaaggtgctgtttgcctgtgtgcccccaacagagtactgccacggctgggcctgctttgctgtgtccatcctgatcatcggcatgctgacagccatcattggagacctggccagccacttcggctgcaccatcggcctgaaggacagcgtgacagctgtggtgtttgtggccttcggcacctctgtgcctgacacctttgccagcaaggctgctgccctgcaggatgtgtatgcagatgccagcattggaaatgtgacaggcagcaatgctgtgaatgtgttcctgggcatcggcctggcctggagcgtggccgccatctactgggccctgcagggccaggagttccacgtgtctgctggcaccctggccttctctgtgaccctcttcaccatctttgcctttgtgtgcatctctgtgctgctgtacagaagaagaccccacctgggcggggagctgggcggcccccggggctgcaagctggccaccacctggctgtttgtgtccctgtggctgctgtacatcctgtttgccaccctggaggcctactgctacatcaagggcttctag

SEQ ID NO: 177124 - DNA, 705 bp, Artificial Sequence
  Description of Artificial Sequence: Synthetic coding sequence
atgagcagcgaggtgtctgccaggagagatgccaagaagctggtgcgcagccccagcggcctgaggatggtgcctgagcaccgggccttcggcagccccttcggcctggaggagccccagtgggtgcctgacaaggagtgccgccgctgcatgcagtgtgatgccaagtttgacttcctgaccaggaagcaccactgcagaagatgtgggaagtgcttctgtgaccgctgctgcagccagaaggtgcccctgcggaggatgtgctttgtggaccctgtgcggcagtgtgccgagtgtgccctggtgtccctgaaggaggccgagttctatgacaagcagctgaaggtgctgctgagcggggccaccttcctggtgacctttggaaacagcgagaagccagagaccatgacctgccgcctgagcaacaaccagcgctacctgttcctggatggagacagccactatgaaattgaaattgtgcacatcagcacagtgcagatcctgacagagggcttccccccaggcggcggcaatgcccgggccaccggcatgttcctgcagtacacagtgcctggaacagaaggagtgacccagctgaagctgactgtggtggaggatgtgacagtgggccggcggcaggccgtggcctggctggtggccatgcacaaggccgccaagctgctgtatgagagccgggaccagtag

SEQ ID NO: 177125 - DNA, 7620 bp, Artificial Sequence
  Description of Artificial Sequence: Synthetic coding sequence
atgaaccacccctttgggaaggaggaggccgccagccagaagcagctgtttggcttcttctgtgagtgcctgcggcggggggagtgggagctggcccaggcctgtgtgccccagctgcaggagggccagggcgacatccccaagagggtggaggacatcctgcaggccctggtggtgtgccccaacctgctgcgctgtggccaggacatcaacccccagagggtggcctgggtgtggctgctggtgctggagaagtggctggcccgggagaagaagctgctgcctgtggtgttccggaggaagctggagttcctgctgctgtctgaggacctgcagggcgacatccctgagaacatcctggaggagctgtatgagaccctgacccagggcgctgtgggccacgtgcctgatggcaacccccggcgggagagctggaccccccggctgagcagcgaggccgtgtctgtgctgtgggacctgctgcggcagagcccccagcctgcccaggccctgctggagctgctgctggaggaggatgatggcaccggcctgtgccactggcccctgcagaatgccctggtggacctgatcaggaaggccctgcgggccctgcagggcccagattctgtgcccccaggagtggtggatgccatctatggagccctgcggaccctgcgctgcccagctgagcccctgggcgtggagctgcacctgctgtgtgaggagctgctggaggcctgcaggacagagggcagccccctgcgggaggagcggctgctgagctgcctgctgcacaaggccagccggggcctgctgagcctgtatggccacacctacgccgagaaggtgacagagaagccaccccgggccacagccagcggcaaggtgtccccagaccacctggaccctgagcgggccatgctggccctcttcagcaaccccaacccagctgaggcctggaaggtggcctacttctactgcctgagcaacaacaagcacttcctggagcagatcctggtgacagccctgaccctgctgaaggaggaggacttccccaacctgggctgcctgctggaccgggagttccggcccctgagctgcctgctggtgctgctgggctggacccactgccagagcctggagagcgccaagaggctgctgcagaccctgcacaggacccagggccctggctgtgatgagctgctgagagatgcctgtgatggcctgtgggcccacctggaggtgctggagtggtgcatccagcagagcagcaaccccatccccaagagggacctgctgtaccacctgcatggaggagacagccacagcgtgctgtacaccctgcaccacctgaccaacctgcctgccctgcgggaggaggatgtgctgaagctgctgcagaaggtgcctgccaaggacccccagcaggagccagatgctgtggatgcccctgtgcctgagcacctgagccagtgccagaacctgaccctgtaccagggcttctgtgccatgaagtatgccatctatgccctgtgtgtgaacagccaccagcacagccagtgccaggactgcaaggacagcctgtctgaggacctggccagcgccacagagcccgccaatgacagcctgagcagccctggggccgccaacctcttcagcacctacctggcccgctgccagcagtacctgtgcagcatcccagacagcctgtgcctggagctgctggagaacatcttcagcctgctgctgatcaccagcgctgacctgcaccctgagccccacctgcctgaagattatgcagaagatgatgacatcgagggcaagagccccagcggcctgcggagccccagcgagagcccccagcacatcgcccaccctgagaggaagtctgagcggggcagcctgggcgtgcccaagaccctggcctacaccatgcccagccacgtgaaggccgagcccaaggacagctacccaggcccccaccgccacagcttcctggacctgaagcacttcaccagcggcatcagcggcttcctggctgatgaatttgccatcggggccttcctgcggctgctgcaggagcagctggatgagatcagcagccgcagccccccagagaagcccaagcaggagagccagagctgcagcggcagcagagatggcctgcagagccggctgcaccggctgagcaaggtggtgtctgaggcccagtggaggcacaaggtggtgaccagcaaccacaggtctgaggagcagcccagccgccgctaccagcctgccaccaggcaccccagcctgcggcggggccgccgcaccaggaggagccaggctgatggccgggaccggggcagcaaccccagcctggagagcaccagcagcgagctgagcaccagcaccagcgagggcagcctgagcgccatgagcggcagaaatgagctgcacagccggctgcacccccacccccagagcagcctcatccccatgatgttcagccccccagagagcctgctggccagctgcatcctgcggggcaactttgctgaggcccaccaggtgctcttcaccttcaacctgaagagcagccccagcagcggggagctgatgttcatggagcgctaccaggaggtgatccaggagctggcccaggtggagcacaagattgagaaccagaacagtgatgctggcagcagcaccatccggaggacaggcagcggccgcagcaccctgcaggccatcggcagcgctgctgctgctggcatggtgttctacagcatcagtgatgtgacagacaagctgctgaacaccagcggggaccccatccccatgctgcaggaggacttctggatcagcacagccctggtggagcccacagcccccctgcgggaggtgctggaggacctgagccccccagccatggccgcctttgacctggcctgcagccagtgccagctgtggaagacctgcaagcagctgctggagacagctgagcggcggctgaacagcagcctggagcggcggggcagaagaattgaccacgtgctgctgaatgctgatggcatccggggcttccctgtggtgctgcagcagatcagcaagagcctgaactacctgctgatgtctgccagccagaccaagtctgagagcgtggaggagaagggcggcggccccccacgctgcagcatcacagagctgctgcagatgtgctggcccagcctgtctgaggactgtgtggccagccacaccaccctgagccagcagctggaccaggtgctgcagagcctgcgggaggccctggagctgcctgagcccaggaccccacccctgagcagcctggtggagcaggccgcccagaaggcccctgaggccgaggcccaccctgtgcagatccagacccagctgctgcagaagaacctgggcaagcagacccccagcggcagccggcagatggactacctgggcaccttcttctcctactgcagcaccctggccgctgtgctgctgcagagcctgagcagcgagccagaccacgtggaggtgaaggtgggcaacccctttgtgctgctgcagcagagcagcagccagctggtgagccacctgctgtttgagcggcaggtgcccccagagcggctggccgccctgctggcccaggagaacctgagcctgtctgtgccccaggtgattgtgtcctgctgctgtgagcccctggccctgtgcagcagccggcagagccagcagaccagcagcctgctgacccggctgggcaccctggcccagctgcacgccagccactgcctggatgacctgcccctgagcacccccagcagccccaggaccacagagaaccccaccctggagaggaagccctacagcagcccccgggacagcagcctgcctgccctgaccagcagcgccctggccttcctgaagagccgcagcaagctgctggccaccgtggcctgcctgggcgccagcccccggctgaaggtgtccaagcccagcctgtcctggaaggagctgcggggccggcgggaggtgcccctggccgctgagcaggtggccagagaatgtgagcggctgctggagcagttccccctgtttgaggccttcctgctggccgcctgggagcccctgcggggcagcctgcagcagggccagagcctggccgtgaacctgtgtggctgggccagcctgagcacagtgctgctgggcctgcacagccccatcgccctggatgtgctgtctgaggcctttgaggagagcctggtggcccgggactggagccgggccctgcagctgacagaggtgtatggaagagatgtggatgacctgagcagcatcaaggatgctgtgctgagctgtgctgtggcctgtgacaaggagggctggcagtacctgtttcctgtgaaggatgccagcctgcggagccggctggccctgcagtttgtggaccgctggcccctggagagctgcctggagatcctggcctactgcatcagtgacacagctgtgcaggagggcctgaagtgtgagctgcagaggaagctggccgagctgcaggtgtaccagaagatcctgggcctgcagagcccccctgtgtggtgtgactggcagaccctgcggagctgctgcgtggaggaccccagcacagtgatgaacatgatcctggaggcccaggagtatgagctgtgtgaggagtggggctgcctgtaccccatcccccgggagcacctgatcagcctgcaccagaagcacctgctgcacctgctggagcggcgggaccatgacaaggccctgcagctgctgcggcgcatcccagaccccaccatgtgcctggaggtgacagagcagagcctggaccagcacaccagcctggccaccagccacttcctggccaactacctgaccacccacttctacggccagctgacagctgtgcgccaccgggagatccaggccctgtatgtgggcagcaagatcctgctgaccctgcctgagcagcaccgggccagctacagccacctgagcagcaaccccctcttcatgctggagcagctgctgatgaacatgaaggtggactgggccaccgtggccgtgcagaccctgcagcagctgctggtgggccaggagatcggcttcaccatggatgaggtggacagcctgctgagccgctatgcagagaaggccctggacttcccctacccccagcgggagaagagaagtgacagcgtcatccacctgcaggagatcgtgcaccaggccgctgaccctgagaccctgcccaggagccccagcgctgagttctccccagctgcccctcctggcatcagcagcatccacagccccagcctgcgggagaggagcttcccccccacccagcccagccaggagtttgtgcccccagccaccccaccagcccggcaccagtgggtgcctgatgaaacagagagcatctgcatggtgtgctgccgggagcacttcaccatgttcaacagaagacaccactgccgccgctgtggccgcctggtgtgcagcagctgcagcaccaagaagatggtggtggagggctgccgggagaacccagcccgggtgtgtgaccagtgctacagctactgcaacaaggatgtgcctgaggagcccagcgagaagccagaggccctggacagcagcaagaatgaaagccccccctacagctttgtggtgcgggtgcccaaggcagatgaggtggagtggatcctggacctgaaggaggaggagaatgagctggtgcgctctgagttctactatgagcaggcccccagcgccagcctgtgcatcgccatcctgaacctgcaccgggacagcatcgcctgtggccaccagctgattgagcactgctgccgcctgagcaagggcctgaccaaccctgaggtggatgctggcctgctgacagacatcatgaagcagctgctcttcagcgccaagatgatgtttgtgaaggccggccagagccaggacctggccctgtgtgacagctacatcagcaaggtggatgtgctgaacatcctggtggccgccgcctaccgccacgtgcccagcctggaccagatcctgcagcctgctgctgtgacccggctgaggaaccagctgctggaggccgagtactaccagctgggcgtggaggtgtccaccaagacaggcctggacaccactggagcctggcacgcctggggcatggcctgcctgaaggccggcaacctgacagctgcccgggagaagttcagccgctgcctgaagcccccatttgacctgaaccagctgaaccacggcagccggctggtgcaggatgtggtggagtacctggagagcacagtgcggccctttgtgtccctgcaggatgatgactactttgccaccctgcgggagctggaggccaccctgcggacccagagcctgagcctggccgtcatccctgagggcaagatcatgaacaacacctactaccaggagtgcctcttctacctgcacaactacagcaccaacctggccatcatctccttctacgtgcgccacagctgcctgcgggaggccctgctgcacctgctgaacaaggagagccccccagaggtgttcatcgagggcatcttccagcccagctacaagagcggcaagctgcacaccctggagaacctgctggagagcattgaccccaccctggagagctggggcaagtacctgattgctgcctgccagcacctgcagaagaagaactactaccacatcctgtatgagctgcagcagttcatgaaggaccaggtgcgggccgccatgacctgcatccgcttcttcagccacaaggccaagagctacacagagctgggggagaagctgtcctggctgctgaaggccaaggaccacctgaagatctacctgcaggagaccagccgcagcagcggcaggaagaagaccaccttcttcaggaagaagatgacagctgctgatgtgagccgccacatgaacaccctgcagctgcagatggaggtgacccgcttcctgcaccgctgtgagagcgctggcaccagccagatcaccaccctgcccctgcccaccctgtttggaaacaaccacatgaagatggatgtggcctgcaaggtgatgctgggcggcaagaatgtggaggatggcttcggcatcgccttccgggtgctgcaggacttccagctggatgctgccatgacctactgcagagctgcccggcagctggtggagaaggagaagtacagcgagatccagcagctgctgaagtgtgtgtctgagagcggcatggccgccaagagtgatggagacaccatcctgctgaactgcctggaggccttcaagagaattcctccccaggagctggagggcctcatccaggccatccacaatgatgacaacaaggtgcgggcctacctgatctgctgcaagctgcggagcgcctacctgattgctgtgaagcaggagcacagccgggccacagccctggtgcagcaggtgcagcaggccgccaagagcagtggagatgctgtggtgcaggacatctgtgcccagtggctgctgaccagccaccccaggggggcccacggccctggcagcaggaagtag

SEQ ID NO: 177126 - DNA, 7557 bp, Artificial Sequence
  Description of Artificial Sequence: Synthetic coding sequence
atgaaccacccctttgggaaggaggaggccgccagccagaagcagctgtttggcttcttctgtgagtgcctgcggcggggggagtgggagctggcccaggcctgtgtgccccagctgcaggagggccagggcgacatccccaagagggtggaggacatcctgcaggccctggtggtgtgccccaacctgctgcgctgtggccaggacatcaacccccagagggtggcctgggtgtggctgctggtgctggagaagtggctggcccgggagaagaagctgctgcctgtggtgttccggaggaagctggagttcctgctgctgtctgaggacctgcagggcgacatccctgagaacatcctggaggagctgtatgagaccctgacccagggcgctgtgggccacgtgcctgatggcaacccccggcgggagagctggaccccccggctgagcagcgaggccgtgtctgtgctgtgggacctgctgcggcagagcccccagcctgcccaggccctgctggagctgctgctggaggaggatgatggcaccggcctgtgccactggcccctgcagaatgccctggtggacctgatcaggaaggccctgcggaccctgcgctgcccagctgagcccctgggcgtggagctgcacctgctgtgtgaggagctgctggaggcctgcaggacagagggcagccccctgcgggaggagcggctgctgagctgcctgctgcacaaggccagccggggcctgctgagcctgtatggccacacctatgcagagaaggtgacagagaagccaccccgggccacagccagcggcaaggtgtccccagaccacctggaccctgagcgggccatgctggccctcttcagcaaccccaacccagctgaggcctggaaggtggcctacttctactgcctgagcaacaacaagcacttcctggagcagatcctggtgacagccctgaccctgctgaaggaggaggacttccccaacctgggctgcctgctggaccgggagttccggcccctgagctgcctgctggtgctgctgggctggacccactgccagagcctggagagcgccaagaggctgctgcagaccctgcacaggacccagggccctggctgtgatgagctgctgagagatgcctgtgatggcctgtgggcccacctggaggtgctggagtggtgcatccagcagagcagcaaccccatccccaagagggacctgctgtaccacctgcacggcggggacagccacagcgtgctgtacaccctgcaccacctgaccaacctgcctgccctgcgggaggaggatgtgctgaagctgctgcagaaggtgcctgccaaggacccccagcaggagccagatgctgtggatgcccctgtgcctgagcacctgagccagtgccagaacctgaccctgtaccagggcttctgtgccatgaagtatgccatctatgccctgtgtgtgaacagccaccagcacagccagtgccaggactgcaaggacagcctgtctgaggacctggccagcgccacagagcccgccaatgacagcctgagcagccctggagctgccaacctcttcagcacctacctggcccgctgccagcagtacctgtgcagcatcccagacagcctgtgcctggagctgctggagaacatcttcagcctgctgctgatcaccagcgctgacctgcaccctgagccccacctgcctgaggactatgcagaagatgatgacatcgagggcaagagccccagcggcctgcggagccccagcgagagcccccagcacatcgcccaccctgagaggaagtctgagcggggcagcctgggcgtgcccaagaccctggcctacaccatgcccagccacgtgaaggccgagcccaaggacagctacccaggcccccaccgccacagcttcctggacctgaagcacttcaccagcggcatcagcggcttcctggctgatgaatttgccatcggggccttcctgcggctgctgcaggagcagctggatgagatcagcagccgcagccccccagagaagcccaagcaggagagccagagctgcagcggcagcagagatggcctgcagagccggctgcaccggctgagcaaggtggtgtctgaggcccagtggaggcacaaggtggtgaccagcaaccacaggtctgaggagcagcccagccgccgctaccagcctgccaccaggcaccccagcctgcggcggggccgccgcacccggcgcagccaggctgatggccgggaccggggcagcaaccccagcctggagagcaccagcagcgagctgagcaccagcaccagcgagggcagcctgagcgccatgtctggaagaaatgagctgcacagccggctgcacccccacccccagagcagcctcatccccatgatgttcagccccccagagagcctgctggccagctgcatcctgcggggcaactttgctgaggcccaccaggtgctcttcaccttcaacctgaagagcagccccagcagtggagagctgatgttcatggagcgctaccaggaggtgatccaggagctggcccaggtggagcacaagattgagaaccagaacagtgatgctggcagcagcaccatcagaagaactggaagtggccgcagcaccctgcaggccatcggcagcgctgctgctgctggcatggtgttctacagcatcagtgatgtgacagacaagctgctgaacaccagcggggaccccatccccatgctgcaggaggacttctggatcagcacagccctggtggagcccacagcccccctgcgggaggtgctggaggacctgagccccccagccatggccgcctttgacctggcctgcagccagtgccagctgtggaagacctgcaagcagctgctggagacagctgagcggcggctgaacagcagcctggagcggcggggcagaagaattgaccacgtgctgctgaatgctgatggcatccggggcttccctgtggtgctgcagcagatcagcaagagcctgaactacctgctgatgtctgccagccagaccaagtctgagagcgtggaggagaagggcggcggccccccacgctgcagcatcacagagctgctgcagatgtgctggcccagcctgtctgaggactgtgtggccagccacaccaccctgagccagcagctggaccaggtgctgcagagcctgcgggaggccctggagctgcctgagcccaggaccccacccctgagcagcctggtggagcaggccgcccagaaggcccctgaggccgaggcccaccctgtgcagatccagacccagctgctgcagaagaacctgggcaagcagaccccatctggcagccggcagatggactacctgggcaccttcttctcctactgcagcaccctggccgctgtgctgctgcagagcctgagcagcgagccagaccacgtggaggtgaaggtgggcaacccctttgtgctgctgcagcagagcagcagccagctggtgagccacctgctgtttgagcggcaggtgcccccagagcggctggccgccctgctggcccaggagaacctgagcctgtctgtgccccaggtgattgtgtcctgctgctgtgagcccctggccctgtgcagcagccggcagagccagcagaccagcagcctgctgacccggctgggcaccctggcccagctgcacgccagccactgcctggatgacctgcccctgagcacccccagcagccccaggaccacagagaaccccaccctggagaggaagccctacagcagcccccgggacagcagcctgcctgccctgaccagcagcgccctggccttcctgaagagccgcagcaagctgctggccaccgtggcctgcctgggcgccagcccccggctgaaggtgtccaagcccagcctgtcctggaaggagctgcggggcagaagagaggtgcccctggccgctgagcaggtggcccgggagtgtgagcggctgctggagcagttccccctgtttgaggccttcctgctggccgcctgggagcccctgcggggcagcctgcagcagggccagagcctggccgtgaacctgtgtggctgggccagcctgagcacagtgctgctgggcctgcacagccccatcgccctggatgtgctgtctgaggcctttgaggagagcctggtggcccgggactggagccgggccctgcagctgacagaggtgtatggaagagatgtggatgacctgagcagcatcaaggatgctgtgctgagctgtgctgtggcctgtgacaaggagggctggcagtacctgtttcctgtgaaggatgccagcctgcggagccggctggccctgcagtttgtggaccgctggcccctggagagctgcctggagatcctggcctactgcatcagtgacacagctgtgcaggagggcctgaagtgtgagctgcagaggaagctggccgagctgcaggtgtaccagaagatcctgggcctgcagagcccccctgtgtggtgtgactggcagaccctgcggagctgctgcgtggaggaccccagcacagtgatgaacatgatcctggaggcccaggagtatgagctgtgtgaggagtggggctgcctgtaccccatcccccgggagcacctgatcagcctgcaccagaagcacctgctgcacctgctggagcggcgggaccatgacaaggccctgcagctgctgcggcgcatcccagaccccaccatgtgcctggaggtgacagagcagagcctggaccagcacaccagcctggccaccagccacttcctggccaactacctgaccacccacttctacggccagctgacagctgtgcgccaccgggagatccaggccctgtatgtgggcagcaagatcctgctgaccctgcctgagcagcaccgggccagctacagccacctgagcagcaaccccctcttcatgctggagcagctgctgatgaacatgaaggtggactgggccaccgtggccgtgcagaccctgcagcagctgctggtgggccaggagatcggcttcaccatggatgaggtggacagcctgctgagccgctatgcagagaaggccctggacttcccctacccccagcgggagaagagaagtgacagcgtcatccacctgcaggagatcgtgcaccaggccgctgaccctgagaccctgcccaggagccccagcgctgagttcagccctgctgcccctcctggcatcagcagcatccacagccccagcctgcgggagaggagcttcccccccacccagcccagccaggagtttgtgcccccagccaccccaccagcccggcaccagtgggtgcctgatgaaacagagagcatctgcatggtgtgctgccgggagcacttcaccatgttcaacagaagacaccactgcagaagatgtggccgcctggtgtgcagcagctgcagcaccaagaagatggtggtggagggctgcagagaaaatcctgcccgggtgtgtgaccagtgctacagctactgcaacaaggatgtgcctgaggagcccagcgagaagccagaggccctggacagcagcaagaatgaaagccccccctacagctttgtggtgcgggtgcccaaggcagatgaggtggagtggatcctggacctgaaggaggaggagaatgagctggtgcgctctgagttctactatgagcaggcccccagcgccagcctgtgcatcgccatcctgaacctgcaccgggacagcatcgcctgtggccaccagctgattgagcactgctgccgcctgagcaagggcctgaccaaccctgaggtggatgctggcctgctgacagacatcatgaagcagctgctcttcagcgccaagatgatgtttgtgaaggccggccagagccaggacctggccctgtgtgacagctacatcagcaaggtggatgtgctgaacatcctggtggccgccgcctacagacatgtgcccagcctggaccagatcctgcagcctgctgctgtgacccggctgaggaaccagctgctggaggccgagtactaccagctgggcgtggaggtgtccaccaagacaggcctggacaccaccggggcctggcacgcctggggcatggcctgcctgaaggccggcaacctgacagctgcccgggagaagttcagccgctgcctgaagcccccatttgacctgaaccagctgaaccacggcagccggctggtgcaggatgtggtggagtacctggagagcacagtgcggccctttgtgtccctgcaggatgatgactactttgccaccctgcgggagctggaggccaccctgcggacccagagcctgagcctggccgtcatccctgagggcaagatcatgaacaacacctactaccaggagtgcctcttctacctgcacaactacagcaccaacctggccatcatctccttctacgtgcgccacagctgcctgcgggaggccctgctgcacctgctgaacaaggagagccccccagaggtgttcatcgagggcatcttccagcccagctacaagagcggcaagctgcacaccctggagaacctgctggagagcattgaccccaccctggagagctggggcaagtacctgattgctgcctgccagcacctgcagaagaagaactactaccacatcctgtatgagctgcagcagttcatgaaggaccaggtgcgggccgccatgacctgcatccgcttcttcagccacaaggccaagagctacacagagctgggggagaagctgtcctggctgctgaaggccaaggaccacctgaagatctacctgcaggagaccagccgcagcagcggcaggaagaagaccaccttcttcaggaagaagatgacagctgctgatgtgagccgccacatgaacaccctgcagctgcagatggaggtgacccgcttcctgcaccgctgtgagagcgctggcaccagccagatcaccaccctgcccctgcccaccctgtttggaaacaaccacatgaagatggatgtggcctgcaaggtgatgctgggcggcaagaatgtggaggatggctttggaattgccttccgggtgctgcaggacttccagctggatgctgccatgacctactgccgggccgcccggcagctggtggagaaggagaagtacagcgagatccagcagctgctgaagtgtgtgtctgagagcggcatggccgccaagagtgatggagacaccatcctgctgaactgcctggaggccttcaagaggatccccccccaggagctggagggcctcatccaggccatccacaatgatgacaacaaggtgcgggcctacctgatctgctgcaagctgcggagcgcctacctgattgctgtgaagcaggagcacagccgggccacagccctggtgcagcaggtgcagcaggccgccaagagcagtggagatgctgtggtgcaggacatctgtgcccagtggctgctgaccagccaccccaggggggcccacggccctggcagcaggaagtag

SEQ ID NO: 177127 - DNA, 1119 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggggcctggtacagcgtgggcgccctgatgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagaggacctgaccccaggctctgtggaggaggccgaggaggccgagccagatgaggagttcaaggatgccattgaagaagatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagaggaggagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177128 - DNA, 1251 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggagatggagtgcgctacctgctgcgctggcagatgcccctgtgcagcctgctgacctgcctgggcctgaatgtgctcttcctgaccctgaatgaaggagcctggtacagcgtgggcgccctgatgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagagagcctgagcagccaggacctgaccccaggctctgtggaggaggccgaggaggccgagccagatgaggagttcaaggatgccatcgaggagacccacctggtggtgctggaggatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagaggaggagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177129 - DNA, 957 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggagatggagtgcgctacctgctgagcctcatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagaggacctgaccccaggctctgtggaggaggccgaggaggccgagccagatgaggagttcaaggatgccattgaagaagatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagaggaggagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177130 - DNA, 1215 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggagatggagtgcgctacctgctgcgctggcagatgcccctgtgcagcctgctgacctgcctgggcctgaatgtgctcttcctgaccctgaatgaaggagcctggtacagcgtgggcgccctgatgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagaggacctgaccccaggctctgtggaggaggccgaggaggccgagccagatgaggagttcaaggatgccattgaagaagatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagaggaggagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177131 - DNA, 936 bp, Artificial Sequence
  Description of Artificial Sequence: Synthetic coding sequence
atgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagagagcctgagcagccaggacctgaccccaggctctgtggaggaggccgaggaggccgagccagatgaggagttcaaggatgccatcgaggaggatgatgagggcgccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagagaagaagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177132 - DNA, 861 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggagatggagtgcgctacctgctgcgcttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagaggacctgaccccaggctctgtggaggaggccgaggaggccgagccagatgaggagttcaaggatgccattgaagaagatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagaggaggagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177133 - DNA, 1236 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggagatggagtgcgctacctgctgcgctggcagatgcccctgtgcagcctgctgacctgcctgggcctgaatgtgctcttcctgaccctgaatgaaggagcctggtacagcgtgggcgccctgatgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagaggacctgaccccaggctctgtggaggaggccgaggaggccgagccagatgaggagttcaaggatgccatcgaggagacccacctggtggtgctggaggatgatgagggcgccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagagaagaagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177134 - DNA, 1185 bp, Artificial Sequence
  Description of Artificial Sequence: Synthetic coding sequence
ctggagagcccccccttccccaccaagagccctgcctttgacctcttcaacctggtgctgagctacaagaggctggagatctacctggagcccctgaaggatgctggagatggagtgcgctacctgctgcgctggcagatgcccctgtgcagcctgctgacctgcctgggcctgaatgtgctcttcctgaccctgaatgaaggagcctggtacagcgtgggcgccctgatgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagagagcctgagcagccaggacctgaccccaggctctgtggaggaggccgaggaggccgagccagatgaggagttcaaggatgccatcgaggagacccacctggtggtgctggaggatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggaaactgcaccggctgcagcgccaccttctctgtgctgaagaagaggaggagctgcagcaactgtggcaacagcttctgcagccgctgctgcagcttcaaggtgcccaagagctccatgggcgccacagcccctgaggcccagcgggagaccgtgtttgtgtgtgccagctgcaaccagaccctgagcaagtag

SEQ ID NO: 177135 - DNA, 1047 bp, Artificial Sequence
  Description of Artificial Sequence: Synthetic coding sequence
atgcagaccagcgagcgggagggcagcggccctgagctgagccccagcgtgatgcctgaggcccccctggagagcccccccttccccaccaagagccctgcctttgacctcttcaacctggtgctgagctacaagaggctggagatctacctggagcccctgaaggatgctggagatggagtgcgctacctgctgcgctggcagatgcccctgtgcagcctgctgacctgcctgggcctgaatgtgctcttcctgaccctgaatgaaggagcctggtacagcgtgggcgccctgatgatctctgtgcctgccctgctgggctacctgcaggaggtgtgccgggcccggctgcctgacagcgagctgatgaggaggaagtaccacagcgtgcggcaggaggacctgcagaggggccgcctgagcaggcctgaggccgtggccgaggtgaagagcttcctgatccagctggaggccttcctgagccggctgtgctgcacctgtgaggccgcctacagagtgctgcactgggagaaccctgtggtgagcagccagttctacggggccctgctgggcaccgtgtgcatgctgtacctgctgcccctgtgctgggtgctgaccctgctgaacagcaccctcttcctgggcaatgtggagttcttccgggtggtgtctgagtaccgggccagcctgcagcagaggatgaaccccaagcaggaggagcacgcctttgagagccccccacctccagatgtgggcggcaaggatggcctgatggacagcaccccagccctgacccccacagaggacctgaccccaggctctgtggaggaggccgaggaggccgagccagatgaggagttcaaggatgccattgaagaagatgatgaaggagccccctgcccagcagaagatgagctggccctgcaggacaatggcttcctgagcaagaatgaggtgctgcggagcaaggtgtcccggctgacagagcggctgaggaagcgctaccccaccaacaactttggagtgactggagctggcagcagctag

SEQ ID NO: 177136 - DNA, 2664 bp, Artificial Sequence
  Description of Artificial Sequence: Synthetic coding sequence
atgatgaaccgcttcaggaagtggctgtacaagcccaagagaagtgacccccagctgctggcccgcttctactatgcagatgaggagctgaaccaggtggccgctgagctggacagcctggatggcaggaaggacccccagcgctgcaccctgctggtgtcccagttccgcagctgccaggacaacgtgctgaacatcatcaaccagatcatggatgagtgcatcccccaggaccgggccccccgggacttctgtgtgaagtttcctgaggagatcagacatgacaacctggccggccagctgtggtttggagctgagtgcctggccgccggcagcatcatcatgaaccgggagctggagagcatggccatgaggcccctggccaaggagctgaccaggagcctggaggatgtgcggggggccctgcgggaccaggccctgcgggacctgaacacctacacagagaagatgagggaggccctgcggcactttgatgtgctgtttgctgagtttgagctgtcctatgtgtctgccatggtgcctgtgaagagcccccgggagtactacgtgcagcaggaggtgattgtgctcttctgtgaaacagtggagcgggccctggactttggctacctgacccaggacatgattgatgattatgagcccgccctgatgttcagcatcccccggctggccatcgtgtgtggcctggtggtgtatgcagatggccccctgaacctggacaggaaggtggaggacatgtctgagctgttccggcccttccacaccctgctgaggaagatccgggacctgctgcagaccctgacagaggaggagctgcacaccctggagaggaacctgtgcatcagccaggatgtggagttccccatccgggcagatgtgcagggccctgctgccctggccccagccctgagcgcccccctgcccccagagggccccctgagcgccaaggccaaggaccctgatgctgagctggcctgcagcatgcagtatgatgaccaggagctggagcagctgagcaggatggtgcacagagctggagatgagatgagcagcctgctgagcccccccatcgcctgccagagccctgcccacaggcctggagctgagggcagccctggaggagaggccagccctggccggccccggctgcggagcggcagtgatgaggaggagagggtcttcttcatggatgatgtggagggcacagctgaggccctggcccggcctgagagccctgctggccccttcggctgggccggcagcacctgggccgacccccaggagaagggccagggcggccctggaggagctgctggcatcagcctgcctgccagcgagaaggaggaggacctgagcaacaacaacctggaggccgagggcacagatggagccagcctggccggcaccagcagctgcagctgcctggacagccggctgcacctggatggctgggaggtgggcgcagatgatgctgagacagctgagatgattgcccacaggactggaggcatgaagctgagcgccaccgtcatcttcaaccccaagagccccaccagcctggacagcgctgtggccacccaggaggccgccagcgagcctgtggccgagggcatggatggcggcccccacaagctgagcactggagccaccaactgcctgctgcacagctgtgtgtgctgcggcagctgtggggacagcagagaagatgtggtggagcggctgcgggagaagtgcagccctggaggagtgattggagccagctatgctgctggcctggccaaggccagtgaccgggcccctgagcggcaggaggaggcccctcctccttctgaagatgccagcaatggccgggagcccaaggcccccaccagtgacaagtgcctgccccacaccagcggcagccaggtggacacagccagcggcctgcagggcgaggccggcgtggccggccagcaggagcctgaggcccgggagctgcacgccggcagccccagcgcccacgaggccccccaggccctgagcggcagcagcagcagcacagctggcagctgcagcagtgacaagatgggccctgaggccgccccagctgccacccatgctgccccccaggccacccgggagaagatccgcagccgcttccacggcagccatgacctgatccaccggctgtttgtgtgcatctctggagtggccgaccagctgcagaccaactatgccagtgacctgcggagcatcctgaagaccctgtttgaggtgatggccaccaagccagagacagatgacaaggagaagctgaggaaggtgacccagaccctgcggtctgctgccctggaggactgtgccctgtgccaggagaccctgagcagcagcgagctggccgccaagaccagagatggagactttgaagatcctcctgagtgggtgcctgatgaggcctgtggcttctgcacagcctgcaaggcccccttcaccgtcatccggaggaagcaccactgccgcagctgtgggaagatcttctgcagccgctgcagcagccacagcgcccccctgcccaggtatggccaggtgaagcctgtgcgggtgtgcacccactgctacatgttccacgtgacccccttctacagcgacaaggccggcctgtag

SEQ ID NO: 177137 - DNA, 2574 bp, Artificial Sequence
  Description of Artificial Sequence: Synthetic coding sequence
atgatgaaccgcttcaggaagtggctgtacaagcccaagagaagtgacccccagctgctggcccgcttctactatgcagatgaggagctgaaccaggtggccgctgagctggacagcctggatggcaggaaggacccccagcgctgcaccctgctggtgtcccagttccgcagctgccaggacaacgtgctgaacatcatcaaccagatcatggatgagtgcatcccccaggaccgggccccccgggacttctgtgtgaagtttcctgaggagatcagacatgacaacctggccggccagctgtggtttggagctgagtgcctggccgccggcagcatcatcatgaaccgggagctggagagcatggccatgaggcccctggccaaggagctgaccaggagcctggaggatgtgcggggggccctgcgggaccaggccctgcgggacctgaacacctacacagagaagatgagggaggccctgcggcactttgatgtgctgtttgctgagtttgagctgtcctatgtgtctgccatggtgcctgtgaagagcccccgggagtactacgtgcagcaggaggtgattgtgctcttctgtgaaacagtggagagcggcctggtggtgtatgcagatggccccctgaacctggacaggaaggtggaggacatgtctgagctgttccggcccttccacaccctgctgaggaagatccgggacctgctgcagaccctgacagaggaggagctgcacaccctggagaggaacctgtgcatcagccaggatgtggagttccccatccgggcagatgtgcagggccctgctgccctggccccagccctgagcgcccccctgcccccagagggccccctgagcgccaaggccaaggaccctgatgctgagctggcctgcagcatgcagtatgatgaccaggagctggagcagctgagcaggatggtgcacagagctggagatgagatgagcagcctgctgagcccccccatcgcctgccagagccctgcccacaggcctggagctgagggcagccctggaggagaggccagccctggccggccccggctgcggagcggcagtgatgaggaggagagggtcttcttcatggatgatgtggagggcacagctgaggccctggcccggcctgagagccctgctggccccttcggctgggccggcagcacctgggccgacccccaggagaagggccagggcggccctggaggagctgctggcatcagcctgcctgccagcgagaaggaggaggacctgagcaacaacaacctggaggccgagggcacagatggagccagcctggccggcaccagcagctgcagctgcctggacagccggctgcacctggatggctgggaggtgggcgcagatgatgctgagacagctgagatgattgcccacaggactggaggcatgaagctgagcgccaccgtcatcttcaaccccaagagccccaccagcctggacagcgctgtggccacccaggaggccgccagcgagcctgtggccgagggcatggatggcggcccccacaagctgagcactggagccaccaactgcctgctgcacagctgtgtgtgctgcggcagctgtggggacagcagagaagatgtggtggagcggctgcgggagaagtgcagccctggaggagtgattggagccagctatgctgctggcctggccaaggccagtgaccgggcccctgagcggcaggaggaggcccctcctccttctgaagatgccagcaatggccgggagcccaaggcccccaccagtgacaagtgcctgccccacaccagcggcagccaggtggacacagccagcggcctgcagggcgaggccggcgtggccggccagcaggagcctgaggcccgggagctgcacgccggcagccccagcgcccacgaggccccccaggccctgagcggcagcagcagcagcacagctggcagctgcagcagtgacaagatgggccctgaggccgccccagctgccacccatgctgccccccaggccacccgggagaagatccgcagccgcttccacggcagccatgacctgatccaccggctgtttgtgtgcatctctggagtggccgaccagctgcagaccaactatgccagtgacctgcggagcatcctgaagaccctgtttgaggtgatggccaccaagccagagacagatgacaaggagaagctgaggaaggtgacccagaccctgcggtctgctgccctggaggactgtgccctgtgccaggagaccctgagcagcagcgagctggccgccaagaccagagatggagactttgaagatcctcctgagtgggtgcctgatgaggcctgtggcttctgcacagcctgcaaggcccccttcaccgtcatccggaggaagcaccactgccgcagctgtgggaagatcttctgcagccgctgcagcagccacagcgcccccctgcccaggtatggccaggtgaagcctgtgcgggtgtgcacccactgctacatgttccacgtgacccccttctacagcgacaaggccggcctgtag

SEQ ID NO: 177138 - DNA, 2454 bp, Artificial Sequence
  Description of Artificial Sequence: Synthetic coding sequence
atggatgagtgcatcccccaggaccgggccccccgggacttctgtgtgaagtttcctgaggagatcagacatgacaacctggccggccagctgtggtttggagctgagtgcctggccgccggcagcatcatcatgaaccgggagctggagagcatggccatgaggcccctggccaaggagctgaccaggagcctggaggatgtgcggggggccctgcgggaccaggccctgcgggacctgaacacctacacagagaagatgagggaggccctgcggcactttgatgtgctgtttgctgagtttgagctgtcctatgtgtctgccatggtgcctgtgaagagcccccgggagtactacgtgcagcaggaggtgattgtgctcttctgtgaaacagtggagcgggccctggactttggctacctgacccaggacatgattgatgattatgagcccgccctgatgttcagcatcccccggctggccatcgtgtgtggcctggtggtgtatgcagatggccccctgaacctggacaggaaggtggaggacatgtctgagctgttccggcccttccacaccctgctgaggaagatccgggacctgctgcagaccctgacagaggaggagctgcacaccctggagaggaacctgtgcatcagccaggatgtggagttccccatccgggcagatgtgcagggccctgctgccctggccccagccctgagcgcccccctgcccccagagggccccctgagcgccaaggccaaggaccctgatgctgagctggcctgcagcatgcagtatgatgaccaggagctggagcagctgagcaggatggtgcacagagctggagatgagatgagcagcctgctgagcccccccatcgcctgccagagccctgcccacaggcctggagctgagggcagccctggaggagaggccagccctggccggccccggctgcggagcggcagtgatgaggaggagagggtcttcttcatggatgatgtggagggcacagctgaggccctggcccggcctgagagccctgctggccccttcggctgggccggcagcacctgggccgacccccaggagaagggccagggcggccctggaggagctgctggcatcagcctgcctgccagcgagaaggaggaggacctgagcaacaacaacctggaggccgagggcacagatggagccagcctggccggcaccagcagctgcagctgcctggacagccggctgcacctggatggctgggaggtgggcgcagatgatgctgagacagctgagatgattgcccacaggactggaggcatgaagctgagcgccaccgtcatcttcaaccccaagagccccaccagcctggacagcgctgtggccacccaggaggccgccagcgagcctgtggccgagggcatggatggcggcccccacaagctgagcactggagccaccaactgcctgctgcacagctgtgtgtgctgcggcagctgtggggacagcagagaagatgtggtggagcggctgcgggagaagtgcagccctggaggagtgattggagccagctatgctgctggcctggccaaggccagtgaccgggcccctgagcggcaggaggaggcccctcctccttctgaagatgccagcaatggccgggagcccaaggcccccaccagtgacaagtgcctgccccacaccagcggcagccaggtggacacagccagcggcctgcagggcgaggccggcgtggccggccagcaggagcctgaggcccgggagctgcacgccggcagccccagcgcccacgaggccccccaggccctgagcggcagcagcagcagcacagctggcagctgcagcagtgacaagatgggccctgaggccgccccagctgccacccatgctgccccccaggccacccgggagaagatccgcagccgcttccacggcagccatgacctgatccaccggctgtttgtgtgcatctctggagtggccgaccagctgcagaccaactatgccagtgacctgcggagcatcctgaagaccctgtttgaggtgatggccaccaagccagagacagatgacaaggagaagctgaggaaggtgacccagaccctgcggtctgctgccctggaggactgtgccctgtgccaggagaccctgagcagcagcgagctggccgccaagaccagagatggagactttgaagatcctcctgagtgggtgcctgatgaggcctgtggcttctgcacagcctgcaaggcccccttcaccgtcatccggaggaagcaccactgccgcagctgtgggaagatcttctgcagccgctgcagcagccacagcgcccccctgcccaggtatggccaggtgaagcctgtgcgggtgtgcacccactgctacatgttccacgtgacccccttctacagcgacaaggccggcctgtag

SEQ ID NO: 177139 - DNA, 1212 bp, Artificial Sequence
  Description of Artificial Sequence: Synthetic coding sequence
atggagcccgccggcccctgtggcttctgcccagctggggaggtgcagcctgcccgctacacctgcccccgctgcaatgccccctactgcagcctgcgctgctaccgcacccacggcacctgtgccgagaacttctacagagaccaggtgctgggggagctgcggggctgcagcgccccacccagccggctggccagcgccctgcggcggctgcggcagcagcgggagacagaagatgagcctggagaggccggcctgagcagcggccctgcccctgggggcctgagcggcctgtgggagcggctggcccctggagagaaggccgcctttgagcggctgctgagcagaggagaggccggccgcctgctgcccccctggaggccctggtggtggaacagaggagctggcccccagctgctggaggagctggacaatgcccctggcagtgatgctgctgagctggagctggccccagcccggaccccaccagattctgtgaaggatgccagcgctgctgagcctgctgctgctgagcgggtgctgggagatgtgcctggggcctgcacccctgtggtgcccacccgcatcccagccatcgtgtccctgagccggggccctgtgagccccctggtgcgcttccagctgcccaacgtgctgtttgcctatgcccacaccctggccctgtaccacggcggagatgatgccctgctgagtgacttctgtgccaccctgctgggcgtgtctggggccctgggcgcccagcaggtgtttgccagcgctgaggaggccctgcaggccgccgcccacgtgctggaggccggggagcaccccccaggccccctgggcaccaggggggccatgcatgaggtggcccgcatcctgctgggggagggccccaccaaccagaagggctacaccctggccgccctgggggacctggcccagaccctgggccgggccaggaagcaggccgtggcccgggaggagcgggaccacctgtaccgggccaggaagaagtgccagttcctgctggcctggaccaatgaaaatgaggccgccctgacccccctggccctggactgtgcccgggcccaccaggcccatgctgtggtggccgaggaggtggccgccctgactggagagctggagcggctgtggggcggccctgtgcccccagcccccaggaccctcatcgaggagctgcccagctag

SEQ ID NO: 177140 - DNA, 1683 bp, Artificial Sequence
  Description of Artificial Sequence: Synthetic coding sequence
atggccggcccccagcccctggccctgcagctggagcagctgctgaacccccggcccagcgaggccgaccctgaggccgaccctgaggaggccacagctgcccgggtgattgacagatttgatgaaggagaagatggagagggggacttcctggtggtgggcagcatcaggaagctggccagcgccagcctgctggacacagacaagcgctactgtgggaagaccaccagcaggaaggcctggaatgaagaccactgggagcagaccctgcccggcagcagtgatgaggagatcagtgatgaggagggcagcggagatgaagattctgagggcctgggcctggaggagtatgatgaagatgacctgggcgctgctgaggagcaggagtgtggggaccaccgggagagcaagaagagccgcagccacagcgccaagaccccaggcttctctgtgcagagcatcagtgactttgagaagttcaccaagggcatggatgacctgggcagcagcgaggaggaggaggatgaggagagcggcatggaggagggagatgatgctgaggacagccagggcgagagtgaagaagatcgggccggggacagaaattctgaagatgatggagtggtgatgaccttcagctctgtgaaggtgtctgaggaggtggagaagggccgggctgtgaagaaccagatcgccctgtgggaccagctgctggagggccgcatcaagctgcagaaggccctgctgaccaccaaccagctgccccagccagatgtgttccccctcttcaaggacaagggcggccctgagttcagcagcgccctgaagaacagccacaaggccctgaaggccctgctgcggagcctggtgggcctgcaggaggagctgctcttccagtacccagacacccgctacctggtggatggcaccaagcccaatgccggcagcgaggagatcagcagtgaagatgatgagctggtggaggagaagaagcagcagaggagaagagtgcctgccaagaggaagctggagatggaggactaccccagcttcatggccaagagatttgctgacttcaccgtgtacagaaacagaaccctgcagaagtggcatgacaagaccaagctggccagcggcaagctgggcaaaggatttggagcctttgagaggagcatcctgacccagattgaccacatcctgatggacaaggagcggctgctgcggaggacccagaccaagaggtctgtgtacagagtgctgggcaagccagagcctgctgcccagcctgtgcctgagagcctgcctggagagcctgagatcctgccccaggccccagccaatgcccacctgaaggacctggatgaggagatctttgatgatgatgacttctaccaccagctgctgcgggagctgattgaaaggaagaccagcagcctggaccccaatgaccaggtggccatgggccggcagtggctggccatccagaagctgcggagcaagatccacaagaaggtggacaggaaggccagcaaaggaaggaagctgcgcttccacgtgctgagcaagctgctgtccttcatggcccccatcgaccacaccaccatgaatgatgatgccaggacagagctgtaccgcagcctgtttggccagctgcaccccccagatgagggccacggggactag

SEQ ID NO: 177141 - DNA, 4134 bp, Artificial Sequence
  Description of Artificial Sequence: Synthetic coding sequence
atggacaccagctctgtgggcggcctggagctgacagaccagacccctgtgctgctgggcagcacagccatggccaccagcctgaccaacgtgggcaacagcttcagcggccctgccaaccccctggtgagccgcagcaacaagttccagaacagctctgtggaggatgatgatgatgtggtgttcatcgagcctgtgcagcccccaccacccagcgtgcctgtggtggccgaccagaggaccatcaccttcaccagcagcaagaatgaggagctgcagggcaatgacagcaagatcacccccagcagcaaggagctggccagccagaagggctctgtgtctgagaccatcgtgattgatgatgaggaggacatggagaccaaccagggccaggagaagaacagcagcaacttcattgaaagaagacctcctgagaccaagaacagaacaaatgatgtggacttcagcaccagcagcttcagccgcagcaaggtgaatgccggcatgggcaacagcggcatcaccacagagccagacagcgagatccagatcgccaacgtgaccaccctggagaccggggtgtcctctgtgaatgatggccagctggagaacacagatggccgggacatgaacctgatgatcacccacgtgaccagcctgcagaacaccaacctgggagatgtgtccaatggcctgcagagcagcaactttggagtgaacatccagacctacacccccagcctgaccagccagaccaagacaggagtgggccccttcaaccctggccgcatgaatgtggccggagatgtgttccagaatggagagagcgccacccaccacaacccagacagctggatcagccagagcgccagcttccccaggaaccagaagcagcccggggtggacagcctgagccctgtggccagcctgcccaagcagatcttccagcccagcgtgcagcagcagcccaccaagcctgtgaaggtgacctgtgccaactgcaagaagcccctgcagaagggccagacagcctaccagaggaagggcagcgcccacctgttctgcagcaccacctgcctgagcagcttcagccacaagccagcccccaagaagctgtgtgtgatgtgcaagaaggacatcaccaccatgaagggcaccatcgtggcccaggtggacagcagcgagagcttccaggagttctgcagcaccagctgcctgagcctgtatgaggacaagcagaaccccaccaagggggccctgaacaagagccgctgcaccatctgtgggaagctgacagagatcagacatgaggtgtccttcaagaacatgacccacaagctgtgcagcgaccactgcttcaaccgctacaggatggccaacggcctcatcatgaactgctgtgagcagtgtggggagtacctgcccagcaaaggagctggcaacaacgtgctggtgattgatggccagcagaagcgcttctgctgccagagctgtgtgtctgagtacaagcaggtgggcagccaccccagcttcctgaaggaggtgcgggaccacatgcaggacagcttcctgatgcagcctgagaagtatggcaagctgaccacctgcaccggctgcaggacccagtgccgcttctttgacatgacccagtgcatcggccccaacggctacatggagccctactgcagcacagcctgcatgaacagccacaagaccaagtatgccaagagccagagcctgggcatcatctgccacttctgcaagaggaacagcctgccccagtaccaggccaccatgccagatggcaagctgtacaacttctgcaacagcagctgtgtggccaagttccaggccctgtccatgcagagcagccccaacggccagtttgtggcccccagcgacatccagctgaagtgcaactactgcaagaacagcttctgcagcaagccagagatcctggagtgggagaacaaggtgcaccagttctgcagcaagacctgcagtgatgactacaagaagctgcactgcatcgtgacctactgtgagtactgccaggaggagaagaccctgcatgaaacagtgaacttctctggagtgaagaggcccttctgcagcgagggctgcaagctgctgtacaagcaggactttgcccggcggctgggcctgcgctgtgtgacctgcaactactgcagccagctgtgcaagaagggggccaccaaggagctggatggagtggtgcgggacttctgcagcgaggactgctgcaagaagttccaggactggtactacaaggccgcccgctgtgactgctgcaagagccagggcaccctgaaggagcgggtgcagtggagaggagagatgaagcacttctgtgaccagcactgcctgctgcgcttctactgccagcagaatgagcccaacatgaccacccagaagggccctgagaacctgcactatgaccagggctgccagaccagcaggaccaagatgactggaagtgcccccccacccagccccacccccaacaaggagatgaagaacaaggctgtgctgtgcaagcccctgaccatgaccaaggccacctactgcaagccccacatgcagaccaagagctgccagacagatgacacctggaggacagaatatgtgcctgtgcccatccctgtgcctgtgtacatccctgtgcccatgcacatgtacagccagaacatccctgtgcccaccaccgtgcctgtgcctgtgcctgtgcctgtgttcctgcctgcccccctggacagcagcgagaagatcccagctgccatcgaggagctgaagagcaaggtgtccagtgatgccctggacacagagctgctgaccatgacagacatgatgtctgaagatgagggcaagacagagaccaccaacatcaacagcgtcatcatcgagacagacatcattggaagtgacctgctgaagaacagcgaccctgagacccagagctccatgccagatgtgccctatgagccagacctggacatcgagattgacttccccagggctgctgaggagctggacatggagaatgagttcctgctgccccctgtgtttggagaggagtatgaggagcagccccggcccaggagcaagaagaagggggccaagaggaaggctgtgtctggctaccagagccatgatgacagcagtgacaacagtgaatgttccttccccttcaagtacacctacggcgtgaatgcctggaagcactgggtgaagacccggcagctggatgaggacctgctggtgctggatgagctgaagagcagcaagtctgtgaagctgaaggaggacctgctgagccacaccacagctgagctgaactacggcctggcccactttgtgaatgagatccggcggcccaatggagaaaattatgccccagacagcatctactacctgtgcctgggcatccaggagtacctgtgtggcagcaacaggaaggacaacatcttcatcgaccccggctaccagacctttgagcaggagctgaacaagatcctgcgctcctggcagcccagcatcctgcctgatggcagcatcttcagccgggtggaggaggactacctgtggaggatcaagcagctgggcagccacagccctgtggccctgctgaacaccctcttctacttcaacaccaagtacttcggcctgaagacagtggagcagcacctgcggctgagctttggcaccgtcttccgccactggaagaagaaccccctgaccatggagaacaaggcctgcctgcgctaccaggtgagcagcctgtgtggcacagacaatgaagacaagatcaccaccgggaagaggaagcatgaagatgatgagcctgtgtttgagcagatcgagaacacagccaaccccagccgctgccctgtgaagatgtttgagtgctacctgagcaagagcccccagaacctgaaccagaggatggatgtgttctacctgcagcctgagtgcagcagcagcacagacagccctgtgtggtacaccagcaccagcctggacaggaacaccctggagaacatgctggtgcgggtgctgctggtgaaggacatctatgacaaggacaactatgagctggatgaggacacagactag

SEQ ID NO: 177142 - DNA, 4128 bp, Artificial Sequence
  Description of Artificial Sequence: Synthetic coding sequence
atggacaccagctctgtgggcggcctggagctgacagaccagacccctgtgctgctgggcagcacagccatggccaccagcctgaccaacgtgggcaacagcttcagcggccctgccaaccccctggtgagccgcagcaacaagttccagaacagctctgtggaggatgatgatgatgtggtgttcatcgagcctgtgcagcccccaccacccagcgtgcctgtggtggccgaccagaggaccatcaccttcaccagcagcaagaatgaggagctgcagggcaatgacagcaagatcacccccagcagcaaggagctggccagccagaagggctctgtgtctgagaccatcgtgattgatgatgaggaggacatggagaccaaccagggccaggagaagaacagcagcaacttcattgaaagaagacctcctgagaccaagaacagaacaaatgatgtggacttcagcaccagcagcttcagccgcagcaaggtgaatgccggcatgggcaacagcggcatcaccacagagccagacagcgagatccagatcgccaacgtgaccaccctggagaccggggtgtcctctgtgaatgatggccagctggagaacacagatggccgggacatgaacctgatgatcacccacgtgaccagcctgcagaacaccaacctgggagatgtgtccaatggcctgcagagcagcaactttggagtgaacatccagacctacacccccagcctgaccagccagaccaagacaggagtgggccccttcaaccctggccgcatgaatgtggccggagatgtgttccagaatggagagagcgccacccaccacaacccagacagctggatcagccagagcgccagcttccccaggaaccagaagcagcccggggtggacagcctgagccctgtggccagcctgcccaagcagatcttccagcccagcgtgcagcagcagcccaccaagcctgtgaaggtgacctgtgccaactgcaagaagcccctgcagaagggccagacagcctaccagaggaagggcagcgcccacctgttctgcagcaccacctgcctgagcagcttcagccacaagccagcccccaagaagctgtgtgtgatgtgcaagaaggacatcaccaccatgaagggcaccatcgtggcccaggtggacagcagcgagagcttccaggagttctgcagcaccagctgcctgagcctgtatgaggacaagcagaaccccaccaagggggccctgaacaagagccgctgcaccatctgtgggaagctgacagagatcagacatgaggtgtccttcaagaacatgacccacaagctgtgcagcgaccactgcttcaaccgctacaggatggccaacggcctcatcatgaactgctgtgagcagtgtggggagtacctgcccagcaaaggagctggcaacaacgtgctggtgattgatggccagcagaagcgcttctgctgccagagctgtgtgtctgagtacaagcaggtgggcagccaccccagcttcctgaaggaggtgcgggaccacatgcaggacagcttcctgatgcagcctgagaagtatggcaagctgaccacctgcaccggctgcaggacccagtgccgcttctttgacatgacccagtgcatcggccccaacggctacatggagccctactgcagcacagcctgcatgaacagccacaagaccaagtatgccaagagccagagcctgggcatcatctgccacttctgcaagaggaacagcctgccccagtaccaggccaccatgccagatggcaagctgtacaacttctgcaacagcagctgtgtggccaagttccaggccctgtccatgcagagcagccccaacggccagtttgtggcccccagcgacatccagctgaagtgcaactactgcaagaacagcttctgcagcaagccagagatcctggagtgggaggccagcctgcaccagttctgcagcaagacctgcagtgatgactacaagaagctgcactgcatcgtgacctactgtgagtactgccaggaggagaagaccctgcatgaaacagtgaacttctctggagtgaagaggcccttctgcagcgagggctgcaagctgctgtacaagcaggactttgcccggcggctgggcctgcgctgtgtgacctgcaactactgcagccagctgtgcaagaagggggccaccaaggagctggatggagtggtgcgggacttctgcagcgaggactgctgcaagaagttccaggactggtactacaaggcctgtgactgctgcaagagccagggcaccctgaaggagcgggtgcagtggagaggagagatgaagcacttctgtgaccagcactgcctgctgcgcttctactgccagcagaatgagcccaacatgaccacccagaagggccctgagaacctgcactatgaccagggctgccagaccagcaggaccaagatgactggaagtgcccccccacccagccccacccccaacaaggagatgaagaacaaggctgtgctgtgcaagcccctgaccatgaccaaggccacctactgcaagccccacatgcagaccaagagctgccagacagatgacacctggaggacagaatatgtgcctgtgcccatccctgtgcctgtgtacatccctgtgcccatgcacatgtacagccagaacatccctgtgcccaccaccgtgcctgtgcctgtgcctgtgcctgtgttcctgcctgcccccctggacagcagcgagaagatcccagctgccatcgaggagctgaagagcaaggtgtccagtgatgccctggacacagagctgctgaccatgacagacatgatgtctgaagatgagggcaagacagagaccaccaacatcaacagcgtcatcatcgagacagacatcattggaagtgacctgctgaagaacagcgaccctgagacccagagctccatgccagatgtgccctatgagccagacctggacatcgagattgacttccccagggctgctgaggagctggacatggagaatgagttcctgctgccccctgtgtttggagaggagtatgaggagcagccccggcccaggagcaagaagaagggggccaagaggaaggctgtgtctggctaccagagccatgatgacagcagtgacaacagtgaatgttccttccccttcaagtacacctacggcgtgaatgcctggaagcactgggtgaagacccggcagctggatgaggacctgctggtgctggatgagctgaagagcagcaagtctgtgaagctgaaggaggacctgctgagccacaccacagctgagctgaactacggcctggcccactttgtgaatgagatccggcggcccaatggagaaaattatgccccagacagcatctactacctgtgcctgggcatccaggagtacctgtgtggcagcaacaggaaggacaacatcttcatcgaccccggctaccagacctttgagcaggagctgaacaagatcctgcgctcctggcagcccagcatcctgcctgatggcagcatcttcagccgggtggaggaggactacctgtggaggatcaagcagctgggcagccacagccctgtggccctgctgaacaccctcttctacttcaacaccaagtacttcggcctgaagacagtggagcagcacctgcggctgagctttggcaccgtcttccgccactggaagaagaaccccctgaccatggagaacaaggcctgcctgcgctaccaggtgagcagcctgtgtggcacagacaatgaagacaagatcaccaccgggaagaggaagcatgaagatgatgagcctgtgtttgagcagatcgagaacacagccaaccccagccgctgccctgtgaagatgtttgagtgctacctgagcaagagcccccagaacctgaaccagaggatggatgtgttctacctgcagcctgagtgcagcagcagcacagacagccctgtgtggtacaccagcaccagcctggacaggaacaccctggagaacatgctggtgcgggtgctgctggtgaaggacatctatgacaaggacaactatgagctggatgaggacacagactag

SEQ ID NO: 177143 - DNA, 4128 bp, Artificial Sequence; identical to SEQ ID NO: 177142
  Description of Artificial Sequence: Synthetic coding sequence

SEQ ID NO: 177144 - DNA, 1134 bp, Artificial Sequence
  Description of Artificial Sequence: Synthetic coding sequence
atgcaggacagcttcctgatgcagcctgagaagtatggcaagctgaccacctgcaccggctgcaggacccagtgccgcttctttgacatgacccagtgcatcggccccaacggctacatggagccctactgcagcacagcctgcatgaacagccacaagaccaagtatgccaagagccagagcctgggcatcatctgccacttctgcaagaggaacagcctgccccagtaccaggccaccatgccagatggcaagctgtacaacttctgcaacagcagctgtgtggccaagttccaggccctgtccatgcagagcagccccaacggccagtttgtggcccccagcgacatccagctgaagtgcaactactgcaagaacagcttctgcagcaagccagagatcctggagtgggagaacaaggtgcaccagttctgcagcaagacctgcagtgatgactacaagaagctgcactgcatcgtgacctactgtgagtactgccaggaggagaagaccctgcatgaaacagtgaacttctctggagtgaagaggcccttctgcagcgagggctgcaagctgctgtacaagcaggactttgcccggcggctgggcctgcgctgtgtgacctgcaactactgcagccagctgtgcaagaagggggccaccaaggagctggatggagtggtgcgggacttctgcagcgaggactgctgcaagaagttccaggactggtactacaaggccgcccgctgtgactgctgcaagagccagggcaccctgaaggagcgggtgcagtggagaggagagatgaagcacttctgtgaccagcactgcctgctgcgcttctactgccagcagaatgagcccaacatgaccacccagaagggccctgagaacctgcactatgaccagggctgccagaccagcaggaccaagatgactggaagtgcccccccacccagccccacccccaacaaggagatgaagaacaaggctgtgctgtgcaagcccctgaccatgaccaaggccacctactgcaagccccacatgcagaccaagagctgccagacagacatcacctggaggatccagcacctgatcctgaaccactatgaccagagcctcatcaaggcctag

SEQ ID NO: 177145 - DNA, 4134 bp, Artificial Sequence; identical to SEQ ID NO: 177141
  Description of Artificial Sequence: Synthetic coding sequence

SEQ ID NO: 177146 - DNA, 4113 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagaggaagaggtctgagcgggtgcggcgggcagagccccccaagccagaggtggtggacagcacagagagcatccctgtgtctgatgaagattctgatgccatggtggatgaccccaatgatgaagattttgtgcccttccggcccaggaggagccccaggatgagcctgcggagctctgtgtcccagagagctggccgctctgctgtgggcaccaagatgacctgtgcccactgcaggacccccctgcagaagggccagacagcctaccagaggaagggcctgccccagctgttctgcagcagcagctgcctgaccaccttcagcaagaagcccagcggcaagaagacctgcaccttctgcaagaaggagatctggaacaccaaggacagcgtggtggcccagacaggcagcggcggcagcttccacgagttctgcacctctgtgtgcctgagcctgtatgaggcccagcagcagaggcccatcccccagagcggggaccctgcagatgccacccgctgcagcatctgccagaagacaggagaggtgctgcacgaggtgtccaatggatctgtggtgcaccggctgtgcagcgacagctgcttcagcaagttccgggccaacaagggcctgaagaccaactgctgtgaccagtgtggggcctacatctacaccaagacaggcagccctggccctgagctgctcttccacgagggccagcagaagcgcttctgcaacaccacctgcctgggcgcctacaagaagaagaacaccagggtgtacccctgtgtgtggtgcaagaccctgtgcaagaactttgagatgctgagccacgtggacagaaatggcaagaccagcctcttctgcagcctgtgctgcaccaccagctacaaggtgaagcaggccggcctgaccggccccccccggccctgcagcttctgccgccgcagcctgagtgacccctgctactacaacaaggtggacagaacagtgtaccagttctgcagccccagctgctggaccaagttccagaggaccagccctgagggcggcatccacctgagctgccactactgccacagcctcttcagcggcaagccagaggtgctggactggcaggaccaggtgttccagttctgctgccgggactgctgtgaggacttcaagaggctgcggggcgtggtgtcccagtgtgagcactgccggcaggagaagctgctgcacgagaagctgcgcttctctggagtggagaagagcttctgcagcgagggctgtgtgctgctgtacaagcaggacttcaccaagaagctgggcctgtgctgcatcacctgcacctactgcagccagacctgccagaggggcgtgacagagcagctggatggcagcacctgggacttctgcagcgaggactgcaagagcaagtacctgctgtggtactgcaaggccgcccgctgccacgcctgcaagaggcagggcaagctgctggagaccatccactggaggggccagatccgccacttctgcaaccagcagtgcctgctgcgcttctacagccagcagaaccagcccaacctggacacccagagcggccctgagagcctgctgaacagccagagccctgagagcaagccccagacccccagccagaccaaggtggagaacagcaacacagtgaggaccccagaggagaatggaaacctgggcaagatccctgtgaagaccaggtctgcccccacagcccccaccccacctcctcctcctcctccagccacccccaggaagaacaaggccgccatgtgcaagcccctgatgcagaacagaggagtgtcctgcaaggtggagatgaagagcaagggcagccagacagaggagtggaagccccaggtgattgtgctgcccatccctgtgcccatctttgtgcctgtgcccatgcacctgtactgccagaaggtgcctgtgcccttctccatgcccatccctgtgcctgtgcccatgttcctgcccaccaccctggagagcacagacaagatcgtggagaccatcgaggagctgaaggtgaagatccccagcaaccccctggaggccgacatcctggccatggccgagatgattgctgaggccgaggagctggacaaggccagcagtgacctgtgtgacctggtgagcaaccagagcgctgagggcctgctggaggactgtgacctgtttggacctgccagagatgatgtgctggccatggctgtgaagatggccaacgtgctggatgagcccggccaggacctggaggccgacttccccaagaaccccctggacatcaaccccagcgtggacttcctgtttgactgtggcctggtgggcccagaagatgtgtccacagagcaggacctgcccaggaccatgaggaagggccagaagaggctggtgctgtctgagagctgcagccgggacagcatgagcagccagcccagctgcaccggcctgaactacagctatggagtgaatgcctggaagtgctgggtgcagagcaaatatgccaatggagagaccagcaaaggagatgagctgcgcttcggccccaagcccatgaggatcaaggaggacatcctggcctgcagcgctgctgagctgaactacggcctggcccagtttgtgcgggagatcacccggcccaacggggagagatatgagccagacagcatctactacctgtgcctgggcatccagcagtacctgctggagaacaacaggatggtgaacatcttcacagacctgtactacctgacctttgtgcaggagctgaacaagagcctgagcacctggcagcccaccctgctgcccaacaacacagtgttcagccgggtggaggaggagcacctgtgggagtgcaagcagctgggcgtgtacagcccctttgtgctgctgaacaccctgatgttcttcaacaccaagttcttcggcctgcagacagctgaggagcacatgcagctgtccttcaccaacgtggtgcggcagagcaggaagtgcaccaccccccggggcaccaccaaggtggtgtccatccgctactatgcccctgtgcggcagaggaagggccgggacaccggccctgggaagaggaagagagaagatgaggcccccatcctggagcagagagaaaataggatgaaccccctgcgctgccctgtgaagttctatgagttctacctgagcaagtgcccagagagcctgcggaccagaaatgatgtgttctacctgcagcctgagaggagctgcatcgccgagagccccctgtggtacagcgtcatccccatggaccgctccatgctggagagcatgctgaaccgcatcctggccgtgcgggagatctatgaggagctgggccggcctggagaggaggacctggactag

SEQ ID NO: 177147 - DNA, 4113 bp, Artificial Sequence; identical to SEQ ID NO: 177146
  Description of Artificial Sequence: Synthetic coding sequence

SEQ ID NO: 177148 - DNA, 1050 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagcgggtgcagaagaggtctgagcgggtgcggcgggcagagccccccaagccagaggtggtggacagcacagagagccgccgcagcggcacccccaggacccggctgtggaggcggctggtgctggaggcccccagcatgagcagcgcccaccccagcgtgagcccctgcatgaggcccagcagcagcgcccggagccccagcctgggcatcccccccaccctgctggccgccgcctatgcccggcggctggagaggagctgcaccaggtctgccatggccgcctggtacacaggcagcgctgccatcctggccagccccaacagcggccccacccgggactag

SEQ ID NO: 177149 - DNA, 1488 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagaggaagaggtctgagcgggtgcggcgggcagagccccccaagccagaggtggtggacagcacagagagcatccctgtgtctgatgaagattctgatgccatggtggatgaccccaatgatgaagattttgtgcccttccggcccaggaggagccccaggatgagcctgcggagctctgtgtcccagagagctggccgctctgctgtgggcaccaagatgacctgtgcccactgcaggacccccctgcagaagggccagacagcctaccagaggaagggcctgccccagctgttctgcagcagcagctgcctgaccaccttcagcaagaagcccagcggcaagaagacctgcaccttctgcaagaaggagatctggaacaccaaggacagcgtggtggcccagacaggcagcggcggcagcttccacgagttctgcacctctgtgtgcctgagcctgtatgaggcccagcagcagaggcccatcccccagagcggggaccctgcagatgccacccgctgcagcatctgccagaagacaggagaggtgctgcacgaggtgtccaatggatctgtggtgcaccggctgtgcagcgacagctgcttcagcaagttccgggccaacaagggcctgaagaccaactgctgtgaccagtgtggggcctacatctacaccaagacaggcagccctggccctgagctgctcttccacgagggccagcagaagcgcttctgcaacaccacctgcctgggcgcctacaagaaggtgggcccccgggagtag

SEQ ID NO: 177150 - DNA, 1494 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagcgggtgcagaagaggtctgagcgggtgcggcgggcagagccccccaagccagaggtggtggacagcacagagagcatccctgtgtctgatgaagattctgatgccatggtggatgaccccaatgatgaagattttgtgcccttccggcccaggaggagccccaggatgagcctgcggagctctgtgtcccagagagctggccgctctgctgtgggcaccaagatgacctgtgcccactgcaggacccccctgcagaagggccagacagcctaccagaggaagggcctgccccagctgttctgcagcagcagctgcctgaccaccttcagcaagaagcccagcggcaagaagacctgcaccttctgcaagaaggagatctggaacaccaaggacagcgtggtggcccagacaggcagcggcggcagcttccacgagttctgcacctctgtgtgcctgagcctgtatgaggcccagcagcagaggcccatcccccagagcggggaccctgcagatgccacccgctgcagcatctgccagaagacaggagaggtgctgcacgaggtgtccaatggatctgtggtgcaccggctgtgcagcgacagctgcttcagcaagttccgggccaacaagggcctgaagaccaactgctgtgaccagtgtggggcctacatctacaccaagacaggcagccctggccctgagctgctcttccacgagggccagcagaagcgcttctgcaacaccacctgcctgggcgcctacaagaaggtgggcccccgggagtag

SEQ ID NO: 177151 - DNA, 3843 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagcgggtgcagaagaggtctgagcgggtgcggcgggcagagccccccaagccagaggtggtggacagcacagagagcatccctgtgtctgatgaagattctgatgccatggtggatgaccccaatgatgaagattttgtgcccttccggcccaggaggagccccaggatgagcctgcggagctctgtgtcccagagagctggccgctctgctgtgggcaccaagatgacctgtgcccactgcaggacccccctgcagaagggccagacagcctaccagaggaagggcctgccccagctgttctgcagcagcagctgcctgaccaccttcagcaagaagcccagcggcaagaagacctgcaccttctgcaagaaggagatctggaacaccaaggacagcgtggtggcccagacaggcagcggcggcagcttccacgagttctgcacctctgtgtgcctgagcctgtatgaggcccagcagcagaggcccatcccccagagcggggaccctgcagatgccacccgctgcagcatctgccagaagacaggagaggtgctgcacgaggtgtccaatggatctgtggtgcaccggctgtgcagcgacagctgcttcagcaagttccgggccaacaagggcctgaagaccaactgctgtgaccagtgtggggcctacatctacaccaagacaggcagccctggccctgagctgctcttccacgagggccagcagaagcgcttctgcaacaccacctgcctgggcgcctacaagaagaagaacaccagggtgtacccctgtgtgtggtgcaagaccctgtgcaagaactttgagatgctgagccacgtggacagaaatggcaagaccagcctcttctgcagcctgtgctgcaccaccagctacaaggtgaagcaggccggcctgaccggccccccccggccctgcagcttctgccgccgcagcctgagtgacccctgctactacaacaaggtggacagaacagtgtaccagttctgcagccccagctgctggaccaagttccagaggaccagccctgagggcggcatccacctgagctgccactactgccacagcctcttcagcggcaagccagaggtgctggactggcaggaccaggtgttccagttctgctgccgggactgctgtgaggacttcaagaggctgcggggcgtggtgtcccagtgtgagcactgccggcaggagaagctgctgcacgagaagctgcgcttctctggagtggagaagagcttctgcagcgagggctgtgtgctgctgtacaagcaggacttcaccaagaagctgggcctgtgctgcatcacctgcacctactgcagccagacctgccagaggggcgtgacagagcagctggatggcagcacctgggacttctgcagcgaggactgcaagagcaagtacctgctgtggtactgcaaggccgcccgctgccacgcctgcaagaggcagggcaagctgctggagaccatccactggaggggccagatccgccacttctgcaaccagcagtgcctgctgcgcttctacagccagcagaaccagcccaacctggacacccagagcggccctgagagcctgctgaacagccagagccctgagagcaagccccagacccccagccagaccaaggtggagaacagcaacacagtgaggaccccagaggagaatggaaacctgggcaagatccctgtgaagaccaggtctgcccccacagcccccaccccacctcctcctcctcctccagccacccccaggaagaacaaggccgccatgtgcaagcccctgatgcagaacagaggagtgtcctgcaaggtggagatgaagagcaagggcagccagacagaggagtggaagccccaggtgattgtgctgcccatccctgtgcccatctttgtgcctgtgcccatgcacctgtactgccagaaggtgcctgtgcccttctccatgcccatccctgtgcctgtgcccatgttcctgcccaccaccctggagagcacagacaagatcgtggagaccatcgaggagctgaaggtgaagatccccagcaaccccctggaggccgacatcctggccatggccgagatgattgctgaggccgaggagctggacaaggccagcagtgacctgtgtgacctggtgagcaaccagagcgctgagggcctgctggaggactgtgacctgtttggacctgccagagatgatgtgctggccatggctgtgaagatggccaacgtgctggatgagcccggccaggacctggaggccgacttccccaagaaccccctggacatcaaccccagcgtggacttcctgtttgactgtggcctggtgggcccagaagatgtgtccacagagcaggacctgcccaggaccatgaggaagggccagaagaggctggtgctgtctgagagctgcagccgggacagcatgagcagccagcccagctgcaccggcctgaactacagctatggagtgaatgcctggaagtgctgggtgcagagcaaatatgccaatggagagaccagcaaggccaagcccatgaggatcaaggaggacatcctggcctgcagcgctgctgagctgaactacggcctggcccagtttgtgcgggagatcacccggcccaatggagagagatatgagccagacagcatctactacctgtgcctgggcatccagcagtacctgctggagaacaacaggatggtgaacatcttcacagacctgtactacctgacctttgtgcaggagctgaacaagagcctgagcacctggcagcccaccctgctgcccaacaacacaggccctgggaagaggaagagagaagatgaggcccccatcctggagcagagagaaaataggatgaaccccctgcgctgccctgtgaagttctatgagttctacctgagcaagtgcccagagagcctgcggaccagaaatgatgtgttctacctgcagcctgagaggagctgcatcgccgagagccccctgtggtacagcgtcatccccatggaccgctccatgctggagagcatgctgaaccgcatcctggccgtgcgggagatctatgaggagctgggccggcctggagaggaggacctggactag

SEQ ID NO: 177152 - DNA, 4119 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagcgggtgcagaagaggtctgagcgggtgcggcgggcagagccccccaagccagaggtggtggacagcacagagagcatccctgtgtctgatgaagattctgatgccatggtggatgaccccaatgatgaagattttgtgcccttccggcccaggaggagccccaggatgagcctgcggagctctgtgtcccagagagctggccgctctgctgtgggcaccaagatgacctgtgcccactgcaggacccccctgcagaagggccagacagcctaccagaggaagggcctgccccagctgttctgcagcagcagctgcctgaccaccttcagcaagaagcccagcggcaagaagacctgcaccttctgcaagaaggagatctggaacaccaaggacagcgtggtggcccagacaggcagcggcggcagcttccacgagttctgcacctctgtgtgcctgagcctgtatgaggcccagcagcagaggcccatcccccagagcggggaccctgcagatgccacccgctgcagcatctgccagaagacaggagaggtgctgcacgaggtgtccaatggatctgtggtgcaccggctgtgcagcgacagctgcttcagcaagttccgggccaacaagggcctgaagaccaactgctgtgaccagtgtggggcctacatctacaccaagacaggcagccctggccctgagctgctcttccacgagggccagcagaagcgcttctgcaacaccacctgcctgggcgcctacaagaagaagaacaccagggtgtacccctgtgtgtggtgcaagaccctgtgcaagaactttgagatgctgagccacgtggacagaaatggcaagaccagcctcttctgcagcctgtgctgcaccaccagctacaaggtgaagcaggccggcctgaccggccccccccggccctgcagcttctgccgccgcagcctgagtgacccctgctactacaacaaggtggacagaacagtgtaccagttctgcagccccagctgctggaccaagttccagaggaccagccctgagggcggcatccacctgagctgccactactgccacagcctcttcagcggcaagccagaggtgctggactggcaggaccaggtgttccagttctgctgccgggactgctgtgaggacttcaagaggctgcggggcgtggtgtcccagtgtgagcactgccggcaggagaagctgctgcacgagaagctgcgcttctctggagtggagaagagcttctgcagcgagggctgtgtgctgctgtacaagcaggacttcaccaagaagctgggcctgtgctgcatcacctgcacctactgcagccagacctgccagaggggcgtgacagagcagctggatggcagcacctgggacttctgcagcgaggactgcaagagcaagtacctgctgtggtactgcaaggccgcccgctgccacgcctgcaagaggcagggcaagctgctggagaccatccactggaggggccagatccgccacttctgcaaccagcagtgcctgctgcgcttctacagccagcagaaccagcccaacctggacacccagagcggccctgagagcctgctgaacagccagagccctgagagcaagccccagacccccagccagaccaaggtggagaacagcaacacagtgaggaccccagaggagaatggaaacctgggcaagatccctgtgaagaccaggtctgcccccacagcccccaccccacctcctcctcctcctccagccacccccaggaagaacaaggccgccatgtgcaagcccctgatgcagaacagaggagtgtcctgcaaggtggagatgaagagcaagggcagccagacagaggagtggaagccccaggtgattgtgctgcccatccctgtgcccatctttgtgcctgtgcccatgcacctgtactgccagaaggtgcctgtgcccttctccatgcccatccctgtgcctgtgcccatgttcctgcccaccaccctggagagcacagacaagatcgtggagaccatcgaggagctgaaggtgaagatccccagcaaccccctggaggccgacatcctggccatggccgagatgattgctgaggccgaggagctggacaaggccagcagtgacctgtgtgacctggtgagcaaccagagcgctgagggcctgctggaggactgtgacctgtttggacctgccagagatgatgtgctggccatggctgtgaagatggccaacgtgctggatgagcccggccaggacctggaggccgacttccccaagaaccccctggacatcaaccccagcgtggacttcctgtttgactgtggcctggtgggcccagaagatgtgtccacagagcaggacctgcccaggaccatgaggaagggccagaagaggctggtgctgtctgagagctgcagccgggacagcatgagcagccagcccagctgcaccggcctgaactacagctatggagtgaatgcctggaagtgctgggtgcagagcaaatatgccaatggagagaccagcaaaggagatgagctgcgcttcggccccaagcccatgaggatcaaggaggacatcctggcctgcagcgctgctgagctgaactacggcctggcccagtttgtgcgggagatcacccggcccaacggggagagatatgagccagacagcatctactacctgtgcctgggcatccagcagtacctgctggagaacaacaggatggtgaacatcttcacagacctgtactacctgacctttgtgcaggagctgaacaagagcctgagcacctggcagcccaccctgctgcccaacaacacagtgttcagccgggtggaggaggagcacctgtgggagtgcaagcagctgggcgtgtacagcccctttgtgctgctgaacaccctgatgttcttcaacaccaagttcttcggcctgcagacagctgaggagcacatgcagctgtccttcaccaacgtggtgcggcagagcaggaagtgcaccaccccccggggcaccaccaaggtggtgtccatccgctactatgcccctgtgcggcagaggaagggccgggacaccggccctgggaagaggaagagagaagatgaggcccccatcctggagcagagagaaaataggatgaaccccctgcgctgccctgtgaagttctatgagttctacctgagcaagtgcccagagagcctgcggaccagaaatgatgtgttctacctgcagcctgagaggagctgcatcgccgagagccccctgtggtacagcgtcatccccatggaccgctccatgctggagagcatgctgaaccgcatcctggccgtgcgggagatctatgaggagctgggccggcctggagaggaggacctggactag

SEQ ID NO: 177153 - DNA, 4077 bp, Artificial Sequence
  Description of Artificial Sequence: Synthetic coding sequence
atggaccccagcgacttccccagcccctttgaccccctgaccctgcctgagaagcccctggccggggacctgcctgtggacatggagtttggagaggacctgctggagagccagacagcccccacccggggctgggcccctcctggccccagccccagcagcggggccctggacctgctggacaccccagctggcctggagaaggaccccggggtgctggatggagccacagagctgctgggcctgggcggcctgctgtacaaggcccccagccccccagaggtggaccacggccctgagggcaccctggcctgggatgctggggaccagaccctggagcccggccctgggggccagaccccagaggtggtgcccccagaccccggggccggggccaacagctgcagccctgagggcctgctggagcccctggccccagacagccccatcaccctgcagagcccccacatcgaggaggaggagaccaccagcatcgccacagcccggcggggcagccctggccaggaggaggagctgccccagggccagccccagagccccaatgccccacccagccccagcgtgggggagaccctgggagatggcatcaacagcagccagaccaagccaggcggcagcagccccccagcccaccccagcctgcctggagatggcctgacagccaaggccagcgagaagcccccagagaggaagaggtctgagcgggtgcggcgggcagagccccccaagccagaggtggtggacagcacagagagcatccctgtgtctgatgaagattctgatgccatggtggatgaccccaatgatgaagattttgtgcccttccggcccaggaggagccccaggatgagcctgcggagctctgtgtcccagagagctggccgctctgctgtgggcaccaagatgacctgtgcccactgcaggacccccctgcagaagggccagacagcctaccagaggaagggcctgccccagctgttctgcagcagcagctgcctgaccaccttcagcaagaagcccagcggcaagaagacctgcaccttctgcaagaaggagatctggaacaccaaggacagcgtggtggcccagacaggcagcggcggcagcttccacgagttctgcacctctgtgtgcctgagcctgtatgaggcccagcagcagaggcccatcccccagagcggggaccctgcagatgccacccgctgcagcatctgccagaagacaggagaggtgctgcacgaggtgtccaatggatctgtggtgcaccggctgtgcagcgacagctgcttcagcaagttccgggccaacaagggcctgaagaccaactgctgtgaccagtgtggggcctacatctacaccaagacaggcagccctggccctgagctgctcttccacgagggccagcagaagcgcttctgcaacaccacctgcctgggcgcctacaagaagaagaacaccagggtgtacccctgtgtgtggtgcaagaccctgtgcaagaactttgagatgctgagccacgtggacagaaatggcaagaccagcctcttctgcagcctgtgctgcaccaccagctacaaggtgaagcaggccggcctgaccggccccccccggccctgcagcttctgccgccgcagcctgagtgacccctgctactacaacaaggtggacagaacagtgtaccagttctgcagccccagctgctggaccaagttccagaggaccagccctgagggcggcatccacctgagctgccactactgccacagcctcttcagcggcaagccagaggtgctggactggcaggaccaggtgttccagttctgctgccgggactgctgtgaggacttcaagaggctgcggggcgtggtgtcccagtgtgagcactgccggcaggagaagctgctgcacgagaagctgcgcttctctggagtggagaagagcttctgcagcgagggctgtgtgctgctgtacaagcaggacttcaccaagaagctgggcctgtgctgcatcacctgcacctactgcagccagacctgccagaggggcgtgacagagcagctggatggcagcacctgggacttctgcagcgaggactgcaagagcaagtacctgctgtggtactgcaaggccgcccgctgccacgcctgcaagaggcagggcaagctgctggagaccatccactggaggggccagatccgccacttctgcaaccagcagtgcctgctgcgcttctacagccagcagaaccagcccaacctggacacccagagcggccctgagagcctgctgaacagccagagccctgagagcaagccccagacccccagccagaccaaggtggagaacagcaacaccatccctgtgaagaccaggtctgcccccacagcccccaccccacctcctcctcctcctccagccacccccaggaagaacaaggccgccatgtgcaagcccctgatgcagaacagaggagtgtcctgcaaggtggagatgaagagcaagggcagccagacagaggagtggaagccccaggtgattgtgctgcccatccctgtgcccatctttgtgcctgtgcccatgcacctgtactgccagaaggtgcctgtgcccttctccatgcccatccctgtgcctgtgcccatgttcctgcccaccaccctggagagcacagacaagatcgtggagaccatcgaggagctgaaggtgaagatccccagcaaccccctggaggccgacatcctggccatggccgagatgattgctgaggccgaggagctggacaaggccagcagtgacctgtgtgacctggtgagcaaccagagcgctgagggcctgctggaggactgtgacctgtttggacctgccagagatgatgtgctggccatggctgtgaagatggccaacgtgctggatgagcccggccaggacctggaggccgacttccccaagaaccccctggacatcaaccccagcgtggacttcctgtttgactgtggcctggtgggcccagaagatgtgtccacagagcaggacctgcccaggaccatgaggaagggccagaagaggctggtgctgtctgagagctgcagccgggacagcatgagcagccagcccagctgcaccggcctgaactacagctatggagtgaatgcctggaagtgctgggtgcagagcaaatatgccaatggagagaccagcaaaggagatgagctgcgcttcggccccaagcccatgaggatcaaggaggacatcctggcctgcagcgctgctgagctgaactacggcctggcccagtttgtgcgggagatcacccggcccaacggggagagatatgagccagacagcatctactacctgtgcctgggcatccagcagtacctgctggagaacaacaggatggtgaacatcttcacagacctgtactacctgacctttgtgcaggagctgaacaagagcctgagcacctggcagcccaccctgctgcccaacaacacagtgttcagccgggtggaggaggagcacctgtgggagtgcaagcagctgggcgtgtacagcccctttgtgctgctgaacaccctgatgttcttcaacaccaagttcttcggcctgcagacagctgaggagcacatgcagctgtccttcaccaacgtggtgcggcagagcaggaagtgcaccaccccccggggcaccaccaaggtggtgtccatccgctactatgcccctgtgcggcagaggaagggccgggacaccggccctgggaagaggaagagagaagatgaggcccccatcctggagcagagagaaaataggatgaaccccctgcgctgccctgtgaagttctatgagttctacctgagcaagtgcccagagagcctgcggaccagaaatgatgtgttctacctgcagcctgagaggagctgcatcgccgagagccccctgtggtacagcgtcatccccatggaccgctccatgctggagagcatgctgaaccgcatcctggccgtgcgggagatctatgaggagctgggccggcctggagaggaggacctggactag

SEQ ID NO: 177154 - DNA, 2112 bp, Artificial Sequence; identical to SEQ ID NO: 176438
  Description of Artificial Sequence: Synthetic coding sequence

SEQ ID NO: 177155 - DNA, 2229 bp, Artificial Sequence
  Description of Artificial Sequence: Synthetic coding sequence
atggagtttgtgtctggctacagagatgagttcctggacttcaccgccctgctgtttggctggttcaggaagtttgtggccgagagaggagctgtgggcaccagcctggagggccgctgccggcagctggaggcccagatccggcggctgccccaggaccctgccctgtgggtgctgcacgtgctgcccaaccacagcgtgggcatcagcctgggccagggcgctgagcccggccctggccctggcctgggcacagcctggctgctgggggacaacccccccctgcacctgcgggacctgagcccctacatcagctttgtgtccctggaggatggagaggagggggaggaggaggaggaggaggatgaggaggaggagaagagagaagatggaggagctggcagcacagagaaggtggagccagaagaagatcgggagctggcccccaccagccgggagagcccccaggagaccaaccccccaggagagagcgaggaggccgcccgggaggccggcggcggcaaggatggctgccgggaggacagagtggagaatgagacccggccccagaagaggaagggccagaggtctgaggccgcccccctgcacgtgtcctgcctgctgctggtgacagatgagcacggcaccatcctgggcatcgacctgctggtggatggagcccagggcacagcctcctggggcagcggcaccaaggacctggccccctgggcctatgccctgctgtgccacagcatggcctgccccatgggcagcggggaccccaggaagccccggcagctgactgtgggagatgcccggctgcaccgggagctggagagcctggtgccccggctgggcgtgaagctggccaagacccccatgaggacctggggccccaggcctggcttcacctttgccagcctgcgggcccggacctgccacgtgtgccaccgccacagctttgaggccaagctgaccccctgcccccagtgcagcgctgtgctgtactgtggggaggcctgcctgcgggctgactggcagcgctgcccagatgatgtgagccaccgcttctggtgcccccggctggccgccttcatggagagagctggggagctggccaccctgcccttcacctacacagctgaggtgaccagcgagaccttcaacaaggaggccttcctggccagccggggcctgacccggggctactggacccagctgtccatgctgatccctggccctggcttcagccgccacccccggggcaacacccccagcctgagcctgctgcggggcggggacccctaccagctgctgcagggagatggaacagccctgatgcctcctgtgcccccccaccccccccggggcgtgtttggctcctggcaggactactacacctggaggggcctgagcctggacagccccatcgctgtgctgctgacctaccccctgactgtgtactacgtgatcacccacctggtgccccagagcttccctgagctgaacatccagaacaagcagagcctgaagatccacgtggtggaggccggcaaggagtttgacctggtgatggtgttctgggagctgctggtgctgctgccccacgtggccctggagctgcagtttgtgggagatggcctgcccccagagagtgatgagcagcacttcaccctgcagagggacagcctggaggtgtctgtgcggcccggcagcggcatcagcgcccggcccagcagcggcaccaaggagaagggcggccggcgggacctgcagatcaaggtgtctgcccggccctaccacctgttccagggccccaagccagacctggtgattggcttcaacagcggctttgccctgaaggacacctggctgcggagcctgccccggctgcagagcctgcgggtgcctgccttcttcacagagagcagcgagtacagctgtgtgatggatggccagaccatggctgtggccactggaggcggcaccagccccccccagcccaaccccttccgcagccccttccggctgcgggctgctgacaactgcatgtcctggtactgcaatgccttcatcttccacctggtgtacaagccagcccagggcagcggggcccggcctgcccctggccccccaccacccagccccaccccatctgcccccccagcccccaccaggagaagaagaggagagaagaagccaggccgcggggcccggcggaggaagtag

SEQ ID NO: 177156 - DNA, 684 bp, Artificial Sequence
  Description of Artificial Sequence: Synthetic coding sequence
atgacagacttcaagctgggcatcgtgcggctgggccgggtggccggcaagaccaagtacaccctgattgatgagcaggacatccccctggtggagagctacagctttgaggccaggatggaggtggatgctgatggaaatggagccaagatctttgcctatgcctttgacaagaacagaggccggggcagcggccgcctgctgcacgagctgctgtgggagcggcaccggggcggcgtggcccctggcttccaggtggtgcacctgaatgctgtgacagtggacaaccggctggacaacctgcagctggtgccctggggctggaggcccaaggccgaggagaccagcagcaagcagcgggagcagagcctgtactggctggccatccagcagctgcccacagaccccatcgaggagcagtttcctgtgctgaatgtgacccgctactacaatgccaatggagatgtggtggaggaggaggagaacagctgcacctactatgagtgccactacccaccctgcaccgtgattgagaagcagctgcgggagttcaacatctgtggccgctgccaggtggcccgctactgcggcagccagtgccagcagaaggactggccagcccacaagaagcactgccgggagaggaagaggcccttccagcacgagctggagcctgagaggtag

SEQ ID NO: 177157 - DNA, 2127 bp, Artificial Sequence
  Description of Artificial Sequence: Synthetic coding sequence
atgtctgagcggggcatcaagtgggcctgtgagtactgcacctatgagaactggcccagcgccatcaagtgcaccatgtgccgggcccagaggccttctggcaccatcatcacagaggaccccttcaagagcggcagcagtgatgtgggccgggactgggaccccagcagcacagagggcggcagcagccccctcatctgcccagacagcagcgcccggccccgggtgaagagcagctacagcatggagaatgccaacaagtggagctgccacatgtgcacctacctgaactggccccgggccatccgctgcacccagtgcctgagccagaggaggaccaggagccccacagagagcccccagagcagcggcagcggcagcaggcctgtggccttctctgtggacccctgtgaggagtacaatgacaggaacaagctgaacaccaggacccagcactggacctgcagcgtgtgcacctatgagaactgggccaaggccaagagatgtgtggtgtgtgaccacccccggcccaacaacatcgaggccatcgagctggccgagacagaggaggccagcagcatcatcaatgagcaggaccgggcccgctggaggggcagctgcagcagcggcaacagccagaggaggagccccccagccaccaagagggacagcgaggtgaagatggacttccagagaattgagctggccggggctgtgggcagcaaggaggagctggaggtggacttcaagaagctgaagcagatcaagaacaggatgaagaagacagactggctgttcctgaatgcctgtgtgggcgtggtggagggggacctggccgccatcgaggcctacaagagcagtggaggagacatcgcccggcagctgacagcagatgaggtgcggctgctgaaccggcccagcgcctttgatgtgggctacaccctggtgcacctggccatccgcttccagaggcaggacatgctggccatcctgctgacagaggtgtcccagcaggccgccaagtgcatcccagccatggtgtgcccagagctgacagagcagatccggcgggagattgctgccagcctgcaccagaggaaaggagactttgcctgctacttcctgacagacctggtgaccttcaccctgcctgctgacatcgaggacctgcccccaacagtgcaggagaagctgtttgatgaggtgctggacagagatgtgcagaaggagctggaggaggagagccccatcatcaactggagcctggagctggccacccggctggacagccggctgtatgccctgtggaacagaacagctggggactgcctgctggacagcgtgctgcaggccacctggggcatctatgacaaggacagcgtgctgaggaaggccctgcatgacagcctgcatgactgcagccactggttctacacccgctggaaggactgggagagctggtacagccagagctttggcctgcacttcagcctgcgggaggagcagtggcaggaggactgggccttcatcctgagcctggccagccagcccggggccagcctggagcagacccacatctttgtgctggcccacatcctgcggcggcccatcatcgtgtatggagtgaagtactacaagagcttccggggggagaccctgggctacacccgcttccagggcgtgtacctgcccctgctgtgggagcagagcttctgctggaagagccccatcgccctgggctacacccggggccacttcagcgccctggtggccatggagaatgatggctacggcaacagaggagctggggccaacctgaacacagatgatgatgtgaccatcaccttcctgcccctggtggacagcgagaggaagctgctgcacgtgcacttcctgagcgcccaggagctgggcaatgaggagcagcaggagaagctgctgcgggagtggctggactgctgcgtgacagagggcggcgtgctggtggccatgcagaagagcagcagaagaagaaaccaccccctggtgacccagatggtggagaagtggctggaccgctaccggcagatccggccctgcaccagcctgagtgatggagaagaagatgaagatgatgaagatgaatag

SEQ ID NO: 177158 - DNA, 2400 bp, Artificial Sequence
  Description of Artificial Sequence: Synthetic coding sequence
atggagatccccaagctgctgcctgcccggggcaccctgcagggcggcggcggcggcggcatcccagctgggggcggccgggtgcaccggggccctgacagccctgctggccaggtgcccacccggcggctgctgctgccccggggcccccaggacggcggccctggaagaagaagagaggaggccagcacagccagccggggccctggccccagcctgtttgccccccggccccaccagcccagcggcggcggagatgacttcttcctggtgctgctggaccctgtgggcggagatgtggagacagctggcagcggccaggccgccggccctgtgctgcgggaggaggccaaggccggccctggcctgcagggagatgagagcggggccaacccagctggctgcagcgcccagggcccccactgcctgtctgctgtgcccaccccagcccccatcagcgcccctggccctgctgctgcctttgctggcaccgtgaccatccacaaccaggacctgctgctgcgctttgaaaatggagtgctgaccctggccaccccacctcctcatgcctgggagcctggagctgccccagcccagcagccccgctgcctgattgccccccaggccggcttcccccaggccgcccaccctggggactgcccagagctgcggagtgacctgctgctggccgagcctgctgagcccgccccagccccagccccccaggaggaggccgagggcctggccgccgccctgggcccccggggcctgctgggcagcggccctggggtggtgctgtacctgtgcccagaggccctgtgtggccagacctttgccaagaagcaccagctgaagatgcacctgctgacccacagcagcagccagggccagaggcccttcaagtgccccctgggcggctgcggctggaccttcaccaccagctacaagctgaagaggcacctgcagagccatgacaagctgcggcccttcggctgcccagctgagggctgcggcaagagcttcaccaccgtgtacaacctgaaggcccacatgaagggccacgagcaggagaacagcttcaagtgtgaggtgtgtgaggagagcttccccacccaggccaagctgggcgcccaccagaggagccactttgagcctgagcggccctaccagtgtgccttcagcggctgcaagaagaccttcatcaccgtgtctgccctcttcagccacaacagagcccacttccgggagcaggagctgttcagctgcagcttccctggctgcagcaagcagtatgacaaggcctgccgcctgaagatccacctgcggagccacactggagagcggcccttcctgtgtgactttgatggctgcggctggaacttcacctccatgagcaagctgctgcggcacaagaggaagcatgatgatgaccggcgcttcatgtgccctgtggagggctgcggcaagagcttcaccagggctgagcacctgaagggccacagcatcacccacctgggcaccaagccctttgtgtgccctgtggccggctgctgtgcccgcttcagcgcccggagcagcctgtacatccacagcaagaagcacctgcaggatgtggacacctggaagagccgctgccccatcagcagctgcaacaagctgttcaccagcaagcacagcatgaagacccacatggtgaagaggcacaaggtgggccaggacctgctggcccagctggaggccgccaacagcctgacccccagcagcgagctgaccagccagaggcagaatgacctgagtgatgctgagatcgtgtccctcttcagtgatgtgcctgacagcaccagcgctgccctgctggacacagccctggtgaacagcggcatcctgaccattgatgtggcctctgtgagcagcaccctggccggccacctgcctgccaacaacaacaacagcgtgggccaggccgtggacccccccagcctgatggccaccagtgaccccccccagagcctggacaccagcctcttctttggaacagctgccaccggcttccagcagagcagcctgaacatggatgaggtgtcctctgtgtctgtgggccccctgggcagcctggacagcctggccatgaagaacagcagccctgagccccaggccctgacccccagcagcaagctgactgtggacacagacaccctgacccccagcagcaccctgtgtgaaaattctgtgtctgagctgctgaccccagccaaggccgagtggagcgtgcaccccaacagcgacttcttcggccaggagggggagacccagtttggcttccccaatgctgctggcaaccacggcagccagaaggagaggaacctgatcaccgtgacaggcagcagcttcctggtgtag

SEQ ID NO: 177159 - DNA, 2412 bp, Artificial Sequence
  Description of Artificial Sequence: Synthetic coding sequence
atggagatccccaagctgctgcctgcccggggcaccctgcagggcggcggcggcggcggcatcccagctgggggcggccgggtgcaccggggccctgacagccctgctggccaggtgcccacccggcggctgctgctgctgcggggcccccaggacggcggccctggaagaagaagagaggaggccagcacagccagccggggccctggccccagcctgctggcccccaggacagaccagcccagcggcggcggcggcggcggcggagatgacttcttcctggtgctgctggaccctgtgggcggagatgtggagacagctggcagcggccaggccgccggccctgtgctgcgggaggaggccgaggagggccctggcctgcagggcggggagagcggggccaacccagctggccccacagccctgggcccccgctgcctgtctgctgtgcccaccccagcccccatcagcgcccctggccctgctgctgcctttgctggcaccgtgaccatccacaaccaggacctgctgctgcgctttgaaaatggagtgctgaccctggccaccccacctcctcatgcctgggagcctggagctgccccagcccagcagcccggctgcctgattgccccccaggccggcttcccccacgccgcccaccctggggactgcccagagctgcccccagacctgctgctggccgagcctgctgagcccgccccagccccagcccctgaggaggaggccgagggccctgctgctgccctgggcccccggggccccctgggcagcggccctggggtggtgctgtacctgtgcccagaggcccagtgtggccagacctttgccaagaagcaccagctgaaggtgcacctgctgacccacagcagcagccagggccagaggcccttcaagtgccccctgggcggctgcggctggaccttcaccaccagctacaagctgaagaggcacctgcagagccatgacaagctgcggcccttcggctgcccagctgagggctgcggcaagagcttcaccaccgtgtacaacctgaaggcccacatgaagggccacgagcaggagaacagcttcaagtgtgaggtgtgtgaggagagcttccccacccaggccaagctgagcgcccaccagaggagccactttgagcctgagcggccctaccagtgtgccttcagcggctgcaagaagaccttcatcaccgtgtctgccctcttcagccacaacagagcccacttccgggagcaggagctgttcagctgcagcttccctggctgcagcaagcagtatgacaaggcctgccgcctgaagatccacctgcggagccacactggagagcggcccttcctgtgtgactttgatggctgcggctggaacttcacctccatgagcaagctgctgcggcacaagaggaagcatgatgatgaccggcgcttcatgtgccctgtggagggctgcggcaagagcttcaccagggctgagcacctgaagggccacagcatcacccacctgggcaccaagccctttgtgtgccctgtggccggctgctgtgcccgcttcagcgcccggagcagcctgtacatccacagcaagaagcacctgcaggatgtggacacctggaagagccgctgccccatcagcagctgcaacaagctgttcaccagcaagcacagcatgaagacccacatggtgaagaggcacaaggtgggccaggacctgctggcccagctggaggccgccaacagcctgacccccagcagcgagctgaccagccagaggcagaatgacctgagtgatgctgagatcgtgtccctcttcagtgatgtgcctgacagcaccagcgctgccctgctggacacagccctggtgaacagcggcatcctgaccattgatgtggcctctgtgagcagcaccctggccggccacctgcctgccaacaacaacaacagcgtgggccaggccgtggacccccccagcctgatggccaccagtgaccccccccagagcctggacaccagcctcttctttggaacagctgccaccggcttccagcagagcagcctgaacatggatgaggtgtcctctgtgtctgtgggccccctgggcagcctggacagcctggccatgaagaacagcagccctgagccccaggccctgacccccagcagcaagctgactgtggacacagatgccctgacccccagcagcaccctgtgtgaaaattctgtgtctgagctgctgacccccaccaaggccgagtggaatgtgcacccagacagcgacttcttcggccaggagggggagacccagtttggcttccccaatgctgctggcaaccacggcagccagaaggagacagacctgatcaccgtgacaggcagcagcttcctggtgtag

SEQ ID NO: 177160 - DNA, 2622 bp, Artificial Sequence
  Description of Artificial Sequence: Synthetic coding sequence
atggccagcaggaggaagagcaccaccccctgcatggtgctggccagcgagcaggaccctgacctggagctgatcagtgacctggatgagggcccccctgtgctgacccctgtggagaacaccagggctgagagcatcagcagtgatgaggaggtgcatgaatctgtggacagcgacaaccagcagaacaagaaggtggagggcggctatgagtgcaagtactgcaccttccagaccccagacctgaacatgttcaccttccacgtggacagcgagcaccccaacgtggtgctgaacagcagctatgtgtgtgtggagtgcaacttcctgaccaagagatatgatgccctgtctgagcacaacctgaagtaccaccctggagaggagaacttcaagctgaccatggtgaagaggaacaaccagaccatctttgagcagaccatcaatgacctgacctttgatggcagctttgtgaaggaggagaatgctgagcaggccgagagcacagaggtgagcagcagcggcatcagcatcagcaagacccccatcatgaagatgatgaagaacaaggtggagaacaagagaattgctgtgcaccacaacagcgtggaggatgtgcctgaggagaaggaaaatgagatcaagccagaccgggaggagatcgtggagaaccccagcagcagcgccagcgagagcaacaccagcaccagcatcgtgaaccgcatccaccccagcacagccagcacagtggtgaccccagctgctgtgctgcccggcctggcccaggtgatcacagctgtgtctgcccagcagaacagcaacctgatccccaaggtgctgatccctgtgaacagcatccccacctacaatgctgccctggacaacaaccccctgctgctgaacacctacaacaagttcccctaccccaccatgtctgagatcaccgtgctgagcgcccaggccaagtacacagaggagcagatcaagatctggttcagcgcccagaggctgaagcatggagtgtcctggaccccagaggaggtggaggaggcccggaggaagcagttcaatggaacagtgcacacagtgccccagaccatcaccgtcatccccacccacatcagcacaggcagcaatggcctgcccagcatcctgcagacctgccagatcgtgggccagcccggcctggtgctgacccaggtggccggcaccaacaccctgcctgtgacagcccccatcgccctgactgtggccggcgtgcccagccagaacaacatccagaagagccaggtgcctgctgcccagcccacagctgagaccaagccagccacagctgctgtgcccaccagccagagcgtgaagcatgaaacagccctggtgaacccagacagctttggcatccgggccaagaagaccaaggagcagctggccgagctgaaggtgtcctacctgaagaaccagttcccccatgacagcgagatcatccggctgatgaagatcaccggcctgaccaagggggagatcaagaagtggttcagtgacacccgctacaaccagaggaacagcaagagcaaccagtgcctgcacctgaacaatgacagcagcaccaccatcatcatcgacagcagtgatgagaccacagagagccccaccgtgggcacagcccagcccaagcagagctggaaccccttcccagacttcaccccccagaagttcaaggagaagacagctgagcagctgcgggtgctgcaggccagcttcctgaacagctctgtgctgacagatgaggagctgaaccggctgcgggcccagaccaagctgacccggcgggagattgatgcctggttcacagagaagaagaagagcaaggccctgaaggaggagaagatggagattgatgagagcaatgccggcagcagcaaggaggaggccggggagaccagccctgcagatgaaagtggggcccccaagagcggcagcacaggcaagatctgcaagaagaccccagagcagctgcacatgctgaagagcgcctttgtgaggacccagtggcccagccctgaggagtatgacaagctggccaaggagagcggcctggccaggacagacatcgtgtcctggtttggagacaccaggtatgcctggaagaatggaaacctgaagtggtactactactaccagagcgccaacagcagctccatgaatggcctgagcagcctgaggaagaggggccggggccggcccaagggccggggccggggccggccccggggccggccccggggcagcaagaggatcaacaactgggaccggggccccagcctcatcaagttcaagacaggaacagccatcctgaaggactactacctgaagcacaagttcctgaatgagcaggacctggatgagctggtgaacaagagccacatgggctatgagcaggtgcgggagtggtttgctgagcggcagaggagaagtgagctgggcatcgagctgtttgaggagaatgaggaggaggatgaggtgattgatgaccaggaggaggatgaggaggagacagatgacagcgacacctgggagccccccaggcatgtgaagaggaagctgagcaagagtgatgactag

SEQ ID NO: 177161 - DNA, 2622 bp, Artificial Sequence; identical to SEQ ID NO: 177160
  Description of Artificial Sequence: Synthetic coding sequence

SEQ ID NO: 177162 - DNA, 2622 bp, Artificial Sequence; identical to SEQ ID NO: 177160
  Description of Artificial Sequence: Synthetic coding sequence

SEQ ID NO: 177163 - DNA, 1497 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgaacagcgagcacacagacttcaacaaggaccccacctttgtgtgcagcggctgcagcttcctggccaagaccccagagggcctgagcctgcacaatgccacctgccacagcggggaggccagctttgtgtggaatgtggccaagccagacaaccacgtggtggtggagcagagcatccctgagagcaccagcaccccagacctggccggggagcccagcgctgagggcgcagatggccaggccgagatcatcatcaccaagacccccatcatgaagatcatgaagggcaaggccgaggccaagaagatccacaccctgaaggaaaatgtgcccagccagcctgtgggggaggccctgcccaagctgagcactggagagatggaggtgcgggagggggaccacagcttcatcaacggggctgtgcctgtgtcccaggccagcgccagcagcgccaagaacccccacgccgccaacggccccctcatcggcaccgtgcctgtgctgcctgctggcatcgcccagttcctgagcctgcagcagcagccccctgtgcacgcccagcaccacgtgcaccagcccctgcccacagccaaggccctgcccaaggtgatgatccccctgagcagcatccccacctacaatgctgccatggacagcaacagcttcctgaagaacagcttccacaagttcccctaccccaccaaggccgagctgtgctacctgactgtggtgaccaagtacccagaggagcagctgaagatctggttcaccgcccagaggctgaagcagggcatctcctggagccctgaggagattgaagatgccaggaagaagatgttcaacacagtcatccagagcgtgccccagcccaccatcaccgtgctgaacacccccctggtggccagcgctggaaatgtgcagcacctgatccaggccgccctgcccggccacgtggtgggccagcctgagggcactggaggcggcctgctggtgacccagcccctgatggccaacggcctgcaggccaccagcagccccctgcccctgactgtgacctctgtgcccaagcagcccggggtggcccccatcaacacagtgtgcagcaacaccaccagcgctgtgaaggtggtgaatgctgcccagagcctgctgacagcctgccccagcatcaccagccaggccttcctggatgccagcatctacaagtag

SEQ ID NO: 177164 - DNA, 291 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgtag

SEQ ID NO: 177165 - DNA, 2244 bp, Artificial Sequence
  Description of Artificial Sequence: Synthetic coding sequence
atggaggtgcgggagggggaccacagcttcatcaacggggctgtgcctgtgtcccaggccagcgccagcagcgccaagaacccccacgccgccaacggccccctcatcggcaccgtgcctgtgctgcctgctggcatcgcccagttcctgagcctgcagcagcagccccctgtgcacgcccagcaccacgtgcaccagcccctgcccacagccaaggccctgcccaaggtgatgatccccctgagcagcatccccacctacaatgctgccatggacagcaacagcttcctgaagaacagcttccacaagttcccctaccccaccaaggccgagctgtgctacctgactgtggtgaccaagtacccagaggagcagctgaagatctggttcaccgcccagaggctgaagcagggcatctcctggagccctgaggagattgaagatgccaggaagaagatgttcaacacagtcatccagagcgtgccccagcccaccatcaccgtgctgaacacccccctggtggccagcgctggaaatgtgcagcacctgatccaggccgccctgcccggccacgtggtgggccagcctgagggcactggaggcggcctgctggtgacccagcccctgatggccaacggcctgcaggccaccagcagccccctgcccctgactgtgacctctgtgcccaagcagcccggggtggcccccatcaacacagtgtgcagcaacaccaccagcgctgtgaaggtggtgaatgctgcccagagcctgctgacagcctgccccagcatcaccagccaggccttcctggatgccagcatctacaagaacaagaagagccatgagcagctgagcgccctgaagggcagcttctgcaggaaccagtttcctggccagagcgaggtggagcacctgaccaaggtgacaggcctgagcacccgggaggtgaggaagtggttcagtgaccggcgctaccactgcaggaacctgaagggcagccgggccatgatccctggggaccacagcagcatcatcatcgacagcgtgcctgaggtgtccttcagccccagcagcaaggtgcctgaggtgacctgcatccccaccacagccaccctggccacccaccccagcgccaagaggcagagctggcaccagaccccagacttcacccccaccaagtacaaggagcgggcccctgagcagctgcgggccctggagagcagctttgcccagaaccccctgcccctggatgaggagctggaccggctgcggtctgagaccaagatgacccggcgggagattgacagctggttcagcgagaggaggaagaaggtgaatgctgaggagaccaagaaggccgaggagaatgccagccaggaggaggaggaggccgcagaagatgaaggaggagaggaggacctggccagcgagctgcgggtgtctggagaaaatggcagcctggagatgcccagcagccacatcctggccgagaggaaggtgagccccatcaagatcaacctgaagaacctgcgggtgacagaggccaacggcagaaatgagatccctggcctgggcgcctgtgaccctgaagatgatgagagcaacaagctggccgagcagctgcccgggaaggtgtcctgcaagaagacagcccagcagaggcacctgctgcggcagctgtttgtgcagacccagtggcccagcaaccaggactatgacagcatcatggcccagacaggcctgcccaggcctgaggtggtgcgctggtttggagacagccgctatgccctgaagaatggccagctgaagtggtatgaggactacaagaggggcaacttccccccaggcctgctggtgattgcccctggcaaccgggagctgctgcaggactactacatgacccacaagatgctgtatgaggaggacctgcagaacctgtgtgacaagacccagatgagcagccagcaggtgaagcagtggtttgctgagaagatgggagaggagaccagggctgtggccgacaccggcagcgaggaccagggccctggcaccggggagctgacagctgtgcacaagggcatgggagacacctacagcgaggtgtctgaaaattctgagagctgggagccccgggtgcctgaggccagcagcgagccctttgacaccagcagcccccaggccggccggcagctgggctcctggagcctgagcagccagcccctgcccagcctgctgaccctgtag

SEQ ID NO: 177166 - DNA, 2871 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgaacagcgagcacacagacttcaacaaggaccccacctttgtgtgcagcggctgcagcttcctggccaagaccccagagggcctgagcctgcacaatgccacctgccacagcggggaggccagctttgtgtggaatgtggccaagccagacaaccacgtggtggtggagcagagcatccctgagagcaccagcaccccagacctggccggggagcccagcgctgagggcgcagatggccaggccgagatcatcatcaccaagacccccatcatgaagatcatgaagggcaaggccgaggccaagaagatccacaccctgaaggaaaatgtgcccagccagcctgtgggggaggccctgcccaagctgagcactggagagatggaggtgcgggagggggaccacagcttcatcaacggggctgtgcctgtgtcccaggccagcgccagcagcgccaagaacccccacgccgccaacggccccctcatcggcaccgtgcctgtgctgcctgctggcatcgcccagttcctgagcctgcagcagcagccccctgtgcacgcccagcaccacgtgcaccagcccctgcccacagccaaggccctgcccaaggtgatgatccccctgagcagcatccccacctacaatgctgccatggacagcaacagcttcctgaagaacagcttccacaagttcccctaccccaccaaggccgagctgtgctacctgactgtggtgaccaagtacccagaggagcagctgaagatctggttcaccgcccagaggctgaagcagggcatctcctggagccctgaggagattgaagatgccaggaagaagatgttcaacacagtcatccagagcgtgccccagcccaccatcaccgtgctgaacacccccctggtggccagcgctggaaatgtgcagcacctgatccaggccgccctgcccggccacgtggtgggccagcctgagggcactggaggcggcctgctggtgacccagcccctgatggccaacggcctgcaggccaccagcagccccctgcccctgactgtgacctctgtgcccaagcagcccggggtggcccccatcaacacagtgtgcagcaacaccaccagcgctgtgaaggtggtgaatgctgcccagagcctgctgacagcctgccccagcatcaccagccaggccttcctggatgccagcatctacaagaacaagaagagccatgagcagctgagcgccctgaagggcagcttctgcaggaaccagtttcctggccagagcgaggtggagcacctgaccaaggtgacaggcctgagcacccgggaggtgaggaagtggttcagtgaccggcgctaccactgcaggaacctgaagggcagccgggccatgatccctggggaccacagcagcatcatcatcgacagcgtgcctgaggtgtccttcagccccagcagcaaggtgcctgaggtgacctgcatccccaccacagccaccctggccacccaccccagcgccaagaggcagagctggcaccagaccccagacttcacccccaccaagtacaaggagcgggcccctgagcagctgcgggccctggagagcagctttgcccagaaccccctgcccctggatgaggagctggaccggctgcggtctgagaccaagatgacccggcgggagattgacagctggttcagcgagaggaggaagaaggtgaatgctgaggagaccaagaaggccgaggagaatgccagccaggaggaggaggaggccgcagaagatgaaggaggagaggaggacctggccagcgagctgcgggtgtctggagaaaatggcagcctggagatgcccagcagccacatcctggccgagaggaaggtgagccccatcaagatcaacctgaagaacctgcgggtgacagaggccaacggcagaaatgagatccctggcctgggcgcctgtgaccctgaagatgatgagagcaacaagctggccgagcagctgcccgggaaggtgtcctgcaagaagacagcccagcagaggcacctgctgcggcagctgtttgtgcagacccagtggcccagcaaccaggactatgacagcatcatggcccagacaggcctgcccaggcctgaggtggtgcgctggtttggagacagccgctatgccctgaagaatggccagctgaagtggtatgaggactacaagaggggcaacttccccccaggcctgctggtgattgcccctggcaaccgggagctgctgcaggactactacatgacccacaagatgctgtatgaggaggacctgcagaacctgtgtgacaagacccagatgagcagccagcaggtgaagcagtggtttgctgagaagatgggagaggagaccagggctgtggccgacaccggcagcgaggaccagggccctggcaccggggagctgacagctgtgcacaagggcatgggagacacctacagcgaggtgtctgaaaattctgagagctgggagccccgggtgcctgaggccagcagcgagccctttgacaccagcagcccccaggccggccggcagctggagacagactag

SEQ ID NO: 177167 - DNA, 141 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagctag

SEQ ID NO: 177168 - DNA, 1497 bp, Artificial Sequence; identical to SEQ ID NO: 177163
  Description of Artificial Sequence: Synthetic coding sequence

SEQ ID NO: 177169 - DNA, 147 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgcctag

SEQ ID NO: 177170 - DNA, 273 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacctag

SEQ ID NO: 177171 - DNA, 357 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgaacagcgagcacacagacttcaacaaggaccccacctttgtgtgcagcggctgcagcttcctggcctag

SEQ ID NO: 177172 - DNA, 2871 bp, Artificial Sequence; identical to SEQ ID NO: 177166
  Description of Artificial Sequence: Synthetic coding sequence

SEQ ID NO: 177173 - DNA, 2910 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgaacagcgagcacacagacttcaacaaggaccccacctttgtgtgcagcggctgcagcttcctggccaagaccccagagggcctgagcctgcacaatgccacctgccacagcggggaggccagctttgtgtggaatgtggccaagccagacaaccacgtggtggtggagcagagcatccctgagagcaccagcaccccagacctggccggggagcccagcgctgagggcgcagatggccaggccgagatcatcatcaccaagacccccatcatgaagatcatgaagggcaaggccgaggccaagaagatccacaccctgaaggaaaatgtgcccagccagcctgtgggggaggccctgcccaagctgagcactggagagatggaggtgcgggagggggaccacagcttcatcaacggggctgtgcctgtgtcccaggccagcgccagcagcgccaagaacccccacgccgccaacggccccctcatcggcaccgtgcctgtgctgcctgctggcatcgcccagttcctgagcctgcagcagcagccccctgtgcacgcccagcaccacgtgcaccagcccctgcccacagccaaggccctgcccaaggtgatgatccccctgagcagcatccccacctacaatgctgccatggacagcaacagcttcctgaagaacagcttccacaagttcccctaccccaccaaggccgagctgtgctacctgactgtggtgaccaagtacccagaggagcagctgaagatctggttcaccgcccagaggctgaagcagggcatctcctggagccctgaggagattgaagatgccaggaagaagatgttcaacacagtcatccagagcgtgccccagcccaccatcaccgtgctgaacacccccctggtggccagcgctggaaatgtgcagcacctgatccaggccgccctgcccggccacgtggtgggccagcctgagggcactggaggcggcctgctggtgacccagcccctgatggccaacggcctgcaggccaccagcagccccctgcccctgactgtgacctctgtgcccaagcagcccggggtggcccccatcaacacagtgtgcagcaacaccaccagcgctgtgaaggtggtgaatgctgcccagagcctgctgacagcctgccccagcatcaccagccaggccttcctggatgccagcatctacaagaacaagaagagccatgagcagctgagcgccctgaagggcagcttctgcaggaaccagtttcctggccagagcgaggtggagcacctgaccaaggtgacaggcctgagcacccgggaggtgaggaagtggttcagtgaccggcgctaccactgcaggaacctgaagggcagccgggccatgatccctggggaccacagcagcatcatcatcgacagcgtgcctgaggtgtccttcagccccagcagcaaggtgcctgaggtgacctgcatccccaccacagccaccctggccacccaccccagcgccaagaggcagagctggcaccagaccccagacttcacccccaccaagtacaaggagcgggcccctgagcagctgcgggccctggagagcagctttgcccagaaccccctgcccctggatgaggagctggaccggctgcggtctgagaccaagatgacccggcgggagattgacagctggttcagcgagaggaggaagaaggtgaatgctgaggagaccaagaaggccgaggagaatgccagccaggaggaggaggaggccgcagaagatgaaggaggagaggaggacctggccagcgagctgcgggtgtctggagaaaatggcagcctggagatgcccagcagccacatcctggccgagaggaaggtgagccccatcaagatcaacctgaagaacctgcgggtgacagaggccaacggcagaaatgagatccctggcctgggcgcctgtgaccctgaagatgatgagagcaacaagctggccgagcagctgcccgggaaggtgtcctgcaagaagacagcccagcagaggcacctgctgcggcagctgtttgtgcagacccagtggcccagcaaccaggactatgacagcatcatggcccagacaggcctgcccaggcctgaggtggtgcgctggtttggagacagccgctatgccctgaagaatggccagctgaagtggtatgaggactacaagaggggcaacttccccccaggcctgctggtgattgcccctggcaaccgggagctgctgcaggactactacatgacccacaagatgctgtatgaggaggacctgcagaacctgtgtgacaagacccagatgagcagccagcagaagcagacagaatttgacctgatcaacgtgaaggactggcctgtgtgggagacagcctgccacgtggaggagcccaaccccaccctgtgctgccacatgcccttcccctgcccagctgctggccacctgggggagctgcctgagagcagccagacagcccagagcctgcccctgcccagcgcctgccccccacccagcaagcagcaggcccgctggggcagccaccagttcttcctgccccagtgcaggaccttccccctgcccagcaatggatag

SEQ ID NO: 177174 - DNA, 948 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgaacagcgagcacacagacttcaacaaggaccccacctttgtgtgcagcggctgcagcttcctggccaagaccccagagggcctgagcctgcacaatgccacctgccacagcggggaggccagctttgtgtggaatgtggccaagccagacaaccacgtggtggtggagcagagcatccctgagagcaccagcaccccagacctggccggggagcccagcgctgagggcgcagatggccaggccgagatcatcatcaccaagacccccatcatgaagatcatgaagggcaaggccgaggccaagaagatccacaccctgaaggaaaatgtgcccagccagcctgtgggggaggccctgcccaagctgagcactggagagatggagaagcagacagaatttgacctgatcaacgtgaaggactggcctgtgtgggagacagcctgccacgtggaggagcccaaccccaccctgtgctgccacatgcccttcccctgcccagctgctggccacctgggggagctgcctgagagcagccagacagcccagagcctgcccctgcccagcgcctgccccccacccagcaagcagcaggcccgctggggcagccaccagttcttcctgccccagtgcaggaccttccccctgcccagcaatggatag

SEQ ID NO: 177175 - DNA, 501 bp, Artificial Sequence
  Description of Artificial Sequence: Synthetic coding sequence
atggccagcaagaggaagagcaccaccccctgcatgatccctgtgaagacagtggtgctgcaggatgcctccatggaggcccagcctgctgagaccctgcctgagggcccccagcaggacctgcccccagaggccagcgctgccagcagcgaggccgcccagaaccccagcagcacagatggcagcaccctggccaacggccacaggagcaccctggatggctacctgtacagctgcaagtactgtgacttccgcagccatgacatgacccagtttgtgggccacatgaacagcgagcacacagacttcaacaaggaccccacctttgtgtgcagcggctgcagcttcctggccaagaccccagagggcctgagcctgcacaatgccacctgccacagcggggaggccagctttgtgtggaatgtggccaagccagacaaccacgtggtggtggagcagagcatccctgagagcaccagcaccccagacctggccggctag

SEQ ID NO: 177176 - DNA, 2871 bp, Artificial Sequence; identical to SEQ ID NO: 177166
  Description of Artificial Sequence: Synthetic coding sequence

SEQ ID NO: 177177 - DNA, 2871 bp, Artificial Sequence; identical to SEQ ID NO: 177166
  Description of Artificial Sequence: Synthetic coding sequence

SEQ ID NO: 177178 - DNA, 501 bp, Artificial Sequence; identical to SEQ ID NO: 177175
  Description of Artificial Sequence: Synthetic coding sequence

SEQ ID NO: 177179 - DNA, 1428 bp, Artificial Sequence
  Description of Artificial Sequence: Synthetic coding sequence
atgggcatgtgggccagcctggatgccctgtgggagatgcctgctgagaagaggatctttggagctgtgctgctcttctcctggacagtgtacctgtgggagaccttcctggcccagaggcagaggcgcatctacaagaccaccacccacgtgcccccagagctgggccagatcatggattctgagacctttgagaagagccggctgtaccagctggacaagagcaccttctccttctggagcggcctgtacagcgagacagagggcaccctcatcctgctgtttggaggcatcccctacctgtggaggctgagcggccgcttctgtggctacgccggcttcggcccagaatatgagatcacccagagcctggtgttcctgctgctggccaccctcttcagcgccctgaccggcctgccctggagcctgtacaacacctttgtgattgaggagaagcacggcttcaaccagcagaccctgggcttcttcatgaaggatgccatcaagaagtttgtggtgacccagtgcatcctgctgcctgtgagcagcctgctgctgtacatcatcaagattggaggagactacttcttcatctatgcctggctgttcaccctggtggtgtccctggtgctggtgaccatctatgctgactacatcgcccccctgtttgacaagttcacccccctgcctgagggcaagctgaaggaggagattgaggtgatggccaagagcattgacttccccctgaccaaggtgtatgtggtggagggcagcaagaggagcagccacagcaatgcctacttctacggcttcttcaagaacaagagaattgtgctgtttgacaccctgctggaggagtacagcgtgctgaacaaggacatccaggaggacagcggcatggagcccagaaatgaggaggagggcaacagcgaggagatcaaggccaaggtgaagaacaagaagcagggctgcaagaatgaggaggtgctggccgtgctgggccacgagctgggccactggaagctgggccacacagtgaagaacatcatcatcagccagatgaacagcttcctgtgcttcttcctgtttgctgtgctgattggaaggaaggagctgtttgctgccttcggcttctatgacagccagcccaccctcatcggcctgctgatcatcttccagttcatcttcagcccctacaatgaggtgctgtccttctgcctgactgtgctgagccgccgctttgagttccaggctgatgcctttgccaagaagctgggcaaggccaaggacctgtacagcgccctgatcaagctgaacaaggacaacctgggcttccctgtgtctgactggctgttctccatgtggcactacagccacccccccctgctggagcggctgcaggccctgaagaccatgaagcagcactag

SEQ ID NO: 177180 - DNA, 1017 bp, Artificial Sequence
  Description of Artificial Sequence: Synthetic coding sequence
atgatgaggacctgtgtgctgctgtctgctgtgctgtggtgcctgactggagtgcagtgcccccgcttcaccctcttcaacaagaagggcttcatctacggcaagacaggccagcctgacaagatctacgtggagctgcaccagaacagccctgtgctgatctgcatggacttcaagctgagcaagaaggagatcgtggaccccacctacctgtggattggccccaatgagaagaccctgactggaaacaaccgcatcaacatcacagaaacaggccagctgatggtgaaggacttcctggagcccctgagcggcctgtacacctgcaccctgagctacaagacagtgaaggccgagacccaggaggagaagacagtgaagaagagatatgacttcatggtgtttgcctaccgggagccagactacagctaccagatggctgtgcgcttcaccaccaggagctgcatcggccgctacaatgatgtgttcttccgggtgctgaagaagatcctggacagcctcatcagtgacctgagctgccacgtgattgagcccagctacaagtgccacagcgtggagatccctgagcacggcctcatccacgagctgttcatcgccttccaggtgaacccctttgcccctggctggaagggggcctgcaatggatctgtggactgtgaggacaccaccaaccacaacatcctgcaggcccgggacagaattgaggacttcttccgcagccaggcctacatcttctaccacaacttcaacaagaccctgcctgccatgcactttgtggaccacagcctgcaggtggtgcggctggacagctgccggcccggctttgggaagaatgaaaggctgcacagcaactgtgccagctgctgcgtggtgtgcagccctgccaccttctccccagatgtgaatgtgacctgccagacctgtgtgtctgtgctgacctatggagccaagagctgcccccagaccagcaacaagaaccagcagtatgaagattag

SEQ ID NO: 177181 - DNA, 951 bp, Artificial Sequence
  Description of Artificial Sequence: Synthetic coding sequence
atgatgaggacctgtgtgctgctgtctgctgtgctgtggtgcctgaccggggacaagatctacgtggagctgcaccagaacagccctgtgctgatctgcatggacttcaagctgagcaagaaggagatcgtggaccccacctacctgtggattggccccaatgagaagaccctgactggaaacaaccgcatcaacatcacagaaacaggccagctgatggtgaaggacttcctggagcccctgagcggcctgtacacctgcaccctgagctacaagacagtgaaggccgagacccaggaggagaagacagtgaagaagagatatgacttcatggtgtttgcctaccgggagccagactacagctaccagatggctgtgcgcttcaccaccaggagctgcatcggccgctacaatgatgtgttcttccgggtgctgaagaagatcctggacagcctcatcagtgacctgagctgccacgtgattgagcccagctacaagtgccacagcgtggagatccctgagcacggcctcatccacgagctgttcatcgccttccaggtgaacccctttgcccctggctggaagggggcctgcaatggatctgtggactgtgaggacaccaccaaccacaacatcctgcaggcccgggacagaattgaggacttcttccgcagccaggcctacatcttctaccacaacttcaacaagaccctgcctgccatgcactttgtggaccacagcctgcaggtggtgcggctggacagctgccggcccggctttgggaagaatgaaaggctgcacagcaactgtgccagctgctgcgtggtgtgcagccctgccaccttctccccagatgtgaatgtgacctgccagacctgtgtgtctgtgctgacctatggagccaagagctgcccccagaccagcaacaagaaccagcagtatgaagattag

SEQ ID NO: 177182 - DNA, 1917 bp, Artificial Sequence
  Description of Artificial Sequence: Synthetic coding sequence
atggccggcggcagcgccaccacctggggctaccctgtggccctgctgctgctggtggccaccctgggcctgggccgctggctgcagcctgaccccggcctgcccggcctgcggcacagctatgactgtggcatcaagggcatgcagctgctggtgttcccccggcccggccagaccctgcgcttcaaggtggtggatgaatttggaaacagatttgatgtgaacaactgcagcatctgctaccactgggtgaccagccggccccaggagcctgctgtgttttctgctgactaccggggctgccacgtgctggagaaggatggccgcttccacctgcgggtcttcatggaggccgtgctgcccaacggccgggtggatgtggcccaggatgccaccctcatctgccccaagccagaccccagcaggaccctggacagccagctggcccccccagccatgttttctgtgtccaccccccagaccctgtccttcctgcccaccagcggccacaccagccagggcagcggccacgccttccccagccccctggaccccggccacagctctgtgcaccccaccccagccctgcccagccctggccctggccccaccctggccaccctggcccagccccactggggcaccctggagcactgggatgtgaacaagagggactacatcggcacccacctgagccaggagcagtgccaggtggccagcggccacctgccctgcatcgtgcggaggaccagcaaggaggcctgccagcaggccggctgctgctatgacaacacccgggaggtgccctgctactacggcaacacagccaccgtgcagtgcttcagagatggctactttgtgctggtggtgtcccaggagatggccctgacccaccgcatcaccctggccaacatccacctggcctatgcccccaccagctgcagccccacccagcacacagaggcctttgtggtgttctacttccccctgacccactgcggcaccaccatgcaggtggccggggaccagctgatctatgagaactggctggtgtctggcatccacatccagaagggcccccagggcagcatcacccgggacagcaccttccagctgcacgtgcgctgtgtgttcaatgccagtgacttcctgcccatccaggccagcatcttccccccacccagccctgcccccatgacccagcccggccccctgcggctggagctgagaattgccaaggatgagaccttcagcagctactatggagaagatgactaccccatcgtgcggctgctgcgggagcctgtgcacgtggaggtgcggctgctgcagaggacagaccccaacctggtgctgctgctgcaccagtgctggggcgcccccagcgccaaccccttccagcagccccagtggcccatcctgagtgatggctgccccttcaagggggacagctaccgcacccagatggtggccctggatggagccacccccttccagagccactaccagcgcttcaccgtggccacctttgccctgctggacagcggcagccagagggccctgcggggcctggtgtacctgttctgcagcaccagcgcctgccacaccagcggcctggagacctgcagcacagcctgcagcacaggcaccacccggcagaggaggagcagcggccacagaaatgacacagcccggccccaggacatcgtgagcagccctggccctgtgggctttgaagattcctatggccaggagcccaccctgggccccacagacagcaatggaaacagcagcctgcggcccctgctgtgggccgtgctgctgctgcctgctgtggccctggtgctgggcttcggcgtgtttgtgggcctgagccagacctgggcccagaagctgtgggagagcaaccggcagtag

SEQ ID NO: 177183 - DNA, 993 bp, Artificial Sequence
  Description of Artificial Sequence: Synthetic coding sequence
atggccctgacccaccgcatcaccctggccaacatccacctggcctatgcccccaccagctgcagccccacccagcacacagaggcctttgtggtgttctacttccccctgacccactgcggcaccaccatgcaggtggccggggaccagctgatctatgagaactggctggtgtctggcatccacatccagaagggcccccagggcagcatcacccgggacagcaccttccagctgcacgtgcgctgtgtgttcaatgccagtgacttcctgcccatccaggccagcatcttccccccacccagccctgcccccatgacccagcccggccccctgcggctggagctgcgcatcgccaaggatgagaccttcagcagctactacggggaggatgactaccccatcgtgcggctgctgcgggagcctgtgcacgtggaggtgcggctgctgcagaggacagaccccaacctggtgctgctgctgcaccagtgctggggcgcccccagcgccaaccccttccagcagccccagtggcccatcctgagtgatggctgccccttcaagggggacagctaccgcacccagatggtggccctggatggagccacccccttccagagccactaccagcgcttcaccgtggccacctttgccctgctggacagcggcagccagagggccctgcggggcctggtgtacctgttctgcagcaccagcgcctgccacaccagcggcctggagacctgcagcacagcctgcagcacaggcaccacccggcagaggaggagcagcggccacagaaatgacacagcccggccccaggacatcgtgagcagccctggccctgtgggctttgaggacagctatggccaggagcccaccctgggccccacagacagcaatggaaacagcagcctgcggcccctgctgtgggccgtgctgctgctgcctgctgtggccctggtgctgggctttggagtgtttgtggcctag

SEQ ID NO: 177184 - DNA, 1317 bp, Artificial Sequence
  Description of Artificial Sequence: Synthetic coding sequence
atgggccgggtggaggatggcggcaccacagaggagctggaggactgggaccccggcaccagcgccctgcctgcccctggcatcaagcagggcccccgggagcagacaggcaccggccccctgagccagaagtgctgggagcctgagccagatgcccccagccagcccggccctgccctgtggagccggggccgggcccggacccaggccctggccggcggcagcagcctgcagcagctggaccctgaaaatacaggcttcatcggggctgacaccttcaccggcctggtgcacagccatgagctgcccctggaccctgccaagctggacatgctggtggccctggcccagagcaatgagcagggccaggtgtgctaccaggagctggtggacctgatcagcagcaagaggagcagcagcttcaagagggccatcgccaacggccagagggccctgcccagagatggccccctggatgagcccggcctgggcgtgtacaagagatttgtgcgctacgtggcctatgagatcctgccctgtgaggtggaccggcgctggtacttctaccgccacaggagctgccccccacctgtgttcatggcctctgtgaccctggcccagatcatcgtgttcctgtgctacggggcccggctgaacaagtgggtgctgcagacctaccaccctgagtacatgaagagccccctggtgtaccaccctggccaccgggcccgggcctggaggttcctgacctacatgttcatgcacgtgggcctggagcagctgggcttcaatgccctgctgcagctgatgattggagtgcccctggagatggtgcacggcctgctgcgcatcagcctgctgtacctggccggcgtgctggccggcagcctgactgtgtccatcacagacatgagggcccctgtggtgggcggcagcggcggcgtgtatgccctgtgcagcgcccacctggccaacgtggtgatgaactgggccggcatgcgctgcccctacaagctgctgaggatggtgctggccctggtgtgcatgagcagcgaggtgggccgggctgtgtggctgcgcttcagcccccccctgcctgccagcggcccccagcccagcttcatggcccacctggccggggctgtggtgggcgtgtccatgggcctgaccatcctgcggagctatgaggagcggctgcgggaccagtgtggctggtgggtggtgctgctggcctacggcaccttcctgctgtttgctgtgttctggaatgtgtttgcctatgacctgctgggcgcccacatccccccacctccttag

SEQ ID NO: 177185 - DNA, 1122 bp, Artificial Sequence
  Description of Artificial Sequence: Synthetic coding sequence
atggtgatggtgtccaaggacctgtttggaacaggcaagctgatccgggctgctgacctgaccctgggccctgaggcctgtgagcccctggtgtccatggacacagaagatgtggtgcgctttgaggtgggcctgcatgaatgtggcaacagcatgcaggtgacagatgatgccctggtgtacagcaccttcctgctgcatgaccccaggcctgtgggcaacctgagcatcgtgaggaccaacagagctgagatccccatcgagtgccgctacccccggcagggcaatgtgagcagccaggccatcctgcccacctggctgcccttccgcaccaccgtcttcagcgaggagaagctgaccttcagcctgcggctgatggaggagaactggaatgctgagaagaggagccccaccttccacctgggagatgctgcccacctgcaggccgagatccacacaggcagccacgtgcccctgcggctgtttgtggaccactgtgtggccacccccaccccagaccagaatgccagcccctaccacaccatcgtggacttccacggctgcctggtggatggcctgacagatgccagcagcgccttcaaggtgcccaggcctggccctgacaccctgcagttcaccgtggatgtgttccactttgccaatgacagcaggaacatgatctacatcacctgccacctgaaggtgaccctggccgagcaggaccctgatgagctgaacaaggcctgcagcttcagcaagcccagcaacagctggttccctgtggagggcagcgctgacatctgccagtgctgcaacaagggggactgtggcacccccagccacagccggcggcagccccacgtgatgagccagtggagccgcagcgccagcaggaacagaagacatgtgacagaggaggctgatgtgacagtgggccccctcatcttcctggacagaagaggagaccacgaggtggagcagtgggccctgcccagcgacacctctgtggtgctgctgggcgtgggcctggccgtggtggtgtccctgaccctgacagctgtgatcctggtgctgacccggcgctgcaggacagccagccaccctgtgtctgccagcgagtag

SEQ ID NO: 177186 - DNA, 1275 bp, Artificial Sequence
  Description of Artificial Sequence: Synthetic coding sequence
atggagctgagctaccgcctcttcatctgcctgctgctgtggggcagcacagagctgtgctacccccagcccctgtggctgctgcagggcggggccagccaccctgagacctctgtgcagcctgtgctggtggagtgccaggaggccaccctgatggtgatggtgtccaaggacctgtttggcaccgggaagctgatccgggctgctgacctgaccctgggccctgaggcctgtgagcccctggtgtccatggacacagaagatgtggtgcgctttgaggtgggcctgcatgaatgtggcaacagcatgcaggtgacagatgatgccctggtgtacagcaccttcctgctgcatgaccccaggcctgtgggcaacctgagcatcgtgaggaccaacagagctgagatccccattgaatgtcgctacccccggcagggcaatgtgagcagccaggccatcctgcccacctggctgcccttccgcaccaccgtcttcagcgaggagaagctgaccttcagcctgcggctgatggaggagaactggaatgctgagaagaggagccccaccttccacctgggagatgctgcccacctgcaggccgagatccacacaggcagccacgtgcccctgcggctgtttgtggaccactgtgtggccacccccaccccagaccagaatgccagcccctaccacaccatcgtggacttccacggctgcctggtggatggcctgacagatgccagcagcgccttcaaggtgccccggcccggccctgacaccctgcagttcaccgtggatgtgttccactttgccaatgacagcaggaacatgatctacatcacctgccacctgaaggtgaccctggccgagcaggaccctgatgagctgaacaaggcctgcagcttcagcaagcccagcaacagctggttccctgtggagggcagcgctgacatctgccagtgctgcaacaagggggactgtggcacccccagccacagccggcggcagccccacgtgatgagccagtggagccgcagcgccagcaggaacagaagacatgtgacagaggaggctgatgtgacagtgggccccctcatcttcctggaccggcggggggaccacgaggtggagcagtgggccctgcccagcgacacctctgtggtgctgctgggcgtgggcctggccgtggtggtgtccctgaccctgacagctgtgatcctggtgctgacccggcgctgcaggacagccagccaccctgtgtctgccagcgagtag

SEQ ID NO: 177187 - DNA, 1116 bp, Artificial Sequence
  Description of Artificial Sequence: Synthetic coding sequence
atggagctgagctaccgcctcttcatctgcctgctgctgtggggcagcacagagctgtgctacccccagcccctgtggctgctgcagggcggggccagccaccctgagacctctgtgcagcctgtgctggtggagtgccaggaggccaccctgatggtgatggtgtccaaggacctgtttggcaccgggaagctgatccgggctgctgacctgaccctgggccctgaggcctgtgagcccctggtgtccatggacacagaagatgtggtgcgctttgaggtgggcctgcatgaatgtggcaacagcatgcaggtgacagatgatgccctggtgtacagcaccttcctgctgcatgaccccaggcctgtgggcaacctgagcatcgtgaggaccaacagagctgagatccccattgaatgtcgctacccccggcagggcaatgtgagcagccaggccatcctgcccacctggctgcccttccgcaccaccgtcttcagcgaggagaagctgaccttcagcctgcggctgatggaggagaactggaatgctgagaagaggagccccaccttccacctgggagatgctgcccacctgcaggccgagatccacacaggcagccacgtgcccctgcggctgtttgtggaccactgtgtggccacccccaccccagaccagaatgccagcccctaccacaccatcgtggacttccacggctgcctggtggatggcctgacagatgccagcagcgccttcaaggtgccccggcccggccctgacaccctgcagttcaccgtggatgtgttccactttgccaatgacagcaggaacatgatctacatcacctgccacctgaaggtgaccctggccgagcaggaccctgatgagctgaacaaggcctgcagcttcagcaagcccagcaacagctggttccctgtggagggcagcgctgacatctgccagtgctgcaacaagggggactgtggcacccccagccacagccggcggcagccccacgtgatgagccagtggagccgcagcgccagcaggaacagaagacatgtgacagaggaggctgatgtgacagtgggcacagacctgcccggccaggagggctag

SEQ ID NO: 177188 - DNA, 1623 bp, Artificial Sequence
  Description of Artificial Sequence: Synthetic coding sequence
atgtggctgctgcgctgtgtgctgctgtgtgtgtccctgagcctggccgtgtctggccagcacaagccagaggccccagactacagctctgtgctgcactgcggcccctggagcttccagtttgctgtgaacctgaaccaggaggccaccagcccccctgtgctgattgcctgggacaaccagggcctgctgcacgagctgcagaatgacagcgactgtggcacctggatcagaaaaggacctggcagctctgtggtgctggaggccacctacagcagctgctacgtgacagagtgggacagccactacatcatgcctgtgggcgtggagggcgctggagctgctgagcacaaggtggtgacagagaggaagctgctgaagtgccccatggacctgctggccagagatgccccagacacagactggtgtgacagcatcccagcccgggaccggctgccctgtgcccccagccccatcagcagaggagactgtgagggcctgggctgctgctacagcagcgaggaggtgaacagctgctactacggcaacacagtgaccctgcactgcacccgggagggccacttcagcattgctgtgtccagaaatgtgaccagcccccccctgctgctggacagcgtgcggctggccctgagaaatgattctgcctgcaaccctgtgatggccacccaggcctttgtgctcttccagttccccttcaccagctgtggcaccacccggcagatcactggagacagagctgtgtatgaaaatgagctggtggccaccagagatgtgaagaatggcagccggggctctgtgacccgggacagcatcttccggctgcacgtgtcctgcagctacagcgtgagcagcaacagcctgcccatcaacgtgcaggtgttcaccctgcccccacccttccctgagacccagcccggccccctgaccctggagctgcagatcgccaaggacaagaactacggcagctactatggagtgggggactaccctgtggtgaagctgctgcgggaccccatctacgtggaggtgtccatcctgcacaggacagacccctacctgggcctgctgctgcagcagtgctgggccacccccagcacagaccccctgagccagccccagtggcccatcctggtgaagggctgcccctacatcggggacaactaccagacccagctgatccctgtgcagaaggccctggacctgcccttccccagccaccaccagcgcttcagcatcttcaccttctcctttgtgaaccccaccgtggagaagcaggccctgcggggccctgtgcacctgcactgcagcgtgtctgtgtgccagcctgctgagacccccagctgtgtggtgacctgcccagacctgagcagaagaagaaactttgacaacagcagccagaacaccacagcctctgtgagcagcaagggccccatgatcctgctgcaggccaccaaggaccccccagagaagctgcgggtgcctgtggacagcaaggtgctgtgggtggccggcctgagcggcaccctcatcctgggcgccctgctggtgtcctacctggccgtgaagaagcagaagagctgcccagaccagatgtgccagtag

SEQ ID NO: 177189 - DNA, 2340 bp, Artificial Sequence
  Description of Artificial Sequence: Synthetic coding sequence
atggccagctttgtgacagaggtgctggcccacagcggccgcctggagaaggaggacctgggcacccgcatcagccggctgaccaggagagtggaggagatcaagggggaggtgtgcaacatgatcagcaagaagtacagcgagttcctgcccagcatgcagagcgcccagggcctcatcacccaggtggacaagctgtctgaggacatcgacctgctgaagagcagaattgaaagtgaggtgcggcgggacctgcacgtgtccactggagagttcacagacctgaagcagcagctggagcgggacagcgtggtgctgagcctgctgaagcagctgcaggagttcagcacagccatcgaggagtacaactgtgccctgacagagaagaagtatgtgactggagcccagaggctggaggaggcccagaagtgcctgaagctgctgaagagcaggaagtgctttgacctgaagatcctgaagagcctgtccatggagctgaccatccagaagcagaacatcctgtaccacctgggggaggagtggcagaagctgattgtgtggaagttcccccccagcaaggacaccagcagcctggagagctacctgcagacagagctgcacctgtacacagagcagagccacaaggaggagaagacccccatgccacccatcagctctgtgctgctggccttctctgtgctgggggagctgcacagcaagctgaagagctttggccagatgctgctgaagtacatcctgcggcccctggccagctgccccagcctgcacgccgtcatcgagagccagcccaacatcgtcatcatccgctttgagagcatcatgaccaacctggagtaccccagccccagcgaggtgttcaccaagatccggctggtgctggaggtgctgcagaagcagctgctggacctgcccctggacacagacctggagaatgagaagaccagcacagtgcccctggccgagatgctgggggacatgatctgggaggacctgtctgagtgcctgatcaagaactgcctggtgtacagcatccccaccaacagcagcaagctgcagcagtatgaggagatcatccagagcacagaggagtttgaaaatgccctgaaggagatgaggttcctgaagggggacaccacagacctgctgaagtatgccaggaacatcaacagccactttgccaacaagaagtgccaggacgtcatcgtggccgccaggaacctgatgaccagcgagatccacaacacagtgaagatcatcccagacagcaagatcaacgtgcctgagctgcccaccccagatgaggacaacaagctggaggtgcagaaggtgagcaacacccagtaccacgaggtgatgaacctggagcctgagaacaccctggaccagcacagcttcagcctgcccacctgccgcatcagcgagagcgtgaagaagctgatggagctggcctaccagaccctgctggaggccaccaccagcagtgaccagtgtgctgtgcagctgttctacagcgtgaggaacatcttccacctgttccatgatgtggtgcccacctaccacaaggagaacctgcagaagctgccccagctggccgccatccaccacaacaactgcatgtacatcgcccaccacctgctgaccctgggccaccagttccggctgcggctggcccccatcctgtgtgatggaacagccacctttgtggacctggtgcccggcttccggcggctgggcacagagtgcttcctggcccagatgagggcccagaagggggagctgctggagcggctgagcagcgccaggaacttcagcaacatggatgatgaggagaactacagcgctgccagcaaggctgtgcggcaggtgctgcaccagctgaagaggctgggcatcgtgtggcaggatgtgctgcctgtgaacatctactgcaaggccatgggcaccctgctgaacacagccatcagcgaggtgattggcaagatcacagccctggaggacatcagcacagaagatggagaccggctgtacagcctgtgcaagacagtgatggatgagggcccccaggtgtttgcccccctgtctgaggagagcaagaacaagaagtaccaggaggaggtgcctgtgtatgtgcccaagtggatgcccttcaaggagctgatgatgatgctgcaggccagcctgcaggagattggagaccgctgggcagatggcaagggccccctggccgccgccttcagcagcagcgaggtgaaggccctgatccgggccctcttccagaacacagagcggcgggctgctgccctggccaagatcaagtag

SEQ ID NO: 177190 - DNA, 2019 bp, Artificial Sequence
  Description of Artificial Sequence: Synthetic coding sequence
atggccagctttgtgacagaggtgctggcccacagcggccgcctggagaaggaggacctgggcacccgcatcagccggctgaccaggagagtggaggagatcaagggggaggtgtgcaacatgatcagcaagaagtacagcgagttcctgcccagcatgcagagcgcccagggcctcatcacccaggtggacaagctgtctgaggacatcgacctgctgaagagcagaattgaaagtgaggtgcggcgggacctgcacgtgtccactggagagttcacagacctgaagcagcagctggagcgggacagcgtggtgctgagcctgctgaagcagctgcaggagttcagcacagccatcgaggagtacaactgtgccctgacagagaagaagtatgtgactggagcccagaggctggaggaggcccagaagtgcctgaagctgctgaagagcaggaagtgctttgacctgaagatcctgaagagcctgtccatggagctgaccatccagaagcagaacatcctgtaccacctgggggaggagtggcagaagctgattgtgtggaagttcccccccagcaaggacaccagcagcctggagagctacctgcagacagagctgcacctgtacacagagcagagccacaaggaggagaagacccccatgccacccatcagctctgtgctgctggccttctctgtgctgggggagctgcacagcaagctgaagagctttggccagatgctgctgaagtacatcctgcggcccctggccagctgccccagcctgcacgccgtcatcgagagccagcccaacatcgtcatcatccgctttgagagcatcatgaccaacctggagtaccccagccccagcgaggtgttcaccaagatccggctggtgctggaggtgctgcagaagcagctgctggacctgcccctggacacagacctggagaatgagaagaccagcacagtgcccctggccgagatgctgggggacatgatctgggaggacctgtctgagtgcctgatcaagaactgcctggtgtacagcatccccaccaacagcagcaagctgcagcagtatgaggagatcatccagagcacagaggagtttgaaaatgccctgaaggagatgaggttcctgaagggggacaccacagacctgctgaagtatgccaggaacatcaacagccactttgccaacaagaagtgccaggacgtcatcgtggccgccaggaacctgatgaccagcgagatccacaacacagtgaagatcatcccagacagcaagatcaacgtgcctgagctgcccaccccagatgaggacaacaagctggaggtgcagaaggtgagcaacacccagtaccacgaggtgatgaacctggagcctgagaacaccctggaccagcacagcttcagcctgcccacctgccgcatcagcgagagcgtgaagaagctgatggagctggcctaccagaccctgctggaggccaccaccagcagtgaccagtgtgctgtgcagctgttctacagcgtgaggaacatcttccacctgttccatgatgtggtgcccacctaccacaaggagaacctgcagaagctgccccagctggccgccatccaccacaacaactgcatgtacatcgcccaccacctgctgaccctgggccaccagttccggctgcggctggcccccatcctgtgtgatggaacagccacctttgtggacctggtgcccggcttccggcggctgggcacagagtgcttcctggcccagatgagggcccagaagggggagctgctggagcggctgagcagcgccaggaacttcagcaacatggatgatgaggagaactacagcgctgccagcaaggctgtgcggcaggtgctgcaccagctgaagaggctgggcatcgtgtggcaggatgtgctgcctgtgaacatctactgcaaggccatgggcaccctgctgaacacagccatcagcgaggtgattggcaagatcacagccctggagtag

SEQ ID NO: 177191 - DNA, 1776 bp, Artificial Sequence
  Description of Artificial Sequence: Synthetic coding sequence
atgtgggagcggctgaactgtgccgctgaggacttctacagccggctgctgcagaagttcaatgaggagaagaagggcatcaggaaggaccccttcctgtatgaagcagatgtgcaggtgcagctgatcagcaagggccagcccaaccccctgaagaacatcctgaatgaaaatgacatcgtgttcatcgtggagaaggtgcccctggagaaggaggagaccagccacatcgaggagctgcagagcgaggagacagccatcagtgacttcagcactggagaaaatgtgggccccctggccctgcctgtgggcaaggcccggcagctgattggcctgtacaccatggcccacaaccccaacatgacccacctgaagatcaacctgcctgtgacagccctgccccccctgtgggtgcgctgtgacagcagtgaccctgagggcacctgctggctgggcgctgagctgatcaccaccaacaacagcatcactggaattgtgctgtatgtggtgtcctgcaaggctgacaagaactacagcgtgaacctggagaacctgaagaacctgcacaagaagaggcaccacctgagcacagtgaccagcaaaggatttgcccagtatgagctgttcaagagcagcgccctggatgacaccatcacagccagccagacagccatcgccctggacatctcctggagccctgtggatgagatcctgcagatcccccccctgagcagcacagccaccctgaacatcaaggtggagagcggggagccccggggccccctgaaccacctgtaccgggagctgaagttcctgctggtgctggctgatggcctgaggactggagtgacagagtggctggagcccctggaggccaagtctgctgtggagctggtgcaggagttcctgaatgacctgaacaagctggatggctttggagacagcaccaagaaggacacagaggtggagaccctgaagcatgacacagctgctgtggacagatctgtgaagaggctcttcaaggtgcggagtgacctggactttgctgagcagctgtggtgcaagatgagcagcagcgtcatctcctaccaggacctggtgaagtgcttcaccctcatcatccagagcctgcagagaggagacatccagccctggctgcacagcggcagcaacagcctgctgagcaagctgatccaccagagctaccacggcaccatggacacagtgtccctgagcggcaccatccctgtgcagatgctgctggagatcggcctggacaagctgaagaaggactacatctccttcttcatcggccaggagctggccagcctgaaccacctggagtacttcatcgcccccagcgtggacatccaggagcaggtgtacagagtgcagaagctgcaccacatcctggagatcctggtgtcctgcatgcccttcatcaagagccagcacgagctgctcttcagcctgacccagatctgcatcaagtactacaagcagaaccccctggatgagcagcacatcttccagctgcctgtgcggcccacagctgtgaagaacctgtaccagagcgagaagccccagaagtggagggtggagatctacagcggccagaagaagatcaagacagtgtggcagctgagtgacagcagccccatcgaccacctgaacttccacaagccagacttcagcgagctgaccctgaatggcagcctggaggagcgcatcttcttcaccaacatggtgacctgcagccaggtgcacttcaagtag

SEQ ID NO: 177192 - DNA, 1434 bp, Artificial Sequence
  Description of Artificial Sequence: Synthetic coding sequence
atggcccacaaccccaacatgacccacctgaagatcaacctgcctgtgacagccctgccccccctgtgggtgcgctgtgacagcagtgaccctgagggcacctgctggctgggcgctgagctgatcaccaccaacaacagcatcactggaattgtgctgtatgtggtgtcctgcaaggctgacaagaactacagcgtgaacctggagaacctgaagaacctgcacaagaagaggcaccacctgagcacagtgaccagcaaaggatttgcccagtatgagctgttcaagagcagcgccctggatgacaccatcacagccagccagacagccatcgccctggacatctcctggagccctgtggatgagatcctgcagatcccccccctgagcagcacagccaccctgaacatcaaggtggagagcggggagccccggggccccctgaaccacctgtaccgggagctgaagttcctgctggtgctggctgatggcctgaggactggagtgacagagtggctggagcccctggaggccaagtctgctgtggagctggtgcaggagttcctgaatgacctgaacaagctggatggctttggagacagcaccaagaaggacacagaggtggagaccctgaagcatgacacagctgctgtggacagatctgtgaagaggctcttcaaggtgcggagtgacctggactttgctgagcagctgtggtgcaagatgagcagcagcgtcatctcctaccaggacctggtgaagtgcttcaccctcatcatccagagcctgcagagaggagacatccagccctggctgcacagcggcagcaacagcctgctgagcaagctgatccaccagagctaccacggcaccatggacacagtgtccctgagcggcaccatccctgtgcagatgctgctggagatcggcctggacaagctgaagaaggactacatctccttcttcatcggccaggagctggccagcctgaaccacctggagtacttcatcgcccccagcgtggacatccaggagcaggtgtacagagtgcagaagctgcaccacatcctggagatcctggtgtcctgcatgcccttcatcaagagccagcacgagctgctcttcagcctgacccagatctgcatcaagtactacaagcagaaccccctggatgagcagcacatcttccagctgcctgtgcggcccacagctgtgaagaacctgtaccagagcgagaagccccagaagtggagggtggagatctacagcggccagaagaagatcaagacagtgtggcagctgagtgacagcagccccatcgaccacctgaacttccacaagccagacttcagcgagctgaccctgaatggcagcctggaggagcgcatcttcttcaccaacatggtgacctgcagccaggtgcacttcaagtag

SEQ ID NO: 177193 - DNA, 1434 bp, Artificial Sequence; identical to SEQ ID NO: 177192
  Description of Artificial Sequence: Synthetic coding sequence

SEQ ID NO: 177194 - DNA, 1275 bp, Artificial Sequence
  Description of Artificial Sequence: Synthetic coding sequence
atggccgccctgggagatgaggtgctggatggctacgtgtttcctgcctgccccccctgcagctaccgctacccctacccagctgccaccaagggcaaaggagctgctgggggctcctggcagcagaggggccggggctgcctgcctgccagcagcccctgcagcgctggggccgccagcctgtccttccctggctgcggccgcctgacagctgctgagtactttgacagctaccagcgggagcggctgatggccctgctggcccaggtgggccctggcctgggcccccgggccaggagagctggcagctgtgatgtggccgtgcaggtgagccccagaattgatgctgctgtgcagtgcagcctgggccgccgcaccctgcagaggcgggcccgggaccctgagagccctgctggccctggagctgagggcaccaccggcggcggcagcttcagccagcagcccagcagaagaggcctggagcagggcagcccccagaatggagccccccggcccatgaggttccccaggacagtggccgtgtacagccccctggccctgcggcggctgacagccttcctggagggccctggccctgctgctggggagcagaggtctggggccagtgatggagagcggggccccccaccagcccggctgcagggccctgaggagggggaggtgtggaccaagaaggccccccggcggccccagagtgatgatgatggagaggcccaggccgctgtgcgggcctcctgggagcagcctgcagatggccctgagctgcccccccgggaggcccaggagggggaggccgcccccaggtctgccctgcggagccctggccagccccccagcgctggccgggccagagatggaggagatggccgggaggccgctgtggccggggagggccccagccccaggagccctgagctgggcaaggagcggctgcgcttccagttcctggagcagaagtatggctactaccactgcaaggactgcaacatccgctgggagagcgcctacgtgtggtgtgtgcagggcaccaacaaggtgtacttcaagcagttctgcaggacctgccagaagagctacaacccctacagagtggaggacatcacctgccagagctgcaagcagacccgctgcagctgccctgtgaagctgcggcacgtggaccccaagaggccccaccggcaggacctgtgtggccgctgcaagggcaagaggctgagctgtgacagcaccttctccttcaagtacatcatctag

SEQ ID NO: 177195 - DNA, 1719 bp, Artificial Sequence
  Description of Artificial Sequence: Synthetic coding sequence
atggccgccccccggcccagccctgccatctctgtgtctgtgtctgccccagccttctacgccccccagaagaagtttggacctgtggtggcccccaagcccaaggtgaaccccttccggcctggggacagcgagcccccaccagcccctggggcccagagggcccagatgggccgggtgggggagatccccccacctcctcctgaggacttccccctgcccccaccacccctggccggagatggagatgatgctgagggcgccctgggcggggccttccccccacctcctccacccatcgaggagagcttccccccagcccccctggaggaggagatcttccccagccccccacctcctcctgaggaggagggcggccctgaggcccccatccccccaccaccccagccccgggagaaggtgagcagcattgacctggagattgacagcctgagcagcctgctggatgacatgaccaagaatgaccccttcaaggcccgggtgagcagcggctacgtgcccccacctgtggccacccccttcagcagcaagagcagcaccaagccagctgctgggggcacagcccccctgcccccctggaagagccccagcagcagccagcccctgccccaggtgcctgccccagcccagagccagacccagttccacgtgcagccccagccccagcccaagccccaggtgcagctgcacgtgcagagccagacccagcctgtgtccctggccaacacccagccccggggccccccagccagcagccctgccccagcccccaagttcagccctgtgacccccaagttcacccctgtggccagcaagttcagccctggggcccctgggggcagcggcagccagcccaaccagaagctgggccaccctgaggccctgtctgctggcaccggcagcccccagcccccatccttcacctacgcccagcagcgggagaagccccgggtgcaggagaagcagcaccctgtgcccccaccagcccagaaccagaaccaggtgcgcagccctggggcccctggccccctgaccctgaaggaggtggaggagctggagcagctgacccagcagctgatgcaggacatggagcacccccagaggcagaatgtggccgtgaatgagctgtgtggccgctgccaccagcccctggcccgggcccagcctgctgtgcgggccctgggccagctgttccacatcgcctgcttcacctgccaccagtgtgcccagcagctgcagggccagcagttctacagcctggagggcgccccctactgtgagggctgctacacagacaccctggagaagtgcaacacctgtggggagcccatcacagacaggatgctgcgggccaccgggaaggcctaccacccccactgcttcacctgtgtggtgtgtgcccggcccctggagggcaccagcttcatcgtggaccaggccaaccggccccactgtgtgcctgactaccacaagcagtatgccccccgctgcagcgtgtgcagcgagcccatcatgcctgagcccggcagagatgagaccgtgcgggtggtggccctggacaagaacttccacatgaagtgctacaagtgtgaggactgtgggaagcccctgagcattgaagcagatgacaatggctgcttccccctggatggccacgtgctgtgcaggaagtgccacacagcccgggcccagacctag

SEQ ID NO: 177196 - DNA, 1623 bp, Artificial Sequence
  Description of Artificial Sequence: Synthetic coding sequence
gctgccccccggcccagccctgccatctctgtgtctgtgtctgccccagccttctacgccccccagaagaagtttggacctgtggtggcccccaagcccaaggtgaaccccttccggcctggggacagcgagcccccaccagcccctggggcccagagggcccagatgggccgggtgggggagatccccccacctcctcctgaggacttccccctgcccccaccacccctggccggagatggagatgatgctgagggcgccctgggcggggccttccccccacctcctccacccatcgaggagagcttccccccagcccccctggaggaggagatcttccccagccccccacctcctcctgaggaggagggcggccctgaggcccccatccccccaccaccccaggtgagcagcggctacgtgcccccacctgtggccacccccttcagcagcaagagcagcaccaagccagctgctgggggcacagcccccctgcccccctggaagagccccagcagcagccagcccctgccccaggtgcctgccccagcccagagccagacccagttccacgtgcagccccagccccagcccaagccccaggtgcagctgcacgtgcagagccagacccagcctgtgtccctggccaacacccagccccggggccccccagccagcagccctgccccagcccccaagttcagccctgtgacccccaagttcacccctgtggccagcaagttcagccctggggcccctgggggcagcggcagccagcccaaccagaagctgggccaccctgaggccctgtctgctggcaccggcagcccccagcccccatccttcacctacgcccagcagcgggagaagccccgggtgcaggagaagcagcaccctgtgcccccaccagcccagaaccagaaccaggtgcgcagccctggggcccctggccccctgaccctgaaggaggtggaggagctggagcagctgacccagcagctgatgcaggacatggagcacccccagaggcagaatgtggccgtgaatgagctgtgtggccgctgccaccagcccctggcccgggcccagcctgctgtgcgggccctgggccagctgttccacatcgcctgcttcacctgccaccagtgtgcccagcagctgcagggccagcagttctacagcctggagggcgccccctactgtgagggctgctacacagacaccctggagaagtgcaacacctgtggggagcccatcacagacaggatgctgcgggccaccgggaaggcctaccacccccactgcttcacctgtgtggtgtgtgcccggcccctggagggcaccagcttcatcgtggaccaggccaaccggccccactgtgtgcctgactaccacaagcagtatgccccccgctgcagcgtgtgcagcgagcccatcatgcctgagcccggcagagatgagaccgtgcgggtggtggccctggacaagaacttccacatgaagtgctacaagtgtgaggactgtgggaagcccctgagcattgaagcagatgacaatggctgcttccccctggatggccacgtgctgtgcaggaagtgccacacagcccgggcccagacctag

SEQ ID NO: 177197 - DNA, 1248 bp, Artificial Sequence
  Description of Artificial Sequence: Synthetic coding sequence
atgaccaagaatgaccccttcaaggcccgggtgagcagcggctacgtgcccccacctgtggccacccccttcagcagcaagagcagcaccaagccagctgctgggggcacagcccccctgcccccctggaagagccccagcagcagccagcccctgccccaggtgcctgccccagcccagagccagacccagttccacgtgcagccccagccccagcccaagccccaggtgcagctgcacgtgcagagccagacccagcctgtgtccctggccaacacccagccccggggccccccagccagcagccctgccccagcccccaagttcagccctgtgacccccaagttcacccctgtggccagcaagttcagccctggggcccctgggggcagcggcagccagcccaaccagaagctgggccaccctgaggccctgtctgctggcaccggcagcccccagccccccagcttcacctacgcccagcagcgggagaagccccgggtgcaggagaagcagcaccctgtgcccccaccagcccagaaccagaaccaggtgcgcagccctggggcccctggccccctgaccctgaaggaggtggaggagctggagcagctgacccagcagctgatgcaggacatggagcacccccagaggcagaatgtggccgtgaatgagctgtgtggccgctgccaccagcccctggcccgggcccagcctgctgtgcgggccctgggccagctgttccacatcgcctgcttcacctgccaccagtgtgcccagcagctgcagggccagcagttctacagcctggagggcgccccctactgtgagggctgctacacagacaccctggagaagtgcaacacctgtggggagcccatcacagacaggatgctgcgggccaccgggaaggcctaccacccccactgcttcacctgtgtggtgtgtgcccggcccctggagggcaccagcttcatcgtggaccaggccaaccggccccactgtgtgcctgactaccacaagcagtatgccccccgctgcagcgtgtgcagcgagcccatcatgcctgagcccggcagagatgaaacagtgcgggtggtggccctggacaagaacttccacatgaagtgctacaagtgtgaggactgtgggaagcccctgagcattgaagcagatgacaatggctgcttccccctggatggccacgtgctgtgcaggaagtgccacacagcccgggcccagacctag

SEQ ID NO: 177198 - DNA, 1458 bp, Artificial Sequence
  Description of Artificial Sequence: Synthetic coding sequence
atgggccgggtgggggagatccccccacctcctcctgaggacttccccctgcccccaccacccctggccggagatggagatgatgctgagggcgccctgggcggggccttccccccacctcctccacccatcgaggagagcttccccccagcccccctggaggaggagatcttccccagccccccacctcctcctgaggaggagggcggccctgaggcccccatccccccaccaccccaggtgagcagcggctacgtgcccccacctgtggccacccccttcagcagcaagagcagcaccaagccagctgctgggggcacagcccccctgcccccctggaagagccccagcagcagccagcccctgccccaggtgcctgccccagcccagagccagacccagttccacgtgcagccccagccccagcccaagccccaggtgcagctgcacgtgcagagccagacccagcctgtgtccctggccaacacccagccccggggccccccagccagcagccctgccccagcccccaagttcagccctgtgacccccaagttcacccctgtggccagcaagttcagccctggggcccctgggggcagcggcagccagcccaaccagaagctgggccaccctgaggccctgtctgctggcaccggcagcccccagccccccagcttcacctacgcccagcagcgggagaagccccgggtgcaggagaagcagcaccctgtgcccccaccagcccagaaccagaaccaggtgcgcagccctggggcccctggccccctgaccctgaaggaggtggaggagctggagcagctgacccagcagctgatgcaggacatggagcacccccagaggcagaatgtggccgtgaatgagctgtgtggccgctgccaccagcccctggcccgggcccagcctgctgtgcgggccctgggccagctgttccacatcgcctgcttcacctgccaccagtgtgcccagcagctgcagggccagcagttctacagcctggagggcgccccctactgtgagggctgctacacagacaccctggagaagtgcaacacctgtggggagcccatcacagacaggatgctgcgggccaccgggaaggcctaccacccccactgcttcacctgtgtggtgtgtgcccggcccctggagggcaccagcttcatcgtggaccaggccaaccggccccactgtgtgcctgactaccacaagcagtatgccccccgctgcagcgtgtgcagcgagcccatcatgcctgagcccggcagagatgaaacagtgcgggtggtggccctggacaagaacttccacatgaagtgctacaagtgtgaggactgtgggaagcccctgagcattgaagcagatgacaatggctgcttccccctggatggccacgtgctgtgcaggaagtgccacacagcccgggcccagacctag

SEQ ID NO: 177199 - DNA, 495 bp, Artificial Sequence
  Description of Artificial Sequence: Synthetic coding sequence
atggccgccccccggcccagccctgccatctctgtgtctgtgtctgccccagccttctacgccccccagaagaagtttggacctgtggtggcccccaagcccaaggtgaaccccttccggcctggggacagcgagcccccaccagcccctggggcccagagggcccagatgggccgggtgggggagatccccccacctcctcctgaggacttccccctgcccccaccacccctggccggagatggagatgatgctgagggcgccctgggcggggccttccccccacctcctccacccatcgaggagagcttccccccagcccccctggaggaggagatcttccccagccccccacctcctcctgaggaggagggcggccctgaggcccccatccccccaccaccccagccccgggagaaggtgagcagcattgacctggagattgacagcctgagcagcctgctggatgacatgaccaagaatgaccccttctag

SEQ ID NO: 177200 - DNA, 852 bp, Artificial Sequence
  Description of Artificial Sequence: Synthetic coding sequence
atggacctgtggcccggcgcctggatgctgctgctgctgctgttcttattgctgctgtttttgctccccacgctttggttctgtagtccgagtgccaaatatttcttcaaaatggcattctacaacgggtggattctgttccttgctgtgctggcaatccccgtctgcgcggtgaggggccgcaatgttgaaaacatgaagattctgcgcctgatgctgctgcacatcaagtatctctatggtatacgggtcgaagtcaggggggctcatcatttccccccgagccagccttacgttgtagtgagtaatcaccagtctagtctagacctgttaggcatgatggaggttctgcccgggcgttgtgtgcccatcgccaagcgggaactgctctgggcagggtctgctggcctggcttgttggctggccggggtgatctttattgacagaaagcgcaccggagatgccatttccgtaatgtctgaagtagcccagacccttcttactcaggacgtcagggtttgggtattccccgaagggacacgaaatcataatggtagcatgctgccttttaaacgaggtgctttccacctggccgtgcaggcccaggtgccaatcgtccccatcgtcatgagtagttatcaggacttctattgcaagaaggaaaggaggtttacctccggccaatgtcaggtcagggtgcttcctcctgtgcccacggagggtctgacacccgacgacgtgccagcccttgctgatcgcgtccggcacagcatgctaaccgtctttcgcgaaattagtacagacggacggggcggtggcgactaccttaagaaacccgggggaggaggttag

SEQ ID NO: 177201 - DNA, 852 bp, Artificial Sequence
  Description of Artificial Sequence: Synthetic coding sequence
atggacctgtggcccggcgcctggatgctgctgctgctgctgttcctgcttctactctttctcctgcctacgctttggttctgcagtcccagcgctaaatatttcttcaagatggcattctataacgggtggattctattcctagccgtgctggcgatacccgtatgcgcagttcgagggagaaacgttgaaaacatgaaaattctgcgcctgatgctcctccacataaaatacctgtatggaatccgcgtggaggttcggggagcccaccatttccctcccagccaaccctacgttgtcgtctcgaaccaccagtcgtctctcgatttgttggggatgatggaagttttgcccgggcggtgtgtcccaatagctaagagagagttgctgtgggcaggctcagccggcctcgcatgctggttggctggtgtgattttcattgaccggaagaggacaggcgatgctatttccgtgatgtccgaggtggcacagacgcttttaacgcaggacgttagagtgtgggtcttcccagaggggacacgtaaccacaatggcagtatgctgcccttcaagcgcggtgcttttcatctggcagtccaagcccaagtcccaatagtccccatcgtcatgtcaagttaccaggacttctactgcaaaaaggagagaaggtttacctccgggcagtgccaggttcgtgttcttccgccagtaccaacagagggattaacaccagacgacgtgcctgctctggctgacagagttaggcatagtatgcttacggttttcagggagatctccaccgacggtagaggtggtggggattacttgaaaaaaccgggagggggggggtag

SEQ ID NO: 177202 - DNA, 852 bp, Artificial Sequence
  Description of Artificial Sequence: Synthetic coding sequence
atggacctgtggcccggcgcctggatgctgctgctgctgctgttcctgcttttgttgtttctgcttccaacgctctggttttgtagcccctctgcaaagtatttctttaagatggccttctacaatggatggatcctcttcttagccgtgctggcgatacccgtctgcgcagtgcgaggaagaaacgtggaaaatatgaagattctgcggctcatgcttctccacatcaagtatctgtatggcatcagagtggaggtcaggggtgcacatcacttcccaccctcccagccttacgtggtggttagcaatcatcaaagctccctggacttgctgggaatgatggaagttctgcccggccggtgcgttcccatcgctaaacgcgaattactgtgggcaggctcagccggactggcatgctggctggcaggggtcattttcatcgacagaaagcgaaccggggacgccatttccgttatgtcggaggtggcccaaacacttctgactcaggacgttcgagtgtgggtgttcccagagggtaccaggaaccacaatggatctatgctgccatttaagcgcggtgccttccatctggccgtccaggcccaggtgcctatcgtgcccatcgttatgagcagttaccaagatttctattgcaagaaggagagaagatttacaagcggtcagtgtcaggttcgagtgctccctcctgttccgacggaaggcttaactcctgacgatgtacccgccctagccgatcgagtgaggcactcgatgttaaccgtgttcagagagataagtacagacggcagggggggcggagactacttgaagaagcccggaggggggggctag

SEQ ID NO: 177203 - DNA, 852 bp, Artificial Sequence
  Description of Artificial Sequence: Synthetic coding sequence
atggacctgtggcccggcgcctggatgctgctgctgctgctgttcctacttcttttgttcctgttgccaaccctgtggttctgctcacccagcgccaagtattttttcaaaatggcgttttacaacggctggatcctcttccttgcagtgctggctatcccagtgtgcgccgtacggggacgcaacgtggagaacatgaaaattctcagattgatgcttctgcatattaagtatctctacggaatcagggttgaagtgaggggggctcatcattttccaccttctcaaccctatgtcgtcgtgtccaatcaccaatctagcctcgatctccttgggatgatggaagtcctgcccgggcggtgcgtgccaatagccaaacgcgagctgctgtgggctggatccgccggcctcgcctgctggcttgccggggtgatcttcatcgatcgcaagaggaccggcgacgcaatctctgtgatgtccgaagttgcccaaacgctcctgacccaagacgttagggtttgggtcttccccgaggggaccagaaaccataatggctctatgttgcctttcaagaggggcgctttccatttagccgtacaagcgcaagtccccattgtgccgatcgtcatgtcctcctaccaagatttctactgtaagaaggagaggcgatttacttccggccaatgccaggtcagagtccttccacccgtcccgactgagggactgacgcccgatgatgtccccgctctcgctgaccgtgtgaggcactccatgctaacagtgtttagagagatttctaccgatggtagaggagggggggactaccttaaaaaaccgggcggaggcgggtag

SEQ ID NO: 177204 - DNA, 852 bp, Artificial Sequence
  Description of Artificial Sequence: Synthetic coding sequence
atggacctgtggcccggcgcctggatgctgctgctgctgctgttcctcctgttgctattccttctacccacactctggttctgctctcccagcgccaagtatttcttcaagatggcattctataatggttggatcctctttcttgctgtcctggccattcctgtgtgcgccgtgcgcgggagaaatgtggaaaacatgaagatcttgagacttatgctactgcatattaagtacctgtatggtatccgggtggaggtgaggggagctcatcactttcctccttcccagccatacgtagtagtgtcgaaccaccagtctagtctggacctgttgggaatgatggaggtgctgccaggtagatgcgtgcccatcgctaaaagggagctcctgtgggccgggtccgcagggctggcctgctggctggcaggcgttatcttcattgataggaagcgaacaggcgacgctatctccgtcatgtccgaagtcgcccagaccctcctgactcaagacgtgagagtgtgggtcttccccgagggcacaagaaatcataatggttctatgctccctttcaagcggggggccttccacctagctgttcaggcccaagtacccatcgtgcccatagtcatgtccagctatcaggatttctactgcaagaaggagagaagattcacctccgggcagtgtcaggtgagagtcctgcctccagttccaaccgagggactgacacccgatgacgtaccggccctcgccgatcgggtgagacactcaatgctgaccgtctttcgggagatttctactgacggtcggggagggggggactatctgaagaaacctggcggcggtggctag

SEQ ID NO: 177205 - DNA, 852 bp, Artificial Sequence
  Description of Artificial Sequence: Synthetic coding sequence
atggacctgtggcccggcgcctggatgctgctgctgctgctgttccttctgctgttattcctgctccctacactttggttttgcagtccgagtgcaaagtacttcttcaagatggctttctataatggatggatcctgtttctggctgtgttagccatacccgtgtgtgctgtgcggggccgcaacgtggagaatatgaagatcttacgcctaatgctgctacacatcaagtacctgtatggtattcgggttgaggtgaggggcgcccatcactttcccccctctcaaccctatgtggtggtatcaaatcaccaatcttctctcgacttattagggatgatggaagtactcccaggaaggtgtgtgccgatagccaagagggagctgctctgggccggctcggcaggacttgcatgttggttggcaggggtgatattcattgacagaaagaggaccggcgatgccatttcagtgatgtctgaggtcgcccagacactgctgacacaggacgtgagggtttgggtgttccccgagggcacccggaatcacaatggaagtatgctcccattcaagaggggcgcattccatttggctgtgcaggcacaggtgccaattgttccaattgttatgtcaagctaccaggatttctattgtaagaaagaaaggcgtttcaccagtggccagtgccaggtgcgcgtgctgcctcctgttccaactgaggggctcactcccgatgacgtacccgcgttagcagatcgcgtacgacattccatgttgaccgtgttcagagagatcagcaccgacgggcgtggaggtggggattacctaaaaaagccaggcggtggcggatag

SEQ ID NO: 177206 - DNA, 852 bp, Artificial Sequence
  Description of Artificial Sequence: Synthetic coding sequence
atggacctgtggcccggcgcctggatgctgctgctgctgctgttcctcctcctcttattcctccttcccactctgtggttttgttcgccatcagctaagtacttttttaaaatggctttctacaatgggtggattttgttcctggccgttctcgccattccggtctgcgccgtccgcggccggaatgttgaaaacatgaagattctgaggttaatgttgcttcatatcaaatatctgtatgggatccgtgtggaagttcggggtgctcaccatttcccgccctctcagccatatgtggtggtatctaatcatcaaagttcactggatttgctgggcatgatggaagtgctgccaggcaggtgtgtcccgattgccaaacgcgagctgctttgggccggtagcgccggactggcctgttggcttgccggcgttattttcattgatcggaaacggacgggagatgccatcagcgtcatgtctgaggtcgctcagaccctgctgacacaagacgtgcgggtatgggtgtttccagagggtacgagaaaccataacggcagtatgctcccattcaaaaggggcgctttccacctggccgttcaggcccaggtgcccattgtgcctatcgtgatgagctcttaccaggacttctattgcaagaaggagcgacgctttacttccggccaatgtcaggtacgagtgttgccccctgtaccgacagagggcctcactccggatgacgtccccgctctggcagatcgcgtcaggcactcaatgctgaccgttttcagagagatctctactgatgggcggggtggaggagactacctgaaaaagccaggtggtggcgggtag

SEQ ID NO: 177207 - DNA, 852 bp, Artificial Sequence
  Description of Artificial Sequence: Synthetic coding sequence
atggacctgtggcccggcgcctggatgctgctgctgctgctgttccttctactcctcttcttactacctaccctctggttttgctctccctcagccaaatacttctttaaaatggctttctataatggatggattttattcctcgccgtcctggctattcctgtctgtgcggtgcggggaaggaatgtagagaatatgaaaattctgcgtctaatgcttctgcatataaagtacctgtacggtatccgcgtagaagtcagaggagcccaccactttccccctagtcagccttacgtggtcgtctctaatcatcagagttctctggaccttctggggatgatggaagtactgcctggtagatgcgtgcctatcgcgaaaagggagctactgtgggccggctcagccggcctggcctgttggctggccggggttatcttcatcgatcgcaagagaaccggggatgctatcagcgttatgtcagaggtggcacagacattacttacgcaggacgttcgggtgtgggtttttcctgaggggacgcggaatcataatggatcgatgctgcccttcaagaggggtgctttccacctggccgtacaggctcaagtcccaatcgttcctattgtcatgagctcttaccaggacttttattgtaagaaagagagacggtttacaagcggccagtgtcaggtgcgcgtgctacctcccgtgcctaccgaggggctcaccccagacgacgtgcctgcgctagccgaccgtgttcgtcattccatgctgaccgtctttcgtgaaatcagcaccgacggccgaggcggcggggactaccttaagaaacccggtggtgggggctag

SEQ ID NO: 177208 - DNA, 852 bp, Artificial Sequence
  Description of Artificial Sequence: Synthetic coding sequence
atggacctgtggcccggcgcctggatgctgctgctgctgctgttcttgctcctgctttttctcctgccaacactctggttttgttctccaagtgcaaaatatttctttaagatggctttctataatggttggatactctttctggcggtactcgccattcccgtatgtgcagtacgggggaggaatgtcgagaatatgaagatactgagactaatgctgttacatatcaagtatctctatgggatcagggtggaagtgcgcggagcacaccatttccctccaagccagccttacgtggtcgtgtccaatcatcaaagtagtctcgacctgctgggaatgatggaagtgctgcctggtcgatgcgttcctatcgctaaacgcgagctcctttgggcgggaagcgcagggcttgcttgttggctggcaggagtgatatttattgatagaaaaagaaccggtgatgccattagcgtgatgagcgaggtagcacagaccctccttacgcaggacgtccgggtgtgggtctttcctgaaggcaccagaaatcacaacggctccatgctgccattcaaacgcggggcgttccacctggcagttcaggcgcaggtgccgatcgtgccaatcgtgatgtcatcataccaagatttctactgtaagaaggagagacggttcacgagtgggcagtgtcaggtgcgggtcctccctcctgttcctaccgaaggcctgacacccgacgacgtgcccgccctggctgaccgagtgagacacagtatgctaacagtattccgggagatatccacagacgggcgcggcggtggcgattacctcaagaagcctgggggcggagggtag

SEQ ID NO: 177209 - DNA, 852 bp, Artificial Sequence
  Description of Artificial Sequence: Synthetic coding sequence
atggacctgtggcccggcgcctggatgctgctgctgctgctgttcctgctcctgctgtttctgctaccgaccctctggttttgtagcccttcagcaaaatacttcttcaagatggctttctataacggttggattttatttttggcggtactggcaattcccgtttgtgcggtgcggggcagaaatgtggagaacatgaaaatcctacgtttgatgctgttacatatcaagtatctctacggcatacgagtggaggttcgcggcgcgcaccattttcctccatctcagccttatgttgtcgtttccaaccaccagtcctccctggacctgctgggtatgatggaggtgctgccaggtagatgcgtgcccatcgctaaaagagagttgttgtgggccggctcggcagggcttgcttgttggcttgcaggggttattttcattgaccgaaagcgcactggggatgcaatctccgtcatgtccgaagtggcccaaactctgttaacgcaggatgtgcgggtgtgggtctttccagagggcacccgtaatcataatggtagtatgctcccattcaagaggggagctttccacctggcagtgcaggcgcaggtccctattgtgccaatcgtgatgtcctcctaccaagatttctactgtaagaaggaaaggcgcttcacgagtggccagtgccaggtgcgggttctgcctcccgtgccaaccgagggcctcactccggatgatgtgcctgctttggctgatcgagtgcgccattcaatgctgacagtgttcagggaaatctcgaccgacggtaggggaggtggagattacctgaaaaagccaggtggaggcggttag

SEQ ID NO: 177210 - DNA, 852 bp, Artificial Sequence
  Description of Artificial Sequence: Synthetic coding sequence
atggacctgtggcccggcgcctggatgctgctgctgctgctgttccttttactgctgtttctgctgcccactctgtggttctgttcgccctcggcaaagtatttctttaaaatggccttttacaatggttggatcctgttcctggctgtcctcgccatccctgtgtgcgcggtgcgtggtcgcaatgtggaaaacatgaaaatccttagacttatgctcctccacatcaagtacctttacggaatacgggtcgaggtccggggagcacaccattttccaccctcccaaccatatgtggtcgtgagcaatcatcagagttcactcgatttgctgggcatgatggaggttctgccaggaagatgtgtaccaattgcaaagcgggagctgctgtgggctggaagtgcgggacttgcctgttggctggctggcgtcatatttatcgatcgcaagcggacaggagatgccattagcgtgatgagcgaagtcgcacagacactacttacacaggatgttagagtgtgggttttcccagaaggtacaaggaatcataacggttccatgctcccttttaagcgtggcgcctttcatctcgctgtacaggcgcaggtgcccattgtacctatcgtcatgtcctcatatcaggatttctactgcaagaaggaaagacggtttacttcggggcaatgccaggtgcgggtgctccccccagtaccgactgaggggctcacaccagacgacgtccctgccctggctgaccgcgttagacatagcatgctaacagtgttccgggaaataagcactgacgggcgtggcgggggggattacctgaaaaaacccggaggcggaggctag

SEQ ID NO: 177211 - DNA, 852 bp, Artificial Sequence
  Description of Artificial Sequence: Synthetic coding sequence
atggacctgtggcccggcgcctggatgctgctgctgctgctgttcctcctgttgctctttctattgcccaccctttggttttgctcaccttccgcaaaatatttttttaagatggccttttacaatggttggattctttttctcgctgtgttagcgatcccagtgtgcgccgtacggggccggaatgtggagaacatgaagatactacggctgatgctccttcatattaagtacctctacgggatccgggtggaggtaagaggcgctcaccactttcctccaagtcagccctatgttgtggtcagcaaccaccagagcagcttggacctgctggggatgatggaggtgctgcctggtaggtgcgttcccatcgctaaaagggagttgctatgggctggaagcgcaggattggcttgctggttagccggcgtgattttcatcgacaggaaacgtacgggagacgcaatatcagtgatgtccgaggttgctcaaactctattgacccaagacgtgagagtatgggtgttccccgaaggtaccagaaaccataatggatcaatgctgccattcaagaggggcgccttccacttagccgtgcaggcacaggtgcccatcgttccaatagtgatgtcctcgtatcaggatttttattgtaagaaagaacggaggttcacatccggccagtgccaggtgcgcgtgcttccccccgtgccgaccgaaggccttacacccgacgacgtaccagcattggccgatagggtgcgtcactcaatgctgaccgtcttccgcgagattagtactgacggtcgaggggggggggattatctcaaaaaacccggcgggggcggctag

SEQ ID NO: 177212 - DNA, 516 bp, Artificial Sequence
  Description of Artificial Sequence: Synthetic coding sequence
atgatggaggtgctgcccggccggtgcgtgcccatcgccaagcgggagctgctttgggccgggtctgccggcctggcttgttggctcgccggagtgatctttatcgataggaagcgaacaggggatgcgatcagcgtgatgagcgaggtggcccaaacacttttgacccaggacgttagggtatgggtatttcccgaaggcaccaggaaccataacgggagtatgctcccctttaaacgaggggcgtttcaccttgcagtgcaagcacaggtcccaattgttcccattgttatgagtagctaccaagacttctactgcaaaaaagaaagaaggtttacgtcaggacagtgccaggtgcgcgtcctgcccccagtgccaactgagggcctcacacccgatgatgtgcctgcacttgccgaccgtgtgcgccatagcatgctgactgtcttccgggaaatatctacagacggacggggcggcggggattacctcaagaagccagggggtggaggttag

SEQ ID NO: 177213 - DNA, 852 bp, Artificial Sequence
  Description of Artificial Sequence: Synthetic coding sequence
atggacctgtggcccggcgcctggatgctgctgctgctgctgttcttgctcctgctgtttcttttgcctacgctgtggttctgcagtccttcagctaaatacttttttaagatggccttctataatggatggatccttttcctcgccgttctggccatacccgtgtgcgccgtacgaggcaggaacgtcgaaaatatgaaaatactgaggctaatgttgctccacattaagtatctatacggcatcagggtcgaggttcgtggagctcaccacttccccccgtcacagccctacgtagtcgtgtccaatcaccagtcttctctagatctcttaggcatgatggaggtgctccctgggaggtgtgtgccaatagccaagcgggagcttctttgggccggttctgcaggcctcgcctgctggctggccggagttattttcatcgatcggaagcggactggggatgccattagcgtgatgagtgaggtggcccagaccctgttgacacaggacgtgcgggtttgggtgtttcctgaaggaacgcgcaaccacaacggctctatgttgccattcaagcgcggcgccttccacctagctgttcaggctcaggtacccatcgttccgattgtcatgagcagctaccaggatttttattgcaaaaaggagcgcagattcacatcaggtcagtgccaggtgcgggtgttaccccctgttccaaccgaagggttaacacctgacgatgtgcccgccctggccgacagggtgcgccactcaatgctcaccgtatttcgcgagatctccacagatggaagaggaggcggcgattatctgaaaaagcccggggggggcggatag

SEQ ID NO: 177214 - DNA, 852 bp, Artificial Sequence
  Description of Artificial Sequence: Synthetic coding sequence
atggacctgtggcccggcgcctggatgctgctgctgctgctgttcttattgctcctttttctcctgcccaccttgtggttctgctcgccttccgccaaatacttttttaagatggctttctacaacggatggatcctcttcctcgccgtgctggccatccccgtctgcgcagtgcggggccgtaacgtggagaacatgaaaattttaaggctgatgctgctacacatcaaatacctctatgggataagggtcgaagtgcgaggagctcatcatttcccaccctcacaaccttacgtcgtggtgagcaaccatcagtcgtccttggacctgctgggaatgatggaagtcctgccaggtcgctgtgtgcctattgcgaaacgcgagctcctgtgggccggaagcgccgggctggcatgctggcttgccggggtcatttttatcgaccggaaacggactggtgacgccataagcgtgatgtccgaggtggcccagacactcctgacacaggatgttcgcgtgtgggtgttcccggaggggaccagaaatcataacggctctatgctgccttttaaaagaggcgcatttcacctggctgttcaggcacaggtgccaatcgtgcccatcgtgatgtctagctaccaagacttctactgcaaaaaggaacgcagatttacctccggacagtgtcaggtgcgggtgttacccccagtgcccacagaggggctcacaccagacgatgtccccgctctggcagacagagtgcggcactcaatgctcactgtctttagggaaatctccactgacggcagaggaggtggggactatctgaagaagcccggtggcggcggatag

SEQ ID NO: 177215 - DNA, 852 bp, Artificial Sequence
  Description of Artificial Sequence: Synthetic coding sequence
atggacctgtggcccggcgcctggatgctgctgctgctgctgttcctgttgttgctgttcttactgcccacactctggttttgctctccatctgctaagtacttctttaaaatggccttctacaacggttggattttgttcttggcagtattggccatacctgtgtgcgctgtgagaggccgcaacgtggagaatatgaagatactgagacttatgctcttacacatcaagtatctctacggcattcgtgtcgaagtgagaggagctcatcactttccaccttcgcagccttacgtggtggtaagtaatcaccagagctccctcgacctgctcggtatgatggaggtgctgcccggccggtgtgtacctattgcaaaaagggagcttctgtgggccggtagcgcaggcttggcctgttggttggccggagtgatctttatcgatagaaagaggacaggcgacgcaatctccgtgatgagtgaggtggcccagactctgcttacccaggatgtccgtgtttgggtcttcccagagggcacacggaatcataacgggtccatgctcccatttaagaggggggccttccacctggcagtgcaagctcaagtacccattgtgcctatcgtgatgtcttcttatcaagacttttactgtaaaaaagaacggcgctttacttcaggacagtgtcaggttcgagtgttgcctccggtccccacagagggactgactcccgatgatgtgcccgcacttgctgatcgagtgaggcattccatgctgactgtgttccgggaaatttctactgacggtcgaggaggtggagactatctcaaaaagccaggaggtgggggctag

SEQ ID NO: 177216 - DNA, 852 bp, Artificial Sequence
  Description of Artificial Sequence: Synthetic coding sequence
atggacctgtggcccggcgcctggatgctgctgctgctgctgttcctcctcctgctttttttgctccccaccctgtggttttgttccccttcagccaagtacttttttaagatggcattttacaatggctggattttatttctggcagtgctggcgatccctgtttgcgcggtgcgtggcagaaacgtggaaaatatgaagatcctgcgactgatgctcctgcatatcaaatacttatacggaatccgtgtggaggttcgcggagcacaccatttcccaccttcacagccttatgtggtcgtatctaaccaccagtcttcccttgatttactgggaatgatggaggttctgcccggccggtgtgtgcctatcgctaaacgcgagctactgtgggccgggtccgccggtctagcatgctggctcgctggagtaatttttatcgaccggaagaggacaggagatgctattagtgtaatgagcgaggtagctcagacgctcctcactcaagacgtgcgcgtctgggtcttccccgagggcacgagaaatcacaatggttcgatgttaccttttaagagaggagcttttcatctggcggtccaggcccaggtcccgatcgtgcctattgtgatgtcaagttaccaggacttttattgcaaaaaggaacgaagattcacgagcgggcagtgtcaagtacgcgtgctgcctcccgttccgaccgagggcctcacacccgacgatgtcccagccttagccgacagagtgcggcattcaatgttgacggtatttagggaaatcagcacagatgggcgtggagggggagattacctcaagaagccaggaggtggaggctag

SEQ ID NO: 177217 - DNA, 852 bp, Artificial Sequence
  Description of Artificial Sequence: Synthetic coding sequence
atggacctgtggcccggcgcctggatgctgctgctgctgctgttcctgctgttactctttcttcttccaaccttatggttctgctccccatccgccaagtactttttcaagatggcgttttataatggctggattctgttcctggcggttctggctattcccgtctgcgcggtacggggaagaaatgtggaaaacatgaaaattctgcgtctgatgctcctgcatataaagtacttatacggaattcgggtggaggtgagaggagcgcaccattttccaccctcgcagccatacgtcgtagtttcaaatcaccagtcttcccttgatttactgggcatgatggaggttctcccgggacgctgcgtacccattgccaaacgcgagttgctttgggcggggtccgccggactggcctgttggctggctggcgtcatcttcatcgaccgtaagagaacaggggatgccatctcagtcatgtccgaagtggcccagactctgctcacccaagatgtgagggtctgggtgtttcctgagggaacaaggaaccacaatggcagcatgttgccgttcaagaggggggcctttcatctcgctgtgcaagcccaagtgcccatagtgccgatcgttatgagcagctatcaggacttctattgcaagaaagagcgccgcttcacctctggtcagtgtcaagtccgcgtactgccacccgtgcctacagagggattgacacctgatgatgtgcctgctttggccgatcgcgtgcgtcattctatgctcacagtgtttcgcgaaatcagcacagacggccggggtggtggagattatcttaagaagcccggtggaggtggctag

SEQ ID NO: 177218 - DNA, 852 bp, Artificial Sequence
  Description of Artificial Sequence: Synthetic coding sequence
atggacctgtggcccggcgcctggatgctgctgctgctgctgttcttgctcttgttgtttcttctgcctactctatggttctgtagtccatccgcaaagtacttctttaagatggcattctacaatggctggatcctttttctggccgttctggcaatcccagtgtgcgctgtgcggggacggaacgtagagaacatgaagatcctgagacttatgctgcttcacatcaagtacctgtacggaattagggtagaagttaggggcgcccatcacttcccgccatcccagccctatgtggtcgtcagtaatcatcagagcagcctcgacctcttagggatgatggaggtattgccgggaaggtgcgtcccgatagctaagcgagaattactttgggccggtagcgccggtctggcctgttggctggccggggtcatcttcattgataggaagagaaccggcgacgcaattagcgtgatgagtgaagtcgcccagacacttctgacccaggacgtccgggtctgggtgttccccgagggcactcgaaaccataacggatcaatgctgcccttcaagcggggcgcctttcacctggccgtccaggctcaggtgcccatcgtgcccatcgttatgtcatcatatcaggacttttactgtaagaaggagaggaggttcaccagcggacagtgtcaggttcgcgttctgccccctgtcccaacagaaggcttgactcctgatgatgtgcctgctctcgcagacagggtgaggcactccatgctgactgtgttccgcgagatctctaccgatggcaggggcgggggcgactatcttaaaaaacccggcggtggcgggtag

SEQ ID NO: 177219 - DNA, 852 bp, Artificial Sequence
  Description of Artificial Sequence: Synthetic coding sequence
atggacctgtggcccggcgcctggatgctgctgctgctgctgttcctgctgttactgtttttattgccaactttgtggttttgcagtccttctgcaaagtatttttttaagatggccttctataatggctggatccttttcctggcggtgctagctatccctgtctgtgctgttcggggaaggaatgtggagaatatgaagatcctccgtctgatgctcctccatatcaagtatctttacgggatcagagtggaggtccggggagcccatcatttccccccttctcagccgtatgtggtggtctccaaccaccagtcatccttagaccttctcggaatgatggaagtgctccccgggcgatgcgtgcccatagctaaaagagagctgctgtgggccggaagtgctggcctggcttgctggcttgcaggcgttatttttatcgaccggaagcgcaccggggatgcaattagtgtaatgagcgaggtagctcagacgctgctcacccaggatgtcagagtgtgggtcttccccgaaggcacacggaatcacaacggctccatgctgcccttcaagcgcggagccttccacctagccgtccaagcgcaggttcccatcgttccgatcgttatgagtagctatcaggatttctattgtaaaaaggaaaggaggttcacttccggtcagtgccaggttagggtgctacctccagtgccaaccgaaggtctcaccccggacgatgtgcccgcactcgccgacagagtgcgacactctatgttgacagtcttccgcgagattagcacggacggtaggggggggggagattaccttaagaagcctggcggaggcgggtag

SEQ ID NO: 177220 - DNA, 852 bp, Artificial Sequence
  Description of Artificial Sequence: Synthetic coding sequence
atggacctgtggcccggcgcctggatgctgctgctgctgctgttccttttactgttgttcctgctgcctactctgtggttttgctcaccttctgccaagtactttttcaaaatggccttttataatggctggatcctctttctcgccgtgctggcaatacctgtgtgcgctgtgcgtggcagaaacgtggagaatatgaagatacttcgactgatgctgctgcatatcaagtatctgtacggcatccgcgtagaggtccgtggcgctcaccatttccccccctcccagccttatgtggttgtgtcaaaccaccagtctagtttggaccttctaggcatgatggaggtactgccgggccgttgtgttcctatagctaagagggagcttctgtgggccggatccgcgggactggcgtgctggctggctggggtcatctttattgatagaaaacggactggcgacgcaatctctgtgatgagcgaagtagcccagacattgctgacacaggacgtgcgggtttgggtattcccggagggtaccaggaatcataatggctcaatgctccccttcaagcgcggtgcgttccacctcgctgtgcaggctcaggtgcccatcgtaccgatcgtgatgtctagctaccaagacttctattgcaaaaaagagcgaaggtttaccagcgggcaatgccaggtcagggtgctgcctccggttcctactgaaggcctcacacctgatgatgtccccgctctagctgaccgcgttcgacactctatgcttaccgtgtttagagaaatctctaccgacgggcggggtggcggagactatctgaagaagcccgggggcggcggctag

SEQ ID NO: 177221 - DNA, 852 bp, Artificial Sequence
  Description of Artificial Sequence: Synthetic coding sequence
atggacctgtggcccggcgcctggatgctgctgctgctgctgttccttctcctgctgtttctgcttcctacgttatggttttgctctccgtcagctaagtacttcttcaagatggctttctacaacggctggattctttttctagctgttctagcgatccccgtgtgcgctgttagaggacgtaatgtggaaaacatgaagatactgcgtctgatgcttctccatattaaatacctttacgggatacgtgtcgaggtacggggcgctcatcacttccctcccagccagccatatgtggttgtcagtaatcatcaatcttcacttgaccttcttgggatgatggaggttttgcctggacgatgcgtgcctattgcgaaaagggagctgctctgggccggcagtgccggcctggcatgttggttagcaggggtcattttcatagacaggaagcggacaggcgacgctatcagcgtcatgagcgaggtggcccagacccttttgacacaagatgtccgggtctgggtctttcctgagggaactagaaaccataacggaagcatgttaccttttaagagaggagcctttcatctggctgttcaggctcaggtgccaatcgttccaatcgtcatgtctagctatcaggatttttactgcaaaaaagagaggcgctttacctcgggacagtgtcaggtccgagtactgcctccagtgcccaccgaaggactgactccagacgatgtgccggcacttgccgatagagtgaggcacagtatgcttaccgtgtttcgggagatcagtacggacggccgaggcggaggcgattacctcaagaaacctggaggaggcggttag

SEQ ID NO: 177222 - DNA, 852 bp, Artificial Sequence
  Description of Artificial Sequence: Synthetic coding sequence
atggacctgtggcccggcgcctggatgctgctgctgctgctgttcctgcttttgctatttttgttgccgaccctctggttctgttcccccagtgcgaagtattttttcaagatggcattctacaacggctggattctctttctggcggtgctagctatcccggtgtgtgccgtgcgcggtcgaaacgttgagaacatgaagattctcaggctcatgctgcttcacatcaaatatttgtacgggatccgggttgaagtaagaggtgcccaccatttcccaccttcgcagccctacgtggtggtatcaaatcatcaatcttctctggacctacttggaatgatggaagtgttgccagggcggtgtgtgcctatcgcaaaacgcgagcttctttgggcaggcagcgccgggctggcttgctggttagccggggttattttcatcgacagaaaacgaacaggagacgcaatctctgtaatgtcagaagtcgcccagaccctgttgactcaggacgtccgggtgtgggtgttcccggaaggtactcgaaatcacaacggctcgatgctccccttcaagcggggtgcttttcacctggccgtacaagcacaggtgcccatagtccccatcgttatgtcctcatatcaggatttttactgcaaaaaagaacgacgattcacatcaggacagtgccaagtcagagtgttgccgcctgtacctacagaggggctgacacctgacgatgtgcccgcgctggctgatcgggtgaggcacagcatgttaacagtgtttcgcgagatctccactgatgggcgcggagggggcgactatcttaagaaacctggaggcggtggatag

SEQ ID NO: 177223 - DNA, 852 bp, Artificial Sequence
  Description of Artificial Sequence: Synthetic coding sequence
atggacctgtggcccggcgcctggatgctgctgctgctgctgttccttctgctgttattcctactcccaaccttgtggttttgctctcctagtgcgaaatacttcttcaagatggcattctataatggatggatccttttccttgccgtactggccatcccggtctgcgctgttcgcggccgcaacgtagagaatatgaagattctgaggttaatgcttctgcatattaaatacctttacggtatcagagtggaggtgcgaggggcccatcactttcctccttcacaaccatacgtggtcgtcagcaaccaccaaagctctttagaccttctgggaatgatggaggtactgcccggacggtgtgtacccattgctaaaagagagcttctgtgggcaggatccgctggattagcctgctggttagccggggtcatatttatcgatcggaagaggacaggagacgccataagcgtcatgtctgaggtagcacagacccttttgactcaggatgtgcgggtgtgggtttttcctgaaggtacaaggaatcataacgggagtatgttgccattcaaaagaggagcttttcacctggctgttcaggcccaagtccctatcgtgccaatcgttatgagtagctatcaagacttctactgcaagaaggagcgacgcttcacgtcaggacaatgccaagtgcgggttctgccaccggttccaaccgaaggccttactcccgatgacgtacctgccctggccgatagagtgagacactccatgctcaccgtctttagggaaatcagtaccgatggtagggggggaggggattacctgaaaaaacccgggggaggcggatag

SEQ ID NO: 177224 - DNA, 852 bp, Artificial Sequence
  Description of Artificial Sequence: Synthetic coding sequence
atggacctgtggcccggcgcctggatgctgctgctgctgctgttcctcctgcttctattcctgttgccgacactgtggttctgctcaccgagtgcgaagtacttcttcaaaatggcattctataatggttggattctgttcttagcagtcctggccatccctgtgtgtgctgtgagagggagaaacgtcgaaaacatgaaaatcctgcgcctcatgcttctccatataaagtacttgtatggcattcgggtggaagttcgtggggctcatcatttccctccaagtcagccctatgtggtagtgagcaatcaccaatcatcactggatctgctaggaatgatggaagttctgcctggaagatgcgtccccatagcgaagagagagctgctctgggccggttcagcgggcttggcctgctggctggctggtgtgatctttattgacaggaaacgcactggtgacgcgatatctgtgatgtccgaggttgcccagacattgctgacccaggacgtacgggtttgggtgtttcccgagggcactcgcaatcacaatggctctatgctcccctttaaaaggggggcgtttcacttagcagtccaggcgcaagtgcccatcgtgcccatagtgatgagctcctaccaagacttttactgcaaaaaggagcggcgatttacaagtgggcagtgccaggtgagggtgttgcctccggtgccaaccgagggcttgaccccggatgatgtacccgctcttgctgatagggtgaggcacagcatgctgaccgtatttcgcgaaatctctacagacgggaggggcggaggagactacctgaagaaacctggcggaggaggatag

SEQ ID NO: 177225 - DNA, 852 bp, Artificial Sequence
  Description of Artificial Sequence: Synthetic coding sequence
atggacctgtggcccggcgcctggatgctgctgctgctgctgttcctcctcttactgtttctgttgcctaccttatggttctgcagtccgagtgctaaatatttcttcaagatggccttctataacgggtggatcttatttctggctgtgttggccatacctgtctgcgccgtacgcggacggaatgtggaaaatatgaagatactgcgccttatgcttctacacataaaatacttgtatggcattagagtggaggtcagaggtgcgcatcacttccccccaagtcagccctatgttgtggtctccaaccaccagtcctcattggacctgctcgggatgatggaagtgctgcctgggagatgtgtgcccattgcgaaacgggaactcctctgggctgggtctgctgggctggcatgctggctggctggcgtcatatttatcgatcgcaaaagaaccggtgacgcgatctcagttatgtctgaggtggcccaaacgctgcttactcaggacgttagggtatgggtgtttccagagggcacacggaatcataatggatcaatgctccccttcaagcgcggagcttttcacttagcagtgcaggcgcaggtacccattgtgcctatcgtgatgtcaagctaccaggatttctactgtaagaaggagcgccgtttcacatctgggcagtgtcaggttcgcgtgctgcctcctgtgcctaccgaaggcctgaccccagacgatgtccccgccctggccgacagggtgagacactccatgttgacggtgttcagagagatctctacagatgggaggggcggaggcgattacctgaagaagccaggaggtgggggttag

SEQ ID NO: 177226 - DNA, 852 bp, Artificial Sequence
  Description of Artificial Sequence: Synthetic coding sequence
atggacctgtggcccggcgcctggatgctgctgctgctgctgttccttttgctgctcttcctgctgccgaccttgtggttctgctctcccagtgctaagtacttcttcaaaatggccttttacaatgggtggattctattccttgccgttctggctatacccgtttgcgctgtgagggggaggaatgtcgagaacatgaagatcctgcgtctgatgctgcttcacattaaatatctctatggcatccgggtggaggtccggggcgcacatcacttccctccctctcaaccttacgtcgtcgtatcaaatcaccagtcctctttagacctgctgggcatgatggaggtgctgccaggccgctgtgtgcctatagctaagcgtgagctcctttgggcaggatctgccgggcttgcctgctggctggctggggtgatctttattgatagaaagcggactggagatgctatctctgttatgtctgaagtggctcagacgctcctgactcaggacgtgcgcgtttgggttttccctgaggggacccggaaccacaacggcagcatgctgcctttcaaaagaggggccttccatttagctgtgcaggcgcaggtgccgatcgtccccattgtgatgtcctcatatcaggacttttattgcaagaaagaacggaggttcaccagtgggcaatgccaggtgagagtcctgccgcctgtcccaacagaagggctgacacctgatgacgtcccagctctggcagaccgcgttcggcactctatgctcacggtgttccgcgagatttccaccgacgggcgcggtgggggggactaccttaagaagcctggggggggagggtag

SEQ ID NO: 177227 - DNA, 852 bp, Artificial Sequence
  Description of Artificial Sequence: Synthetic coding sequence
atggacctgtggcccggcgcctggatgctgctgctgctgctgttcctgcttctcctgtttctgttacccaccctctggttttgctcccctagcgctaagtattttttcaagatggcattttacaatgggtggattctgtttctggccgtgcttgcgattcccgtctgtgccgtgagggggagaaacgttgagaacatgaagattctgcgactgatgctgctacatataaagtatctgtatggaatcagagtcgaggtccggggagcccaccacttcccgccgtctcagccctatgtggtggtgtccaaccaccagagctccttggacttactcggaatgatggaagtgctccctggacgctgtgttccaatcgccaagagggagctgctgtgggcaggcagtgcaggcctcgcatgttggctagccggagtgattttcatcgatcgaaaaagaactggagatgccatttcagtcatgagcgaagtggcccagacacttctgacacaggacgttcgcgtgtgggtgtttccagaaggcactcgcaaccacaacgggagtatgctcccattcaaacgaggagccttccatttagctgtgcaggcccaagtaccaatcgttcctatcgtgatgtcatcctatcaggacttctactgcaagaaggagcggaggttcaccagcgggcagtgccaggtgcgcgtgctccccccagtcccaaccgaaggtctcactcccgatgatgtaccagcactcgcagacagagtgagacacagcatgcttaccgtcttcagagaaatttcgaccgatgggcgaggggggggcgattatctcaaaaagccggggggcggcgggtag

SEQ ID NO: 177228 - DNA, 852 bp, Artificial Sequence
  Description of Artificial Sequence: Synthetic coding sequence
atggacctgtggcccggcgcctggatgctgctgctgctgctgttcctgcttcttctgttcttgctgcctaccctatggttttgctctccatcagcgaagtatttcttcaagatggctttctacaacggttggatcctcttcttggccgtcttggccatccctgtctgcgcagtgcggggaaggaacgtggaaaacatgaagatattgaggttgatgcttttacatatcaaatatttgtacggaattcgggttgaagtgagaggtgcccatcacttccctccatctcagccttatgtggtcgtatcaaaccatcaaagtagccttgatttgctgggtatgatggaggtgctccctggcaggtgcgtcccgatcgcaaagcgagaactgttatgggccggcagcgcaggtttggcatgttggttagctggagtgatctttatagaccgtaagcgcaccggtgatgcgatctcagtaatgtccgaggtggcccagaccctgttgacacaggacgtgagagtgtgggtctttcccgagggaacaaggaatcataacggctccatgcttccgttcaaacgcggcgcgttccacctggcagtgcaggctcaggtgccaatcgtgcctattgtgatgtctagctatcaggacttttattgtaaaaaagaacgcaggttcacttccgggcagtgtcaggtccgcgtgttgcctcccgtgcccaccgagggcctgaccccggatgacgtgcctgccttggcagacagagtgagacacagcatgctcacagtcttccgggagatttctacggacggccgcggtggtggagattacctcaagaagcccggcggaggtggctag

SEQ ID NO: 177229 - DNA, 852 bp, Artificial Sequence
  Description of Artificial Sequence: Synthetic coding sequence
atggacctgtggcccggcgcctggatgctgctgctgctgctgttcctacttcttctgtttctgctcccaacgctgtggttctgcagcccaagcgccaagtatttttttaagatggctttttacaacgggtggatcctctttctggccgtgcttgctataccagtctgcgccgttagaggaagaaatgtggaaaacatgaaaattttaagactgatgctgctacacatcaagtacttgtacggaatccgcgttgaggtccggggggcccaccacttccctccaagtcagccatacgtggtcgtgagcaaccaccagtccagcctcgaccttttgggcatgatggaggttcttcccgggcggtgcgtccctattgccaaaagagagctgctgtgggcaggcagtgccggcctggcctgttggttggcaggcgttatctttattgatcggaaaaggacaggtgacgccatttcagtgatgtcagaagtagcacagacccttttaacccaggacgttagagtgtgggtatttcccgagggcaccagaaatcacaatggttccatgctccccttcaagcgaggcgctttccatcttgctgtacaggcccaggtgcctattgttcccatcgtcatgtcatcataccaggatttctactgtaagaaagaaaggcgcttcacctccggccagtgccaggtgagagtattgcctccagttcctacagaaggactcaccccagatgacgtacccgccctggccgatagagttagacattccatgctcacagtcttccgtgagatctcaaccgacgggcgaggtgggggagactatttaaagaagcctggaggagggggatag

SEQ ID NO: 177230 - DNA, 852 bp, Artificial Sequence
  Description of Artificial Sequence: Synthetic coding sequence
atggacctgtggcccggcgcctggatgctgctgctgctgctgttcttgctgttgctgtttttattgccgaccttatggttctgctccccgagtgccaagtacttcttcaaaatggccttctacaacggttggatcctttttttggccgtcctggccatcccagtatgcgcagtgcggggcaggaacgtggagaatatgaagattttgaggctaatgcttctccacatcaagtacttgtacgggattagagtcgaagttcgaggggcacatcactttccaccaagccaaccctacgtggttgtgtccaaccaccagagcagtctggatttgttgggcatgatggaagtgttgccaggccgttgtgtccccattgcaaagagagagctgttatgggccggctcagcggggctggcttgctggctggctggggtcatattcatagacaggaagcgaaccggagacgctatcagcgttatgtccgaagtggctcagacactgctaacacaggacgtacgtgtgtgggtgttccccgaagggacccgcaatcacaacggcagcatgctgcctttcaagcgaggcgctttccacttggccgtgcaagcccaggtgccaatcgtccctatcgtcatgagctcttaccaagatttttactgtaaaaaggaacgacggttcactagtggacagtgtcaggtgcgcgtcctgcctcctgttccgacggaaggcttaacgcctgacgacgtgcccgcgctcgcagaccgtgtacgacactcaatgcttaccgtgtttagggagatatccactgatggcaggggcggcggagattaccttaaaaagcctgggggcggcggctag

SEQ ID NO: 177231 - DNA, 852 bp, Artificial Sequence
  Description of Artificial Sequence: Synthetic coding sequence
atggacctgtggcccggcgcctggatgctgctgctgctgctgttcctgctgctgctctttctgctcccaacactatggttttgttcacccagcgccaaatacttttttaagatggctttttataacgggtggatcttgtttctcgccgttctcgccatccccgtgtgcgcagttcggggacggaatgttgaaaatatgaagatcctgagactgatgcttctgcatatcaagtatctgtacggaattcgagtggaagtgcgtggtgctcatcactttcccccatcgcaaccgtatgttgtggtatcaaatcaccagagctctctggatttgctgggcatgatggaagttctacctggccgatgcgtacccatcgccaagcgcgaattgctatgggcgggaagtgccggcctggcatgttggctcgctggcgtcatatttattgaccgaaaacggaccggagatgccatctcagtgatgtctgaggtggcacagacgctgctgacccaggacgttagagtgtgggtgtttcctgagggaacccgcaaccataatggttctatgctgcccttcaagagaggtgcctttcaccttgccgtgcaagcacaagtgcctattgtgccaattgttatgagtagttaccaggatttctactgtaagaaggagcggcggttcacctctggccagtgccaggtcagggtgttacccccagtgcctaccgaggggttaactccagacgatgtaccagccctggcagacagggtgcgacattccatgctcacagtattccgtgaaatttccaccgacggccgaggtggcggcgattatctgaagaagcccggtggcgggggatag

SEQ ID NO: 177232 - DNA, 852 bp, Artificial Sequence
  Description of Artificial Sequence: Synthetic coding sequence
atggacctgtggcccggcgcctggatgctgctgctgctgctgttcctgctgttattattcttgctcccaaccctgtggttttgcagcccatccgctaaatacttttttaagatggcgttctataacgggtggatcctgttccttgctgtgctggccatccccgtgtgcgctgtgaggggccgtaatgtagaaaatatgaagattctccggctcatgctgttgcacataaagtacctatacggcattcgcgtggaagtgcgcggagcccatcattttcctccctctcagccatatgtcgtagtttccaatcaccaatccagcttggacctgctggggatgatggaggtgctgcccgggcgctgcgtccccatcgccaaacgagaactgctgtgggccggcagcgccggcctggcatgttggctcgctggcgtcatttttatcgatcgcaagcgaactggcgacgcaatcagcgtcatgtccgaagtggcccagactcttcttacacaggacgtccgagtttgggtgtttccggaaggtacgcgaaatcacaacggttcaatgttgccctttaaacgcggtgctttccaccttgccgtgcaggcacaggtgcctattgtccctattgtcatgtcgtcttatcaggatttctattgtaaaaaagagaggcgattcaccagtggccaatgtcaggtgagggtgctacctcctgtacctactgaaggattgacacccgatgacgtgccggccctagccgacagagttcgtcattcaatgctgacagtgtttagggagattagcaccgacggcaggggtggcggggattatctgaagaaacctggcggcggaggttag

SEQ ID NO: 177233 - DNA, 852 bp, Artificial Sequence
  Description of Artificial Sequence: Synthetic coding sequence
atggacctgtggcccggcgcctggatgctgctgctgctgctgttcctgctcctgctcttcctgctgccgacactgtggttttgtagcccatcagccaagtatttcttcaagatggcattttataatggctggattctcttcctcgccgtactggcaatcccggtgtgtgctgtccggggacgcaatgtggagaacatgaaaatcttgaggctgatgttgctgcacatcaagtacctctacgggatcagagtcgaggtgcggggcgctcatcatttcccacccagccagccatacgttgtggtctccaatcaccagtctagcctggatctgttgggaatgatggaagtcctaccagggcggtgcgtccccattgccaaacgcgagctcctttgggccgggagtgccggcctggcctgctggctggccggtgtcatattcatcgaccggaaacggaccggggacgccattagcgttatgtctgaggtggcccagaccctgcttacacaggacgttagagtgtgggtcttcccagagggcacccgtaaccacaatggtagtatgctgccgtttaagaggggtgcttttcatcttgctgttcaagcacaagttcctattgtgcctattgtaatgtcttcttaccaagacttttattgtaagaaagaaaggcgctttacaagtggacagtgccaggttagggtgctgccaccagtccccacagagggcttgacacctgacgacgtgcccgcactcgcagatcgcgtccggcactccatgctgacagttttccgcgaaatttcaaccgatggcaggggtggcggcgactatctgaaaaagcccgggggaggcgggtag

SEQ ID NO: 177234 - DNA, 852 bp, Artificial Sequence
  Description of Artificial Sequence: Synthetic coding sequence
atggacctgtggcccggcgcctggatgctgctgctgctgctgttcttgctgttactttttctgctgccaaccctgtggttttgtagcccttctgcaaaatacttctttaagatggccttctacaacggctggattctcttcctggccgtcctggccatcccagtgtgtgccgtcagagggcggaacgtagagaatatgaaaatcttgcgtcttatgctgctccacattaaatacctatatgggatcagggtggaggtcagaggcgcccatcacttcccgccttcccagccttacgtggtcgtgtcaaatcaccaatcatccctcgatttgctcggcatgatggaggtactgccgggacgatgcgttcccatcgcaaaacgagagctattgtgggcaggctccgctggcttagcctgctggctcgccggagtgattttcattgataggaagcgcaccggggacgccatttccgtcatgagcgaggtcgcccagaccctgcttacccaggacgtgcgcgtgtgggtgttccctgaaggcacccgcaaccacaatggctccatgttgccatttaagaggggcgcattccaccttgcagtccaggcacaggtacccatagtgccaatcgttatgtcttcctaccaggacttttactgcaagaaagagcgcaggttcacatccggccagtgccaggtcagagtgctgcctccggtcccgaccgagggcctgacccccgacgacgtgccagcccttgccgatcgcgtgaggcattctatgctcaccgtatttagggagatttctactgacgggcggggagggggagactacctgaagaagcctggcgggggcggctag

SEQ ID NO: 177235 - DNA, 852 bp, Artificial Sequence
  Description of Artificial Sequence: Synthetic coding sequence
atggacctgtggcccggcgcctggatgctgctgctgctgctgttcttattactgctgttcctgttgcccactctgtggttctgtagcccctctgccaaatatttcttcaaaatggcattctacaacggctggatcctgttcctcgcagtacttgctattccagtatgcgccgtgcgcggtagaaacgtggagaacatgaagatcctgcgcctgatgttgctgcatataaaatatctctacggaattcgggtggaggtgcggggtgcacaccacttccccccatcccagccctacgtggtggtgagcaaccatcagtcatcactggacttgctcggcatgatggaggtgttaccgggtagatgcgttccaatagccaaacgggagctgttgtgggccggatccgctggcttggcctgttggctggccggcgtaatctttattgatagaaagcgcactggcgacgctatttctgtgatgagtgaggttgcccaaaccctactgactcaagatgtgcgggtttgggtgttccctgaaggcacacggaaccacaatggcagcatgctccccttcaagcggggagcattccatctggctgtccaggcacaggttccaatcgtgcccatagtaatgtctagctaccaggacttttattgtaagaaagaacgaagatttacgtcagggcagtgccaggtgcgggtgctccccccagtcccgacagaagggttgacaccagatgacgtgccagcactggcagatcgggtgaggcactccatgctgaccgtgttcagagaaattagcaccgatggcaggggaggtggagactatctgaaaaagcccggaggtgggggctag

SEQ ID NO: 177236 - DNA, 852 bp, Artificial Sequence
  Description of Artificial Sequence: Synthetic coding sequence
atggacctgtggcccggcgcctggatgctgctgctgctgctgttcctcctactgcttttcctcctcccgacactctggttttgctcacccagtgcaaaatatttcttcaagatggcattctacaacggatggattctgttcctggcagttttggccatccccgtctgtgcagtgcgtggcaggaacgttgaaaatatgaaaatactgcgccttatgttattgcacattaagtatttatatgggattagggtggaggtccggggagcacaccatttccctcccagccagccatatgtggtcgtgagtaaccatcagtctagccttgatttgttaggaatgatggaggtgctccctggccgctgtgtaccaatagcgaaaagggagctcctttgggctggcagtgctgggctggcctgctggttagctggggtgatcttcattgacaggaagaggactggtgacgctattagcgttatgagtgaggtggcacagacactcctgacacaggacgtcagagtgtgggtgttccccgagggcaccagaaatcacaatggatccatgctgcccttcaaaaggggggccttccacctcgccgtgcaggcccaagtgccaatcgtcccgattgttatgagcagctatcaggatttctactgcaaaaaagagaggaggttcaccagcggtcagtgccaggttcgcgtgctaccacctgtgcctacggaaggacttacgcccgatgacgtgccagccctggccgacagggttcgccattcgatgttgacagtattcagagaaatctccaccgatggccgcggaggtggggattacctgaaaaagccggggggcggtggctag

SEQ ID NO: 177237 - DNA, 852 bp, Artificial Sequence
  Description of Artificial Sequence: Synthetic coding sequence
atggacctgtggcccggcgcctggatgctgctgctgctgctgttcctgctcctactcttcctgctgccaaccctctggttttgcagtccaagtgctaaatatttcttcaagatggctttttataatggatggatcttgtttctcgcagtcctagccatccctgtgtgcgcggtacgtggaaggaacgtggaaaacatgaaaatcctcagattgatgctgctgcatatcaaatatttatacgggatcagagtggaggtccgtggcgcacatcacttcccacccagtcagccgtacgtagtggtatccaaccaccaatcatcgttagacttgctcggaatgatggaagtgctccctggcagatgcgtgccaatcgctaaaagagagctgctttgggctggctccgctgggctggcttgttggctggccggagtcatctttatcgatcggaaacgcaccggagacgccattagtgtaatgtcagaggtagcacagaccctgctcacacaggatgtccgagtctgggtattccccgaaggcaccaggaatcacaacggatcaatgctccccttcaagcgcggagcgtttcacctggccgttcaggctcaggtgcctatagtgccaatcgtgatgtccagctatcaggatttttattgcaaaaaggaacgcagatttacatccggtcaatgtcaggtgagggtgttgccaccagttcctactgaaggcttgacacctgatgatgtgcccgccctagccgatagagttaggcatagtatgctgacagtattcagggaaatttctacagatggaaggggaggcggtgactaccttaagaaaccaggcgggggaggctag

SEQ ID NO: 177238 - DNA, 852 bp, Artificial Sequence
  Description of Artificial Sequence: Synthetic coding sequence
atggacctgtggcccggcgcctggatgctgctgctgctgctgttcctgcttctcctgtttcttctgcccacgctttggttctgctctccttcagcaaaatatttttttaagatggctttttataacggatggatccttttcctggcagtcctcgcgattcccgtgtgtgcagtgcggggaagaaatgtggagaacatgaaaatactccgcctcatgctgctacatatcaagtacctgtacggcatccgtgtcgaggtccggggagcccatcactttcccccttcgcagccgtatgtggtagtctctaaccatcaatctagcctcgatcttcttggaatgatggaggtgctgcctgggagatgtgttcctatagctaagagggagctgttgtgggccggatctgctggactcgcgtgttggttggccggagtcatttttattgatcggaaacgcactggtgacgccattagcgtgatgtcagaagttgcccagacattgctgactcaggacgtgcgggtgtgggtgttccctgagggtactcgcaaccataatggaagcatgctgccgttcaaaagaggtgcatttcacttagctgttcaggcccaagtgcctatagtacccatcgtcatgtctagctaccaggatttttattgtaaaaaagagcgccggttcacttccggccagtgccaggtccgggttctaccccccgtcccgactgaaggactgacccctgacgacgtacctgcacttgcagatcgagtcaggcactctatgctgaccgtgttccgggagattagtaccgatggccgcggcggcggcgactatctgaagaagcctggcggtggcggctag

SEQ ID NO: 177239 - DNA, 852 bp, Artificial Sequence
  Description of Artificial Sequence: Synthetic coding sequence
atggacctgtggcccggcgcctggatgctgctgctgctgctgttcctgttactgctctttctcctgccaacactgtggttttgttcaccctccgcaaagtattttttcaagatggctttttataatgggtggattttgtttcttgccgtgttggcaatccccgtatgcgcggtgagaggcaggaatgttgagaacatgaagatcctgcgactaatgctgctgcacatcaagtacttgtatggcattagagttgaagtacgcggtgcccaccactttccaccttcccaaccatacgttgtcgtatctaaccatcagtcatctctagacctgcttggaatgatggaagtgctcccaggaagatgcgtgcccatagctaaaagggaattactgtgggccggctcagccggtcttgcatgttggctagctggcgtgatttttattgaccggaaacgcacaggcgacgccatttcagtgatgtcagaggtggctcaaacactgctgacacaggacgtccgtgtttgggttttccccgaggggacccggaatcacaacggatcaatgctgcccttcaaaaggggcgctttccatctcgctgtacaggcccaagtcccaatagtgccaattgtcatgagttcttatcaggacttctattgtaaaaaggagcggcggtttacttccggccagtgccaagtgcgcgtgttgccacccgtgcctactgagggccttactcccgacgacgtccctgctctcgcggacagggttagacacagtatgttgacggttttccgagagatatctactgatgggcggggcgggggtgactacctgaagaaacctggcggtgggggttag

SEQ ID NO: 177240 - DNA, 852 bp, Artificial Sequence
  Description of Artificial Sequence: Synthetic coding sequence
atggacctgtggcccggcgcctggatgctgctgctgctgctgttcttattgcttctgtttctgctgcccactctgtggttctgctcgccatccgctaagtatttcttcaagatggccttctataacgggtggatattattcctcgcagttcttgccatacctgtctgtgctgtgcggggaagaaacgtggagaatatgaagattcttcgccttatgctgctccacatcaaatacctgtacggcattagagtagaggtcaggggggcccatcattttcctccaagccagccatatgttgtggtatcgaatcaccagagcagtctagatctgttgggtatgatggaagttttaccaggccggtgcgtccctatcgcgaagcgggagctgctttgggccggatctgctggactggcgtgttggctggctggagtaatctttatagaccgcaaaaggaccggggacgcaattagcgtgatgagcgaggttgcccagacactgctcacgcaggatgtccgtgtgtgggttttccccgagggcaccaggaatcataacgggtccatgttgccgtttaaacggggagcctttcatctcgctgtgcaggctcaagtgcccattgtgcccattgtcatgtctagctatcaggacttctattgcaagaaggagcggagatttacctctggacagtgccaggtgcgggtgttgcctcccgtgcccactgagggccttacccctgacgacgtccccgcccttgcagacagggtgagacactccatgttgaccgtgttccgcgaaatcagcacggacggacggggaggcggcgactatctgaaaaaaccaggagggggcgggtag

SEQ ID NO: 177241 - DNA, 852 bp, Artificial Sequence
  Description of Artificial Sequence: Synthetic coding sequence
atggacctgtggcccggcgcctggatgctgctgctgctgctgttcctattgttgttgtttttgttgcccaccctgtggttttgtagtccgagcgctaaatatttcttcaaaatggctttttataacgggtggatcctttttctggccgtacttgcaattcccgtttgcgccgtcagaggccggaatgtcgagaatatgaaaatcctccgtctgatgttgcttcatattaaatacttgtacggaatacgcgttgaggtgaggggagcacaccactttccacccagccaaccgtatgtcgtagtgtccaatcatcaaagctcactggatctgctggggatgatggaagtgcttccagggcgttgcgtgcccattgctaaacgggaattgctctgggccggtagcgctggtctcgcgtgttggctagctggggtgattttcatcgacaggaagcgaaccggcgatgccatctctgtgatgtccgaggtcgcgcaaacgctactgacgcaggatgtacgcgtctgggtctttcccgaggggactagaaaccacaacggatctatgcttcctttcaagcgcggcgccttccatctggcagtgcaggcccaggtcccaatcgtccccatcgtgatgagtagttaccaagacttctactgcaagaaggaacgacggtttacgtctggccaatgccaggtgagggttttgccacccgttccgaccgaggggttgactcctgacgacgttcctgccctcgctgaccgggtgaggcactctatgctgaccgtgtttcgggagatttctacggacggtaggggtggcggggactatctaaaaaagccaggaggaggtggttag

SEQ ID NO: 177242 - DNA, 852 bp, Artificial Sequence
  Description of Artificial Sequence: Synthetic coding sequence
atggacctgtggcccggcgcctggatgctgctgctgctgctgttcctacttctgctttttcttttgccaactctgtggttttgctcccccagcgctaaatacttttttaagatggctttctacaatgggtggatactgttcttggccgtgctagctattccagtctgcgctgtaaggggcaggaacgtcgaaaacatgaagatattacgtctcatgttgctgcacatcaaatatctttacggtatcagagtcgaggtgcgcggtgctcaccatttcccccctagtcagccgtacgtcgtcgttagtaaccaccaatcctcgttagacctgttggggatgatggaagttctgcctgggcgctgtgtccctatagccaaacgcgaactgttgtgggccggatcagccggcctcgcctgctggcttgccggcgtcattttcatcgatcggaaacggacaggcgacgcgatttcggtgatgtctgaagtcgcccaaacgctgctgactcaggatgtgcgcgtgtgggtatttccagaaggcacacggaatcacaatggcagcatgcttcccttcaagagaggcgcctttcacctggcggtccaagctcaagtgcccattgtgcccatcgtgatgtcctcataccaggatttctattgtaagaaagagcgaaggttcacatccggccagtgtcaggtgcgcgttttgccaccggtaccgacggagggccttactccagacgacgtgcccgccctagctgatcgggtaagacacagcatgctgacggtctttcgggagatctccacagatggcagaggcggcggtgactacctcaagaagcccggagggggaggctag

SEQ ID NO: 177243 - DNA, 276 bp, Artificial Sequence
  Description of Artificial Sequence: Synthetic coding sequence
cacagcgccagcacccccatcctgacccacagccaccccgcccagggcatgatggaggtccttcctggccgatgcgtcccgatcgccaaaagagagcttctttgggccgggtcagccggattggcctgctggcttgctggggtcattttcatagaccggaagcgcaccggggatgcaatctccgtgatgtccgaagtagcccagaccctgcttacccaagacgtttctcatccggggcttctgcttcaggagggagctagtctccacctcggatag

SEQ ID NO: 177244 - DNA, 276 bp, Artificial Sequence
  Description of Artificial Sequence: Synthetic coding sequence
cacagcgccagcacccccatcctgacccacagccaccccgcccaggggatgatggaggtcttgccagggcggtgtgtgccaatcgcaaaaagagagctcctgtgggcgggctctgctggtcttgcttgttggctggctggcgtaatattcatcgacagaaagaggactggtgacgcgatctccgtaatgagcgaagtggctcaaaccctacttacacaggatgtttcccatcctggcttgttgcttcaggaaggggcatcattacatttgggctag

SEQ ID NO: 177245 - DNA, 276 bp, Artificial Sequence
  Description of Artificial Sequence: Synthetic coding sequence
cacagcgccagcacccccatcctgacccacagccaccccgcccagggtatgatggaggtcctgccaggacgatgtgttcccatcgccaaaagggagctgctttgggctgggagtgctggcttagcctgctggctagctggtgtcatcttcatcgataggaagcggacgggggatgccatctccgtgatgagtgaagtggcccaaacgcttttaacccaggacgtcagtcatcccggcctgctcctacaggagggggcatcactccatttaggttag

SEQ ID NO: 177246 - DNA, 516 bp, Artificial Sequence
  Description of Artificial Sequence: Synthetic coding sequence
atgatggaggtgctgcccggccggtgcgtgcccatcgccaagcgggagctcctgtgggcaggttcagccgggttggcctgctggcttgcgggtgttatcttcattgaccgtaaacggacgggagacgccatatctgttatgtcagaggtggcacaaacactcctgactcaggacgtgcgagtgtgggtttttcctgaaggaacgcgcaaccacaacgggtctatgctgccattcaaacgcggcgcttttcacctcgctgttcaagctcaggtcccaatcgtgcccatcgtaatgagctcctatcaggatttttattgcaagaaggaacgaaggttcacttctggacagtgtcaagtacgggtcctgccgcctgtccccaccgagggcctgacacctgacgatgtcccagccctggccgacagggtccgccactccatgctcacagtgttccgagaaatttcaacagacggccgaggtggaggagactatctaaagaagccagggggaggcggatag

SEQ ID NO: 177247 - DNA, 516 bp, Artificial Sequence
  Description of Artificial Sequence: Synthetic coding sequence
atgatggaggtgctgcccggccggtgcgtgcccatcgccaagcgggaacttttatgggccgggagcgccggactcgcctgttggcttgcaggggtcatttttatcgatcggaagcgcacaggagacgccatatccgtcatgtccgaggtggcccagactctactcactcaggatgtgagagtttgggtattccccgagggcacacggaaccacaatggctctatgcttccgttcaagcgtggcgcctttcacttggcagttcaggctcaggtcccgatcgttcctattgtcatgtctagctatcaggacttttattgcaaaaaagagcggcgatttacgtccggacagtgtcaggtgagggtgcttccccctgtcccgaccgagggcttgaccccggatgacgtcccagctctcgcggatcgtgtgaggcacagcatgctgacggtgttccgcgagatctctaccgacgggagaggtgggggcgattacctgaaaaagcccgggggggggggctag

SEQ ID NO: 177248 - DNA, 276 bp, Artificial Sequence
  Description of Artificial Sequence: Synthetic coding sequence
cacagcgccagcacccccatcctgacccacagccaccccgcccagggaatgatggaggtgctgcctggccgatgcgtcccaatagcaaaaagagagctactgtgggctggaagcgcagggctcgcatgctggctggcaggggtgatctttatagacaggaaaaggactggtgacgccatatccgttatgtcagaagttgcgcaaacactgttaacacaggatgtttcccacccggggctacttctccaggagggagccagcttacacctggggtag

SEQ ID NO: 177249 - DNA, 276 bp, Artificial Sequence
  Description of Artificial Sequence: Synthetic coding sequence
cacagcgccagcacccccatcctgacccacagccaccccgcccaggggatgatggaggttctgccaggcaggtgtgtgccgatcgccaagcgcgaactgctgtgggccggcagtgcagggctggcctgttggctcgctggagtgattttcattgacaggaagcggaccggggacgccatcagtgtcatgagcgaggttgcccagaccttgctgacccaggatgtcagtcatcctggtctcctactgcaggaaggagcctccctgcatctgggctag

SEQ ID NO: 177250 - DNA, 276 bp, Artificial Sequence
  Description of Artificial Sequence: Synthetic coding sequence
cacagcgccagcacccccatcctgacccacagccaccccgcccagggtatgatggaagtgcttccaggaagatgtgtgcctattgcaaagagggaactactttgggccggcagcgcggggttggcatgctggttagccggggtgatctttatcgacaggaaacggacaggagacgccatatcggtcatgtccgaggttgcacagactctcctgacccaggatgtcagccatcccggcctcctcctccaggagggtgcaagtctccacctgggatag

SEQ ID NO: 177251 - DNA, 516 bp, Artificial Sequence
  Description of Artificial Sequence: Synthetic coding sequence
atgatggaggtgctgcccggccggtgcgtgcccatcgccaagcgggaattactttgggctgggagtgcaggcctggcatgctggctcgccggggttattttcattgacaggaagcgaactggcgacgcaatatccgtgatgtcggaagtggcacagactctattgactcaggacgttagagtttgggtgtttcctgagggcacacgcaatcacaatgggagcatgttacctttcaagcggggcgcttttcatctggccgtccaagcccaggtgcctattgttccgattgtgatgtcatcttaccaagatttctattgtaagaaggagagacggttcacttcaggacagtgccaagtgagggtgcttccacctgtacccaccgagggcctgactccagatgacgtgcctgctcttgccgatcgcgttaggcactcgatgcttacggtgttccgcgagatctccacggatggccggggcgggggtgactacctgaagaaacccggtggtgggggctag

SEQ ID NO: 177252 - DNA, 516 bp, Artificial Sequence
  Description of Artificial Sequence: Synthetic coding sequence
atgatggaggtgctgcccggccggtgcgtgcccatcgccaagcgggaattgctgtgggccgggagcgcgggtctcgcctgctggttggccggagtgatattcatcgatcggaaaagaacgggtgacgccatctccgtgatgagtgaagtggctcagacattacttacacaggatgttcgtgtatgggtgttccccgagggaacccggaatcataacggctccatgctccccttcaaacgcggagcctttcacctggccgtgcaagctcaggtccccattgttccaatagtgatgtcatcttatcaggacttctactgcaaaaaagagaggcgcttcacttccggacaatgtcaggtgcgggtactgccgcctgtgcccaccgaagggctgaccccagacgacgtaccggcccttgcagaccgggtacgccattccatgttaactgttttccgcgagatcagcaccgacgggcgcggcggaggagattatctcaagaagcctggcgggggggggtag

SEQ ID NO: 177253 - DNA, 276 bp, Artificial Sequence
  Description of Artificial Sequence: Synthetic coding sequence
cacagcgccagcacccccatcctgacccacagccaccccgcccaggggatgatggaggtcctccctggacggtgcgtcccgatcgctaagagggagctactctgggctggctcggccggccttgcctgctggctcgctggagtgatttttatcgaccggaaaagaacgggcgacgcaatttcagtgatgagcgaggtggctcaaaccctgttaacccaggatgtcagccacccaggactgctgttacaggagggggcctccttgcacctggggtag

SEQ ID NO: 177254 - DNA, 516 bp, Artificial Sequence
  Description of Artificial Sequence: Synthetic coding sequence
atgatggaggtgctgcccggccggtgcgtgcccatcgccaagcgggagctgctgtgggcaggaagcgcaggcctagcctgctggttggcgggcgtgatttttatcgatcggaaacgcacgggcgacgcaatttctgttatgtccgaagtggctcagactctcctaacccaggatgtccgtgtgtgggtgttccccgaaggaacccgcaaccataacggctccatgctgcccttcaaacggggcgcctttcatcttgcagtccaagcccaggtacccattgttccaattgtgatgtcatcataccaagacttttattgtaaaaaagagcgccgcttcacatctggccagtgccaggttcgcgtccttcctccagtacctactgaaggactgactcccgacgatgtgcccgccctggccgatcgcgtcaggcactcaatgttgacggtcttccgcgagatatcaaccgacggaagggggggcggcgattaccttaaaaagccaggtggagggggatag

SEQ ID NO: 177255 - DNA, 516 bp, Artificial Sequence
  Description of Artificial Sequence: Synthetic coding sequence
atgatggaggtgctgcccggccggtgcgtgcccatcgccaagcgggagttgctgtgggccggatccgcaggtttagcttgctggctggcaggggtgattttcattgatcgcaaacgcaccggggacgcaatctccgtgatgtccgaggttgcccagactcttctcacccaggatgtgagggtctgggtgttcccagagggaacccgcaatcataatggtagcatgttgccatttaagaggggcgccttccacctggccgtgcaggcacaggtcccaatcgtcccgatagtaatgtcaagttaccaggatttctactgcaaaaaggagcgacgttttacttccgggcaatgccaagttagggttctccccccggtccccaccgagggcctgacccctgacgacgttcccgctctggcggaccgggtgaggcactccatgttgaccgtctttcgggaaatcagtaccgacggccgcggcggcggggactatctgaaaaaacctggtggtggagggtag

SEQ ID NO: 177256 - DNA, 741 bp, Artificial Sequence
  Description of Artificial Sequence: Synthetic coding sequence
atggagctgtggccctgcctggccgccgccctgctgctgctgctgctgttggtgcagttgagcagggctgccgagttctacgctaaagtggccctctactgcgcactctgtttcactgtttcagcagtggccagcttagtatgcctcctgcggcacggggggcgaaccgtggaaaatatgagcatcatagggtggtttgttcggtcctttaagtacttttacgggctgcgctttgaagtgagagatcccaggaggctgcaggaagcccgaccttgcgtgatagtctctaaccaccagtctatcctcgacatgatgggcttaatggaggtgctccccgagcggtgtgtgcagatcgcaaaacgcgaacttttattcctgggccctgtcggcctcattatgtaccttggaggcgtttttttcatcaacagacaacggtccagtactgctatgactgtaatggccgatctcggggaacggatggtaagagagaacgtgcctatcgttcccgtagtctactccagcttcagtagcttctacaacacgaaaaagaagttctttaccagtggtaccgtgacagtgcaggtcttagaagccattcccacctccgggctgactgccgctgacgtgcctgcactggttgatacatgccatagggccatgcgtactacgtttctgcatatctcaaaaacgccgcaggaaaatggagcaacagccggctcgggcgttcagcccgcccagtag

SEQ ID NO: 177257 - DNA, 837 bp, Artificial Sequence
  Description of Artificial Sequence: Synthetic coding sequence
atggagctgtggccctgcctggccgccgccctgctgctgctgctgttattggtgcagttaagcagagccgccgaattctacgccaaggttgccttgtattgtgcgctgtgcttcactgtttctgcagtggccagtctggtctgcctgctgcgtcatgggggcagaaccgtagagaatatgagtatcataggctggtttgtgaggtcctttaaatatttttacgggttacgtttcgaggttcgcgacccacggcggctgcaagaagctcggccatgcgttatcgtgagcaatcatcagagcattctggacatgatgggcctgatggaggtgctgccagagaggtgtgtgcaaattgccaaacgcgaacttctgttcctgggacctgtcgggttgatcatgtacctgggcggtgtattttttattaacagacagagatcttctacagccatgacagtgatggccgacttgggtgaacggatggtcagagaaaacctaaaagtctggatttacccagaaggaactcgaaacgacaatggagatctgcttccctttaaaaaaggcgccttttacttggccgtgcaggcacaggtgcctatcgttcccgtggtctacagctcattttcaagcttctacaacacaaaaaagaaatttttcacatctgggaccgtgactgtgcaggttctcgaggctataccgaccagcggtctgactgcagcagacgttcctgccctcgtcgatacatgtcatcgcgccatgcgcaccaccttcctgcacatctccaaaacgcctcaagaaaatggcgctacagccgggagtggtgtgcaacccgctcaatag

SEQ ID NO: 177258 - DNA, 837 bp, Artificial Sequence
  Description of Artificial Sequence: Synthetic coding sequence
atggagctgtggccctgcctggccgccgccctgctgctgctgctgcttctggtccagctgtcaagggccgcggagttctacgccaaggtcgccctttattgcgccctttgtttcacggtcagcgcggtggcttccctcgtgtgtctgctgaggcatggcggacggaccgtggagaatatgagcatcatcggatggtttgtgcggagtttcaagtatttctacgggttacggtttgaggtgcgcgatccgaggcgtttgcaggaagcccggccttgtgtcattgtgtccaaccatcagtctattctggatatgatgggactgatggaggtgctgccagaaaggtgcgtgcaaatagccaagagggaattgctgtttttgggccctgtgggtctcataatgtatcttgggggcgtatttttcatcaacagacagaggtctagtacagctatgacagtcatggccgacttaggggagaggatggttcgcgagaacctgaaggtttggatctatccagaggggacaaggaacgacaatggagaccttcttcccttcaagaagggggccttctacctggcagtgcaggcccaggttcccatcgtccctgtggtctactctagtttttccagtttttacaacaccaagaagaagttcttcacctctggtaccgttacggtgcaggtgctggaggccatccctaccagcgggcttactgctgccgatgtccctgctcttgtcgatacttgccacagggccatgagaacaacattccttcacataagcaagactccacaggagaacggcgcaactgcaggttctggtgtccagccggcacagtag

SEQ ID NO: 177259 - DNA, 1371 bp, Artificial Sequence
  Description of Artificial Sequence: Synthetic coding sequence
atgttcctgctgctgcccttcgacagcctgatcgtgaacctgctgggaatctccttgactgtcttgtttacactgctgctggtgtttataatcgtcccggccatattcggagtgagtttcggcattagaaagctctacatgaaaagcctgctaaagatttttgcatgggccacccttagaatggaaaggggggctaaggagaaaaatcaccagctgtacaaaccatataccaatggcattatcgccaaagaccccaccagcttggaagaagagatcaaagaaattagacgcagcgggagctccaaggcgctggataacaccccagagtttgaactctcagatatattttacttctgccggaaaggcatggagaccattatggacgatgaggttactaagcggttttcggctgaggagttggaatcatggaatctgctttccaggacgaattataattttcaatatattagcctgagactgacagtcctatggggactgggggtcttaattcgctattgctttctactgcccctgaggattgcattggcgtttacaggcatctcattactggttgtaggaacgactgtggttgggtatttgcccaacgggcgctttaaagagttcatgtccaagcatgtgcacttgatgtgttatcgcatttgcgtgagagctttaacagcaatcatcacttaccatgacagagaaaacagaccacgtaacgggggtatttgcgtcgcgaatcacacaagtcctatcgacgtcattatactcgccagcgatggttactatgctatggtggggcaggttcacggtgggctcatgggtgtgatccagcgagcaatggttaaggcctgccctcacgtgtggtttgaaaggagcgaggtaaaggacagacacctcgtggccaaacgcctgaccgaacatgttcaggataaaagcaagctgcccatcctgatttttccagagggtacctgcatcaacaacacatccgtaatgatgttcaaaaagggtagtttcgagatcggcgccacagtttatccggttgccatcaagtatgatccacagtttggagacgcattttggaactcctctaagtatggtatggtgacatatcttctccgaatgatgacaagctgggccatagtgtgctcagtgtggtacttgccaccaatgacaagggaggccgacgaagacgctgtgcaatttgccaatcgcgtgaaaagcgcaatagctcgacaaggcggcctcgttgatttgttatgggatgggggtctgaagagagaaaaggtaaaggataccttcaaagaggaacagcagaagctgtacagtaagatgatcgtaggaaaccacaaggataggtctcgttcgtag

SEQ ID NO: 177260 - DNA, 1305 bp, Artificial Sequence
  Description of Artificial Sequence: Synthetic coding sequence
atggagggcgccgagctggccggcaagatcctgagcacctggctgacgctcgttctcggatttattctgctgccttccgtctttggagtgagtttaggcataagcgaaatctacatgaagatactcgtaaaaaccctggagtgggcaactattaggatcgaaaaaggcacgcctaaggagagcattttaaagaacagcgctagcgtgggaattattcagagggatgaatcaccaatggaaaaagggctgtccggactaaggggacgtgacttcgaattgagcgatgtcttttacttttcaaaaaagggactcgaggctatagtggaagacgaagtaacgcagaggttcagctccgaagagctggttagctggaatctgctgactcgtaccaatgttaatttccagtacatctccctgcggctcacaatggtgtgggtgttaggtgtgatagttcgatactgtgtactgctgccactgagggtcactctggcgttcatcggcattagcctgctggtgattggtactacactcgttggccaactccccgacagctctctgaagaattggttgtccgagctcgtgcatctcacctgttgcagaatctgcgtgagagctctgtccggaactatccattaccataacaagcagtaccgcccacaaaaaggaggcatctgtgtggcgaaccacactagtccaattgacgtcctcattcttaccacagatgggtgttacgcaatggtgggacaggttcatggtggcttaatgggtataattcagagggctatggtgaaggcttgcccacatgtgtggttcgaaagaagcgagatgaaagatcgacatctggtaacaaagagactgaaggagcacatagctgataagaagaaactgcctattctgattttccctgaggggacttgtattaataatacatctgttatgatgtttaagaaagggtcgtttgagatcgggggcacaatacaccccgtggcaattaagtacaatcctcaatttggcgacgcattctggaattcttcgaagtataatatggtctcgtacctgctccgcatgatgacaagttgggccatagtttgcgacgtgtggtacatgccacctatgacgagggaggagggggaagacgcagtgcagtttgcaaacagagtaaaatctgccattgccatacagggaggcctgactgaactgccctgggacggcggcttgaaacgtgccaaggtaaaggatatcttcaaggaggagcagcagaaaaactactctaaaatgatagttgggaatggatcactgagctag

SEQ ID NO: 177261 - DNA, 1305 bp, Artificial Sequence
  Description of Artificial Sequence: Synthetic coding sequence
atggagggcgccgagctggccggcaagatcctgagcacctggctgacgctcgtcctgggattcattctgctacccagtgtgttcggtgtatccttggggattagtgaaatctatatgaagatcctcgtgaagaccctcgagtgggccactattagaattgagaagggcacccctaaggagtccattctaaagaatagcgctagcgtcggaatcatccagcgcgatgaatcacccatggagaaaggcctgagtggattacgaggaagagattttgaactgtcagatgtgttttacttctcaaagaaaggtctggaagccatcgtggaggacgaggtcacccaaagattctcatctgaagaacttgtctcctggaatttgctcacccggacgaatgttaactttcaatatatttcattacgactgaccatggtttgggtccttggcgtaatcgtcaggtactgtgtcctgctgcccctccgggttacactggccttcattggaatcagcctgctcgtgattggtaccacacttgtggggcagcttccagactcgtcgctgaagaattggttatcagagctcgtccatctgacatgttgccggatctgtgtccgggctctgtccgggaccatccattatcataataaacagtacagaccccagaagggaggcatctgcgtcgcgaatcacacttcccccatcgatgtcctgatcttgaccacggacgggtgctacgctatggttgggcaggtccacggcggccttatgggtattatacagagagccatggtgaaagcgtgtccacatgtgtggttcgagcgcagcgagatgaaagatcgacatctggtgacaaaaaggttaaaggagcatatagccgataaaaagaaactccccatattaatatttcctgaaggaacttgcattaacaatacctctgtgatgatgttcaaaaaggggtcgtttgagattggcggaacaatacatcctgttgccatcaaatacaacccccagtttggagatgccttctggaatagtagtaagtacaacatggtgtcttacttacttagaatgatgacttcatgggccatcgtgtgtgatgtctggtacatgcctcctatgacccgcgaggagggcgaggacgctgtacagttcgctaacagggtcaaatccgccatcgcaatccaaggcggtctgacagagttaccatgggacggcgggttgaagagggcaaaggtgaaggacatctttaaggaagaacaacagaagaactatagcaagatgattgtcggcaacggttccctgtcatag

SEQ ID NO: 177262 - DNA, 1506 bp, Artificial Sequence
  Description of Artificial Sequence: Synthetic coding sequence
atgttcaccctgccccagaaggacttccgggcccccaccacctgccttggaccaacctgtatgcaagacttagggtcctctcacggggaggatttggagggagagtgttcgcggaagctggatcaaaagttgcccgagttgaggggggtgggagaccctgcaatgatatcgtccgacactagctacttatcatcaaggggaagaatgatcaagtggttttgggattcagccgaggagggctatagaacataccacatggatgagtacgatgaggataagaacccatctgggattatcaatcttggtacaagtgaaaacaaactgtgctttgacttactgtcttggcggctgtcccagagggacatgcagcgagtggaacctagcctgcttcagtacgcagattggagggggcatctgttcctgagggaggaagttgcgaagttcctttcattctattgcaaaagccccgtacccctacgacccgagaacgtggtggtcctaaatggcggggcgtcactgttctctgccctggcgacagtgctgtgtgaggccggcgaagcatttctgatcccgaccccctactacggagctataacccagcatgtgtgtctctacggcaatataagactggcatatgtgtatctcgacagcgaggtgacagggcttgatacaaggccatttcagcttacagttgagaagctagagatggcgcttcgcgaggctcacagtgagggcgtgaaggttaagggcttaatattaattagcccccagaaccccttgggggacgtgtactctcctgaggagcttcaggagtatttagtgttcgcgaagaggcaccgtctacacgtgatcgttgacgaggtttatatgcttagtgtgtttgaaaaatcagttgggtataggtccgtgctcagcttggagcgcctcccagacccccaacgaacacatgtgatgtgggccaccagcaaagatttcgggatgagcggtttacggtttgggaccctctacacagagaatcaggacgttgccactgcggtcgccagcttatgcagataccacggtctgagcgggctggtgcagtatcagatggcacagctgcttcgggacagggactggattaatcaggtatatctacctgaaaatcacgcccgcttgaaagctgcccacacgtacgtgtctgaggagctgcgagcgcttggcattcctttcctcagccgaggcgccggattttttatatgggtagacctgcgcaagtacctgcctaagggcacctttgaagaggagatgttgctgtggagaagatttctggataataaagtattactgtcctttggcaaggcattcgagtgtaaagagcctggatggttcaggttcgttttttctgatcaggtgcaccgactatgtctcggaatgcagcgcgtccaacaggtcctggccggcaaaagccaggtggcagaggaccctcggccctctcagagccaggagcctagcgatcagaggcgttag

SEQ ID NO: 177263 - DNA, 477 bp, Artificial Sequence
  Description of Artificial Sequence: Synthetic coding sequence
atgttcaccctgccccagaaggacttccgggcccccaccacctgcctcggacccacatgcatgcaagacctggggtcatcacacggcgaggacctcgaaggtgagtgctctcgcaagctggatcagaaattgcctgagctgaggggcgtgggagatcctgccatgatatcctcggatacatcgtatctctcctctcggggtcggatgatcaaatggttctgggactccgccgaagaaggctatcggacttatcatatggacgagtacgatgaagataagaaccccagcggaatcataaacctagggacttctgagaacaagctgtgtttcgatctgctgtcttggcgccccccgggcggaagcggccaggtgcccgttttcctgttacaagagccttccaccccccagactagagagtgcggatgccccgagtggtggtgtctagcactgttgtgttccggacatggcgccgtgtag

SEQ ID NO: 177264 - DNA, 420 bp, Artificial Sequence
  Description of Artificial Sequence: Synthetic coding sequence
atgttcaccctgccccagaaggacttccgggcccccaccacctgcttggggcccacttgcatgcaggacttagggtcttcccatggtgaagatttggaaggggagtgctcacgtaaactggatcagaaactgcccgaactgcgaggggtgggagatcccgccatgatttcatccgacacatcctacctgagttctcgcggtagaatgattaagtggttctgggattctgcggaggagggctaccgcacatatcacatggacgaatacgatgaggacaaaaacccttcaggaattataaatttggggacatccgaaaacaagctctgcttcgatctgctttcctggcggttaagccagagagatatgcagcgcgtggagccctctttactccagtacgccgactggcggggacacctgtag

SEQ ID NO: 177265 - DNA, 234 bp, Artificial Sequence
  Description of Artificial Sequence: Synthetic coding sequence
atgttcaccctgccccagaaggacttccgggcccccaccacctgcctgggaccaacctgtatgcaagatctcggcagcagccacggggaggatctcgaaggtgaatgcagtaggaaactggaccagaaactgcccgagctcagaggggtgggtgaccccgcaatgatcagttcagacacctcatacctgagttcccggggacgcatgatcaaatggttctgggactcggcatag

SEQ ID NO: 177266 - DNA, 780 bp, Artificial Sequence
  Description of Artificial Sequence: Synthetic coding sequence
atgagcaagtacaagctgatcatgctgcggcacggcgagggcgcctggaataaggagaaccggttctgctcttgggtagatcagaagcttaactctgagggaatggaagaagccaggaattgtggtaaacaactgaaagctctgaatttcgagttcgaccttgttttcacgtcggtactgaataggtcaattcataccgcatggctgatcttggaggagttgggccaggagtgggtaccagtcgagagcagctggaggttgaatgagcgccattatggggcattgataggcctgaacagagagcagatggctttgaatcacggcgaggagcaggtacgactgtggagaagatcgtataacgtcacacccccaccaattgaagaaagtcacccctactatcaggaaatctacaacgaccggcgatataaggtgtgtgacgtgcccctcgatcaactacctcggtctgagtccctgaaggatgttcttgaaaggctcctgccgtattggaatgaaaggattgcccccgaagtgctgaggggtaagacaatcctcatctccgcacacggaaattcctccagggcactcctgaagcacctcgagggtatcagcgatgaggatattatcaacatcaccctgcctacgggagtgccaatcttactcgagctggacgagaacctgcgggcagttggaccccatcagtttcttggggatcaagaagctatccaagcagccatcaagaaggtggaggatcagggtaaagtaaagcaggccaagaaatag

SEQ ID NO: 177267 - DNA, 780 bp, Artificial Sequence
  Description of Artificial Sequence: Synthetic coding sequence
atgagcaagtacaagctgatcatgctgcggcacggcgagggcgcctggaacaaagagaacagattctgttcttgggtggatcagaaacttaatagcgagggtatggaggaggccaggaattgcggaaaacaactcaaagcgcttaacttcgagttcgacctcgtgtttacctctgtactaaaccgaagcatccacacagcttggctgatcctagaagagctggggcaggagtgggtgccagtcgaatcctcctggcggctgaatgagaggcattacggagcactgataggtttgaatagagagcagatggctctgaaccatggcgaggagcaggtgcgcttgtggaggagaagctataacgtgactccgcctccgatcgaagagtcacacccatactatcaggagatatataacgaccggcgctataaggtttgtgatgttccgttggaccagttgccaaggtctgagagtctcaaagatgtcctcgagagactactgccttactggaatgagaggattgccccagaagtgcttagaggcaaaaccattctcatcagtgcccacggcaatagcagccgggctctcttaaagcacctggaaggaatttctgacgaagacattattaacatcaccttacctacaggcgtgccaatactgctcgagctggatgaaaatttgagagcagtgggtccacatcaattcctgggcgatcaggaagcgattcaggccgccatcaaaaaagttgaggatcaaggcaaagttaagcaggccaaaaagtag

SEQ ID NO: 177268 - DNA, 780 bp, Artificial Sequence
  Description of Artificial Sequence: Synthetic coding sequence
atgagcaagtacaagctgatcatgctgcggcacggcgagggcgcctggaataaagagaaccgcttctgctcgtgggtggaccagaaacttaactccgaaggaatggaggaagctcggaactgcggcaagcagctgaaagctctgaatttcgagttcgatctcgtgttcacttcagtcttaaatagatctattcatacggcctggctaattcttgaagaacttggccaggaatgggttcccgtcgagtcaagttggaggttaaacgagcgtcactacggcgccctcattggcctcaatcgtgaacagatggccctaaaccacggcgaggagcaggtaaggttatggcgtaggtcttacaacgttacccctccccctattgaggagagccacccctactaccaggaaatttataatgataggaggtacaaagtgtgcgatgtgcccctcgaccagctgccccggagcgagtccctgaaagatgtgctggaacgactgctcccatattggaatgagcggatcgcacctgaagtcctccggggaaaaaccatattgatttctgcccacggaaattcttctcgggccctgctcaagcaccttgaggggatttccgacgaagacattattaacatcaccctgcctacaggtgttcccatcttgctggagctggacgagaacctccgagcagtgggcccccaccagtttctgggagaccaggaggccattcaagccgcaataaagaaggtagaagaccaggggaaagtgaaacaagcgaagaagtag

SEQ ID NO: 177269 - DNA, 237 bp, Artificial Sequence
  Description of Artificial Sequence: Synthetic coding sequence
atgagcaagtacaagctgatcatgctgcggcacggcgagggcgcctggaataaggagaatagattctgttcttgggtggatcagaagttaaacagcgaagggatggaggaggctcgcaactgcgggaagcagttgaaggccctcaatttcgagtttgatttagtattcacctccgtgttgaacaggtctatccacaccgcctggctcatcctcgaggaattgggccaggagtggtag

SEQ ID NO: 177270 - DNA, 894 bp, Artificial Sequence
  Description of Artificial Sequence: Synthetic coding sequence
atgaaccggggcttcagccggaagagccacaccttcctgcccaagatttttttccgtaagatgtccagttccggggctaaggacaagccagaactgcagtttccatttcttcaggatgaggacacggtcgccactcttctggagtgcaaaaccttgtttatcctgagggggctccccggttcgggaaagtcaacgctagcccgcgtcatcgttgacaaataccgggacggtactaagatggtgagtgccgacgcctataagatcacaccaggtgctaggggcgctctaaaggaactgcggcagttcgtacccggggatgaaccccgggagaaaatggatctggtgacgtatttcggcaagcgccctcctggggtgctccattgcacaaccaagttctgcgactacggtaaagcgcccggcgccgaggagtacgcgcagcaggacgtattgaagaaatcctactccaaagcgttcactctgacaatcagcgctctgttcgtcacccctaaaaccacgggggctagggtcgagctgagtgagcagcagctgcagctgtggccctcagatgtagacaagctgtcgccaaccgacaacttgccaaggggctcccgcgcccacatcactttaggctgcgccgccgacgtggaggccgtccagaccgggctggatctactcgagatcctgcgccaggaaaaaggaggaagccggggagaggaagtaggggagctatccagggggaaattgtactcattgggaaacggtaggtggatgctgactcttgccaaaaacatggaagtgcgcgcaatttttacagggtactatggcaagggcaagccagttcctacacaagggagccgaaagggcggggccttacagtcatgtaccatcatctag

SEQ ID NO: 177271 - DNA, 1206 bp, Artificial Sequence
  Description of Artificial Sequence: Synthetic coding sequence
atgagcagcagcggcgccaaggacaagcccgagctgcagttccccttcctgcaggatgaggacaccgttgccactctactagaatgtaaaaccctattcattctccggggcctaccaggctccggcaagtccacacttgcccgagtgatcgtcgacaagtatcgggacggtactaagatggtcagtgctgacgcctataaaatcactcctggcgcaaggggggcattttcagaggagtacaaaagactggacgaggacctggccgcctactgccgcagacgcgatattcggatcctcgtcctggacgataccaatcacgagagagaaagactggagcagctatttgagatggcggaccagtatcagtatcaggtggtgctggtagaaccaaagacagcctggcggctggattgcgcccagttgaaggagaagaaccagtggcaattatcagctgatgatcttaaaaagctgaagcccggcctggagaaagatttcctgcccttatactttgggtggttcctcactaaaaaatcctctgaaacactgagaaaagctggccaagttttcctggaagagcttggaaaccataaggcctttaagaaagaactgcggcagtttgttcctggcgacgagccccgtgagaaaatggacctggtgacatactttggcaagaggcctcccggcgtgctccactgcacaaccaagttctgtgattacggcaaagcaccaggggccgaggagtacgcacaacaggatgtgctcaagaaaagctactccaaagctttcactttaaccatctcagctcttttcgtgaccccaaagactacaggggcgcgtgtagagctgagtgagcaacaattgcagctgtggccgtccgacgtggataagctctcacccaccgataatctcccgaggggcagcagagcacatattactctgggttgtgcagcagatgtggaagcagtgcagactggacttgatctactagaaatattacggcaagagaagggaggctcccgcggggaggaagtgggggagctgtccagagggaagctgtactctctgggaaatgggaggtggatgctgaccctggctaagaacatggaagtccgggcgatattcacaggatattacgggaaagggaagcccgtcccaacacagggcagtagaaagggcggagcactccagtcttgcactattatctag

SEQ ID NO: 177272 - DNA, 1266 bp, Artificial Sequence
  Description of Artificial Sequence: Synthetic coding sequence
atgaaccggggcttcagccggaagagccacaccttcctgcccaagatcttctttagaaagatgtcctctagtggggcaaaggacaaacccgagctgcagtttccattcctccaggacgaagatacggtcgccactctgcttgaatgtaaaaccttattcatattacgcggcctgccaggcagcggaaagtctaccttggcccgggtcatcgtggacaaatatcgggatggtaccaagatggtgtcagccgacgcgtacaagatcacaccgggtgcaaggggggcattttcagaggagtataagagactggatgaagacctagccgcctattgtcgacgtcgtgatatcaggatactggttctcgatgatacgaaccatgagagagagcgtctggaacaactgtttgagatggctgatcaatatcagtaccaggtcgtgctcgtggagcccaagaccgcatggcgcctcgattgcgcacaactcaaggaaaaaaaccagtggcagctaagcgccgacgacctgaagaagttaaaaccagggctggaaaaagattttcttccactgtattttgggtggttcctcacaaaaaaaagctctgaaaccctccgcaaggccggccaggtgtttctggaggagctgggaaaccataaggcctttaaaaaggagctgcgccaattcgtcccaggcgacgagcctagggaaaagatggacctcgtgacctacttcggcaaacggccccctggagtgctgcactgcactacaaagttctgtgattatgggaaggcccctggtgccgaagaatacgcgcagcaggacgttttgaagaagagctatagtaaagcctttacattgaccatcagtgcccttttcgtcacacccaagacgaccggcgccagagtcgaattatccgagcagcaactgcagttatggccctccgatgttgacaaattaagtccaacagataacctccccagaggaagcagagcacacataactctggggtgcgcagcagacgtcgaagcagtacagactggccttgacttgctggaaatcctgagacaggaaaaaggaggtagtagaggcgaagaagtgggggaactgtccaggggaaaactgtacagtttgggaaatgggcgctggatgctgactttggccaagaacatggaggttagggcgatttttacaggctattatgggaagggaaaaccagtgccaacacagggatcccgaaagggaggcgccctccaatcttgtacaatcatttag

SEQ ID NO: 177273 - DNA, 174 bp, Artificial Sequence
  Description of Artificial Sequence: Synthetic coding sequence
atgagcagcagcggcgccaaggacaagcccgagctgcagttccccttcctccaggacgaggacaccgtcgccacactgctcgagtgtaagacgctgttcatcttgcggggactgccggggtctggcaagagtactttggcccgggtgattgtggataagtaccgggatggatag

SEQ ID NO: 177274 - DNA, 1419 bp, Artificial Sequence
  Description of Artificial Sequence: Synthetic coding sequence
atgaagttcctgatcttcgccttcttcggcggcgtgcacctgctgtcactctgctctgggaaggcgatctgtaaaaatggtatctctaagagaaccttcgaggaaatcaaagaggaaatcgcaagctgtggagatgtggctaaggcaatcattaatcttgccgtgtatggcaaagcgcagaaccggtcctatgaacgccttgccctgctggtggacactgtgggtccgcggctaagtggttcaaagaaccttgaaaaggctattcagattatgtaccagaatctgcaacaggacgggctggaaaaggtgcacctcgagccagtgcggatccctcattgggaaagaggcgaggaaagtgctgttatgctggaacccaggattcataagatcgccattcttgggctcggcagtagcatcggcaccccccccgaagggatcactgccgaggttctggtcgtaacttcatttgacgagctgcagcggagagcaagtgaagccagagggaagattgttgtgtataaccagccatacatcaattattcgcgcacagtgcaatacagaacccagggggccgtggaagctgctaaagtaggtgccttggctagcctcatccgatccgtcgcatctttcagcatctactctccacacaccggcattcaagagtatcaggatggagtcccgaagatcccgacggcctgcattactgtggaagacgcggagatgatgagtcgtatggcttcccatgggatcaaaatcgttattcagctgaaaatgggagctaagacataccctgacacagattccttcaacactgtggccgagatcactggatctaagtatccagaacaggttgtgctcgtatctgggcatttagactcctgggacgtgggccagggggctatggacgacggagggggagccttcataagttgggaggcgctgtccctgatcaaagacctcggtctgcggcccaaaagaaccctgaggctggtcctgtggacagctgaagagcagggaggtgtcggagctttccagtattaccaactccacaaggtaaacattagcaattacagcctggtgatggaaagcgatgctgggacgtttctgccgactggactgcagtttacaggctctgagaaagcccgcgctattatggaagaggttatgtcccttctgcagcccctgaatattacccaagtcttgtctcacggtgagggcacagatatcaacttctggattcaggctggtgtccctggcgctagccttcttgacgatttatacaagtattttttcttccatcactcacatggtgacacgatgacagtgatggatcccaagcaaatgaacgtcgccgccgccgtgtgggctgtcgtaagttatgtcgtcgcagacatggaggagatgttaccccgaagctag

SEQ ID NO: 177275 - DNA, 981 bp, Artificial Sequence
  Description of Artificial Sequence: Synthetic coding sequence
atgagcggcctgggcaagaagcacctgctgctgatgggcgagttcttcagttatggcaccaaaatactctaccagaacaccgaagccttgcaatctaaatttttttccccactgcagaaagccatgctgcctcctaactctttccagggtaaggtagcctttattacaggcgggggaaccggtttggggaaaggaatgaccactctactaagttctctgggcgcccagtgtgtgatcgcctctcgtaagatggacgtgctgaaggccaccgctgagcaaatcagtagccagactgggaacaaggtccacgccattcagtgtgacgtgcgcgatcccgacatggtgcagaatacagtgagtgaactgattaaagtcgccggccatcctaacattgtgattaataacgctgccggaaattttatctccccaacagagcgactgagtcccaacgcctggaagactataacagatatcgtcttgaacggtacggcctttgtcacactggaaattggaaagcagctcataaaagcacagaagggagcagcattcctttcaatcaccactatttatgcagaaaccggctccggcttcgttgtgccatccgcatcagctaaagccggagttgaagctatgagcaaaagtctcgccgccgagtggggtaaatatgggatgcgtttcaacgtgattcagccaggaccgatcaagacaaagggcgccttttcccggctggacccaactggaacgttcgaaaaggagatgatcggtcgcataccttgtggcaggttggggacagtggaggagttagccaacctagcggcgtttctgtgcagtgactatgcaagctggataaacggggctgtcatcaaattcgacggaggggaggaagtgttaataagcggcgagttcaacgatctgaggaaagttacaaaggagcagtgggataccatcgaggagctaatcagaaagacaaagggatcttag

SEQ ID NO: 177276 - DNA, 1551 bp, Artificial Sequence
  Description of Artificial Sequence: Synthetic coding sequence
atggagcccgccgtgagcctggccgtgtgcgccctgctgttcctgctctgggtgagacttaaggggttggaattcgtgctgattcaccagcgctgggtgtttgtgtgcctgtttcttctgccactcagcctcattttcgatatatactattacgtgagggcctgggtcgtcttcaagctgtcatcagctccccggctgcatgaacagcgtgtcagagacattcaaaagcaggtgcgagaatggaaggagcagggtagcaagactttcatgtgcaccggaaggcccggctggctaactgtttcccttcgagttgggaaatacaaaaaaacccataagaacattatgatcaacctgatggacattctggaagtggacacaaagaagcagatcgtcagagtcgagcctttggtgacaatgggccaggtcaccgctctcctcacctctatcggatggacactgcccgtccttcctgagctggacgacctgaccgtgggaggactgataatgggcacaggtattgagtcatcatcccataaatatggattgttccagcatatttgcaccgcatacgagctcgtactcgccgatggctctttcgtacggtgcactccaagcgaaaattcagatctcttctatgctgtgccctggagttgtggaactctcgggtttctggtggcagccgagatacgcatcatacctgcaaaaaagtacgtgaagttgcgttttgagccagtccgaggcttggaggcaatctgtgctaagtttactcacgaaagccaacgccaagagaatcattttgtggagggtttactctattccctcgatgaagcagtcatcatgacaggtgtaatgacggacgaggccgagccatccaaactaaattcgataggcaactattacaaaccttggttcttcaagcacgtggagaattacttgaagactaatagagaaggtcttgagtatataccactccgacattactatcatagacacacgcggtcgatcttttgggaattgcaggacatcataccctttggaaataacccaatatttcgctatttgtttggctggatggtgccccccaagatctctttactcaaactgacacaaggagagactttgagaaagctgtacgagcaacaccatgttgtacaggacatgctggtgcccatgaagtgtcttcagcaggccctgcatacgtttcagaatgatatccatgtctacccaatatggctctgtccgttcattctcccttcgcagcctgggctagtgcatccaaaaggaaatgaagctgaactgtacatagacataggggcgtacggcgagcctagggtgaagcacttcgaagcccgctcatgtatgagacagctcgagaagttcgttcgttcagtgcacgggttccagatgctatatgccgattgctatatgaatcgtgaggagttctgggagatgttcgacggatcactataccataagctgcgggagaaactggggtgccaggacgccttccccgaagtctacgacaagatatgcaaagctgctaggcactag

SEQ ID NO: 177277 - DNA, 465 bp, Artificial Sequence
  Description of Artificial Sequence: Synthetic coding sequence
tgaagcctgctgaagctgacccagggcgagaccctgcggaagctgtatgagcagcatcacgttgttcaggacatgctggtccctatgaaatgtctgcagcaggccctccacacattccagaatgatatccatgtgtaccctatttggctctgcccgtttatcctaccgtctcagcctggtctggtgcatcctaagggtaacgaagctgagctctacattgacatcggcgcttatggagagcctcgtgtcaaacattttgaagccaggagctgtatgcggcaactcgagaagtttgttcgctccgtgcatgggtttcagatgctatacgccgactgttatatgaatcgggaagagttttgggagatgtttgatggttcgctgtaccataaattacgcgaaaagttaggatgccaagacgcattccccgaagtctacgacaagatctgcaaggctgctcgtcactag

SEQ ID NO: 177278 - DNA, 1428 bp, Artificial Sequence
  Description of Artificial Sequence: Synthetic coding sequence
atgggcgccggcgagcagaaccggcagagcgcccactgcgtgcaggggatctgcgggtacctggagggtgacgaggaaggggaagagggggaagtgcggagcacccaagtgcgggaatggaaggagcaaggatccaaaacgtttatgtgtacaggaagacctgggtggctgactgtgtccctccgggtgggtaaatataaaaaaacacacaaaaatattatgattaatctcatggacatcctggaagtcgataccaaaaaacagatcgttcgagtagaaccgcttgttactatgggtcaggtgactgcactcctgactagcattggctggacactccccgtccttccggagctggatgatcttactgtggggggcctgattatgggcacaggcatagagagctcatcacataagtacggactttttcagcatatctgtactgcttacgaattggtgctggcggatggaagtttcgtgagatgcaccccttccgaaaacagtgatctcttttacgctgtgccttggtcttgtggaactctaggatttctggtggcggctgaaatccgcataattcccgctaagaaatacgtgaaacttcgtttcgagccagttcggggtttggaggccatatgcgctaagttcacccatgaatcacagcgccaggagaaccactttgtggagggactcttgtacagtcttgacgaggccgttataatgaccggagtgatgaccgacgaagctgaaccctcaaagctgaattctattgggaactattataagccgtggttctttaagcacgtagagaactacctcaagactaatagggaaggcctggaatacatcccgctgagacactactatcacagacacacacggtcgatcttctgggaactgcaggacatcataccttttggtaataacccaatcttcagatacctctttggatggatggtgccacccaagattagccttctgaaactgacacagggagagacactgcggaaactttatgagcagcaccatgttgtccaggacatgctggtcccgatgaaatgcctgcagcaggcattacacacctttcaaaacgacattcatgtgtatccgatatggctgtgtccattcatcctgccttcacagcccgggcttgtccaccccaagggaaacgaggctgagctctatattgatattggcgcctacggcgagccccgcgtaaagcattttgaggcaagatcctgcatgcgacagttagaaaagtttgtgagatcagtgcatggctttcagatgctatatgcggactgctacatgaacagggaagagttctgggaaatgtttgatggctccctatatcacaaacttagagagaagttagggtgccaggacgcttttccagaagtctacgacaagatatgcaaggcggccaggcattag

SEQ ID NO: 177279 - DNA, 903 bp, Artificial Sequence
  Description of Artificial Sequence: Synthetic coding sequence
atgggcaccggcatcgagagcagcagccacaagtacggcctgttccagcatatctgcaccgcctatgagctggtgctggcagatggttcttttgtgcgctgtactccctctgagaactctgacctattttacgcagtgccatggagctgtggcactcttggttttctggtcgcagctgagatccgtattattcccgccaagaaatacgtgaaactccgcttcgaacctgtgcgaggccttgaggcgatctgcgccaagtttacacatgagagccagcgacaggaaaaccacttcgtcgaaggcctgctgtatagcctcgacgaggcggtaataatgaccggcgttatgaccgacgaggctgagccatcgaaggacataattccttttggtaataatccgatttttagatacctgtttggctggatggtccctccaaagattagtctccttaaactcacgcagggtgaaaccctgaggaaactatacgagcagcatcacgtcgtacaggatatgctcgtgcccatgaaatgcctgcagcaggcattgcacacctttcagaatgatattcatgtgtatcctatttggttatgtccgtttatcctgccttcacagccagggcttgtccacccaaagggaaacgaggccgagctgtatatcgacattggcgcttatggggaaccccgcgttaaacacttcgaggctcgctcttgcatgagacagcttgagaaattcgtccgtagcgttcacggctttcagatgctttacgctgactgctatatgaatcgggaagagttttgggagatgtttgacggctcattataccataagctcagagaaaaactggggtgccaagacgcattccctgaggtctacgacaaaatatgtaaggcagcccggcactag

SEQ ID NO: 177280 - DNA, 729 bp, Artificial Sequence
  Description of Artificial Sequence: Synthetic coding sequence
atggagcccgccgtgagcctggccgtgtgcgccctgctgttcctgctttgggttaggctgaaagggctcgagttcgtgttgatccaccagagatgggtatttgtctgtctttttctgctgcccctctctcttatcttcgacatatattattacgttcgagcatgggttgtgttcaagctgagcagtgctccccgactccacgagcaaagggtccgtgatatccagaagcaggtcagggagtggaaggagcagggaagcaaaacattcatgtgcacgggtaggcctggctggctcacagtgagtttgcgcgtgggaaaatacaagaaaacccacaagaacattatgataaacttgatggatatactggaagtcgacactttccaaaacgacatacacgtttacccgatctggctgtgcccatttattctgccatcacaacctggccttgttcatcccaagggcaacgaggctgagctctacatagacatcggcgcatacggtgagccacgcgtcaagcactttgaagcccggtcctgtatgagacaacttgaaaagttcgtgagatccgtccacggatttcagatgttatacgcggactgctacatgaatagggaagaattttgggaaatgtttgacggctctttatatcataaactgagagagaaattagggtgccaggatgcctttcccgaggtgtatgacaagatttgcaaggccgctcgccactag

SEQ ID NO: 177281 - DNA, 1203 bp, Artificial Sequence
  Description of Artificial Sequence: Synthetic coding sequence
atgatggacctgcggaacacccccgccaagagcctggacaagttcatcgaggattaccttttaccggatacatgcttcagaatgcagattaatcatgctattgatattatctgtggctttctgaaggagaggtgcttcagggggtctagctatcccgtgtgtgtctctaaagtagttaagggggggtcatccggcaaaggaaccacactgaggggccgatcagacgccgacttggtcgtgtttctttccccactgacaacctttcaggaccaacttaatcggcggggagaattcatccaggaaattcgcaggcagctcgaggcatgtcaaagagaaagggcattctcagtaaaatttgaagtccaggcccctcgctggggcaatccaagggccctgtcatttgtgttgtcctctctgcagctgggagagggggtagaattcgacgtgctgccagcgttcgacgccctgggtcagctaacgggcggttacaagcccaatcctcaaatctacgtgaagttgatcgaggaatgcacagacctgcagaaagaaggcgaatttagcacctgttttacggaacttcagcgagatttcctaaagcaaaggcctaccaagctgaaatctcttatccgcctcgttaagcactggtatcagaactgcaagaagaaactcgggaagctgccacctcagtacgcacttgagcttcttaccgtctacgcttgggagaggggtagcatgaagacgcattttaacactgctcaaggttttcgcactgtccttgagctggtgattaattaccagcaactatgtatatactggacaaagtactacgatttcaagaatccaatcatcgagaagtatttgaggaggcagctcaccaagcctcgcccagtcatcttggaccctgccgaccccacggggaatctgggggggggcgatccaaaaggttggcgccagttagcccaggaggcggaggcttggttaaactacccatgtttcaagaactgggatggcagcccagtgtcatcctggatcctgcttgccgagagtaactcagccgacgacgagaccgatgatccccggcggtaccaaaagtacggctatattggtacccacgaatatccacatttcagccatcgtccctccaccctgcaggccgcatcaacaccccaggcagaagaagattggacttgtactatcctgtag

SEQ ID NO: 177282 - DNA, 1146 bp, Artificial Sequence
  Description of Artificial Sequence: Synthetic coding sequence
atgatggacctgcggaacacccccgccaagagcctggacaagttcattgaggactatcttttacccgatacttgcttccgcatgcagattaaccatgccatagacatcatatgtggcttcctgaaagaacggtgttttagaggaagcagctaccctgtgtgtgtaagcaaggtggtaaagggtggaagttcagggaaggggaccaccctccgaggtaggagtgatgctgacctggtggtcttcctatccccccttactacgttccaagatcagctcaatcgcaggggcgaatttatacaggagatcaggcgtcaactcgaggcctgtcaaagggaaagggcatttagcgtcaagttcgaggtgcaggcgcctcgatggggaaatccacgtgcgttatcatttgtgctatcctctctgcagcttggtgagggagtcgagtttgacgtgctccctgcatttgacgccctcggacaactgaccggcggttataaaccaaaccctcagatatacgtcaagctgatcgaggaatgcacagacctccagaaagagggggaattcagcacttgctttaccgagcttcaacgcgattttctgaagcagcggccgacgaaactgaaaagtcttatcaggctggtgaagcactggtaccagaattgcaagaagaagctggggaagctccctccacagtatgccctggagctactgacggtatatgcttgggaaaggggcagtatgaagacccactttaacactgcgcagggatttcgcacagtgctggaacttgtgattaattatcagcagctgtgtatttactggactaagtattatgattttaagaatcccataatagaaaaatacctgcgccggcagttaaccaagccccgaccagtcattctggacccagccgacccaacaggcaatctggggggcggggacccgaaaggatggaggcagctggctcaggaggctgaagcctggctaaattatccctgctttaaaaactgggacgggagccctgtcagtagctggatcctcctggtgaatctgacacttgtgggccggaggaattacatcatcagcgaacacgcggtcaatttacagcaaacccgcggagccagtctgagctacagttttcaggtggcttag

SEQ ID NO: 177283 - DNA, 1245 bp, Artificial Sequence
  Description of Artificial Sequence: Synthetic coding sequence
atgatggacctgcggaacacccccgccaagagcctggacaagttcatagaagattatctgctgcccgacacctgctttcgtatgcagattaaccatgccattgatatcatttgcggtttcctaaaggaaaggtgctttcgcggctcatcttacccagtgtgtgtctctaaagttgtcaaagggggcagcagtggaaaaggaaccaccttgaggggcagaagcgacgctgatctcgtggtgtttttgtcccccctcaccacatttcaggatcaacttaacaggagaggcgaattcatacaggaaattcgcaggcagctcgaagcttgccagagagagcgggccttctcagtcaagttcgaggtccaggctccacgatggggaaatcctagagctctatccttcgtcctgtcgagcctgcagctgggggagggggtcgagtttgacgtacttcccgcctttgatgccctggggcagttaacgggtggttataagcccaacccccagatctacgtgaaactcatcgaagaatgtaccgacctgcagaaagagggagagttctcaacatgctttacggaactgcaacgtgactttctgaagcaaaggcctactaagctgaagagcttgattaggcttgttaagcattggtatcagaactgcaaaaaaaaactcgggaagctgcctccccagtacgctttggagctgctcacggtgtacgcctgggaaagaggaagtatgaaaacccactttaacactgcgcagggtttcagaaccgttctggaacttgttataaactaccagcagctgtgcatctattggaccaagtattacgacttcaagaatcctatcattgaaaaatatttacggagacagttgacaaaacctcgcccagtgatcctggacccagccgatcccaccgggaacctcggaggtggtgatcctaaagggtggaggcaactcgctcaggaagcagaggcttggctcaactacccctgctttaagaactgggatggtagcccggtctctagctggatcctgctcacacagcatacaccgggctccatccatcccaccggcagacggggactggatcttcatcacccccttaacgcatcggctagctggggcaaaggtctgcagtgttatttagaccaattcctacatttccaagtgggcctcttgatccagcgaggccagtctagctccgtatcatggtgtattatccaggatcgaactcaggtgtcctag

SEQ ID NO: 177284 - DNA, 1095 bp, Artificial Sequence
  Description of Artificial Sequence: Synthetic coding sequence
atgatggacctgcggaacacccccgccaagagcctggacaagttcatagaggattatctattgcctgacacgtgctttaggatgcagataaaccatgccattgacatcatttgtggttttctgaaggaaagatgcttcagggggagctcctacccagtatgtgtgtcaaaagtggtgaaaggggggtccagtggcaagggaacaacattgcgaggccgctctgatgccgatcttgtcgtcttcctaagcccattaactacctttcaggaccagctaaaccggcgaggggaattcatccaggagatcaggaggcaactcgaggcctgtcagagagagcgtgcgttctcagtcaagttcgaagtccaggcacctcgatggggaaaccctcgagccttgtccttcgtcctgagcagccttcaattgggagagggcgtggaattcgatgttcttcctgcattcgatgcactagggcagttaactggaggatacaagcccaatccacagatatatgtgaagctgattgaggagtgtaccgacctacaaaaggaaggcgaattcagtacctgttttactgagctgcagcgggactttctgaaacagagacccaccaagcttaaatccctcatacgactagtcaaacattggtatcaaaattgtaaaaagaaacttggcaagttgcccccccagtacgctctagagctcctgaccgtctacgcctgggaacgaggaagcatgaagacgcactttaataccgcccaggggttccgaacggtgctggagctggtgatcaattaccagcagttgtgcatctattggacgaagtattatgacttcaaaaaccccattatcgaaaagtatctgcgacggcagctcacgaagcctcgtcccgtgatactggatcctgcggaccctaccggaaatctcgggggaggagacccaaaaggctggcgtcaactggcccaagaggctgaggcttggctcaactatccctgtttcaagaattgggacggatcgccagtgagttcatggatcctgcttgtgcgtccgcctgcatcaagcttgccctttattccggcaccactgcacgaggcttag

SEQ ID NO: 177285 - DNA, 2160 bp, Artificial Sequence
  Description of Artificial Sequence: Synthetic coding sequence
atgggcaacggcgagagccagctgagcagcgtgcccgcccagaagctgggctggttcatccaggaatacctgaagccatatgaggagtgtcagacgctgattgatgagatggtgaatacgatttgcgacgtcttgcaggagcccgagcagttcccactcgtgcagggagtcgccattggggggtcctatgggcggaaaacagtcctgaggggcaacagtgacggaactcttgtgctgtttttctccgatttgaaacagttccaggaccagaagcgctcacagagagatatcctggataaaaccggagataagctgaagttctgtctgttcacaaaatggctcaaaaataatttcgagatccaaaaatccctggatggattcaccattcaggtttttacaaaaaaccagcgcatctccttcgaagtactcgctgctttcaacgctcttagtctgaatgacaatccttcaccctggatttacagagaactgaagcggtcactggacaaaacaaacgccagccctggcgagttcgccgtttgcttcaccgagctgcagcaaaagttcttcgataaccgccccgggaagctgaaggacctcatcttactgatcaaacattggcaccagcagtgtcaaaaaaagataaaagatcttcccagccttagcccgtatgccctcgagctgctcacggtttatgcatgggaacaggggtgtcgaaaggacaactttgatattgcggagggcgtgcgcactgtgttggagttaatcaagtgtcaggaaaagttgtgcatctactggatggtgaactataatttcgaagacgaaactattcgcaatatactgctgcatcaactacagagcgccagacccgtgattttggaccctgtggaccccacgaataatgtctcaggggataagatctgctggcaatggcttaagaaggaggctcagacatggctgacctcacctaacctagacaacgaactccccgcacccagctggaatgtgctccctgctccactgttcaccacacctggccacctgttggataaatttatcaaggaatttttgcagccaaataagtgttttcttgaacaaatcgattcagctgtgaacataattcgaacattcctgaaagaaaattgtttcagacagtcaacggcgaagattcagatcgtcagaggcggctccactgccaagggcactgctcttaagaccggcagtgatgccgacctcgttgtgttccacaacagtctcaagagttacactagccagaagaacgaacgtcataaaattgttaaggagatccatgagcaacttaaagccttttggagagagaaagaggaggaattagaggtgtccttcgagccccccaagtggaaagccccccgagtgctttcgttttcactcaagagtaaggtgttaaatgaatctgtttcctttgatgtactgccagcctttaatgccctgggccagctgtcctctggtagcaccccctccccagaagtttatgcgggcctaatagatttgtataaatcaagtgacctgcccggaggcgaattctctacttgcttcaccgtgttacagcggaacttcatccgtagcagacctaccaagctaaaggatctcatccgcttggtcaaacattggtacaaggagtgtgagcgaaagctgaagcctaagggcagtcttccgcctaaatacgccctggagcttctcacaatttacgcttgggaacaagggagcggggtgcccgatttcgatacggctgaggggtttaggactgtactggaactcgtgacgcaataccaacagctatgcattttttggaaggtgaactacaatttcgaggatgaaaccgtgagaaaatttttgctgagccagctgcagaaaacacgtccagtgatcctcgatcctgccgagcctactggtgacgtgggaggcggcgatagatggtgttggcacttgctggctaaggaagccaaagaatggttgtcctcgccttgctttaaggacggcactggcaatcctatccccccttggaaggtaccaactatgcagacccccgggtcctgtggcgccaggattcatcctattgtcaatgaaatgtttagttccagatctcaccgaatcctcaacaacaattcaaagaggaacttttag

SEQ ID NO: 177286 - DNA, 2064 bp, Artificial Sequence
  Description of Artificial Sequence: Synthetic coding sequence
atgggcaacggcgagagccagctgagcagcgtgcccgcccagaagctcggatggttcattcaggagtacctaaagccttatgaagagtgccagacacttattgatgagatggtaaacacaatctgcgatgttctacaggaaccggaacaatttcccctggtccagggtgttgctatcggcggctcttatggccgaaaaaccgtactccgtgggaacagtgacggcactctcgtgctcttctttagcgacttgaagcagttccaagaccagaagcgatctcagcgggatatcctcgataagacaggggacaaactgaaattttgcctatttaccaagtggttgaagaacaatttcgagatccagaagtctctggatggctttacaatccaagtatttaccaagaaccagagaatctcttttgaagtgctggccgccttcaacgcactctctttgaacgacaatcctagcccatggatttacagggagctgaaaagatcacttgataaaaccaatgcgtccccgggtgagttcgcagtttgtttcacagagttacagcagaaattcttcgataatagaccaggcaaactcaaggacctgatcctgctaattaagcactggcaccagcaatgtcagaaaaaaattaaggatctcccgagcttgagcccatacgccctggagctgctgacggtttacgcttgggaacaggggtgtcggaaagataatttcgacatcgcagaaggagttcgaaccgtgctcgaactgattaaatgccaagagaagctgtgcatttattggatggtgaattataactttgaagatgaaacaatcaggaacattctccttcaccagctccagagcgctcgtcccgtgatcctcgatcccgtggacccaactaataacgtctcgggggataaaatctgctggcagtggctgaagaaggaagctcagacttggctgacatccccaaacctcgacaatgaactccccgcccccagctggaatgttttaccagctccactgttcacaacaccgggtcacctcctagacaaattcatcaaagaattcctgcaacctaacaaatgcttcttggagcaaatcgactcagccgtaaacatcattcgtaccttcctaaaagagaactgcttccggcagtcaacagcgaaaatccagatcgtcaggggaggctccactgcgaaagggactgccctcaaaaccggatccgacgcggacttggtagtctttcacaactctctgaagtcctatacctctcaaaaaaatgagcggcataaaatcgtgaaggaaattcacgagcaactaaaggccttctggcgtgagaaggaggaggaattggaagtctcttttgagcccccaaagtggaaggcccctagagtcctgtctttctccctaaagtcaaaggtgctaaatgagagtgtgagcttcgacgtgctaccagccttcaacgctcttgggcagctgtcttcaggctcaaccccttctcccgaagtatatgccggcctcatcgatctctataaatcatccgacctccccggaggcgagttttctacctgcttcaccgtgctccagagaaatttcatcaggagccgacccaccaagctgaaggacctgatcaggttggtgaagcactggtacaaagaatgcgagaggaagcttaaaccgaagggtagcctgccccccaagtacgcactcgaactcctcacaatttacgcttgggagcagggctctggagtgcctgactttgatacagctgaaggatttaggacagtgttggagctcgtgacacaatatcaacaattatgcattttctggaaggtgaattataacttcgaggacgagactgtcagaaaatttctccttagccaattgcagaaaaccaggcccgttatcttggaccccgctgagcctacaggagacgtcggcgggggcgataggtggtgttggcatcttctcgcaaaggaagctaaagagtggctgagttctccgtgtttcaaggacggcactggaaacccaatacccccatggaaggtccctgtgaaagtgatttag

SEQ ID NO: 177287 - DNA, 519 bp, Artificial Sequence
  Description of Artificial Sequence: Synthetic coding sequence
atgggcaacggcgagagccagctgagcagcgtgcccgcccagaagcttggctggttcatccaggaatacctgaaaccgtacgaagaatgccaaaccctgatcgacgaaatggtgaacaccatttgcgatgtgttgcaagaacccgaacagtttccgcttgtccaaggagtcgccattggcggttcttatggccgtaaaaccgtgttaagaggcaattctgacggaacactggttttattcttctcagatttgaagcagtttcaggaccaaaagaggagccaaagagacatcctcgacaaaaccggggacaagctcaagttctgcttattcaccaagtggctaaagaataacttcgagattcagaagtctcttgatgggttcactatccaggtttttactaaaaaccagaggatcagctttgaagtgttagccgctttcaacgctcttagcaagcactgctgggtcagcggcgaaaagagccagcggtctggatgccagactgcattatgtaatttgtag

SEQ ID NO: 177288 - DNA, 1053 bp, Artificial Sequence
  Description of Artificial Sequence: Synthetic coding sequence
atggccaccgtgggcgccccccggcacttctgccggtgcgcctgcttctgcaccgacaatctctatgttgccagatatgggctgcacgttcgtttcagaggtgaacagcagctgaggcgggattacgggccaattctacgctctcgcggctgcgtctccgccaaggatttccaacaactgctcgctgagctggaacaggaagttgaacgtcgccagcgactggggcaggagtctgccgctcgcaaggctttgattgctagctcctatcatcctgccaggcctgaggtgtacgatagcctccaggatgctgccctggctcccgagttcctagcagtgacagaatatagcgtgagccccgacgccgacctcaagggactgttacagagactcgaaaccgtcagcgaggagaagcgaatttatagggttcccgtcttcacagcccccttctgtcaggctctactggaagagttggagcacttcgagcagtcagatatgcccaagggtcggccaaacacaatgaacaattacggagtgcttttgcatgaactggggctcgacgaacctcttatgacacccctccgggaaaggtttctgcagccattaatggcactgttatatcccgattgcggcggtggtagactggacagtcacagagcatttgtggtgaagtatgccccagggcaggatctggagctgggttgtcactacgacaatgcagagctaactctaaatgtcgcactaggcaaggtgttcacaggaggtgcgctttatttcggtggtctctttcaggctccgacagccctcaccgagccccttgaggttgaacatgtcgtgggtcagggcgtgttacacaggggagggcaattacacggagccagacccctggggacaggcgagaggtggaacttagtggtgtggctccgggcatctgctgtaaggaacagtctgtgtcctatgtgctgcagagagccggatttggtggatgacgaagggttcggagacgggtttacccgcgaggaacccgccactgttgatgtctgcgcacttacctag

SEQ ID NO: 177289 - DNA, 3261 bp, Artificial Sequence
  Description of Artificial Sequence: Synthetic coding sequence
atggacctgtacagcacccccgccgccgccctggaccggttcgtggccagaagactacagccccgcaaagagtttgttgaaaaggccaggcgggcgctgggcgctctggcagccgctctgcgggaaaggggaggtcgactgggggccgccgctccacgcgtgctcaagaccgtaaagggcggcagttcgggtcgcggcaccgcactgaagggggggtgcgatagcgagctcgtaattttcctggattgcttcaaatcatacgttgatcagagagcaaggcgagctgagatcctttccgagatgcgggcgtctctggaatcatggtggcagaaccctgtgccgggcctcagactgacttttcctgagcagagcgttcctggagctctccagtttagattaacatccgtcgatctggaggattggatggatgtgtcattagtcccagcctttaacgtactcgggcaagctgggtcgggggtgaaaccaaagccacaggtgtattctaccctgttgaactcagggtgccaaggcggcgaacacgctgcgtgctttactgagcttcgtagaaacttcgtgaacattcgccccgcgaagcttaagaacctgatcttactggttaagcattggtatcaccaagtgtgcttacagggcttatggaaggagactttaccccccgtatatgccctggaacttctgaccatcttcgcttgggagcagggatgcaagaaggacgcatttagcttagccgagggcctccgtaccgtgctgggtttgattcagcagcatcagcacctatgtgtgttctggaccgtaaattacggtttcgaagaccctgccgtaggtcagttcctgcaaagacagctgaagcgaccaagaccagttatacttgacccagcagaccctacttgggacctaggcaacggcgctgcatggcactgggacctgttggcccaagaggctgcctcatgctacgatcacccctgttttttacgcgggatgggcgatcccgtgcaatcatggaaggggccggggctcccacgagccgggtgttccggcttgggccatcctatccagctggacccgaatcagaagacacctgaaaactctaaaagtctaaacgccgtctatccacgggcaggttccaaaccacccagttgtcccgcaccaggccctactggccagcctgcttctagttctgtgcctggtatggcactggaccttagccagatccccacgaaggagctggaccgcttcatccaggatcatctcaaaccctctccacagtttcaggagcaggttaagaaagctatcgatataattttaaggtgtcttcatgagaattgcgttcacaaggccagccgagtcagcaaaggtggttcctttggccggggcactgatctgcgggatgggtgtgatgtggagttaataattttcttaaattgctttaccgattataaagaccagggtccacgtcgggcggagattctggatgagatgagagcccaactggagtcctggtggcaggatcaggttcctagcctgtcactgcagttcccagagcaaaacgtgcctgaggcccttcagtttcagttggtgagcactgcgctcaagagttggaccgacgtgagcctgctccctgctttcgacgctgtagggcagctaagcagtggcaccaagccgaaccctcaggtgtacagccgtttgctcacttctggctgccaggagggtgaacacaaggcatgctttgccgagctgcgccggaacttcatgaacatccgtcccgttaaattgaaaaacctgattttgttagtgaagcattggtatcggcaggtggctgctcagaacaaaggtaagggtcccgcccccgcatctcttcctcccgcttatgccctggaattgctgaccatcttcgcttgggaacagggttgccggcaggattgtttcaatatggcccagggatttcggactgtgctggggctggtccaacagcatcagcagctctgtgtgtattggactgtgaattatagcacagaggatccggcgatgcgcatgcacttactgggccagctgagaaaaccccgacctctggtgttagaccccgctgaccctacttggaatgtgggccatgggtcttgggaactcttggcccaggaagccgcagctttagggatgcaggcatgctttctgtcacgcgatggcacgtctgtccagccatgggacgtgatgccagcgctgctctatcagacgcctgctggtgacctggataagtttatctcagaattcctgcaacctaaccggcaatttttagcccaagttaacaaggcggtagacactatctgttcttttctgaaggaaaattgttttcgcaactctccaatcaaggtgatcaaggtggtgaaaggtggaagtagtgccaagggtacggcactgcgcggaaggtccgatgccgacttagtcgttttcctgtcatgcttcagtcaattcactgaacagggcaataagcgcgctgagattatttccgaaattcgcgctcagctcgaagcctgtcaacaggagcgtcagttcgaggtgaaattcgaggtttccaagtgggaaaatcccagggtattatcattcagcttgacgtcccagacaatgctggaccagagcgtcgatttcgatgtattaccggccttcgacgccctggggcaattggttagcgggtcaaggccatcaagccaagtgtatgtcgacctgatccactcctactcaaacgcaggagaatactctacttgctttaccgagctgcagcgggacttcatcatctcacgccctactaagcttaagtccctcattagacttgtaaaacattggtaccagcagtgtacaaagatctctaagggccgcggcagtctccctccgcaacatggcctggagcttctaacagtttatgcctgggagcaggggggaaaggactcacaatttaacatggcagagggcttcagaacagtcttagaattggtgacacagtatcgtcagctgtgtatctactggaccatcaactataacgctaaggacaagaccgtgggggacttcctaaaacaacagctgcaaaaaccccggccaattattctggaccctgccgatcctactgggaatttgggccacaatgccaggtgggatcttctggcaaaagaagccgccgcttgcacctctgctctgtgttgcatggggaggaatggtatcccaatacagccctggcccgttaaggcggcagtttag

SEQ ID NO: 177290 - DNA, 1545 bp, Artificial Sequence
  Description of Artificial Sequence: Synthetic coding sequence
atggccctgatgcaggagctgtacagcacccccgccagccggctggactccttcgttgcgcagtggttgcagcctcacagggagtggaaagaggaagtgctggatgcagtacggacggtcgaagaattccttaggcaggaacattttcagggaaagcgcgggctagatcaggacgtgcgggtgctgaaggtggtgaaagttggaagctttggaaatggaacagttctgagatctaccagagaggtcgagttagtagccttcctttcttgcttccactcttttcaggaagccgccaagcaccacaaagacgttctcaggctgatctggaagacgatgtggcagagccaagacctcctggatctaggtctggaggacctgcggatggagcagagggtcccagatgccctggtcttcactatccaaacacggggcaccgctgagcccatcaccgtcacaattgtgccggcctacagggccctgggtccatccctccccaattcacagcctccccctgaagtgtacgtgtccttgatcaaagcctgtggagggccaggaaacttttgcccaagtttttcggagctgcagaggaatttcgtcaaacaccggcctactaaactcaaaagtcttttaagattggtcaaacactggtaccagcagtacgttaaggctaggagtccgcgggccaatctcccccctctttacgctctagaactcctgacaatatacgcttgggagatgggcaccgaggaggacgagaacttcatgttggacgaaggtttcacgacagtcatggacctgctccttgagtacgaagtcatttgcatctattggactaagtactatactctccacaacgccattatcgaagactgtgtgcggaagcaactgaagaaagaacgaccgataattctggacccagcagaccccactttgaacgtggctgaaggttacagatgggatatagtggcacaacgagcgtcacaatgcttgaagcaagattgttgttatgataatcgagagaaccccattagcagctggaacgtcaaacgtgcccgagatattcacctaacggttgaacaacgggggtatccagattttaaccttatcgtgaacccatatgagccgattaggaaggtgaaagaaaagatcagaagaacaagggggtattcggggctacagaggttgtcctttcaggtccccggctcagaaaggcagctgctcagctcgagatgttctctggccaagtacgggattttcagtcacacccacatttacctgcttgaaactatcccctcagaaattcaggtgttcgtgaaaaatcccgacggtgggagctacgcatacgcaatcaacccaaatagttttatcttaggcctcaagcaacaaattgaagaccaacaaggacttccaaaaaagcagcagcagcttgagtttcagggccaggtgctgcaagactggctcggcctcgggatctatggcatccaggactcggacacactgatattgtctaagaaaaagggtgaagctctatttcccgcttcctag

SEQ ID NO: 177291 - DNA, 768 bp, Artificial Sequence
  Description of Artificial Sequence: Synthetic coding sequence
atggccctgatgcaggagctgtacagcacccccgccagccggctggactctttcgtggctcagtggctacaaccccatcgggagtggaaagaggaagttctggacgcagtaaggactgtggaagagttccttcgccaggagcactttcaggggaaacggggccttgatcaggacgtccgggtgctgaaggtcgtgaaagtgggttcgtttggcaatggaaccgtcctacgatccactcgggaagttgaacttgttgcttttctgtcatgctttcactccttccaagaagccgccaaacatcataaggacgttctgaggctgatatggaaaacaatgtggcagagtcaggacctactggaccttgggctggaagaccttaggatggagcagagagtccccgacgctctggtgttcaccatccagacgcggggcacggccgagcccattactgttacaatcgtccctgcctacagagcactcggcccttccctccccaattcccaaccgcctccagaagtgtatgtgagtttaatcaaggcatgcgggggacccggaaacttttgccctagttttagcgaactacagagaaactttgtaaaacaccggccgaccaaactaaagtcactgttgcgactagtgaaacattggtaccagcaagcacatcatcctggatcgggaaggccccacccacaacgcggaagaagggtgcagatggggcatagatgttccgagggattgcccgtgcctgaaaccgggcttctgctatag

SEQ ID NO: 177292 - DNA, 1737 bp, Artificial Sequence
  Description of Artificial Sequence: Synthetic coding sequence
atgcccgacagcaacttcgccgagcggagcgaggagcaggtgagcggcgctaaagttatcgctcaagcccttaagacgcaagacgtggagtacattttcggaattgttgggattcccgtgacagaaatcgctatagcggctcagcagctgggaatcaagtacattgggatgcgcaacgagcaggccgcatgctatgccgccagcgcaatcgggtatctgactagcagacctggcgtgtgtctggtcgtgagcgggccaggtctgatacacgcactcggcggaatggctaatgcgaacatgaactgttggccactgctggtgatcggagggtcatcagagcggaaccaggaaacaatgggggctttccaggagtttcctcaggttgaggcctgccggttgtataccaagttttcagcccgccccagttccatcgaggccatcccctttgtcattgaaaaggccgtgcgcagtagcatctacgggaggcccggggcttgctacgtggatatccctgccgactttgtgaacctgcaggtaaacgtcaacagcatcaaatacatggaacggtgcatgagcccacccatatctatggcggagacctccgcggtttgtaccgcggcgtcagtgataagaaacgccaagcagcccctgctcattatcggcaagggtgctgcgtacgcacacgccgaagagtcaatcaagaagctggtggaacagtataagttgccattcttaccgactcccatgggtaaaggagtcgtgccagacaatcatccctattgcgttggcgctgcaagatcacgcgctctgcagttcgcggatgtgattgttctgttcggcgcccgcttaaactggattctccatttcggcctcccaccacggtaccagccagacgttaaattcatacaggtggacatttgtgcagaagagctggggaacaatgtgaaaccggccgtgactctgctaggcaatatacatgccgtcaccaagcaactcttagaggagcttgacaagaccccgtggcaatacccccctgaaagcaaatggtggaaaacactgcgggaaaaaatgaaatccaatgaagccgcttcaaaagaactggcgtctaagaagagtctgccaatgaattattatactgtgttctaccatgtgcaggaacagttgccgagggattgcttcgtggtctcagaaggggctaacaccatggatattggccgcaccgtgttacagaattacctgccacggcaccgccttgacgccgggacattcgggactatgggagttgggctcggcttcgccatcgcggctgccgttgtagccaaggacaggagtcccggtcaatggatcatttgtgttgaaggagatagcgcctttggattttccggcatggaggtggaaaccatttgtagatataatctacctattattctcctggtggtcaataacaatggcatttatcaagggttcgacaccgacacttggaaggaaatgcttaagtttcaggatgccactgcagtagttcctccaatgtgtctgcttcccaacagtcattatgaacaagtcatgacagcatttggaggcaaggggtactttgtccagactcccgaggagctccagaagagtctgagacagtcccttgcagataccacaaagccctccctcatcaacatcatgatcgagcctcaggccacccgcaaggctcaagacttccactggttgaccagaagcaacatgtag

SEQ ID NO: 177293 - DNA, 1563 bp, Artificial Sequence
  Description of Artificial Sequence: Synthetic coding sequence
atgcccggcagcctgcccctgaacgccgaggcctgctggcccaaggatgtgggcattgtcgcactggagatctacttcccatcacagtatgtggatcaggccgagcttgaaaagtacgacggcgttgacgccggtaaatatactattggtctggggcaggctaaaatggggttttgcactgatagagaggatatcaattcactatgcatgaccgttgtacagaatctcatggagcgaaacaacttgtcatacgactgcatcgggcgcctggaggtgggaacagaaactatcattgataagtcaaaatccgtcaagactaacctgatgcagctttttgaagagtctggtaacactgacattgaaggcatcgacacaactaacgcctgctatgggggcacagccgctgtctttaatgcagtgaattggatagagtcaagttcttgggacggcagatacgccttggttgtggcgggggacattgcggtctacgcgactggcaacgctcggccaaccggaggtgtgggagctgtcgccctgctgattgggccgaacgcccctttgatctttgaacgtggactccgcggcactcatatgcaacacgcgtatgacttttataagcccgatatgctgtctgaatatcctatcgtcgatgggaagctctccatccagtgctacctgtccgctttggaccgctgttacagcgtgtattgcaaaaaaattcatgcccagtggcagaaggagggcaatgacaaggatttcacgctaaatgactttggatttatgatctttcactccccttactgtaagctggttcagaaatctttggcaagaatgctcttgaatgactttctcaacgaccagaatagagataaaaactccatctactctgggctggaggccttcggtgacgtgaagcttgaggacacctactttgaccgggacgttgagaaagcctttatgaaggcctcgagtgagctgttttctcagaagacgaaagccagcttactggtcagtaatcagaatggaaatatgtacacctcatccgtgtacggatcactggcctcagtgctggctcagtatagtccccagcagcttgccggcaaacgaattggggtcttcagctatggttcaggcctggccgctaccctctactctctgaaagtcacgcaggatgcgaccccaggcagcgcgttggacaaaatcactgcatccctatgtgacttaaaaagccgactagacagtaggaccggcgtcgcacctgacgtcttcgctgaaaacatgaaacttcgcgaggatacccaccacctagtaaattacattccccagggctcaattgactcactgttcgaaggaacatggtatctcgtgcgtgttgacgaaaagcataggcgaacttatgcgcggcggccgactcccaatgatgacactctggacgagggagttggccttgtgcactcgaacatcgccacggagcatatcccttctcctgccaagaaagtccccagattaccagctactgcagctgagcctgaggccgccgtgatttcaaacggggagcactag

SEQ ID NO: 177294 - DNA, 1563 bp, Artificial Sequence
  Description of Artificial Sequence: Synthetic coding sequence
atgcccggcagcctgcccctgaacgccgaggcctgctggcccaaggatgtgggcattgtggccctcgaaatttatttcccatcgcagtacgtggaccaggcagagctcgaaaagtatgacggtgtggatgctggtaagtataccattggcctcggacaggccaaaatgggattctgcaccgatcgagaagacatcaactcactgtgcatgacagttgtgcagaatctgatggaaaggaataatttgagttatgattgtataggtcgactggaggtgggaacagaaacaatcatcgacaagtccaagtctgtgaaaacgaatcttatgcaactgttcgaggaatccggcaatacggatatcgaagggatcgataccacaaacgcatgttacggtgggacagccgcggtctttaacgctgtcaactggattgagtcctcttcttgggacggccgttatgcactggtagtggctggagacattgcagtatacgccacgggaaacgcacgccctaccggcggggtgggggccgtggctttgttgattggccccaacgctcctctgattttcgaacggggactcagaggaactcatatgcaacatgcatacgatttctataaacccgacatgctctccgagtatcctattgtcgatggaaagctgagtatccagtgctacttaagtgctctggatcgttgttactcggtgtattgcaagaaaatccacgcgcagtggcaaaaggaggggaacgataaagattttactcttaatgattttggctttatgatatttcacagtccctattgcaagcttgtgcagaagtcactcgcgaggatgctgctgaacgacttcctaaacgatcagaaccgggacaagaacagtatttatagcgggttggaagcctttggcgatgtaaaactggaggacacatactttgatagagatgtggagaaagcctttatgaaagccagcagtgagctgttttcacagaaaactaaagccagtctgctcgtgtccaaccagaatggaaatatgtacacaagctccgtgtacggaagccttgcttcggtgctggctcagtactccccgcaacagctcgcaggaaagcggatcggtgtgtttagctacggctccgggttagccgctacgctgtactcactcaaggtaacccaagacgcgactccgggaagcgcactggataaaatcaccgcctctctttgtgatctgaaatctaggcttgactcaagaaccggagtggcgcccgacgtctttgccgagaatatgaagctgcgggaggatacacatcatctagtgaattacattccacaaggatctatagactcgctgtttgaaggaacttggtatctggtgcgagtagacgagaagcatcggcggacgtacgcccgacgtcctacccccaacgatgacactctggacgagggagttgggctggtccattctaatatcgcaactgagcatatacctagccccgcgaaaaaggtcccgagactgccggcgaccgccgcagaaccagaagcggcggtgatcagcaatggcgaacattag

SEQ ID NO: 177295 - DNA, 291 bp, Artificial Sequence
  Description of Artificial Sequence: Synthetic coding sequence
atgcccggcagcctgcccctgaacgccgaggcctgctggcccaaggacgtgggcattgtggctctagagatctatttcccctcccaatacgtggaccaggcagaacttgagaagtacgatggcgtggatgccgggaagtacacaataggcctcgggcaagcgaaaatgggattctgtacggatagagaggacataaactccctctgcatgaccgtggtacaaaatcttatggagagaaacaatttatcttacgactgcatcggcagacttgaggttggaaccgaaacgtag

SEQ ID NO: 177296 - DNA, 1530 bp, Artificial Sequence
  Description of Artificial Sequence: Synthetic coding sequence
atgcccggcagcctgcccctgaacgccgaggcctgctggcccaaggatgtggggatagtcgcactcgagatttatttcccgagccagtacgtagaccaggccgaactggagaagtatgatggcgtggacgcagggaagtatactatcggcttaggccaggcaaaaatgggtttctgcaccgacagggaggatatcaattccctgtgtatgacggtagtgcagaacttaatggagcgcaacaatctgtcttacgattgtatcggacgccttgaggttggaaccgagaccataatcgataagtctaagagtgtgaagactaacctgatgcagctcttcgaagagtcagggaataccgacatcgaaggaattgacacaacgaatgcagttaactggattgaatcatccagctgggatgggaggtacgccctggtggttgcaggagatattgcggtgtacgccacggggaacgcacgccctacgggcggggtaggggcagttgcactcctgatcggacctaatgcccccctgatcttcgagcgagggttgagagggactcatatgcaacatgcgtacgacttttataagccagatatgctgtcggagtaccctatcgtcgacggaaagctgagcattcagtgctacctgagtgcgctcgatcggtgctattctgtatactgcaaaaagattcacgcccaatggcaaaaggagggcaatgataaagatttcaccctcaacgacttcggcttcatgatctttcactcaccttactgtaagctggttcagaagtctctggcaagaatgctgctaaacgatttcttgaatgaccagaaccgggacaagaacagcatttacagcgggctcgaggcctttggtgatgtaaagctggaagacacctatttcgatcgggacgtcgagaaagcattcatgaaagcaagcagtgagctgttctcccagaaaacaaaggcgagtctgctcgtaagcaatcagaatggaaacatgtatacctccagtgtgtatgggagtcttgcctccgtgctggcacaatactcccctcagcagctagcgggtaagcgtataggagtgttcagctacgggtccgggctggccgcaacactatactctctcaaagtcacacaagatgccacccccgggagcgctctcgataaaatcactgcttcactctgtgacttgaaaagtagactggactcccggactggagtcgcaccagatgtgtttgcggagaacatgaagctgagagaggacacgcatcatctggtcaactacattcctcagggcagtatcgattctctctttgaaggcacatggtatctggtgcgggtcgatgagaaacataggcgaacctatgccaggcggcctaccccaaacgatgataccttggacgaaggtgtcgggttagtgcacagcaatattgccaccgagcatattccctcaccagccaagaaagtgccccgcctgccagctactgctgcggagccagaggctgcagttattagcaatggtgaacactag

SEQ ID NO: 177297 - DNA, 1527 bp, Artificial Sequence
  Description of Artificial Sequence: Synthetic coding sequence
atgcagcggctgctgacccccgtgaagcggatcctgcagctgacccgggccgtccaggagacaagcttaacaccggcccgactgctacccgtagcacatcagagattcagcacagcgagcgctgtacctcttgccaaaaccgatacgtggcccaaagatgttggcattctggctctggaggtgtactttcctgcacagtacgtagaccagactgatctggagaaatataataacgtcgaggccggtaaatacacagtggggctgggacagacaaggatggggttctgctccgtgcaagaggatataaattcactatgcctgacagttgtgcaacgccttatggaacgtattcaattgccctgggacagcgttggccgcctggaagtcggtacggaaacaatcatcgacaagagcaaagcagttaagactgtgcttatggagctttttcaagatagcggaaacacggacatcgagggaatagacacaacaaacgcctgctatggcggaacagcctcactgttcaacgcagcaaattggatggaaagcagctcttgggatggtcggtacgcaatggtggtgtgcggagatatcgctgtataccctagcgggaatgctagacctaccggcggagccggagccgtagctatgctgatcgggcccaaggcccccctggcactggagagagggctccgcggcacacatatggagaacgtgtacgacttctataagcccaatctcgccagtgagtatccaatcgtggacggcaagctttctatccaatgttatctccgtgcactggatcgctgttacacgtcttaccgaaagaaaatccagaatcagtggaagcaagcgggctccgataggccttttaccctggatgacctccagtatatgatcttccatacacccttctgtaagatggtccaaaagtcacttgctagactaatgttcaatgacttcctctcagcttcatccgatacccaaacatcactgtataagggattagaggcctttggaggtttgaagttagaggatacttacaccaacaaggacctcgataaggctctcctcaaggccagccaggacatgtttgacaagaaaaccaaggcgtccctatacctgagtacccataatgggaacatgtacacgagctcattgtatggatgcttagccagcttactcagccaccactcggcgcaggaactggcaggtagtcgcatcggtgcgttttcttacgggagtggtctggccgcttcctttttctccttccgcgtcagccaagacgccgcgcccggatctccactcgataaacttgtatcctcaacatctgacctgccaaagcgactggctagcaggaagtgtgtctctcctgaggagtttaccgaaatcatgaaccagcgcgagcagttttatcataaggtgaatttctcacctcccggtgatacaaactcacttttccctgggacgtggtatctagagcgtgttgatgagcagcatcgccggaagtacgcccgtaggcccgtctag

SEQ ID NO: 177298 - DNA, 1401 bp, Artificial Sequence
  Description of Artificial Sequence: Synthetic coding sequence
atgcagcggctgctgacccccgtgaagcggatcctgcagctgaccagagcggtgcaggaaacttctctgaccccagcacgccttcttcccgtcgctcatcagcggttctccaccgcctccgcagtccctctcgcaaagactgacacatggcctaaggacgtgggaattctagctctggaggtgtactttccagcacagtacgtggaccagactgaccttgaaaagtacaataatgtagaggctggcaagtataccgttggtttgggccagactaggatggggttctgctccgtccaggaagatatcaactctctttgtctgactgtcgtgcagagactcatggagcgcatacagctgccttgggacagcgtgggccgtctggaagtcggtactgagacaattatcgataagagtaaggcagtgaaaacggtcctcatggagctgttccaagattccggcaatacagatatcgaagggattgacacgactaacgcttgttatgggggcacagcaagcttatttaacgctgcaaactggatggagtctagctcatgggacgggcttagggggacacatatggaaaacgtctacgatttctacaaacctaacttggccagcgaatacccgatcgtcgatggcaaattgtccattcagtgttatcttcgggccctcgatcggtgctatacttcgtaccggaagaagatacagaaccagtggaagcaggcagggtccgatagaccatttactctggacgacttgcagtatatgatcttccatactccattttgcaaaatggtccagaagtccctcgccagactcatgttcaatgactttctaagcgcctcatctgacacccagacaagtttatataaaggcttggaggcctttggaggcttaaagttggaagatacgtataccaacaaagacctggataaagccctcctaaaagccagccaagacatgtttgataagaaaactaaggccagcctctacctgagcacccataatggaaatatgtacaccagtagcctttacggatgtctggcttcattgctgagccatcactccgcgcaagagctggctggaagcaggatcggagcattttcctacggcagcgggctagccgcgagcttcttctcctttagggtgtcccaggacgccgcaccaggttcccccctcgacaagctggtgtcgtccacaagtgatctgcctaaaagactggcctcacgaaaatgcgtgtccccagaagagttcaccgaaattatgaatcaacgtgagcaattctaccataaagtcaattttagccctccgggagacacaaactcactgtttcctgggacctggtacctggaacgggtggatgagcagcacagaagaaagtatgcccgccgccccgtttag

SEQ ID NO: 177299 - DNA, 1161 bp, Artificial Sequence
  Description of Artificial Sequence: Synthetic coding sequence
atgggccagcgggagatgtggcggctgatgagccggttcaacgcctttaaacgaaccaatacaatcctccatcacttacgcatgtccaaacatacggacgcagccgaagaggtcttgctggagaagaaggggtgcaccggggtcatcacactgaaccgaccgaagtttctgaacgccttgaccttgaacatgatccggcaaatctatccacaacttaagaagtgggaacaggatcctgagacctttctgattattattaagggcgccggaggaaaagcgttctgtgccggaggtgatattagagttattagcgaggccgagaaggccaaacaaaaaattgcacccgtgttcttccgcgaggagtatatgctcaacaacgccgttggatcatgtcagaagccctacgttgctctgatccatggcatcacgatgggtggcggcgtgggactttcggttcacggacagttccgggtggcgacagagaagtgtctcttcgcaatgcccgaaactgccatagggctttttcctgatgtcggtggcggttacttccttcctcggctgcagggaaaactgggatatttcctggctctcaccgggtttaggttaaagggcagagacgtgtacagggcagggatagccacacacttcgtagattccgaaaagctcgccatgctggaggaagacctgcttgcattgaagtctccctcaaaggagaacatcgcctcggtgcttgaaaactatcataccgagtcaaaaattgatcgagataagtccttcattctggaagagcacatggataaaattaatagctgcttcagcgccaacaccgttgaagagattatcgagaacctacagcaggatggttcatccttcgccctcgaacagcttaaggttatcaataagatgtcccctacctccttgaaaataaccctcagacagctcatggaaggctcaagcaagactttgcaagaggtgctcacgatggagtaccgtttgtctcaggcttgcatgcgaggacacgatttccacgaaggagtgagggccgtgcttatcgataaagaccagtcccccaagtggaagcctgcagacctcaaggaggtgaccgaggaagatttgaacaaccacttcaagtcccttggctcaagtgacctcaagttttag

SEQ ID NO: 177300 - DNA, 1017 bp, Artificial Sequence
  Description of Artificial Sequence: Synthetic coding sequence
atgggccagcgggagatgtggcggctgatgagccggttcaacgcctttaagcggacaaatacaatcttacatcatctgagaatgtccaagcacacagacgcggcagaggaggtcctgctcgagaagaaggggtgcacaggagtgatcaccctgaaccggcctaagttcctgaacgccctaacgctgaatatgattcggcagatttatcctcaactgaaaaaatgggagcaggatcctgagactttcctcattattatcaaaggggcaggaggaaaagccttctgtgcgggtggtgatatacgggtcatctcagaggccgagaaggcgaagcagaagattgcccccgtcttcttccgcgaggaatacatgttgaacaacgctgtaggatcctgccaaaaaccatatgtggcccttatccacggtattaccatgggtgggggcgtgggcctgagcgtgcatggacaatttagggttgctacagaaaaatgtctctttgcaatgcccgaaacagctatagggctgtttccggacgtgggcggcggctattttctgcctaggctgcaaggaaagctaggctattttttagctcttactggcttccgcttgaaagggagggacgtatatagggctggtatcgcgacccattttgtggacagcgagaagctggctatgcttgaggaggatctgttagctcttaagtccccttccaaggagaacattgcaagtgtcttagaaaactatcatacggaatctaaaatagaccgagataagagctttattctggaagagcacatggacaagattaactcatgcttttctgccaataccgttgaggagattatcgaaaacctccaacaagacggctccagttttgccctggagcagttgaaagtgatcaacaagatgagtccgacctccctgaagataactctgcgccagctcatggaagggtcttctaagacgttgcaggaggtgttgactatggagtacagactctcacaggcatgtatgttctag

SEQ ID NO: 177301 - DNA, 117 bp, Artificial Sequence
  Description of Artificial Sequence: Synthetic coding sequence
tgactgatcgacaaggaccagagccccaagtggaagcccgccgacctcaaggaggttacagaggaggacctaaataatcactttaagtcactcggctcctcagatctgaaattctag

SEQ ID NO: 177302 - DNA, 903 bp, Artificial Sequence
  Description of Artificial Sequence: Synthetic coding sequence
atgggcaccctgcccaagcgggtgaagatcgtggaggtgggcccccgcgatggcctgcagaacgagaagaatatcgtgtcaacccccgtcaagattaaactgattgatatgctgagtgaagcgggtttgagcgtgatcgaaaccacgtccttcgtctcgccaaagtgggtgccgcaaatgggtgaccacacagaggtgctgaaaggaattcagaaatttcccggtattaattacccagtcctgacgccaaacctcaagggctttgaggccgccgtcgccgccggggccaaagaggtggtgatcttcggcgcggcaagtgaattatttactaaaaagaatatcaactgcagcattgaagagagctttcagagattcgatgcaatcctgaaagctgcccagtcagcgaatatatccgtgagaggctacgtcagttgcgcactcggatgtccgtacgaaggcaagatctccccagccaaggtggccgaagtgacaaaaaagttctacagcatgggatgttacgaaatatcactgggggacacaattggcgtcggtacccctggcatcatgaaggatatgctgtctgctgtcatgcaggaggtacctctggctgctctggcggttcattgccatgacacgtacgggcaggctctggctaataccttgatggccctccagatgggtgtgtccgttgtggactcttctgttgcgggcctgggcggctgcccctacgcccagggcgcctccggcaaccttgcaacggaggacctcgtatatatgcttgagggattgggcattcacaccggcgtgaatctgcagaaattgttagaagctggtaatttcatatgtcaggctctgaatcggaagacgtcatctaaggtggcgcaagccacctgcaaactttag

SEQ ID NO: 177303 - DNA, 978 bp, Artificial Sequence
  Description of Artificial Sequence: Synthetic coding sequence
atggccgccatgcggaaggccctgccccggcggctggtgggcctggcttccctacgtgccgtttccacctcctccatgggaacactgccgaaaagggttaaaattgttgaggttggccccagagacggcctccagaacgagaaaaatattgtgagcactccggtgaaaatcaagctgatcgacatgctgtctgaggctggcctttccgtgattgagaccactagctttgtctctcctaaatgggtgccgcaaatgggcgaccatacagaggtgctgaagggcattcagaagtttccaggaattaattatcctgtgctcacgcccaatctcaaagggtttgaagctgcagtcgcagccggcgcaaaggaggtcgtgatttttggtgcggcatcagagctgtttacgaagaagaatattaactgctcaatcgaagagtcgttccagaggttcgacgcgatcctgaaggctgctcagagcgcgaatatcagtgtgaggggttatgtttcctgcgcacttggctgtccgtacgaaggcaaaatttcgccagcaaaagttgctgaggtgacgaaaaaattctatagtatggggtgctacgaaatttctctgggggacaccatcggagtggggacaccgggtatcatgaaagacatgttaagcgccgtcatgcaggaggttccactggctgccttggcagtacattgtcatgacacttacggccaggcacttgccaatacattgatggctcttcaaatgggtgtctcagtggtcgattctagcgtagctggcctgggcgggtgtccatatgctcaaggcgcctctggtaatctcgcgaccgaggatctcgtttatatgctggaaggcttaggcattcacaccggggttaatctccaaaagttactcgaggccggcaacttcatatgccaagcactcaaccggaagactagtagcaaagtcgctcaggccacctgcaagctttag

SEQ ID NO: 177304 - DNA, 765 bp, Artificial Sequence
  Description of Artificial Sequence: Synthetic coding sequence
atggccgccatgcggaaggccctgccccggcggctggtgggcctggcaagtctccgtgccgttagtacatcatcaatgggtactctgcccaagcgtgttaaaatcgtcgaggtaggccctcgggatggactgcagaacgagaaaaatatcgtgtccacaccagttaagataaagctgatcgacatgttgagtgaggctggcctatcggtcatagaaaccacatccttcgtcagccccaagtgggtaccccagatgggtgatcatacagaagtactaaagggcatccaaaagttcccaggcataaactatcccgtgctgacccccaacctcaaaggtttcgaggccgctgtaacaaagaagttctacagtatgggttgctacgagataagcttgggtgacacgattggcgtcggaacacctggcattatgaaagatatgttgtccgccgtcatgcaagaggtccctttggccgcactagctgtgcactgtcatgatacttatgggcaagcccttgcaaatacactcatggctctgcaaatgggcgtgtccgtcgtggatagctctgttgctggtctaggaggttgtccttacgctcagggcgcctccggcaatctggctaccgaggacctcgtctacatgctggagggtctgggcattcatacaggagtgaacttgcagaagcttctagaggccggtaatttcatttgccaggctctcaacagaaagactagcagtaaggtagcacaggcaacctgtaagctgtag

SEQ ID NO: 177305 - DNA, 501 bp, Artificial Sequence
  Description of Artificial Sequence: Synthetic coding sequence
atgggcaccctgcccaagcgggtgaagatcgtggaggtgggccccagggacgggctccagaacgaaaaaaacattgtgtcaaccccagtaaaaattaagttgattgatatgctgtcggaggctggactgagcgtgatagaaaccacttctttcgtgagcccaaaatgggtgccacagatgggggatcatactgaggttctaaagggaattcaaaagttccctggtattaattaccctgtgttgacaccaaacttaaaggggtttgaggctgcaatgggagtatccgtcgtggacagctcagtggctgggctcggcggctgcccatatgcccagggtgcctcaggtaacctagcgactgaggacctcgtctacatgctcgaaggcttgggaatccacaccggcgtgaacctccaaaagctgctcgaggccggaaacttcatctgccaggcgctgaacaggaagacatcttccaaagttgcccaggcgacatgcaaactgtag

SEQ ID NO: 177306 - DNA, 1563 bp, Artificial Sequence
  Description of Artificial Sequence: Synthetic coding sequence
atggccgccctgaagctgctgagcagcggcctgcggctgtgcgccagcgcacgcgggagtggggccacttggtacaagggctgtgtgtgctcattctctacctctgcccataggcacaccaagttctacaccgatcctgtggaggccgtgaaggatatcccagatggggcaacagtgctggtgggcggcttcggcctatgcgggattcctgagaacctgatagacgcattgctgaaaacgggcgttaagggcctgaccgcagtctcaaataatgccggcgttgataacttcgggttggggctgttgctgcggagcaaacagatcaaacgtatggtaagcagctatgtgggggaaaacgcagagtttgagaggcagtacctttccggcgagttggaagttgagttgaccccccagggaactcttgcggagcgaattagggccgggggagcgggggtcccagccttttatacacccaccgggtatggaacattagtgcaagaaggcggctcccccatcaaatacaacaaagacggttcagtcgcgatcgctagtaaacctagagaagttcgtgagttcaacgggcagcattttatccttgaagaggccattaccggggatttcgctctcgtgaaggcgtggaaggccgaccgggcggggaacgttattttccggaagagcgccaggaattttaacctgccaatgtgtaaggccgccgaaacaaccgtggttgaagtggaagaaatcgtcgacatcggcgccttcgcccccgaggatatccacattcctcagatttacgttcaccggctgataaaaggcgaaaagtacgagaaaagaattgagcgcttgtcaattcgaaaggaaggtgatggagaggccaagtccgctaaaccaggagatgacgtacgcgaacggatcatcaagagggccgccctggagttcgaggatgggatgtatgccaatttgggaataggtatccccctgctggcaagcaattttatatctcctaacataactgtgcatctgcagagcgagaacggggtcctgggattaggcccttatcctcgacagcacgaggctgacgctgacctaattaatgcaggaaaggaaacagtgacaattctgcctggtgcaagttttttttcctccgatgagtccttcgctatgattagaggagggcacgtggacctgaccatgctgggcgccatgcaggtgtcgaagtacggagacctcgcaaattggatgatccctggaaaaatggtcaaggggatgggcggagctatggacttggtgtcatctgctaagactaaggttgtggtgacaatggagcattctgctaagggcaatgctcacaaaatcatggagaagtgcacacttcccctgaccggtaaacaatgcgtgaatcgaattatcactgagaaggcagtcttcgacgtcgacaagaaaaagggactgaccctaatagagctttgggaagggctgactgtggacgatgtgcagaagtctaccggatgtgattttgcagtctcacccaaattgatgccgatgcagcagattgcgaactag

SEQ ID NO: 177307 - DNA, 1005 bp, Artificial Sequence
  Description of Artificial Sequence: Synthetic coding sequence
atgatggtgcgggagttcaacggccagcacttcatcctggaggaggcaataactggcgacttcgcactggtaaaggcttggaaggccgatagagcgggaaatgttatcttcaggaaaagcgcacggaacttcaacttgccaatgtgcaaagctgccgaaacaacggtcgtggaggtggaagagatcgtggatatcggggcctttgcccctgaggacatccatatccctcaaatatatgtccaccggctgatcaagggagaaaagtacgaaaaacgcatcgagcggctcagtattcgcaaggagggcgacggcgaagcaaaatcagcgaaacctggagacgatgtgagagagcgtataatcaagagagcagctctggagtttgaggacggaatgtatgctaacttggggattggaatcccactcctcgcatcaaattttatcagcccgaacatcactgtgcatctccagagtgagaatggcgtgctcgggctgggcccgtaccctcggcagcacgaggccgacgccgacctgattaacgccggcaaggaaaccgttacgatcctccccggggcttcctttttctcttctgacgaaagctttgcaatgattcgcggcgggcacgtggacctcactatgctcggcgccatgcaagtctccaagtatggcgacctggccaactggatgatacctggcaagatggttaaagggatgggtggcgctatggatcttgtgtccagtgcaaaaaccaaagtggtggtaacgatggaacattcagcaaagggcaacgcccataaaattatggaaaaatgtacactccccttgactggcaaacagtgcgtcaataggattatcacagagaaggctgttttcgacgtagataagaagaagggcctaactctcattgagttgtgggaggggttgactgtcgacgacgttcagaagtcaacaggatgtgatttcgccgtttcaccaaaacttatgccaatgcagcagattgccaattag

SEQ ID NO: 177308 - DNA, 372 bp, Artificial Sequence
  Description of Artificial Sequence: Synthetic coding sequence
atgctgggcgccatgcaggtgagcaagtacggcgacctggccaactggatgatccccggcaaaatggttaagggaatgggtggggcgatggatttagtctcatcggccaagacaaaggtcgtggtgactatggaacactctgccaaaggtaatgcccacaagattatggaaaagtgtacgctgcccctcaccggcaagcagtgtgtcaaccgaataattaccgaaaaggctgttttcgacgtggacaaaaaaaaaggcctgacactgatcgaactgtgggagggacttacggtggatgatgtgcagaagagtaccggctgtgactttgcagtgagccccaagctgatgcctatgcagcagatcgcaaattag

SEQ ID NO: 177309 - DNA, 372 bp, Artificial Sequence
  Description of Artificial Sequence: Synthetic coding sequence
atgctgggcgccatgcaggtgagcaagtacggcgacctggccaactggatgatccccggcaaaatggtgaagggcatgggaggggccatggatcttgtcagcagcgcaaagaccaaagtagtggtaactatggaacacagcgcgaagggtaacgcccacaagatcatggagaaatgtactcttccattaaccggaaagcagtgcgtgaaccggataattacagaaaaagctgtgttcgatgtggacaaaaagaagggcctcaccttgatagagctctgggaaggtctgaccgtggacgacgttcagaagtcgacaggatgtgattttgctgttagccccaaacttatgcctatgcagcaaattgccaattag

SEQ ID NO: 177310 - DNA, 453 bp, Artificial Sequence
  Description of Artificial Sequence: Synthetic coding sequence
agcaacgcctacaaggtggacaacttcggcctgggcctgctgctgaggtcgaagcagattaagaggatggtgtcctcctacgttggggagaatgctgaattcgagcgccagtacctgagtggggagctggaagtcgaattaactccccaggggacacttgctgaacgtatccgagccggtggtgccggagtacccgccttctacacccctacgggctacgggaccctagtccaagaaggcggaagcccaataaagtacaacaaagacggcagtgtagcaatcgcgtcgaagcccagggaagtgagagagtttaacggacagcatttcatcctggaagaggccattactggagattttgctctcgtgaaggcctggaaggctgatcgggcgggaaacgtgatcttccgtaaatccgcccggaattttaatctcccaatgtgtaaagcagcttag

SEQ ID NO: 177311 - DNA, 1131 bp, Artificial Sequence
  Description of Artificial Sequence: Synthetic coding sequence
atgagcaactgcctgcagaacttcctgaagatcaccagcacccggcttttgtgctccaggctgtgccagcagctgcggagcaaaagaaaatttttcgggacagttcctatatcacggcttcacaggcgcgtcgtgataactggaatcggactcgtgacgcctctgggcgtcggtacccacctggtctgggatagactgatcgggggggaatccggcattgtctcgctcgtcggagaggaatacaagtctattccctgttccgtggctgcctatgttcctagaggttcggatgaggggcagtttaacgaacaaaactttgtaagcaagagcgatattaagtctatgtcaagtccaaccataatggccattggagctgctgagttggccatgaaagacagtggatggcacccccagagtgaagccgaccaagtcgctacaggagtggcgatcggcatgggaatgattcctttagaagtagtgtcagaaacggcactgaatttccagacaaagggttacaacaaagtgtcgccctttttcgttccaaaaatcttggtcaatatggcagcaggacaggtatcaattcggtataaattaaagggaccgaaccatgccgtgtcaactgcctgtactactggagcacatgcagtcggagactctttccgtttcatcgcacatggggacgcgggtcatatcaccgcccccgatccggagggagagggagctctgaggtgcatggcggctgccctgaaggatgccggggttcagcccgaggaaatatcgtacatcaacgcgcatgctacctctacgcccctgggggatgctgcagaaaataaagccatcaaacacttatttaaagatcatgcatacgccctcgccgtaagctctaccaaaggggccaccggccacctgttaggggcggctggcgcagtagaggccgcctttacgacactagcatgctactaccagaaacttccaccgaccctgaatcttgattgcagcgaacctgagttcgatctcaactacgttcccttgaaagcccaagagtggaagactgagaagagattcattggcttgaccaactcttttgggtttggaggaactaatgccactctgtgcatcgccggcttatag

SEQ ID NO: 177312 - DNA, 1380 bp, Artificial Sequence
  Description of Artificial Sequence: Synthetic coding sequence
atgagcaactgcctgcagaacttcctgaagatcaccagcacccggttgctatgctcgcggttatgccagcagttgcggagcaaaagaaagttttttggcaccgtgccgattagtcggttacacaggagagttgtcattactgggatcggtctggtgactccacttggagtcggcacccatctggtttgggatcgcctgatcggcggcgagtccggaatcgtgagcctagtgggcgaggaatataaatctatcccatgtagcgtggcggcatacgtgccgagggggtccgatgagggacagtttaacgaacagaattttgtgagcaagagcgacattaagagcatgagctcccctactattatggcaatcggagcggccgagctggctatgaaggattctggatggcatccccagtccgaagcggatcaagttgccacaggggtggcaataggaatgggcatgatccccttggaggttgtatcagagacagcacttaattttcaaacaaaggggtataacaaggtgagcccattcttcgtgccaaagatcctggtgaatatggcggccggtcaggtgtccattcgttacaaacttaaaggcccaaaccatgccgtcagcacagcttgtacgaccggcgctcatgcagttggggactctttcagattcattgcccacggcgatgccgacgtgatggtagctggtgggaccgatagctgcatatcaccactgtcactggcggggttcagccgggcaagagctctctccacaaacagtgaccctaagctggcatgcagacccttccacccgaaaagagatggattcgtgatgggcgagggcgccgccgtattggtcctggaggagtacgagcacgcagttcaacggcgagcccgcatctatgctgaagtgctgggctacgggctctctggcgacgcaggccacattaccgctcctgaccccgagggtgagggcgcgctgcgttgtatggctgctgctttgaaggatgccggggtgcagcccgaggaaatttcttacatcaatgcccatgccacctctactccactcggggatgccgccgagaataaggcgattaagcatctgttcaaggatcatgcctatgctctggcagtgtcttccaccaagggtgctacaggtcacttgctgggtgccgcaggcgccgtggaggccgcctttaccactctggcatgttactaccagaaactgccgcccaccctgaatcttgactgttccgagcccgagtttgatttaaactatgtgccactcaaggcgcaggagtggaaaaccgaaaaacgctttattggccttacgaactcttttggtttcggcggaacaaacgccactctgtgcatagccggtttgtag

SEQ ID NO: 177313 - DNA, 696 bp, Artificial Sequence
  Description of Artificial Sequence: Synthetic coding sequence
atgagcaactgcctgcagaacttcctgaagatcaccagcacccggttgttatgttctcggctctgccagcagcttcggtcaaaacgtaagttttttggcacagttccaatatcacggttacaccggcgcgtggtcataacaggcataggcctggtcacacccctcggagtgggcacgcacttggtttgggatcggctcatcggtggagagtccggtatcgtttcattggtgggcgaggagtacaagagcatcccttgttcagtggccgcatacgttcccaggggctcagacgagggccagttcaatgaacaaaatttcgtctcgaagtccgatataaaatccatgtctagccctaccatcatggccataggggctgccgagctggccatgaaggactccggctggcatccacagtcggaggctgaccaagtggctacaggcgttgccatcggaatggggatgatcccgttggaggtggtttccgagaccgcactgaactttcaaaccaagggatacaacaaagttagcccgttctttgttccaaagatcctcgttaatatggcggccggccaggtgtctatcagatataaactgaaaggcccaaaccatgccgtttctactgcctgcaccactggcgctcatgctgtgggcgattccttccggttcattgcccatggcgatgccgacgtaatgtag

SEQ ID NO: 177314 - DNA, 663 bp, Artificial Sequence
  Description of Artificial Sequence: Synthetic coding sequence
atgagcaactgcctgcagaacttcctgaagatcaccagcacccggctgctgtgctcacgcctttgccaacagctccgtagcaaacggaagttctttggcaccgtgcctatctcacgattgcatcgccgggtagtcataactggaatcggtctggtgacccctttgggcgttgggacccatctggtttgggaccgcctcatagggggagagtctgggatcgtgagcttggtgggcgaagaatataagagcatcccatgcagtgttgctgcgtacgttccaagaggatctgatgagggccagttcaatgaacagaacttcgtgtcaaagtcagatatcaaatccatgagtagccccactattatggccatcggggcggccgaactcgctatgaaggattcaggatggcacccccaatctgaggccgatcaggtggcaacaggagtggcaataggcatgggaatgattcccttagaagttgtgtctgagaccgccttgaactttcagaccaaaggctataataaggtcagccctttctttgtgcccaagattcttgtgaacatggctgccggacaagtttccattcggtacaaactcaagggacccaaccacgctgtatcaacggcttgtacaacaggggctcatgcagtcggagactccttttag

SEQ ID NO: 177315 - DNA, 1875 bp, Artificial Sequence
  Description of Artificial Sequence: Synthetic coding sequence
atggagatccccggcagcctgtgcaagaaggtgaagctgagcaacaacgcgcagaattggggaatgcagagggccaccaatgtaacgtatcaggcccaccatgtcagcagaaataagagaggccaagttgtgggcacaagaggcggattcagaggatgtacggtgtggctaacaggactgagtggggcaggcaaaacgactgtgtcaatggccctcgaggaatacctcgtgtgccacggaattccctgctatacactggacggcgataacatacggcagggtctgaataaaaacctagggttctctccagaggatcgagaagaaaatgtgaggagaatagccgaggttgcaaaactgtttgcagatgccggccttgtgtgcatcaccagttttatttccccatatacccaagacagaaacaacgcccgacagattcatgagggtgcaagcctcccattcttcgaagtgttcgtagacgcccccctccacgtgtgcgaacaacgggacgtgaaggggctttacaaaaaagcccgcgccggcgagatcaaagggttcacgggtatcgactctgaatacgagaagccagaagctcctgagctcgtcctgaaaactgattcctgcgacgttaacgactgtgtacaacaggtagtcgagttactgcaggaaagagatatcgtgccagttgatgcatcctatgaagtgaaggagctctatgttcccgagaataaactccacctcgccaagacggatgcggagacccttcccgccctaaaaatcaacaaggtggacatgcagtgggtccaggtgctagcagaggggtgggctactccccttaatggatttatgagagaacgcgaatacctgcagtgtttgcatttcgattgccttctcgacggaggggtgatcaatctgtcggtgcccatcgtactgacagctacccatgaggataaggagcgcttagacgggtgcaccgcttttgcgctcatgtatgaaggccgccgggtcgcaatcttaagaaaccctgaatttttcgagcataggaaagaggagcgatgcgcacgacagtggggaactacatgcaagaaccatccctacattaaaatggtcatggaacagggtgactggttgataggcggagacctgcaagtgctcgatcgtgtttactggaacgatgggcttgatcagtatagactcacccccacagagcttaagcagaagttcaaggatatgaacgcagatgctgtatttgccttccagctgaggaatccggtacacaacgggcatgctctccttatgcaggacactcataagcagttgctagaaaggggttatcggcgcccagtcctcctgctgcatcccttaggagggtggacgaaggatgatgatgtccctctgatgtggcggatgaaacagcacgctgccgtgctggaggagggcgtactcaaccctgaaacaactgtggtggccatcttcccctcaccaatgatgtacgcaggtcctaccgaagtacagtggcactgtagagctcgaatggtggcaggggcaaatttttacatcgtgggaagagaccccgcaggcatgccgcaccctgagactggtaaggacctgtacgaacctagccacggggcaaaagtgctgaccatggcccccgggctgatcactcttgagattgtcccctttcgggtagccgcctataataagaaaaagaagagaatggactactacgactccgaacaccatgaggacttcgaatttatcagtggcaccagaatgaggaagctggccagagagggtcaaaagcctccagagggatttatggcccctaaagcatggacggtgctcactgagtactacaagtctcttgaaaaagcctag

SEQ ID NO: 177316 - DNA, 1845 bp, Artificial Sequence
  Description of Artificial Sequence: Synthetic coding sequence
atgagcggcatcaagaagcagaagaccgagaaccagcagaagagcaccaatgtggtttaccaggcgcatcacgtatcacgaaacaagagagggcaggtggtgggaacgagaggaggatttcggggctgcacagtctggcttactggtctgagtggggctggcaagactactatttcttttgccctggaagaatacctcgtttcccatgcaatcccctgctattctttggatggggacaatgttagacacggtctgaaccgcaaccttggtttctcccctggtgacagagaagaaaacatccgacggattgccgaggtcgctaagctttttgcagatgcaggcctggtctgcatcacaagtttcatcagcccatttgcgaaggatagggagaatgccaggaagattcatgagtccgccggactaccattcttcgagatctttgtggatgctcccctgaatatctgcgagtcacgtgacgtgaaagggctctacaagagggcaagggcgggcgaaatcaagggattcacaggtatcgactccgattatgagaaaccagagaccccggaacgggttctgaaaacaaacctgtctactgtcagcgattgcgtccatcaagtggtggagctcttacaggaacagaatattgtgccttacactattatcaaggatattcacgagctgttcgtgcctgaaaacaaactggatcatgtgcgcgccgaagctgaaaccctgccatcactgtctattactaagctggacctgcagtgggtgcaggtgctttccgaaggctgggctactccccttaagggtttcatgagagagaaagaatacctgcaggtgatgcattttgacacccttctggacgacggtgtgattaacatgtctattcccattgtgttacccgtcagcgcagaagataagacgcgtctagagggctgttccaagttcgtgttagctcacggcgggcgccgagtggctattctgagggatgctgaattttatgaacaccgaaaggaagagcgctgctctcgagtctggggcaccacctgcacgaagcatccccacatcaagatggtcatggagtccggagactggttggtcgggggagacctgcaggtgctcgaaaaaataagatggaacgacgggctggaccagtaccggctcacacccctggagctgaagcagaagtgcaaggagatgaacgctgacgccgtcttcgcctttcagttaagaaaccccgtgcataacggacatgctctgctgatgcaggatactcgccggcggctgctggaacgaggttataagcatcccgttttgcttttacatccacttggcggctggaccaaagacgacgatgtccctctcgattggagaatgaagcaacatgccgctgttcttgaagaaggggtgctggatcccaaaagtacaatcgtggctatcttcccaagtcccatgttgtacgcaggccctaccgaggtgcagtggcactgccggtccagaatgatagccggcgctaacttttatatagtaggtagggaccccgccggaatgccacatcccgagacaaagaaagacctttacgaacctactcacggagggaaagttctgtctatggcccccggcctgactagcgtggagattattccgttcagggtggccgcctacaataaggccaaaaaggccatggacttctatgaccctgcaagacacaacgaatttgactttatttctggcacgcgcatgcgcaaacttgcccgggaaggcgaaaatccaccggacgggttcatggctccaaaagcatggaaggtgctcaccgattattaccgctcactggaaaagaactag

SEQ ID NO: 177317 - DNA, 1857 bp, Artificial Sequence
  Description of Artificial Sequence: Synthetic coding sequence
agcggcaagaagcaggagaaggaggagaaccagcagaagagcaccaatgtagtataccaggctcaccacgtgagtcgcaataaacgagggcaggtggtgggtacccggggcggatttagaggctgcactgtgtggttgactggactgagtggtgcgggcaagacaaccatttcattcgcattggaggagtacttagtgagccacgccatcccctgctattcccttgacggcgataacgttcgacatgggctgaaccgcaatctaggcttcagccctggcgaccgggaggaaaacattcgtagaatcgcagaagtggccaaactgtttgccgatgccgggctggtatgcattacaagctttatctctcctttcgccaaggaccgtgagaatgctcgcaagattcacgaaagtgcaggactcccgttcttcgaaatttttgtcgatgctccattgaatatttgcgaaagccgcgatgtgaagggcctgtacaagcgggcacgcgccggcgaaatcaaagggttcacaggtatcgatagtgattatgagaaacctgaaacacccgagagagttctgaagacgaacttaagcactgtgtccgactgtgtccaccaggtagtggaacttcttcaggaacagaatattgtaccatacaccatcattaaggacatccacgaactgtttgtccccgaaaacaagcttgatcacgtgagagccgaagcggaaaccctcccgagtttatccatcacaaagcttgacctccagtgggtccaggtactgtccgagggctgggctacaccattaaaaggcttcatgcgcgagaaggaatacctgcaggtcatgcacttcgacacgctattggatggaatgtttctcctggatggagttatcaatatgagcatacccatcgttctacctgtaagcgcagaggataaaacgaggcttgagggatgctcaaaattcgtcctggcgcatgggggccgaagggtggccattctgcgggacgcggaattttatgagcatagaaaggaggagcgatgttcccgcgtatggggtacaacctgtacaaagcacccgcatatcaagatggtgatggaaagcggagattggttggtgggcggcgatctgcaagtattagaaaagattcgctggaacgatggactggatcaatataggttaacaccactcgagctcaaacagaaatgcaaggaaatgaatgcagacgctgtattcgcgtttcagctgcgcaacccggtgcacaacggtcatgctctgctgatgcaggatacacgccgccgcttgcttgaacgcggatataaacaccctgtcctcttgcttcacccactcgggggatggactaaggatgacgacgtgccccttgattggaggatgaaacaacacgccgctgtactagaggagggcgtcctggaccccaagtccacaatcgtggcaatcttcccctctccgatgctctatgccggccctacagaggtgcagtggcactgtcggtctcggatgattgccggcgcaaatttttatatcgtgggaagggatcccgcgggcatgccgcaccctgagactaagaaagatctttacgagcctactcacggggggaaggtgctttctatggcgcctggtttaacgtcagtggagatcattccttttcgcgtagcggcctacaataaggccaaaaaagctatggacttctacgatcctgctaggcacaacgagttcgactttatctccgggacacgcatgcgcaaattggccagggaaggggagaatccacctgacggctttatggccccaaaggcctggaaggtcctgactgattattaccgcagcctggaaaaaaactag

SEQ ID NO: 177318 - DNA, 1857 bp, Artificial Sequence
  Description of Artificial Sequence: Synthetic coding sequence
atgatcgtgctggtgaccgagtgggtggacctgagcctggagaaccaacagaagtccacaaatgtagtgtatcaggcacaccacgtgagtcgaaacaaaagaggccaagtggtcggcaccaggggcggttttcggggctgcacagtatggcttaccggtctctcaggggcgggaaagactacgatatccttcgcattagaggaatacctagtctctcacgctattccctgttattctctcgacggcgacaatgtccgtcacggtctgaaccgcaacctcggattctctccgggcgatcgcgaggaaaacataaggcgaatagcagaggtggctaagctgttcgccgacgcagggttggtatgcatcacttccttcataagcccttttgccaaggaccgcgagaacgctcgtaagatacacgaatccgcaggattgcccttcttcgaaatctttgtggacgctccccttaatatctgcgaatcaagggacgtaaagggtttatataagagagctcgagcaggcgaaattaaagggtttacaggcatagactcagattacgagaaacctgaaacacccgagagagtgctcaaaacaaatctttcaacagtgtccgactgcgtgcatcaagtcgtcgagcttctgcaggagcaaaatatcgttccctacacaattatcaaggacattcatgaattattcgtgcctgaaaacaaactggatcatgtgagggcggaagccgagacactgccttctctctcaatcacaaaactggacctgcagtgggtccaggtgttgtccgaggggtgggctacgcccctgaaggggttcatgagagagaaggaatacctgcaagtaatgcacttcgacactctgcttgacgatggtgttataaatatgtcaatcccgattgtgttgccagtgtccgctgaagataagaccaggctggaagggtgttccaagttcgtgctcgctcacggaggtagacgcgttgcaattctccgcgatgctgagttctatgaacacagaaaggaagagcggtgttccagggtctggggaactacatgcactaagcaccctcatatcaaaatggtgatggagtctggcgactggttggtggggggcgacctacaggtacttgagaagatcaggtggaatgatggactggatcagtatcgcctgactccgcttgagcttaaacagaagtgtaaggagatgaatgcagatgcggtgttcgcgtttcagctgaggaatcccgtgcacaacggtcatgcactcctgatgcaggacacaaggagacgcctgcttgagagagggtataagcaccccgtcctgttactacaccctctaggtgggtggaccaaagatgatgacgtgcccctcgattggcgaatgaagcagcacgcggccgtgctcgaggagggtgtccttgaccccaagagcactatcgtggctatcttccccagccctatgctctacgccggacctacagaggtacagtggcactgtcggtcaaggatgatcgccggcgcaaacttctatattgtgggcagggatcctgcggggatgcctcaccccgagaccaaaaaagatttgtatgaacctacccacggtggaaaggtcctcagcatggcccccgggctcacatcagtcgaaatcatccccttccgagtagccgcttataacaaggcaaagaaagctatggatttttacgatcccgcaaggcacaatgaattcgactttattagcggaactcggatgagaaaactcgccagggagggcgaaaatccacctgacgggttcatggcccctaaggcctggaaagttctgaccgattattatcgaagcttagagaagaattag

SEQ ID NO: 177319 - DNA, 1860 bp, Artificial Sequence
  Description of Artificial Sequence: Synthetic coding sequence
atgagcggcatcaagaagcagaagaccgagaaccagcagaagagcactaacgtagtatatcaggcccatcatgtctctcggaacaagaggggccaggtggtgggaacacgtggcggatttaggggatgcactgtgtggctgacgggactgagcggggcagggaaaaccaccatctcctttgcccttgaagaatatttagttagccatgcaataccttgttattctctcgacggagataatgtgaggcatggactgaacaggaacctcggtttttcgcctggagaccgcgaagagaacatccgacgcatcgccgaggtcgccaaattgtttgctgacgcaggcctggtctgtattacaagctttatctcaccctttgcaaaggaccgagagaacgccaggaaaatccacgaatctgctggactcccgttctttgagatctttgtggacgcccctctgaacatttgcgaatcacgggacgtaaagggtctgtacaaaagggcccgagcaggggagataaagggcttcacaggcatagattccgactacgagaagccagagaccccagagagggttctgaagaccaatctcagtaccgtgtccgattgtgtgcaccaggtagtggaacttctccaggaacagaatattgtgccttatacgattataaaagacatacatgagctctttgtccctgagaataagctggatcatgttcgcgccgaagcagaaaccctgccttctctgagtataacaaagttggacctgcagtgggtccaggtcctgtccgaaggttgggctactcctctcaagggttttatgcgagaaaaggagtacttgcaagtaatgcactttgacaccctgctggacggtatggcactgcccgacggcgtgatcaacatgtcgattcctattgtgctgccagttagcgctgaggataagacccggctcgaggggtgcagtaagtttgtcttggcccatgggggcagacgagtggcaattcttcgcgatgctgagttctatgaacacagaaaggaagagagatgttctagggtgtggggaacaacctgtaccaagcatccccacatcaagatggtgatggaatctggagattggttagtgggaggggacctgcaggtattggagaagatccgctggaatgacggcctggaccagtatagactgaccccgcttgagctgaagcagaagtgcaaggaaatgaatgccgacgctgttttcgctttccagctgcgcaacccagtgcacaatgggcatgctctcttgatgcaggacaccagacgcagattgctggaacgcgggtacaagcaccctgttctgctattacatccgctaggtggctggaccaaagacgacgacgtcccactggattggagaatgaaacagcatgccgccgtgctggaagagggcgtgcttgaccccaagagtactattgttgcaatttttccttccccaatgttgtacgccgggccgacagaagttcaatggcattgtcgatcacgcatgatcgctggggccaacttttacatcgtcggccgggaccccgctgggatgccccatccagaaactaagaaagatctatatgaaccaacacacggtggcaaggtgctgagcatggcccccggcctgacttccgtcgaaatcatcccatttagggtggctgcttacaacaaagctaaaaaagctatggatttttatgaccccgctcgacataacgagttcgattttatctcggggacaaggatgagaaaactggccagagaaggcgagaaccctcccgacggatttatggcaccaaaggcatggaaagtgctcactgattactatagaagcctggaaaagaactag

SEQ ID NO: 177320 - DNA, 1503 bp, Artificial Sequence
  Description of Artificial Sequence: Synthetic coding sequence
atggccagcatgctgctggcccagcggctggcctgcagcttccagcacagctatcggctgctcgtgcccggttctaggcacatctcccaggctgctgccaaggtggacgtcgagtttgattacgacggcccgctgatgaaaaccgaagtaccaggcccgagaagccaagaactgatgaaacagctcaatatcatccagaatgctgaggcagtgcactttttttgtaactacgaggagtccagaggcaactatttggtagatgtcgatggaaaccgaatgttagatctttatagccagatcagttccgtccccattggttattcgcaccccgctttactcaaactgatccagcaaccacaaaatgccagtatgtttgtgaacaggccagctctgggcatactacctcctgaaaacttcgttgagaagcttagacaatccctgctttctgtggcacccaagggcatgtcacagctaattacaatggcctgtggaagttgctccaatgaaaatgcactgaaaacgatttttatgtggtatagatcgaaggagagaggtcagcggggattctcacaggaagaactggagacctgcatgattaaccaggcccctggatgtccggattattctatcctgagctttatgggcgcctttcacgggaggactatgggatgtctcgcaaccacgcattctaaggcgatccataaaatcgatattccatcgttcgactggcccattgctccgtttcctcgcttgaagtatcctctcgaagaattcgtgaaggaaaaccagcaggaagaagcacggtgtttggaggaagtggaagatctcattgtcaaatatagaaaaaaaaagaaaaccgtggctgggattattgtcgagcccatccagagcgaaggcggagacaaccatgctagcgatgatttttttaggaagctgcgcgatatcgcccggaaacacggctgcgccttcttggtggatgaagttcagactggcggcggatgtaccggcaagttttgggcacacgagcattggggactggatgatcccgctgatgtcatgaccttttctaagaagatgatgactgggggcttttttcataaagaagaattccgccccaatgccccttatcggatttttaacacatggcttggcgaccccagtaaaaacctgttgctggctgaagtgattaatataatcaaaagggaggacctgctcaacaacgcggcccacgccggcaaggccctacttacaggcctcctggatttgcaggcaaggtacccgcagtttatcagcagagtaagagggagaggtactttctgttccttcgacactcccgacgactcgataagaaataagctcatcctgattgccagaaacaagggcgtggttctgggtgggtgcggcgataaatctattagatttagacccacactcgtatttagggaccatcacgcacacctctttctgaacatctttagtgatattcttgcagactttaagtag

SEQ ID NO: 177321 - DNA, 1503 bp, Artificial Sequence
  Description of Artificial Sequence: Synthetic coding sequence
atggccagcatgctgctggcccagcggctggcctgcagcttccagcactcataccgtctgctggtccccggctcgcgtcacatctcccaggccgccgctaaggtggacgtggaattcgattacgacggtccactgatgaagactgaagtgccgggaccacgttcccaagaacttatgaagcagctcaacataatacagaatgccgaagcagtgcattttttttgcaattatgaggaaagtaggggaaattacctcgtcgatgtggatgggaatcgcatgcttgacctgtatagccagatctcttccgtgccaatcggatattcacatccagccctcctcaagttgatccaacagccccagaacgcttccatgtttgtgaaccgcccagctctcggaatcctgccccccgagaattttgttgagaaactccgccaatctttactgagtgtggcaccgaaaggcatgtcgcagttaattacaatggcctgtggatcgtgctcaaacgagaacgctctgaagactatcttcatgtggtataggtctaaggagcgaggccagcggggtttcagtcaggaggagctggaaacttgtatgataaatcaggcgcctggttgcccagattactccattctatcctttatgggagctttccacggccgcaccatgggttgcctggcgaccacgcatagcaaagctattcataaaatagatattcctagtttcgattggccaattgccccctttccaagacttaaatacccactggaagagttcgttaaggaaaaccaacaagaagaggctaggtgtctggaggaggttgaagatttaattgtgaaatataggaaaaagaaaaagactgtagctgggataatcgtggaacctatccagtcggaaggaggcgataatcacgcctctgatgattttttccggaagctgcgggacatcgctagaaaacatggctgcgccttcctggtcgatgaagtgcaaaccgggggggggtgtactggaaagttttgggctcatgagcactggggactggatgatcccgccgacgtcatgacattctctaaaaaaatgatgaccggtggtttcttccacaaggaggagttccgccccaacgcaccatacagaatctttaacacatggctaggggacccctcaaagaacctcctcctggccgaggttattaatattatcaagagagaggatctgctgaataatgccgcccacgccggtaaggcactcctaaccggtttgctagatttgcaggcacgttacccccaatttatatcaagagtgcgaggtaggggtactttctgtagttttgacaccccagacgactccattaggaacaaactcattctgatcgccaggaataaaggcgtggtgctgggtggatgcggcgacaaaagcatccgttttaggcctacattggtgtttcgggaccaccacgcgcatctgtttctgaacatcttctctgacattttagcagacttcaagtag

SEQ ID NO: 177322 - DNA, 1503 bp, Artificial Sequence
  Description of Artificial Sequence: Synthetic coding sequence
atggccagcatgctgctggcccagcggctggcctgcagcttccagcactcctaccggctgctagttccagggtcacggcacatcagccaggcagcggctaaagtggacgttgagttcgattatgatggccctctcatgaagaccgaggtacctggcccccggagccaggaactgatgaaacaacttaatatcatacagaacgcggaggccgtccactttttttgtaactatgaggaaagcagaggtaattaccttgtggacgttgacggcaacagaatgctagatctttacagtcagatctcctcagttcctattggctattcacatcccgcgctcctcaagttgatccagcagccccagaatgccagtatgtttgtgaacagacctgccctgggcatccttccaccggagaattttgtcgagaaactgagacagagcttgctgtcagtagcgcccaaaggcatgagccaactgattaccatggcttgtggctcctgctctaatgagaatgcgctaaaaactatatttatgtggtacaggtccaaagaacgcggccagcggggtttttctcaggaggagttagaaacctgcatgatcaaccaggcccccggatgtcccgactattccatcctatcctttatgggtgcctttcacgggcggaccatgggctgtcttgccaccacacattcaaaggctatccacaaaattgacataccaagttttgattggcctatagcccccttcccacgcctgaaatatccactggaagaatttgtgaaggagaatcagcaggaggaagcccgatgcctggaagaagtcgaagacctgattgtaaaatatagaaaaaagaaaaagactgtggccggaatcatcgtagagccaattcagtccgagggcggggataaccatgcctctgatgatttcttccgaaagctacgcgacattgcccgcaagcacggctgcgcctttcttgtcgatgaagttcagacaggtggaggatgcaccggaaaattctgggcacacgagcactggggccttgacgatcctgccgatgtcatgacgttctcaaagaaaatgatgacaggtggattcttccacaaggaagagtttaggcccaatgccccctaccggatattcaatacttggctcggcgatcctagcaagaatctgctgctggctgaggtgattaacatcattaaacgagaggatctattgaataacgccgcacacgcaggcaaagctttgttgacaggattgctggaccttcaggcacggtatccacagttcatctccagagtgaggggaagagggaccttttgttccttcgatacccccgacgactccattcgaaataaactgatattgattgctaggaacaagggagttgtcctgggtgggtgcggggacaagagtatccgatttaggccgacactggtgttccgggatcatcacgcacatctcttcctgaatatcttttccgacattctggccgacttcaagtag

SEQ ID NO: 177323 - DNA, 462 bp, Artificial Sequence
  Description of Artificial Sequence: Synthetic coding sequence
gtggacatggacggcgtgctggccgacttcgaggccggcctgctgcgtgggttcagaaggaggtttcctgaagaaccccatgtgccattagaacaaagacgcggattcctggcacgggagcagtatagagcccttaggcccgatctggcagacaaggtcgcttcagtgtacgaggcccccggatttttccttgatcttgagccgattcctggagccttggatgcagtcagggaaatgaacgacttgccagatactcaggtttttatttgtacctcccctcttcttaagtatcaccactgtgttggcgaaaaggaggagacgcccagctgggaacacattctgtttacatgttgccacaatcgacacttggttctgccccctacaagacgcaggctgctctcctggtcggataactggcgagagatcttggacagcaagaggggcgccgcccaaagggagtag

SEQ ID NO: 177324 - DNA, 606 bp, Artificial Sequence
  Description of Artificial Sequence: Synthetic coding sequence
atggcccggagcgtgcgggtgctggtggacatggacggcgtgctggcggactttgaggccggactgctccgcggtttcagacggcgctttcctgaggaaccacatgttccccttgaacaacgacgcggcttcctggcgagggaacaataccgcgccctgagaccagacttagcggataaggtggcttcggtctacgaagccccaggattctttttggatttagaaccaattccaggcgcgctcgatgctgtcagggaaatgaacgacctccctgacactcaagtgtttatatgcacctcacccctgctgaagtatcaccattgtgttggtgagaaataccgctgggtggagcagcacctcgggccgcagttcgtggaacgaatcatccttacacgggataagactgtggtgctgggagacctattaatagacgataaagacaccgtacgagggcaagaggagactccttcctgggaacacattcttttcacctgttgccataataggcacctagtgctgcctccaaccaggcgaaggctgctctcctggagcgacaattggagagagatattagacagtaaacggggtgccgctcagcgggagtag

SEQ ID NO: 177325 - DNA, 687 bp, Artificial Sequence
  Description of Artificial Sequence: Synthetic coding sequence
atgatccggctgggcggctggtgcgcccggcggctgtgcagcgccgccgtgccggccggtcgccgaggggcagcgggaggtctcggtctggcaggaggtagagcgctccgggttttggtggatatggatggggtgctcgctgacttcgaaggaggtttcctcaggaagtttagggcccggttcccagatcagccttttatcgcgcttgaggacagacgaggcttctgggtttcagagcagtacgggagacttagaccgggactcagcgagaaagccataagcatctgggaatctaagaatttctttttcgagcttgagccccttccaggtgccgtggaggccgtgaaagagatggcttcactgcaaaacacagatgtattcatatgtacctcaccgataaaaatgtttaagtattgcccctacgagaagtacgcgtgggtagaaaagtattttgggccagattttctggaacagatcgttctgacccgcgataagactgtcgtgagtgcagacctccttattgatgaccggcccgatatcacgggcgcggagcccacccccagctgggaacacgtgctgtttacagcatgtcacaatcagcatctgcagcttcagcccccacggagacgtctgcactcatgggctgacgattggaaggccattctggactctaagagaccatgctag

SEQ ID NO: 177326 - DNA, 720 bp, Artificial Sequence
  Description of Artificial Sequence: Synthetic coding sequence
atgatccggctgggcggctggtgcgcccggcggctgtgcagcgccgcagtcccagccggccgacgcggagccgcaggcgggttaggcctcgcaggggggagggctctgcgcgttctggtggatatggacggagtactagccgattttgagggtggatttttgcggaagttccgagcccggttccctgaccagccgtttattgcgctggaggatcgaaggggtttttgggtgtctgaacagtacgggcgtctcaggcccggcctgtcagaaaaggccatcagtatctgggaatccaagaatttttttttcgaattagagcccctgccaggggccgtggaggccgttaaagagatggcctccttgcagaacaccgacgtgttcatctgcacgagccccattaagatgttcaaatattgcccctatgagaaatacgcatgggtagagaaatattttggaccagattttttagagcagatagtccttacacgcgacaagacggttgtgagcgctgatctccttatcgacgaccgaccggatattaccggcaatcagccacctgctggcagtatgtcatccagcccacctgcaacaactagtacttgttcttgttcaccaccagccgctggatgcacaagaggacgcactactggacggccattctggaccgcttcagggccggccgaactggactgcgcttctggaagctctgtggggctgtag

SEQ ID NO: 177327 - DNA, 2853 bp, Artificial Sequence
  Description of Artificial Sequence: Synthetic coding sequence
atgggcgtgcccgccttcttccggtggctgagccggaagtacccctctatcattgttaactgtgtcgaggagaaaccgaaggagtgcaatggcgtgaaaatccccgtggatgcttcaaagcccaaccccaatgatgtcgagtttgacaatctctatctggacatgaatggcatcattcacccctgcacgcaccccgaagacaagcctgcgccaaagaatgaagatgagatgatggtcgcaatcttcgaatacatcgaccggcttttttccatagtcaggccaaggcgcctgctgtatatggcgattgacggcgtggctccgcgggctaagatgaaccagcagagaagcaggagatttcgcgcctctaaagaggggatggaagcagccgtggaaaaacagcgagtcagagaggaaattctggcaaaaggtgggtttctgccacctgaggaaattaaagagagatttgacagtaactgcattaccccaggaacagagtttatggacaatctcgctaagtgcctgagatattacatcgctgaccgcttaaacaacgaccccgggtggaagaatttaactgttattctgtctgacgccagcgctcctggagagggcgaacataagatcatggactatatcagacgacagcgggcccaaccaaaccacgaccccaatacccatcactgcctttgcggagctgacgcagacctgataatgctgggactggcgactcacgaaccgaatttcaccataattcgcgaagagttcaaacctaacaagcctaagccttgcggtctctgcaaccagtttgggcatgaagtgaaggattgcgaaggactccctagggagaagaaaggcaagcacgatgaattggcggattcactgccttgcgccgagggcgaattcatatttttgcgtcttaatgtcttacgcgagtatcttgagcgtgaactgaccatggcctctctgcctttcacattcgatgtggaacgcagtattgatgattgggtctttatgtgcttttttgtcgggaacgattttctcccacacctgccgagtttagaaatcagagagaacgccatagatcgcctggttaacatttacaagaacgtggtgcacaagaccggagggtatctgacagaatcaggatatgtgaatctccagcgggtgcagatgatcatgctggcagttggggaagtggaggactctatattcaaaaagagaaaggacgacgaagatagttttaggcgtcgacagaaagagaagcgaaaacggatgaagagggatcagcccgccttcacaccatcaggcattctgacgcctcacgcgctcggctcccgcaattcaccggggtcacaggtcgcgagtaaccccaggcaggctgcttacgagatgcggatgcagaataactcaagcccatccatttcgcctaacaccagttttacctcggatggaagcccctctcccctgggcggcatcaagcgcaaggcggaagattctgattctgagccagagcctgaagataacgtgcgcctatgggaggccggatggaagcagcggtactataaaaacaaattcgacgtggatgccgccgatgagaagtttagaaggaaggtggtgcagagctatgtggaagggttatgttgggtgctacgctattattatcaggggtgcgccagctggaaatggtattacccttttcattatgcgccgttcgccagcgacttcgagggcattgcggacatgccatccgatttcgagaaaggcaccaaaccttttaaacccctcgagcagctgatgggcgtgtttcccgcagcctctggtaactttctgcctccttcctggcggaaattaatgtctgacccagattcctcaatcattgacttctatccagaagattttgccatagatttaaacggaaaaaaatacgcttggcaaggtgtggcactgttaccatttgtggatgaacgtcgcttgcgcgccgcactcgaggaagtgtaccccgacctgacgccagaggaaacccgaaggaattctctgggcggcgacgttctatttgtggggaagcaccaccccctgcacgattttatcctcgaactataccaaaccgggagcaccgagccagtggaggtgccaccagagctctgtcacggcatccagggaaagttcagtctggacgaagaggcaattcttcccgatcagattgtgtgctctcctgtaccaatgctgcgggatctcacacaaaacaccgtggtgagcataaacttcaaggaccctcagtttgccgaagattatattttcaaggctgtgatgctgcctggtgcacgaaaacccgctgcagtcctgaagccaagcgactgggaaaagtcatctaacggacggcagtggaaaccacagctaggctttaacagggatcgaagacccgtccacctagatcaggccgccttccgaacactggggcacgtgatgcccagggggtccggtaccggaatctattccaacgccgctccgcctcctgttacttatcaggggaacctgtaccgacccctgctgcgaggtcaggctcagatcccaaagctcatgagcaacatgagacctcaagattcatggagaggtcccccccccttattccagcaacaaaggtttgataggggcgtgggtgctgaaccactgctgccatggaatcgcatgctgcagactcagaacgccgccttccaacctaaccagtaccaaatgctcgctggtccaggtggttatccccctagaagggatgatcgaggtggcagacaggggtacccccgggagggaaggaaataccccctacctccaccttcaggtcggtacaactggaactag

SEQ ID NO: 177328 - DNA, 2625 bp, Artificial Sequence
  Description of Artificial Sequence: Synthetic coding sequence
atgatggtggccatcttcgagtacatcgaccggctgttcagcatcgttcgaccaagacgtcttttgtacatggccatagacggagtagcaccaagagctaaaatgaaccagcagcgcagcagaaggttccgtgcatccaaagaggggatggaagcggcagtggagaaacagagagtgcgcgaagagatcttggcgaaaggtggttttctcccaccagaggagattaaagagaggttcgattctaactgtataacacccgggaccgaattcatggacaacctggcaaaatgtctgagatactatatcgcagacaggctcaacaatgacccaggctggaaaaacctgaccgtaatactatccgacgcctctgcacccggggaaggcgaacacaagatcatggattacattcggaggcaaagagctcagcccaatcatgacccgaacactcatcactgcttgtgcggagcggacgccgatctcatcatgctggggcttgctactcacgagcccaattttaccatcattcgggaagaattcaagccaaataagcctaagccttgcggcttgtgcaaccagtttggccacgaagtgaaagactgcgaggggctgccgagggagaaaaagggcaagcatgatgagctggccgattcactaccatgcgccgaaggtgagtttatcttcctgagactgaacgtcctcagggaatacctggagcgggagctcaccatggcctccttgccattcacattcgacgtggagcgctctattgatgattgggtcttcatgtgcttctttgtgggaaacgatttccttccacatctgccttcactggagattcgagaaaacgcgattgacaggctggtgaacatatacaagaacgttgttcacaaaactggcggttaccttacagaatctgggtacgtcaacttacagagagtgcagatgattatgttagcagtgggcgaagttgaagattctatattcaaaaagcgtaaggacgatgaggactcttttaggcgaaggcagaaagaaaagcgcaagaggatgaaacgggatcagccagcctttaccccatcgggcattttaacacctcacgctctcggatcccgcaactccccaggaagtcaagtggcttctaatccaaggcaggccgcttacgagatgaggatgcagaataacagctcacccagtataagccccaacacaagttttaccagcgatggatcccccagccctctgggtgggataaaacggaaggccgaagattcggatagcgagccagagcctgaggacaacgtgagactctgggaagcaggctggaaacaacgttactacaaaaacaaatttgacgtggatgccgcggatgagaagttccgaaggaaagtggtgcaaagctacgtcgaagggctatgctgggttctgcggtactactaccagggttgcgcctcttggaagtggtattacccctttcactacgctccttttgcaagcgacttcgagggcatcgccgacatgccaagtgactttgagaaaggaacaaaaccgttcaaaccccttgagcagctgatgggcgtgtttcccgctgcgtctggtaacttcctgccaccctcttggaggaagctcatgtctgaccccgactcctctatcatagacttctatccagaggatttcgctatcgatctcaacggaaaaaagtatgcttggcaaggcgttgctctgctgcctttcgtcgacgagcgacggctgagagccgctctcgaggaggtgtatcctgacctgactcccgaggagactcggcgaaactcactgggaggagatgttctgtttgtggggaagcatcatccgctgcacgactttatacttgagctttaccagacaggatctaccgagccggtcgaggttcctcccgagctgtgccatgggatccagggcaagttttcgctggacgaagaggctattctgcctgaccagattgtctgttctccggtccctatgctcagagaccttactcagaataccgtcgtaagcatcaactttaaggacccgcaattcgccgaagactatatctttaaggccgtgatgctgcccggcgcccggaaaccagctgcagtccttaagcctagcgattgggaaaaatcttctaacggccgacagtggaaaccccaactcgggttcaatcgagacagaagaccagtgcacctggatcaagcagcttttaggactttggggcacgtgatgcctcgaggctcgggtaccggaatctactctaacgctgcgcctcctcctgtgacgtaccaaggtaacctctatcggcctctgcttagagggcaggcgcagatacctaaacttatgagcaacatgaggccccaggacagttggcgaggcccacccccactgtttcagcaacagcgctttgaccggggcgtcggagctgagccactactaccttggaatcgcatgttgcagacacaaaatgccgcctttcagcccaatcagtatcagatgttggcagggccgggcggatatcctccccgacgtgacgatcgcgggggtagacagggctacccccgcgaggggcggaaatacccactcccccctccaagtggacgttacaactggaactag

SEQ ID NO: 177329 - DNA, 2691 bp, Artificial Sequence
  Description of Artificial Sequence: Synthetic coding sequence
atgaacggcatcatccacccctgcacccaccccgaggacaagcccgccccaaaaaatgaagatgaaatgatggtcgcgattttcgagtatattgatcggttattttcaatcgtgagacccagaaggctgctgtacatggcaatcgacggggttgcaccaagggcgaagatgaatcaacagcgatccaggcgctttcgagcctctaaagaaggaatggaagccgccgtggaaaagcagcgtgtgagggaggaaattctggcaaaaggcggttttctgccccctgaagagataaaggaaagattcgatagcaactgtatcacgcctggtactgaatttatggataacctggccaaatgtctgagatattatatcgctgaccggttgaacaatgaccccgggtggaagaaccttaccgttatactaagcgatgctagtgctcccggggagggagagcataagataatggactatattcgccggcagcgggctcagccaaaccatgatcccaatactcaccactgtctatgtggagctgacgcagacctaatcatgttaggacttgccacacatgagcctaactttacgatcatccgagaggagtttaagcccaacaaacccaagccctgcggcctctgtaatcaattcggccatgaggtcaaagattgcgaaggacttcctagggaaaagaaaggtaagcacgacgagcttgccgacagtttgccctgtgctgagggggagttcatcttcctacggctgaatgttctgcgcgagtatctggagagagaattaacgatggccagtcttccgttcacttttgacgttgagcgctcaattgatgattgggtattcatgtgttttttcgttgggaatgactttcttcctcatttaccttctctcgagatcagggaaaacgccatcgatcgtctggtgaatatctataagaacgtagtacataagactggcggatatctgaccgagtccggttatgtgaatttacagagggtccagatgatcatgctggctgtgggagaggtcgaggatagtattttcaaaaaacgcaaggacgatgaggatagttttaggcgccgccagaaggaaaaaagaaagaggatgaagcgggatcagccggcattcactcccagtggcatcctaacgccccacgccttgggcagcaggaatagtcccggaagccaagtggcaagtaacccgcggcaggctgcctacgagatgagaatgcaaaacaattctagtcctagcatttccccgaacacttcatttacatccgatggctcaccctcaccgctgggcgggatcaaaaggaaggccgaagacagcgacagcgagccggagccagaagacaatgtaagactttgggaagccgggtggaaacaacgatattataagaataagtttgacgtcgacgcggctgacgagaagttccggcggaaggtcgtgcagagctatgttgagggattgtgctgggtcttgaggtactattaccagggatgcgcgtcttggaaatggtattacccgttccactatgctccgtttgctagcgacttcgaagggatagctgacatgccatccgattttgaaaaagggactaagccctttaagcccctggaacaattaatgggcgtgtttcccgccgcctccgggaactttctgcctcctagctggcggaaattgatgtccgatcctgacagttccattattgacttctatccagaggactttgctatagatctgaatgggaagaaatatgcatggcagggcgtcgcactgctgccattcgtggatgagcgtagactgagagcggccctggaggaagtgtatccagatctcacccccgaggagacacgacgcaactcgcttggcggggatgtcttgtttgttgggaaacatcaccccctgcatgatttcattctcgaactgtaccagacaggaagcacagagcccgtggaggtaccacccgaactttgccatggtattcagggaaagttttccctcgatgaggaagctatcctgcctgaccagatcgtttgttctcctgtccccatgttgagagacttaacacagaacacggtcgtgtctatcaactttaaggatccccagttcgcagaagactatatcttcaaggcagtgatgttgcccggagctagaaagcctgcagctgtgcttaaaccctccgattgggaaaaatccagcaatggtaggcagtggaagccccagttgggtttcaatcgggatcgcaggccagtgcatcttgaccaggcagctttccgcaccctgggacatgtgatgccgagggggagtggcacagggatttattcgaatgccgcccccccacccgtaacataccagggaaacctatacaggcccctgctccgtggtcaagctcagatccccaagctgatgtcaaatatgaggccccaggactcttggagagggcctccgcctctgtttcagcaacagagatttgacagaggcgtaggggccgagcctctactgccttggaataggatgctccagacccagaatgccgccttccagccaaaccagtatcagatgctggccggccccggtggctatcccccccgccgtgacgacaggggcggtcggcagggttacccacgagagggaaggaaatacccgctgccccccccgtccggccgctacaattggaactag

SEQ ID NO: 177330 - DNA, 1779 bp, Artificial Sequence
  Description of Artificial Sequence: Synthetic coding sequence
atggcccccggccagctggccctgttcagcgtgagcgacaagaccgggctggttgagtttgcgaggaacctgaccgctcttgggctgaacctggtggccagcggcggaactgctaaagccctgcgtgatgccggtctcgccgtccgggacgtaagcgagctcacaggcttcccggaaatgctgggagggagggtgaaaaccttgcatcctgccgttcatgcgggcatcctggccagaaatatccccgaagacaacgcagatatggcaagactggatttcaatctgatccgggtcgtggcatgcaatttgtacccctttgtgaaaacagtggcatctcccggcgtgacggtggaggaagccgtggagcagatcgacattgggggggtcacattgctgcgggcagctgccaaaaatcatgcacgggttaccgtggtttgcgaacctgaagactatgtggttgtcagcactgagatgcagtcatccgagtctaaagatacctcacttgaaacacgcagacaactcgctctgaaggccttcacacacacggcccagtatgacgaggccatctcagactattttaggaagcagtactcaaagggggtgagtcagatgcctctccgctatggaatgaatccccaccagacaccagcccagctgtacactctccagcccaagttgcccattaccgtcttgaacggcgcacccggattcataaacctctgcgatgctctgaacgcctggcagttggtcaaggagcttaaagaagcactcggaatcccggccgctgcttcctttaaacacgtttcaccggcaggcgccgccgttgggatccccctgagtgaagatgaggccaaagtttgcatggtgtacgacttgtataaaacactgacacctatcagcgcggcctacgcccgcgctcgcggagctgaccgcatgtcctcctttggggattttgtcgccctatccgacgtttgtgacgttcccaccgctaagataatctcccgggaggtcagtgacggcataatcgcccccggctacgaggaagaagcactgacaatcctgtctaagaaaaagaacgggaattattgcgttttgcaaatggaccaatcttataaacctgatgagaatgaggtgcgtacactgttcggactgcacctgagtcagaagcggaataacggtgtcgtggataagtctcttttttctaacgtcgttactaagaataaggacctccctgagagcgcccttcgagacctgattgtggctaccatcgctgtgaagtatacccagtcaaatagtgtgtgctatgccaagaacggtcaggtgattggtatcggggccggtcagcagtcaagaattcactgcacccgactggctggggacaaggccaactactggtggcttagacaccacccacaagttctcagcatgaagtttaagaccggggtgaaacgagccgaaattagtaatgctatcgaccagtacgtgacaggaacaattggagaggacgaagatttaattaaatggaaggcgctgtttgaggaggtgcccgagctgctaactgaggctgagaaaaaagaatgggtggaaaagctgactgaggtctcaatatcctccgatgccttctttccatttcgcgataacgtggatcgcgccaagcgctcaggggtggcctacattgccgccccatctggttccgccgctgataaggtcgtgattgaagcttgcgatgagctgggcattattttggcacataccaacctacgccttttccatcattag

SEQ ID NO: 177331 - DNA, 1602 bp, Artificial Sequence
  Description of Artificial Sequence: Synthetic coding sequence
atgctgggcggccgggtgaagaccctgcaccccgccgtgcacgccggtatcttagctcgcaacattcccgaggacaatgccgatatggcccgtctggatttcaatctcatccgcgtcgtggcctgcaacctttacccgttcgttaagactgtagcctcccctggcgttactgtcgaagaagctgttgagcagatcgatattgggggcgtcacgctgctccgtgctgccgcaaaaaaccatgcccgtgtgaccgtcgtgtgcgagccagaagactacgtggttgtgagcacagagatgcagtcatccgagtctaaagatacgtctttggagacgcgccggcagctggctctgaaagccttcacacatacggcacaatacgatgaagccatctcagattactttcgcaagcaatatagcaagggcgtgtcccagatgccacttcggtatggaatgaacccgcaccagacccctgcccagctgtataccctccagccaaaactgccaatcaccgtgctgaatggggcacctggctttatcaacctgtgcgacgcactgaacgcgtggcagctggttaaggagcttaaggaagccttgggaatacctgctgccgcaagcttcaagcacgtatcacctgccggagccgccgttggcatcccgttgagcgaggatgaagccaaagtttgcatggtttacgatctttacaagacccttacccctatctccgccgcatacgctagggctcgcggtgcggacaggatgtcttctttcggcgattttgtggcactcagcgacgtatgtgatgttcctaccgcaaagattatctctcgcgaagtatccgatggaattatagcgcctggatacgaggaggaagctctcacgattctcagtaaaaaaaagaatggcaactattgcgtcttacaaatggatcagtcttataaaccagacgaaaatgaggtaaggaccctgtttgggctccatctcagccagaaaaggaacaacggagtggtcgataagtcattgttttcaaacgtcgttacaaagaacaaagacttgcctgaaagcgcactgcgggacctgatcgtggccacaatcgccgttaaatatacccagtccaactctgtgtgttatgctaagaacggccaagtcattggtataggggcgggacagcaaagccgaattcattgtacccggctagctggcgacaaagctaactattggtggttgcgtcaccaccctcaggtcctgtccatgaaattcaaaacaggggttaagcgggccgagatcagcaacgccattgaccagtatgtgaccggtaccatcggggaagatgaagacctaatcaaatggaaggctctctttgaagaagtccctgaactgctcacggaagctgagaagaaggagtgggtcgagaagctgactgaggtgagtatctcctctgatgctttttttccctttcgcgacaacgtggatagggctaagcgttctggggtggcatatattgccgcaccatcagggtcagccgcagataaggtggtgattgaggcttgtgacgaactgggtatcatcttagcccatactaaccttcggctgtttcatcactag

SEQ ID NO: 177332 - DNA, 3252 bp, Artificial Sequence
  Description of Artificial Sequence: Synthetic coding sequence
atgaagggcacccgggccatcggcagcgtgcccgagcggagccccgctggggtggacctgtccttgaccggattgcctccccccgtctcaaggaggcctgggtctgcagccacgacaaagccaatcgtccggagtgtgtccgtggtcaccggttcagaacagaaacggaaagtactggaggcgactggccccggggggtcccaggctatcaacaatttgaggcgctccaattccacaacgcaggtgtcacagccaagatccgggagtccacgcccaacagagcctacagattttctcatgctgttcgagggctctcccagcggaaagaaaaggcccgcctcacttagcacagccccatcagaaaagggcgctacatggaatgtgctggacgatcagccaagggggtttacacttccctctaacgctaggagtagtagcgcccttgattcacctgcaggcccacgacggaaagagtgcacagtggccctggcacccaacttcacagccaataaccgctctaacaagggggctgtgggcaactgtgtaaccaccatggtacacaacagatatactccaagtgagagagccccaccgctcaagtcaagcaaccagaccgctccctcactcaataacattataaaagccgccacttgcgaaggcagtgagtcctccggattcggaaagctcccaaagaacgtttcttctgcaacccacagcgcccgaaacaacactggcggatccacaggccttccccggcgaaaggaggtgaccgaggaggaggccgagcggttcatacatcaagtcaaccaagcaaccgtaacaatacaacgttggtaccggcatcaagtgcagaggcgtggggcaggtgcggccaggttggagcatctgttacaagcaaagcgggaggagcagagacagcgcagtggcgagggcacattattagaccttcatcaacagaaagaggccgcccggaggaaggcaagggaagagaaggcgaggcaggcgaggcgggccgcaattcaggagcttcagcaaaaacgagccttaagggcccagaaggctagcactgccgagcgtggaccccctgagaatccgcgggaaacgagggttccggggatgcgccagccagcccaggagctgtctccaacccctggtggtactgcccaccaggctctaaaggccaataacaccgggggtggattgcctgccgctggacctggcgacaggtgcttaccaacatccgactcatcaccagagcctcagcagccccctgaggataggacccaggacgttctagcccaagatgccgctggcgacaacctagagatgatggctccttccagaggatccgctaaatccagaggaccgctcgaagaattactccatacactccagcttctggaaaaggaaccggacgtcttaccgagaccaagaactcatcacagaggacggtacgcctgggccagcgaggtgaccactgaggatgacgcttcctctctgactgcggataatctcgagaagtttggcaagctatctgcatttcccgagccgcccgaagatggcacccttctgtctgaagccaagctccagagcatcatgtctttcctagacgaaatggagaaaagcggtcaggatcagctggattcccagcaagaaggatgggttccagaggccgggcccggtccactggagctcggatccgaggtttcaacttccgtgatgagactcaagcttgaggtggaggaaaaaaaacaagcgatgctattgctccagcgggcgctagcccagcagcgggatctgacagctcggcgggtcaaagagactgagaaggcactgtctcggcaactacaaagacaacgggaacactatgaggcgacaattcagcgtcatctggcatttattgaccagctgatcgaggataagaaagtcctctccgagaagtgcgaagccgtcgtggcagagctgaagcaggaagaccagagatgtacggagagggtggctcaggcacaggctcagcacgaactcgagattaagaagctgaaagagctcatgtccgctacggaaaaagcccggcgcgaaaagtggatttcagagaagaccaaaaaaataaaagaggtaacggtgagaggacttgagcccgagatccagaagttaattgccaggcataaacaggaggttcgcaggctgaagtcactgcatgaggcagagcttttgcagtcagatgaacgtgcgagtcagcgatgcctgcgccaggcagaagaactgagggaacagttggagagggaaaaggaagcactgggccaacaagagcgagagagagcacgccagcgcttccagcagcatctggagcaagagcagtgggcactgcagcagcagcggcagcgattatacagcgaagtggctgaggagcgagagcgtctggggcagcaggccgcccgccagcgtgcagagctcgaagaacttcgacagcaattggaagaatcttcctctgccctgactcgtgcactccgcgccgagtttgaaaagggccgggaggaacaggaaaggagacatcaaatggaactgaataccctgaaacagcagctggagctggaaagacaggcttgggaggccggacgaaccaggaaagaagaggcttggcttcttaatagggagcaagaactacgggaggaaatccgcaaaggcagggataaggagatcgaacttgtgattcaccgcctcgaagcagatatggccctcgcaaaagaagagtccgagaaggcggcggagtctagaattaagagactgagggataaatacgaggccgagctgagtgagctggaacaatccgagcggaagctgcaagaaaggtgcagcgaattgaagggacagctgggtgaggcagagggcgagaacctccggctccagggtctagtccgccaaaaggagcgggccttggaggacgcccaagctgtgaatgagcaacttagctcagaacgttcgaatttggcacaggtcatacgacaagaattcgaggatcgacttgccgccagtgaagaggagacccgtcaggcgaaggcagaactggcgactctccaggcccggcagcagttggagcttgaggaggtccacagacgtgtcaagactgctcttgcccggaaggaggaagccgtgtcaagcctgagaactcagcatgaggccgcggtgaaaagagccgaccacctggaggagctgctggaacagcacaggaggcccaccccctcaacgaagtag

SEQ ID NO: 177333 - DNA, 3135 bp, Artificial Sequence
  Description of Artificial Sequence: Synthetic coding sequence
atgaagggcacccgggccatcggcagcgtgcccgagcggagccccgctggggtggacctctccctcactggactgccacctccagtgagtcggagacccggatcggctgctaccacgaagcctatcgtgagatctgtgtccgtcgtgaccggctcagagcagaagaggaaagtcctggaagccaccgggcccggaggttcccaagcaataaacaatctccgccgcagcaactccactactcaggtgtctcaaccacgttcagggtcccctcgaccaacagaaccaaccgattttcttatgcttttcgaaggtagcccctccggcaaaaaacggccagcttccctgtcaacagcacccagtgaaaagggcgccacctggaacgtcctagatgatcagccaaggggctttaccctgccctcaaacgcccgatctagctccgcactggactcccccgcggggcctcgccgaaaggaatgtactgttgctctggccccaaattttacagcaaacaatcgctccaataaaggtgccgtgggcaattgcgttaccaccatggtgcacaatcgctacacaccttccgagcgggccccacccctgaagtcttctaatcagactgccccaagcctgaataatatcattaaagccgccacatgcgaaggatccgaaagtagcggcttcggcaaattgcccaagaatgtgtccagcgccacccacagcgcgaggaacaacacgggaggctcaaccgggctgccacgccgcaaagaggtgacagaggaggaggctgagaggtttattcaccaggtgaatcaggctaccgtcaccatccagcggtggtacaggcatcaggtacagcggaggggagcgggggctgcccggctggagcacctgcttcaggcaaaacgtgaagagcaacggcaaaggagcggtgagggcaccctcctcgatcttcaccagcagaaagaggccgcccggcgaaaggcacgcgaggagaaggcaaggcaggctcggcgcgccgccatccaggagttgcagcagaagcgcgcgcttagggctcaaaaggccagcaccgcagagcgcgggccacctgaaaacccgagggaaacaagggtcccaggtatgagacagcccgcccaggaactaagccctacaccaggaggcaccgcacaccaggccttgaaggccaacaacaccgggggcggcctgcccgctgccggcccaggcgataggtgtctacccacttccgactcatctccagagccgcagcaaccgcccgaggatagaacccaggacgtgttagcccaggacgctgccggtgataatctcgagatgatggcaccttccagaggctccgcaaagtcgcgcggacccctggaagaactgctccacaccctgcagctgttggagaaagagcccgatgttctcccaagaccaagaactcatcataggggcagatacgcctgggcatctgaagaagacgacgccagctctctcacggctgataatctagagaagtttgggaagctgtcggcatttccagaaccacccgaggacggaaccttgctgagcgaagctaagctgcagtcaattatgtcctttctggatgagatggaaaaatcgggacaggatcagctggactcccagcaggaaggctgggtccctgaagcggggccggggcccttagaactggggagcgaagttagtacatccgtgatgcgtttgaaactggaggttgaggaaaaaaagcaggctatgctgctactccagagagctctggcgcagcaacgcgatctaaccgctagaagggtgaaggaaactgagaaggcactgtcccgacagctccagcgccagcgcgaacattacgaggccactatccagagacatcttgcctttatcgaccaattgatcgaagacaaaaaggtgctcagtgagaagtgcgaggccgtggtggctgagttgaagcaggaagaccagcggtgtaccgagcgagtcgctcaggcccaggctcagcatgagctggaaatcaaaaaactgaaggaacttatgagtgccactgaaaaggccaggcgggagaaatggatcagtgagaaaaccaaaaaaatcaaggaggttacggtacggggcctcgaacccgaaattcagaagcttatcgctagacacaagcaggaggtgcggagactgaagtccttgcatgaggctgagctcctacagagtgatgagcgggcttcacagcggtgtctgcgccaagccgaggaattacgcgaacagctggaacgcgagaaggaggcactggggcagcaggagagggagcgggccagacaacggcagcgtgctgagctggaggaactgcgtcagcagttggaggaatcatcttcagctctgaccagagctctcagggcagaattcgaaaaaggacgcgaggagcaagagcggagacaccaaatggaactcaacaccttgaaacagcaactggaactagagcgccaagcctgggaggccgggcgtacacgtaaggaggaagcatggctgctgaatagggaacaggaactcagggaggagataaggaagggacgcgataaggagattgagttggtgattcaccgcttggaggccgatatggccctggctaaggaggagagtgagaaggccgctgagtcgcggataaaacgtctgcgagataagtacgaagctgagctttccgaactggagcagagcgaacggaaactacaagagaggtgtagcgagttgaagggacagctcggtgaagccgagggtgaaaaccttcgcttacaaggcctcgtgcgtcaaaaagagagagctttggaagacgcacaagccgtgaatgaacagctctcgtccgagcgctccaatctagctcaagttattagacaggagtttgaggatcgactggccgcctctgaagaagaaactcggcaggcaaaggcagagctggctacattgcaggcgcgtcaacagctcgaactggaggaagtgcatcggcgtgtgaagaccgcattagcgaggaaggaggaggcggtgagttcattgcgtacacagcacgaggcagccgtgaagcgagccgatcacttagaagagctgctagaacagcaccgtagacccacccctagtaccaagtag

SEQ ID NO: 177334 - DNA, 3243 bp, Artificial Sequence
  Description of Artificial Sequence: Synthetic coding sequence
atgaagggcacccgggccatcggcagcgtgcccgagcggagccccgcaggcgtcgatctgtcactgaccgggcttccacccccggtgagcaggcggcccggttccgcggccactactaagccaattgtgcgaagcgtgagcgtggtgacagggtctgagcagaaacgtaaggtcctggaggcaacaggacctggaggctcccaggccatcaacaacttgcgaaggtctaatagcacgacccaggtgagtcagccaagatcaggctcaccaaggcccacggagccaacagacttcctgatgctcttcgagggttctccctcaggtaagaaacggccggcttccttgagcaccgccccttccgaaaagggtgccacctggaatgtactcgacgatcaacctcggggattcacactgccctccaacgcccggtccagctccgctctggactcgcccgcggggccgagaagaaaggaatgtaccgtggcattggctcccaattttaccgcaaataataggtccaataaaggggcagtgggcaattgtgtcaccaccatggtgcacaaccgctacactccatctgagagggcgcctcctctgaagagcagcaatcagaccgctcccagccttaataatatcattaaagcggccacttgtgaggggagtgagtccagcggatttggcaaactgcccaagaatgtttcctcggctacccatagcgccaggaacaacacaggcgggagcactggcctgcccaggaggaaagaagtaacagaagaggaagcggagaggtttattcatcaggtaaatcaggccaccgttactatccagcgatggtacagacaccaagtacagcgtagaggagcgggcgcagctagactggagcatctactgcaagccaagagagaggagcaacgacagaggagcggcgaaggaacactattagacctgcaccagcaaaaagaggccgctcgcagaaaagccagggaagagaaggcaaggcaggcccggagagccgctatccaggagctccagcagaagagggcactgcgcgctcagaaggcgagtacagctgagcgtgggccacctgaaaatcctcgcgagacacgcgtgcccgggatgcggcagccagcacaggagctcagtccaactcccggcggaacagctcatcaggctttaaaggcaaacaataccggcggtggcctgccagccgccggccctggggaccgctgccttcccacgtcagactccagccccgaaccccagcagccacccgaagatcgcacccaggacgtgctggcccaggacgcagctggcgacaacttggagatgatggctcctagccgtggctccgccaagtccaggggcccccttgaggagctgctccacacactacaactgcttgaaaaagaacccgatgttctgcccagaccccgaactcatcaccgcggccgttatgcttgggcttctgaggaggacgatgccagctctttgacagcggataacctggagaaattcggtaagctgagtgcgttccccgagccacctgaggacggaaccctgctgagcgaggctaagctgcagtcaatcatgagttttctggacgaaatggagaagtcgggacaggaccagctggatagccagcaggagggatgggtgcccgaggcagggcctggccctctggaactcggaagtgaagtgagcacttccgtgatgcgcctaaaactcgaggtggaagagaagaaacaagccatgttgcttctccagcgcgcgttggctcagcagcgggatttgaccgcacggagagtgaaggagaccgagaaagccctgtcgcgacagcttcagagacagcgggagcattacgaagccacaatacagcggcacctggcctttatcgatcagctcattgaagataaaaaggttctaagcgagaaatgcgaggctgtggtggcagaattgaagcaggaggaccagaggtgcacagagagggttgctcaggcccaggctcagcacgaactcgaaattaaaaaactcaaagagttgatgtctgcaaccgagaaggcccgaagggagaagtggatctccgagaaaaccaaaaaaattaaggaagtaaccgtcagaggcctcgagccggaaattcagaaattaattgctagacataaacaggaagtgcggagactgaagagccttcacgaggctgagctcctgcagagcgacgaacgtgccagccagcgttgcctccggcaggctgaggagctaagagaacagcttgaaagagagaaggaggctctgggccagcaagagagggagcgtgcaagacagcggtttcagcagcaccttgagcaggaacagtgggccttgcagcagcagagacaacggctctattccgaggtggctgaggagagggagcgactgggtcagcaggctgccaggcagagagcagagttagaggagctgcggcaacaattggaggaaagttctagcgcgctcacccgtgcactgcgggccgagttcgagaaaggacgtgaggaacaagagcggcgacaccagatggagctaaacaccctgaagcaacagctggagcttgaaagacaggcatgggaagccgggcgaactaggaaggaagaagcgtggctcttaaatcgggaacaggaactgagggaagagattaggaaggggagggacaaagaaatcgagctcgtcattcacagattggaagccgacatggcactggctaaggaagaaagcgagaaagctgccgaatctcgcatcaaaagattgcgagataagtatgaagcagaactctcggagctcgaacagagcgagcggaagcttcaagagcggtgctccgaacttaagggccagctgggcgaagcagaaggcgaaaacctccgtcttcagggtctcgtccgtcagaaggaaagggccttggaggatgctcaggctgttaacgagcagctctcctccgaacgaagcaacctggcccaggtcattcggcaggaattcgaagaccggctggcggctagcgaggaggaaacgcggcaggcaaaagccgaactggccaccttgcaggcaagacagcaacttgaattggaggaggttcataggcgggttaaaaccgctttggcccggaaggaggaggcagtatcgtctctgagaacccagcatgaggccgccgttaagcgtgccgatcatcttgaggaactgctggaacaacacagacggccgacaccttccacaaaatag

SEQ ID NO: 177335 - DNA, 699 bp, Artificial Sequence
  Description of Artificial Sequence: Synthetic coding sequence
atggacgccctggtggaggacgacatctgcatcctgaaccacgagaaggcacacaagcgggatacagtgacgcccgtgtccatctattcaggagacgaaagcgtcgcctcccacttcgctctggtgacagcttatgaagatatcaaaaagaggctgaaagatagcgagaaggaaaactcgttacttaaaaagcggatacggttcctggaggagaaactcatcgcccggttcgaggaggagacctcgtccgttggccgggagcaggtgaacaaggcctatcacgcctaccgagaggtgtgtatcgatcgcgataacctgaaaagcaaactggacaagatgaacaaagacaactccgaatctctgaaagtgctgaacgaacagcttcagtccaaggaagtggagctgctgcagctccgcaccgaggttgagacacaacaggtcatgaggaatctcaacccgccctcctccaactgggaggttgaaaaactttcgtgtgatttgaaaatccacggcttggagcaagagctcgagctgatgagaaaggagtgcagcgaccttaagatagaactgcagaaggctaaacagacggacccctaccaggaggataaccttaagtccagagatctgcagaaactgagtataagcagagtctccgttgcacaacccggcgttcaatggcggaaccacggcattgcctag

SEQ ID NO: 177336 - DNA, 648 bp, Artificial Sequence
  Description of Artificial Sequence: Synthetic coding sequence
atggacgccctggtggaggacgacatctgcatcctgaaccacgagaaggctcacaagcgggatactgttactcctgtgtcaatttatagcggcgacgagtcagtcgcatctcacttcgcccttgttactgcctatgaggatattaaaaagagactcaaggattccgagaaggagaacagcctgctgaagaagcgaatacgctttttggaagaaaaattgatcgccagatttgaagaggaaacatcaagcgttggtcgggaacaagtaaacaaagcttaccatgcctatagagaggtgtgtattgatcgggataatctcaagagcaaattagacaagatgaataaagataatagtgagtcgctgaaggttctcaatgagcaattacaaagcaaagaggtggaactcctacagttgcgcacagaggtggagactcagcaggttatgagaaaccttaaccccccctcatccaattgggaggtggagaaactctcttgcgatttaaagattcatggacttgagcaggaattggagttgatgaggaaggaatgcagcgatctcaaaatcgaattgcagaaagcgaagcagactgatccataccaggaggataatctaaagtcccgcgaccttcagaagctgagtatttcatag

SEQ ID NO: 177337 - DNA, 288 bp, Artificial Sequence
  Description of Artificial Sequence: Synthetic coding sequence
atggacgccctggtggaggacgacatctgcatcctgaaccacgagaaagctcacaagcgggacactgtaactccagtctccatttattctggtgatgagtcagtcgcgtcacattttgcactggtgaccgcttatgaagatatcaaaaaacggttgaaagattccgagaaggaaaatagcctcctgaaaaaaagaattcggtttctggaggagaagcttatcgctcggttcgaagaggaaacctctagtgtaggccgggagcaagtaaataaagcatatcacgcctag

SEQ ID NO: 177338 - DNA, 732 bp, Artificial Sequence
  Description of Artificial Sequence: Synthetic coding sequence
atggacgccctggtggaggacgacatctgcatcctgaaccacgagaaggcccacaagcgtgatactgtcaccccggttagcatttattcaggcgatgagagcgtagcaagtcatttcgccctcgtcacagcttatgaagacatcaagaagcggctgaaagactcggaaaaggagaactctcttttgaagaaacgcattcggtttctggaagagaaattgatcgctcgctttgaggaggagacatcctcagtgggacgggagcaggtcaacaaagcctaccatgcatatcgggaggtgtgtattgaccgcgacaacttaaaatccaaactcgacaaaatgaacaaggataactccgaaagtctgaaggttctgaacgagcagctgcagtcgaaggaggtggaactcctgcagttgcgcactgaggtggaaactcaacaagtaatgagaaatcttaacccacccagcagcaattgggaggttgagaaactttcttgcgacctgaaaatccatggactggagcaggaactggagctcatgaggaaggagtgttctgacctcaagatcgagttacagaaagcaaaacagacggatccatatcaggaggacaatctgaaatctcgggacctgcagaagttgtctatctcacggcagagcatttgctcgaccgcttggtccgccgtcgcccagagctgggacagtatgaacttcgaggactgttctctattcgcctag

SEQ ID NO: 177339 - DNA, 732 bp, Artificial Sequence
  Description of Artificial Sequence: Synthetic coding sequence
atggacgccctggtggaggacgacatctgcatcctgaaccacgagaaagctcataagcgtgacacggttacgcctgtttccatttattccggagatgagtcagtggcatctcattttgcactggtgactgcatatgaggacataaaaaagcggctgaaggactccgagaaagagaattcactcctgaagaagcgcatcagattcctcgaagaaaagcttattgcccgtttcgaggaagaaaccagttctgtgggaagggagcaagtgaacaaggcttatcatgcctaccgggaagtgtgtattgacagggacaacttgaaatccaagcttgataagatgaacaaggacaatagtgagtcactcaaagtattaaacgagcaactgcagtctaaagaggtggaactactacaattaaggaccgaagtggaaacacagcaggtcatgagaaacttgaatccaccatccagcaattgggaagtggaaaagctctcttgcgacctgaaaatacacggcctcgagcaggagcttgaactgatgagaaaagaatgtagtgacttgaagatcgagctccagaaggcaaagcagacggatccttaccaagaggataacttgaagagccgcgaccttcagaaactgtctatttcacgccagtccatatgtagcactgcctggtccgccgtggcacagtcctgggactcaatgaacttcgaagattgtagccttttcgcttag

SEQ ID NO: 177340 - DNA, 1179 bp, Artificial Sequence
  Description of Artificial Sequence: Synthetic coding sequence
atggacgccctggtggaggacgacatctgcatcctgaaccacgagaaggcacacaaacgggatacagtcaccccggtatcgatttacagtggggatgagtcagttgcttcacacttcgcgcttgtgaccgcatatgaggacataaagaaaagactgaaagacagcgaaaaagaaaactcacttctgaaaaagaggattcgcttcctagaggaaaaacttatcgcgcggttcgaggaagaaacttctagcgtaggacgcgagcaggtgaataaggcctatcatgcttatcgcgaggtctgcatcgaccgggacaatctcaagagcaaattagacaagatgaacaaggataatagtgaatctctgaaggttctgaatgaacagctacagtcaaaggaggtagaactgcttcaactgcgaacagaagttgaaacgcaacaggtgatgcgaaatctgaacccaccttcaagtaattgggaagttgagaaattgtcttgtgacctcaagattcacggcctggagcaggaactggagctcatgcgcaaggagtgcagtgacctcaaaatagagcttcagaaggccaagcagactgacccataccaggaggacaatctgaagtccagagatctccagaagctatccattagctcagacaacatgcagcacgcttattgggagttgaaaagagagatgtccaacttgcatctagtcacccaggtgcaggccgagctcctgagaaaactgaagacaagcaccgcgattaagaaggcgtgcgcccccgttggatgctccgaggacctgggtcgagacagtaccaaactacatctgatgaactttaccgcaacctacacccggcatcctcccctcctccccaacgggaaagcgctatgtcataccacatccagccccctccctggcgacgtaaaggtgttgtctgaaaaggccatactgcagagttggaccgataatgagaggtcgatcccgaacgacggcacgtgcttccaggaacactcttcctatggacgtaacagcctagaagacaacagctgggtttttccctccccaccaaagagttctgagacagcctttggcgagacaaagactaagaccctgcctctgccaaacctgccccctctgcattacctggatcagcacaaccaaaattgcctttacaagaattag

SEQ ID NO: 177341 - DNA, 1269 bp, Artificial Sequence
  Description of Artificial Sequence: Synthetic coding sequence
atggacgtgctgagccccggccagggcaacaacaccaccagcccccctgcaccctttgaaaccgggggaaacactacaggcatctcagacgttacagtgagctaccaggtcatcacttccctcctgttaggcactctgattttctgtgctgtgctgggcaatgcctgcgtcgtggcggctatagcactggagagaagtctacagaacgtagctaattacctgatagggtcgctggctgtgaccgacctgatggtgagtgtacttgtgctgcccatggccgctttgtatcaggtcctgaataagtggacccttgggcaggtgacctgcgacttattcattgctctagatgtgctgtgttgtactagttcaatactgcatctgtgcgccatcgcattagatcgctattgggccataaccgatcctatcgattatgtgaacaaaaggacaccgcggagagctgctgcactcatttcactcacctggctcattggctttcttatctcaatcccaccaatgctcggctggaggactcctgaggatagatccgatccggacgcatgtaccatctccaaggatcacggatatacaatctattccactttcggggcattctatatccctttgctgctcatgctggtcttatacgggcgcatcttcagggctgccagatttaggatccgcaagactgttaaaaaggtcgaaaaaacgggagccgacacccgacatggtgctagcccagccccccaacccaagaaatccgtcaatggtgagtccggaagcaggaattggcgcctaggagtcgaaagcaaagcgggcggcgctctctgcgcaaacggcgctgtgcgccaaggtgatgatggagccgccctggaagtgatcgaggtgcatagggtgggcaattcaaaagagcaccttccactgcccagcgaggccggacctaccccatgtgcccccgcctcttttgagaggaagaatgaacgtaacgccgaagccaagaggaaaatggcactcgcccgagaacgcaagactgtaaagacattgggtatcatcatgggaaccttcatattatgctggctgccattctttatcgttgcccttgtcctgcctttttgcgaatcttcttgtcatatgcccactctgttgggcgcaattattaattggttgggttatagtaacagcttgctgaatccagtgatctacgcctattttaataaagatttccagaatgcctttaagaagatcatcaaatgcaagttctgtaggcagtag

SEQ ID NO: 177342 - DNA, 129 bp, Artificial Sequence
  Description of Artificial Sequence: Synthetic coding sequence
atggacgtgctgagccccggccagggcaacaacaccaccagcccccccgcccccttcgagactggcggtaatacaacaggcatctccgatgtcaccgtttcttaccaggtgataacatccttgctatag

SEQ ID NO: 177343 - DNA, 1173 bp, Artificial Sequence
  Description of Artificial Sequence: Synthetic coding sequence
atggaggagcccggcgcccagtgcgccccccccccccccgccggcagtgagacctgggtgccacaggcaaatctgtccagtgcaccaagccagaattgctccgccaaggactacatctatcaggactctatctccctgccatggaaagtgttgcttgtgatgctgctcgctctgattacgcttgcaactactctgtcgaacgcgttcgtgatcgccacagtgtatcggaccaggaagctccatactcccgccaattacctgattgcctcacttgccgtgaccgatctgctagtttctattttggtgatgccaattagcacgatgtacacagttaccggcaggtggacccttggtcaggtcgtgtgcgatttttggctgagctccgatattacctgctgtacagcctccattctgcacctgtgcgtcatagccctcgatcggtactgggctatcaccgatgctgtcgaatacagcgcaaaacggaccccgaagagggcagcagtgatgatagcacttgtgtgggttttttctataagcatttcactgcccccatttttttggagacaagccaaggctgaagaagaggttagtgagtgtgtcgtcaacactgatcatatactgtacactgtctattcaaccgttggtgctttttacttcccaaccctgttattgatagctctctatggccgaatctacgttgaggctaggtctagaatactgaaacaaacacctaacaggacgggcaaaagactgactcgagcccagttaataaccgatagcccagggagcacctcatccgtgacctctataaatagtcgggtgcctgacgtgcctagcgaaagtgggtcccccgtctatgtgaaccaggtgaaggttcgggttagtgacgccctgctcgagaagaaaaagcttatggctgctcgggaaagaaaggccacaaagaccctgggcattatattaggcgcctttattgtttgttggttacccttttttataatctctctggtgatgcctatctgcaaggacgcatgctggttccatctcgccatcttcgacttcttcacctggcttggatatctgaactcccttatcaatcctataatttataccatgagcaatgaggatttcaagcaggcgtttcacaagttgattcggttcaaatgtacatcctag

SEQ ID NO: 177344 - DNA, 1134 bp, Artificial Sequence
  Description of Artificial Sequence: Synthetic coding sequence
atgagccccctgaaccagagcgccgagggcctgccccaggaggccagtaatcgttcccttaatgccacagaaacctcagaggcatgggaccctaggacgttacaagctctgaagatctcgcttgcggtagtactcagcgtgattaccctggcgacagttcttagcaacgcctttgtgctgaccacgatccttctgactagaaaactccatacgcccgcaaactacttgatcggaagtctggccactaccgatctgctggtaagcatcttggtcatgcctattagcatagcctacactattacgcacacctggaattttgggcagatactgtgtgatatctggctgtcaagcgacattacctgctgcacagcatccatcctccacctttgtgttattgctctggaccggtactgggcaatcacagacgccctggagtacagcaagcgccgtacggctggacatgctgccaccatgatcgctatcgtgtgggccatatctatttgcattagcatcccacctcttttctggcgacaggctaaagcccaggaggagatgtccgactgtttggttaatacatcccagattagctatacgatttacagcacctgtggtgccttctacataccctctgtcctgctgattattctttatggccggatttaccgcgccgctagaaacagaatcctcaaccccccttctctgtatggaaagaggttcaccaccgctcatttgataacggggtctgccggctcctctctatgctccctaaactctagcctccacgaaggccattctcactcagcaggtagccccctgttctttaaccatgtgaagattaagctggcggattctgcactagagcggaagaggatatctgccgcacgggagcgaaaagctaccaagatcttgggaattatactgggggccttcatcatttgctggttgcctttttttgtggtcagtctggtgctcccaatctgccgcgactcttgttggattcatccggcactgtttgacttctttacctggctcggatacctgaatagtctaattaacccaattatctacactgtgttcaatgaggagtttagacaggcctttcaaaagatagtcccgttccggaaggcctcatag

SEQ ID NO: 177345 - DNA, 1134 bp, Artificial Sequence
  Description of Artificial Sequence: Synthetic coding sequence
atgagccccctgaaccagagcgccgagggcctgccccaggaggcctcaaaccggtccctgaatgccaccgaaacatctgaggcatgggacccacgaactctgcaagcactgaagattagcttagccgttgttctcagtgtcataaccctcgccacagtcctgtctaatgcgtttgtgctcacgactatattattgaccagaaagcttcacacacctgcaaattacctaatcggcagcctagccactacagatctgctggtgtccattctagtcatgccaatctcaattgcttatactattacccacacttggaacttcggccagattttatgtgatatatggttgagctccgacattacatgttgcaccgcaagtatccttcacctatgtgtgattgcactagataggtactgggcgattaccgacgctttggagtacagcaagagacgtaccgctggtcacgctgctacaatgattgccatagtgtgggccatttcaatctgcatatctatacctcctttgttctggaggcaggccaaggctcaggaggagatgtccgactgtttggtcaatacgtcccagatcagttacaccatctattcgacgtgcggggcattctacatcccaagtgtgctcctgataattctgtatggccggatttatcgggcggcacggaaccgcattctcaaccctccttccttgtatggaaagcggtttaccactgctcatctcatcacgggcagcgcaggctcaagcctctgtagcttgaatagctcactgcacgaggggcactcccattcggccggttcacctttgttctttaaccatgtgaaaattaagttggccgacagtgctcttgaaaggaagagaatctctgctgccagggagcgtaaggctacaaaaatcttaggcataatactcggggcgttcattatttgttggttgccgtttttcgtggtcagcctcgtgctaccaatctgtagagatagttgctggatccatcccgccctttttgatttttttacatggctcgggtatctgaattccctcatcaatcccatcatctatacagtcttcaatgaagaatttagacaagcgttccagaaaattgtacccttcaggaaggcgtcatag

SEQ ID NO: 177346 - DNA, 1098 bp, Artificial Sequence
  Description of Artificial Sequence: Synthetic coding sequence
atgaacatcaccaactgcaccaccgaggccagcatggccatccggccaaagacaattaccgaaaaaatgcttatctgcatgaccctcgtcgtcatcaccactctaactacgctcctgaaccttgcagttattatggctatcggaacaacaaaaaagctacaccagcccgcgaattacctgatctgtagcctggcagttactgatcttttagtcgctgtcttagtgatgcctctgtcgataatttacatcgtcatggacagatggaagctgggttacttcctgtgtgaagtgtggcttagcgtggacatgacttgttgtacatgctctatactacacctctgtgtgattgcactcgaccgctactgggccattacaaatgccatagaatacgcccgcaaacggaccgccaagagagctgctctgatgatcttgaccgtgtggacaatatcaatctttatctccatgccccctctcttctggagatcccacagacgtttgagtcccccaccctcccagtgcaccatacagcacgatcacgtgatctataccatatacagtactttgggggccttctatatccccctgacccttattttaatactttactaccgtatctatcatgccgccaaatcattgtatcaaaagcgaggttctagtcgccacctgtcaaatcgatcaactgacagtcagaactctttcgcctcatgtaaattgactcaaacgttctgtgtttccgatttcagtacttcagacccgacaaccgagttcgaaaaatttcatgcttcaatcagaatcccgccctttgataatgaccttgaccaccccggggagcggcaacagatatctagcacccgcgagagaaaggcggcccgtatcctcggactcattctgggcgccttcatactgagttggctcccctttttcataaaggaacttattgtaggactgtccatctacaccgtgtcctcagaagttgctgacttcctgacctggttgggatacgtgaactctctgattaatccactactttatacatcgtttaacgaggactttaagttagcgtttaaaaagttgattcgctgcagggaacatacttag

SEQ ID NO: 177347 - DNA, 1098 bp, Artificial Sequence
  Description of Artificial Sequence: Synthetic coding sequence
atgaacatcaccaactgcaccaccgaggccagcatggccatccggcccaagaccatcaccgaaaagatgctgatctgtatgaccctagtagtcataacaactttgactaccctcctcaacctggctgtcatcatggcaattggcacaactaagaaactgcaccagcccgcaaattacttgatttgcagtctggcagtgactgatctgcttgtggcagtgctggtcatgcctctctcaatcatctatatcgtgatggataggtggaaattggggtacttcctttgtgaagtgtggttatccgtcgacatgacttgttgcacctgttcaatcttgcacctgtgcgtgatcgctcttgaccgttactgggctatcacaaacgctatcgagtacgcaagaaaacgtacagctaagcgagctgctttaatgatcttaacagtgtggactatcagtattttcataagcatgccccccctgttttggaggtctcaccgcagattgtcccccccccccagccagtgcactattcagcatgaccatgtgatttatacaatatactctaccctaggagccttctacataccactcacattgattttaattttatattaccggatttaccacgctgcgaagagcctctaccagaagcgaggctcctcccgccatctgtccaatagatctacggatagccagaattcgttcgcaagctgcaaactcactcagactttctgcgtgtctgacttctctaccagcgaccccacaacagagttcgaaaagtttcatgccagcatccgcatccctcctttcgacaatgatttagatcacccaggtgagaggcaacaaatttcaagtacacgagagagaaaggctgctcggatcctgggtctgatactcggggcattcattctctcttggcttcctttctttatcaaggagcttattgtgggattgtccatttacaccgtgtccagcgaagtcgcggattttctaacttggctcggttacgtgaatagtcttatcaaccctctgctctacacctcttttaacgaagactttaaacttgcttttaagaagttaatcaggtgtcgcgagcatacctag

SEQ ID NO: 177348 - DNA, 1101 bp, Artificial Sequence
  Description of Artificial Sequence: Synthetic coding sequence
atggacttcctgaacagcagcgaccagaacctgaccagcgaggagctcctcaatcggatgccatccaaaattctagtgagccttactctgtccggcctggctctgatgacaacaacgattaacagcctggtgattgcggccatcatcgtcacacggaagctgcaccaccctgccaattacctgatctgttctctggccgtaacagattttctggtggcagtcctggtgatgccgttcagcatcgtctatattgtacgcgaatcatggattatgggacaggtagtgtgcgatatctggctatcagtcgatatcacctgctgtacctgttccattttacacttatctgccatcgcactggatagatatagggccatcaccgacgccgtcgagtatgcccgcaagcgtacaccaaaacacgcaggaattatgatcactattgtgtggataatcagcgtattcatttctatgccgccccttttttggcggcatcaggggacaagccgtgacgatgagtgtattatcaaacacgaccacattgtgagcacaatctatagcacatttggcgccttctacattcccctggccctgatcctgatcctctattataagatctacagggctgcgaaaacattgtaccacaaacgccaggcaagcagaattgccaaggaggaggtaaatgggcaggttctgctggagtccggagagaaatccactaagtctgtgtccacaagctacgtgctcgaaaagagtttgagcgatccatccaccgattttgataaaatccactcaacagtgaggtctctgcgctctgagtttaaacacgagaaatcttggcgacggcagaagatcagcggcacccgcgagcggaaagctgccacaacactcggtctcattcttggggcctttgtcatctgctggctgccgtttttcgtgaaggagcttgttgttaatgtttgtgacaaatgcaaaataagcgaggagatgagcaattttctcgcgtggttgggttatttgaactccttaattaatcctctgatctataccatcttcaacgaggacttcaagaaggccttccaaaagctggtcagatgccggtgttag

SEQ ID NO: 177349 - DNA, 1416 bp, Artificial Sequence
  Description of Artificial Sequence: Synthetic coding sequence
atggacatcctgtgcgaggagaacaccagcctgagcagcaccaccaacagtcttatgcagttgaacgacgataccaggttgtacagcaacgatttcaactccggagaggcaaacacttctgacgccttcaactggacggtcgactccgaaaacaggaccaacttgtcttgcgaaggttgtttatcaccttcttgtttgtcacttcttcatttgcaagagaagaactggtctgccctgctgaccgcagtggttataatcctgacgattgccggtaacatcctcgtgatcatggccgtgtctctggagaagaaactgcagaatgcgacgaactacttccttatgagcctagccattgcagatatgcttctgggattcctggtcatgcctgtgtccatgctgactatcttgtacgggtacagatggcctctgccatccaagctctgcgcagtctggatctatttggatgtcctcttcagtaccgcatctatcatgcacttgtgcgcaattagcctggatcgctatgtcgctattcagaatccaatacaccattctaggttcaacagccgaaccaaagcgtttctcaaaatcattgcagtgtggaccatcagcgtgggcatcagtatgccaatccccgtcttcggattgcaggacgactcaaaagtgttcaaagaggggtcttgtctcctggcggatgataatttcgtgttgatcgggtccttcgtcagtttttttataccgctcaccattatggtgataacttattttctgaccatcaagtcattgcagaaagaagccacactctgcgtgagtgaccttggcacccgggcaaaacttgcctcattcagtttcttgcctcaatcctctctgtccagcgagaaattgtttcagcgatccattcacagagaacctggatcctacaccggtcgcagaacgatgcaaagtatatcaaatgaacagaaagcctgtaaggttctgggtatcgtattctttctgttcgttgtaatgtggtgtccattcttcataactaacataatggctgtgatttgtaaggagagctgcaacgaggacgtaatcggtgccctgctcaatgtattcgtgtggataggctatctcagttccgcagtgaatcctctggtttacacactttttaacaagacatatcgctctgccttttcccgatacatccaatgtcagtacaaagagaacaaaaagcccctacagctgatcctggtaaacactattcctgctctggcgtacaagagctcccagttacagatgggacagaagaaaaactccaaacaggacgctaaaaccacggacaatgattgttcgatggtcgcccttggaaaacagcactccgaagaggctagtaaagacaactccgatggcgttaacgaaaaggtgtcctgcgtctag

SEQ ID NO: 177350 - DNA, 1416 bp, Artificial Sequence
  Description of Artificial Sequence: Synthetic coding sequence
atggacatcctgtgcgaggagaacaccagcctgagcagcaccaccaatagcctgatgcagcttaacgatgacacccgtctctacagtaatgacttcaactcaggagaggcaaatacatccgatgcctttaattggactgtcgattcagaaaataggacaaatttgtcatgtgaaggctgcctgtctccttcctgtttgtcactcctccacttgcaggaaaagaactggtccgccctcttaactgccgtcgtgatcattttgaccatcgctgggaacatcctggtcattatggcggtttcactcgagaaaaagctgcagaacgcaaccaattattttttgatgagtctcgctatcgccgatatgctattgggtttcctcgttatgccagtaagtatgttaactatactctacggctaccgatggccgctaccatctaagctgtgcgccgtctggatctacctggatgtgctgttctctaccgcaagtatcatgcatctttgtgctatttcccttgaccgctatgtcgccattcagaatcctatccatcattcacgctttaattcaagaacgaaagcattcctgaaaattatcgctgtctggacaatttcggtgggaatttctatgccgattcccgttttcggactccaagatgattccaaggtgttcaaagaagggtcttgtcttctggccgatgataactttgttttgattggttctttcgtatctttttttattccgctgaccatcatggttattacatacttcctgactatcaagtcattacagaaggaggccaccctttgcgtgagcgatctgggcactcgggcgaagcttgcaagcttttcattcctgccgcagtcttcactgtcttctgagaaactgttccagcggagcattcacagagaaccaggctcctataccggacgtcggaccatgcagagcattagcaacgaacaaaaagcttgcaaagtgcttggcatcgtttttttcctttttgtggtgatgtggtgccctttctttattaccaacattatggctgtgatttgtaaggagagctgtaacgaggatgtgatcggggcactgcttaatgtcttcgtgtggatcgggtacctatcttctgcggtgaatccgctagtgtacacgctcttcaacaagacctatagatcagcattctctcgttatattcagtgtcagtacaaagaaaataagaagccactccagctcatcctggtcaacacgatccccgcactggcttacaagtcttctcaattacagatgggtcagaagaagaacagcaaacaggacgcaaaaactacagataatgactgctcaatggtggcactgggcaagcaacactctgaggaagcctccaaggacaattccgatggtgtgaacgaaaaggttagttgtgtgtag

SEQ ID NO: 177351 - DNA, 1164 bp, Artificial Sequence
  Description of Artificial Sequence: Synthetic coding sequence
atgcagttcctgaagagcgccaagcagaagcccaactactaccacattatgctggtggaggatcaggaggaaggaacactccaccagttcaactattgtgagagatgcagtgaatctcagaataacaagtgtataagctgcgtggaccctgaagacaaatggtatcgctggcctctcccatcgaaactctgtgcggtgtggatctatctggacgtgctgttctcaaccgcttcaatcatgcatctatgcgcaatttctttggatagatacgtggccattcagaatcccattcatcacagccggttcaactcacgcacaaaagctttcctgaagatcatcgcagtatggacgatttctgtggggattagtatgcctattcccgtatttgggctgcaggacgattccaaggtgttcaaggagggttcttgtctcttagctgatgacaactttgtgctaataggatcttttgttagtttcttcatccctttgacaatcatggtgatcacctacttcctcaccatcaaatccctgcagaaagaagcaacactctgtgtgagcgacctgggtaccagagctaagctggcaagcttctcctttctcccacaatcttcattatcttctgaaaagctgttccagaggagcattcaccgagaaccaggatcctacacagggagacggaccatgcagagtatcagcaacgagcaaaaagcttgcaaggtactcggcatcgtctttttcctgtttgttgtcatgtggtgccccttctttattacaaacatcatggccgttatctgcaaggagagttgtaacgaggatgtgatcggggcactgttaaacgtattcgtttggataggttatctatcctcagccgtgaatcccctcgtgtacactttattcaacaaaacatacaggagtgccttctcccgatacatccagtgtcagtataaggaaaacaagaagcccttacaactcatcctggtcaatacaattcccgcactggcttacaaatcctctcagctgcagatggggcagaagaaaaattcaaagcaagacgcgaagacaactgataatgactgttctatggtagctcttggaaaacagcactccgaagaagcatcaaaggacaattcagacggagtgaatgagaaggttagctgcgtgtag

SEQ ID NO: 177352 - DNA, 1446 bp, Artificial Sequence
  Description of Artificial Sequence: Synthetic coding sequence
atggccctgagctaccgggtgagcgagctgcagagcaccatccccgagcacatcctgcagtctacattcgtccacgtaatttcctccaactggagcgggctgcagaccgagagtattcccgaggagatgaaacagatcgttgaggagcaggggaataagcttcattgggcagccctattgattctaatggttatcattccaaccatcgggggtaacacactcgtcatcttggccgtcagtttagagaaaaaattgcagtatgccacgaactatttcttgatgtctttggccgttgccgatctcctcgtgggcctgttcgttatgccaatcgcacttcttaccattatgtttgaagccatgtggccattgcccctggtcctctgcccggcctggctgttcctggatgtgctcttctcaactgcttccatcatgcacctgtgcgcaataagcgtggatcggtatattgccatcaagaagcccattcaggccaatcagtataatagccgggctaccgcattcattaagattacagttgtttggttaatctccattggaattgctattcccgtgcccattaaggggattgaaaccgacgtcgacaacccaaacaatatcacgtgcgtgttgaccaaagagcgatttggggacttcatgttgtttgggagcctggccgccttcttcacaccacttgctataatgatagtcacttatttcctcaccatacacgctcttcagaagaaggcatacctggtgaagaacaaaccaccacagagattgacctggcttaccgtgtcaactgtttttcagagagacgagacaccatgcagttcccctgagaaggtcgctatgttggatggatcacggaaagataaggccctgcctaatagcggcgacgaaaccctgatgaggcggaccagcacaattgggaagaagtccgtccagacaattagtaacgaacaacgggcctctaaggtgctggggatcgtcttcttcttatttctattgatgtggtgcccattctttatcactaacattactctggtgctctgtgactcctgcaaccagactacgcttcagatgctgctggaaatttttgtgtggataggttatgtctcctccggtgtcaatccgctggtctataccctgttcaataagacattcagggacgccttcgggcggtatattacctgtaactatagggcaacaaaatcggtaaagaccctgcgaaagcgatccagtaagatatatttcaggaatccaatggcggagaattccaagttttttaagaaacacgggattagaaatggcataaatccagccatgtatcagagccccatgcggctgcgcagcagcaccatacaatctagctccatcattttgctggacacactgctacttaccgaaaatgagggcgataaaactgaggaacaagtcagctacgtatag

SEQ ID NO: 177353 - DNA, 195 bp, Artificial Sequence
  Description of Artificial Sequence: Synthetic coding sequence
atggtgatcatccccaccatcggcggcaacaccctggtgatcctggccgtcagcctcgagaaaaagctgcagtatgcgacaaactacttcttaatgagtctcgctgtggcagacctcttggtcgggctgtttgtgatgccaatcgcactgctgacaatcatgttcggcatcgccattcccgtgccaatcaagtag

SEQ ID NO: 177354 - DNA, 1377 bp, Artificial Sequence
  Description of Artificial Sequence: Synthetic coding sequence
atggtgaacctgcggaacgccgtgcacagcttcctggtgcacctgatagggctcctcgtatggcaatgcgatatttcagtatcccccgtggcagctatcgtcacggacattttcaacacgtcagacggggggcgcttcaagttcccagatggcgtccagaactggcccgctttgagcattgttatcatcatcatcatgacaatcggaggtaatattttagtaattatggccgtttctatggagaagaagctccataatgcgacaaattattttctaatgtcactagctatcgccgacatgctcgttggtctgctcgtgatgccgcttagcctcctagccatcctttacgattacgtgtggcctctgccaaggtatttgtgcccagtgtggatatccctcgatgtgctgttctctacagcaagcattatgcatttgtgtgccatatccctggaccggtacgtagctatacggaaccctattgaacactcaaggttcaacagtaggacgaaagcaattatgaaaattgcaattgtgtgggctatcagcattggtgtgtctgtccctatccccgttatcgggttaagagatgaggagaaggtcttcgtaaacaataccacctgtgtccttaatgatccaaactttgtgcttatcggatctttcgttgccttttttatacctctcactattatggtgatcacttactgcttaacaatatatgtgctgagacgtcaggctctgatgctactgcatggccacaccgaggagcctccaggactcagccttgactttctcaaatgttgcaaacggaacacagccgaggaagaaaacagtgccaaccctaatcaggatcagaatgcccgaagacgtaagaagaaggaaaggagaccgcggggcacaatgcaggccataaataatgagcgaaaagcctcaaaggtgttgggcatcgtgttttttgtctttctgatcatgtggtgcccattttttatcaccaacatcctaagcgtgctgtgcgagaagtcatgcaaccagaagctcatggagaagctgctgaacgtctttgtctggattggctatgtgtgttccgggattaatcctctcgtgtatacgctgttcaacaaaatctacagacgggcatttagcaactatcttagatgtaattataaggtggaaaagaagcctccggtccgtcagatccctagggtcgctgctactgccctgtcgggccgggagctcaatgtgaatatttacagacatacaaacgagccagtgatagaaaaggcatctgataacgagcctggcatcgaaatgcaggtggagaatcttgagcttcctgtgaacccgtccagtgtggtgagtgaacgaatctccagtgtctag

SEQ ID NO: 177355 - DNA, 747 bp, Artificial Sequence
  Description of Artificial Sequence: Synthetic coding sequence
atggtgaacctgcggaacgccgtgcacagcttcctggtgcacctgatcgggctgctggtatggcagtgtgatatctccgtctcacccgttgccgcgatcgtcacagatatcttcaatacatccgacgggggtaggttcaaatttccggacggggtgcaaaattggccagcattatccatagttataatcataattatgaccataggaggaaatatattggtcattatggcggtgtcgatggaaaagaagctccacaacgctactaactatttcctcatgtcacttgcaatcgccgacatgctagtgggacttctggtgatgccactgtccctcttggccatcctctatgattatgtgtggccattgccaaggtacctttgtcctgtttggatttctttggacgtgctattctcaaccgccagtatcatgcacttgtgcgcaattagcttggaccgctgcattagctcctatccctgcgattggaccgaagggcgacgcaagggcgttcgcgagcaacacgatgtgagggcgcagcgcccaaaattccgctcctattgggtcctgcgctcttttctgcacactgctgacgactatggcgattacgtcctgccagaccatctcaggtcggctcctacctcctttgatgtgacagccagaccccaccggggcaccgcttggaccaagagcggcttcccggaagtcctccaggaagaatatggacgaggtcgggagttgtgcaagccgtag

SEQ ID NO: 177356 - DNA, 1377 bp, Artificial Sequence
  Description of Artificial Sequence: Synthetic coding sequence
atggtgaacctgcggaacgccgtgcacagcttcctggtgcacctgatcggcctgctagtttggcagtgtgatatttctgttagtcccgtcgctgccatcgtgactgatattttcaacacttcggatggcggccggttcaagtttcccgacggtgtgcagaactggcctgctttgagtattgtcattattattatcatgacaatcggaggcaacatcctggtcattatggccgtgagtatggagaagaaactacataacgctactaactacttcttgatgagcctcgcaatagcagacatgctggtgggcttgctagtaatgcctctgagtcttctcgcaatcctatatgattacgtttggcctctacccagatatctctgccctgtctggatcagtttagatgtgcttttttccacagcgagcattatgcacctatgcgcaatatctttagacagatatgtcgctatacgaaatcccatcgagcacagtaggttcaactcgaggacaaaggctattatgaagattgccattgtgtgggccattagcatcggtgtgagcgtccctattccggtgatcggtcttcgggacgaagagaaggtgttcgtcaataatacaacttgcgtgttgaacgatcctaattttgtactgataggcagttttgtcgcttttttcattcctctaactattatggttattacttactgcctcactatctacgtattgcgcagacaggccctgatgctgctgcacgggcatacagaagagccccctgggcttagcctggatttcctgaagtgttgtaaaagaaataccgccgaagaagagaatagcgccaatcctaaccaggaccagaacgcccggagacgcaagaagaaggagagacgcccaaggggcactatgcaagcaattaacaacgagcgtaaagccagcaaggtactgggaatagtatttttcgtgttcctcataatgtggtgcccgttcttcattacaaatatcttaagcgttctgtgcgagaagtcatgcaatcaaaaattaatggaaaagctactgaacgtgttcgtgtggatcggatatgtctgctctggaatcaatcctctcgtatacacactcttcaacaagatatacagaagggccttttccaactacctgaggtgtaactacaaagtggagaagaaacctcccgtccgtcaaattccaagagtagccgccaccgcactgtctggacgtgaacttaatgtgaacatttaccggcatacgaatgagccagtcattgagaaagcctctgacaatgagcccgggatcgagatgcaggtggagaatcttgaactgccagttaaccccagttcagttgtgtctgaacggatatctagcgtctag

SEQ ID NO: 177357 - DNA, 840 bp, Artificial Sequence
  Description of Artificial Sequence: Synthetic coding sequence
atggccagcatgagcatcgtgaaggccaccagcaacaccatcagccagtgtggatggtctgcgtccgccaattggaccccaagcatcagccccagcatggacaggggcgagaggagcccctcagcactatctcctacccaagtagcaatccggcgcaggtgtcgtcccagcccctacgttgtcaacttcttggtcccaagcgggatcctgatagccatagatgccttatccttttacctacctctggaatcaggaaattgcgctccctttaagatgaccgtcctgctgggctattccgtgttcctgctgatgatgaacgacttactgcccgcaactagcacctctagccacgccagcctggtccgccctcatccatccagggaccagaagagaggcgtgtattttgctttatgtctgtcattaatggtgggctcccttctggagactattttcattacccatctgcttcacgtggccactactcaaccacttccactgccacgctggctgcattctcttctactgcattgcacaggacaaggccgctgctgtcccacagcccctcaaaaaggaaataagggcccgggattgacccctactcatttgcccggagtcaaggaacctgaggtgtctgccggccaaatgccaggacctggagaggccgaacttaccggtggatctgaatggaccagagcacaaagagagcacgaggcacagaaacagcactcagtggagctctgggttcagttctcacacgccatggatgccctgctgttccggctttacctgcttttcatggcgagtagcataatcaccgttatatgtctatggaacacatag

SEQ ID NO: 177358 - DNA, 1365 bp, Artificial Sequence
  Description of Artificial Sequence: Synthetic coding sequence
atgcagaagcacagccccggcccccccgccctggccctgctgagccagtccttacttacaactggcaatggcgacaccctaattatcaactgtccgggttttgggcagcatagagtagacccggcagcttttcaggccgtttttgacagaaaggccatagggccagtgaccaactatagcgtggcaacgcatgtaaacatttcctttacgctctcagccatctggaattgctatagccgtattcataccttcaactgccatcacgctcggccgtggcacaatcagttcgtgcagtggaacccagacgaatgtggagggatcaagaagtctgggatggcaaccgaaaatctgtggctcagtgacgtcttcatcgaggaatcagttgaccaaacacccgccggattgatggcctctatgagcatcgttaaagcaaccagcaatacgatttcccagtgcggatggagtgctagcgcgaactggactcctagcatatcccccagcatggatcgagcccgcgcgtggagacgcatgtcacggagctttcagattcatcaccgaacatcattccggacgcgccgcgagtgggtgctattagggatacagaaaagaacaatcaaggtgacagttgctactaatcagtacgagcaggcgattttccatgttgccatccggaggcgttgtagaccttcaccttacgtggtaaattttctggtgcccagcgggatccttatagctatcgacgccttgagcttttatttacccctggagagcggcaactgtgctccctttaagatgaccgtgttactcggctactccgtctttctcctgatgatgaatgaccttctgcccgcaacatcaacatctagccacgcatccctggtggctcccctggctctcatgcaaacccctcttcccgccggggtgtatttcgctctgtgtctgagtttgatggtggggtcactcctggagacgattttcatcacacatctcctgcacgtcgcaactacccagcctctacctcttccgcggtggcttcacagtctgttactgcattgcactgggcagggaaggtgttgccccacagcacctcagaagggaaataaaggcccaggcctaactcccacccacctgcccggagtgaaggagccagaggtcagtgcaggacagatgccaggacccggagaggccgagttgacggggggtagcgaatggacccgggcacaaagagaacacgaggcccaaaagcaacactccgtggagctctgggtccagttttcccatgctatggacgcactgttgttcagactgtacctcttgttcatggcttcttcaattataaccgtcatctgcctgtggaacacatag

SEQ ID NO: 177359 - DNA, 1215 bp, Artificial Sequence
  Description of Artificial Sequence: Synthetic coding sequence
atggagcggggctggttccacggcaagggcttcctgctgggcttcattttgcacctactgctccaggactcacatctccagttggtgacttcctttctatggttaaacatgtggaatccagacgaatgcggcgggataaagaaatccggaatggccactgagaatctctggctcagcgatgtgttcattgaggagagtgtagatcaaaccccggctggactgatggccagcatgtcaattgttaaagctacaagcaacactatttcacagtgcggctggagcgcatctgctaactggacgccttcaatctcgcccagtatggacaggggtgaaaggagcccgagtgccttgagcccaacacaggtgacaagagcctggaggaggatgtcacgctcatttcaaattcatcataggacaagcttcaggacaaggagggagtgggtgctcctgggtatacagaagaggactataaaagtcaccgtcgcgacaaatcaatatgagcaagcaatctttcacgttgccataaggcgaaggtgtagaccatcaccctacgtggtgaatttcttggtgcccagcggcatactgattgcaatcgatgccctgtcgttttatcttccgctggaatccggtaattgcgctccattcaagatgacggtgcttcttggttattctgtcttcctccttatgatgaatgatctgctgcccgcaactagcacctcatcacacgcatcactagtgcggccacacccctccagagaccagaagaggggcgtgtactttgctctgtgcttgagtcttatggtaggaagcctgctggagacaatattcatcacccacctgctgcacgtggcaaccacgcaacctctgcctctcccacgttggctccactccctgctcctgcactgcaccggccaggggcggtgctgccccaccgctccacaaaaggggaataagggcccagggcttactcctacccaccttcccggggtgaaggagccagaagtgagcgcaggacagatgcctggccctggcgaggccgagctgactggaggtagtgagtggacgagagctcagagggagcacgaagcccagaagcagcactccgtcgagctttgggtgcagttcagccacgctatggacgcactgctcttccggctctatctgttgttcatggccagttccatcataacagtgatctgcctgtggaacacttag

SEQ ID NO: 177360 - DNA, 702 bp, Artificial Sequence
  Description of Artificial Sequence: Synthetic coding sequence
atggtggccatccggcggcggtgccggcccagcccctacgtggtgaattttctggtcccgtcagggatcctcattgcaatcgatgcactgagtttttatctcccgttggaatccgggaactgcgcacccttcaagatgacagtcttgctggggtattcagtttttttgctgatgatgaacgacctccttccagccacatctacttcttcacatgcctcactggtcagaccccacccttcacgagatcagaagcggggggtgtattttgctctgtgcctgagccttatggtgggatccctgctcgagacaattttcatcacccacctgctgcatgtggccacaacacagccgctcccactcccaaggtggctccactccctgctgctgcattgcacaggccaagggcgatgctgccccaccgcaccgcaaaaggggaacaaagggccaggcctgaccccaacccatctgcccggggtcaaagagccggaggttagcgctggacagatgcccggacctggcgaggccgagctgaccggagggtccgaatggacaagggctcaacgagagcacgaggcccagaaacagcactccgtcgagctgtgggtacagttttctcacgctatggatgccctcctgtttcgcctctatctacttttcatggcctcctcaatcattactgtgatctgcctctggaacacctag

SEQ ID NO: 177361 - DNA, 1344 bp, Artificial Sequence
  Description of Artificial Sequence: Synthetic coding sequence
atggagggcggctggcccgcccggcagagcgccctgctgtgcctgaccgtgtctctccttttgcagggtcgcggcgatgcattcaccatcaactgcagtgggtttgaccaacacggcgttgaccccgccgttttccaagccgtcttcgaccggaaagcttttcgccccttcaccaactattctatccctacaagagtcaatatttccttcaccctcagcgcaatcctcggcgtggacgcgcagcttcagctgctgacctctttcttgtggatggacctcgtgtgggacaatccatttataaactggaaccctaaggagtgtgtagggatcaacaagcttactgtcctcgccgagaacctttggctgcctgatatattcatcgtagagagcatggacgtggatcagaccccatcagggctgactgcatacatttccagcgagggccgaatcaagtacgataagccaatgagggtgaccagcatctgcaatctggacatcttctattttccttttgatcaacagaactgtacttttaccttctcctcattcttgtacaccgtagactccatgctgctgggtatggataaagaggtgtgggagattacagacacaagcagaaaagtgatacaaactcagggagaatgggagctgctgggaattaataaggctaccccgaaaatgagcatgggaaacaacctgtatgaccagattatgttctacgtggcgatcaggcggcgtccttctctctatattattaacctccttgtgccatcatcctttctcgtcgccatcgacgccttatcgttttacttacccgcggagtctgaaaatcgcgcacctttcaaaataacactgctgctaggatacaatgtgttcctgcttatgatgaacgacctcttgcccgcctctggtactccccttattagcgtctactttgccttatgcttgtccctgatggtggtgtctcttctggagacagtctttattacttacctcctgcacgtggctactacacagccacctccaatgccaaggtggcttcactccttactgctgcattgtacctccccggggcggtgttgtccaacggccccccaaaaaggtaataaaggcttgggcctcaccctcacccacttacccgggcctaaagagcccggagagttagcgggaaaaaagctggggcccagggagacggaacctgatggagggtccggatggacaaaaacacagctgatggagctatgggtgcagtttagtcatgctatggatacgctcctttttcgactgtacttactgtttatggctagctccatcctgaccgtgattgttctgtggaacacttag

SEQ ID NO: 177362 - DNA, 1416 bp, Artificial Sequence
  Description of Artificial Sequence: Synthetic coding sequence
atgctggccttcatcctgagccgggccaccccccggcccgccctgggacccctgtcctacagggaacaccgggtggcgttgcttcacctgacccactccatgagtaccaccggaagaggcgtgacatttacaatcaattgcagtggcttcggtcagcacggggccgatcctacggcactcaacagcgtgtttaatcgcaaaccttttagacccgtgacaaatatttctgtacctacgcaagttaacatcagctttgcaatgtccgcgatactggatgtgaacgagcagctacacctgctgtcatccttcctgtggctcgaaatggtctgggacaatcccttcattagttggaaccccgaggagtgcgagggcatcacaaaaatgtccatggcagctaaaaacctctggctgccagatatattcatcatcgagctgatggatgttgacaaaacacccaagggattgactgcatacgtctcaaatgaaggccgcattagatacaagaaaccaatgaaagtggactcgatttgcaacctcgacatcttctactttccctttgaccagcagaattgtaccctaaccttttcctccttcctctatactgtggattctatgctgctggacatggaaaaggaagtatgggaaatcactgatgcatcaagaaatatcctacagacccacggcgagtgggaacttctggggctgagcaaggctactgcgaagctgtcccgagggggaaatctgtatgaccagattgtgttttacgtagcgattcgcagacgccccagcttgtatgttatcaatttattggtccctagcggttttctcgtggccatcgacgcactgtctttttacttgccagtgaaatccggtaacagagtcccttttaaaatcacactgctgctgggctataacgtgttccttctaatgatgtccgacttacttccaacttcaggcacccccctgattggcgtttacttcgcactgtgcctgtctctgatggtgggttctctcctggaaacaattttcatcacacatctgctccacgtagcgaccacacaacctcccccgctgcctcgctggctgcattccctgctcctgcactgcaattctccaggacggtgctgtccaacagccccacagaaggaaaataagggacccggcctcactccgactcatttgcccggggtgaaagaaccggaagtttctgctggacagatgcccgggccagcagaggctgaacttacgggaggcagtgaatggactcgggctcaaagagaacacgaggctcagaagcagcacagcgtggagctatggctgcagttttcacacgctatggatgctatgcttttcagactttatctgttgttcatggccagctctataattacagtaatttgcctctggaatacttag

SEQ ID NO: 177363 - DNA, 1371 bp, Artificial Sequence
  Description of Artificial Sequence: Synthetic coding sequence
atggagggcagctggttccaccggaagcggttcagcttctacctgctgctggggtttctgctccagggccggggtgtgaccttcaccataaattgctccggattcggtcagcatggcgcagaccccaccgctctgaattctgtgtttaaccgcaaaccatttaggcccgtcacaaatatatcagtccccactcaagtcaacatttctttcgccatgtctgctattctcgacgtgaacgaacagcttcacctgctgagctcttttctttggctggagatggtgtgggacaatccctttatttcgtggaatcctgaggaatgtgagggaatcactaagatgtccatggcggccaagaacttatggctgcccgacatcttcatcatcgaactgatggatgtcgacaaaacccctaagggcctgacagcttatgtgagcaatgagggaaggattaggtataagaaaccgatgaaagtggactcaatttgtaacctagacattttttatttcccttttgaccaacaaaactgtacccttacgttcagttcctttttgtataccgtggacagcatgctgctggacatggagaaggaggtttgggaaattaccgacgccagccgcaacattctgcagactcacggcgagtgggagctacttgggttaagcaaggctacggctaaactatctcgaggagggaacctatacgatcagattgttttctacgtagctatacggcggaggccgtccctctacgtgattaatctacttgtgcctagcggattcctggttgctatcgatgccttgagtttctacctgcccgtgaagtccgggaaccgggttcccttcaagatcaccctccttctgggatacaacgtttttctccttatgatgtcagaccttctccctacttccggtacaccacttattggcgtgtactttgccctgtgcctaagcctgatggtaggttcactgctcgaaactatatttatcacccatctgctgcacgtggctactactcaaccacccccactgccccggtggctacactccttgctattgcattgtaattcccccggtcgctgctgtcccaccgcaccacagaaggagaataaaggccctggactcacacccacacatttacccggggtcaaagaacctgaggtttcggccgggcagatgcctggccccgctgaggccgaactgactggcggatccgagtggacaagagcacagcgtgagcacgaggcacaaaagcagcatagcgtcgagctgtggctgcagttctctcatgctatggatgctatgctgttccgactttacttactcttcatggcatcttctattattacagtgatctgcctttggaatacctag

SEQ ID NO: 177364 - DNA, 1326 bp, Artificial Sequence
  Description of Artificial Sequence: Synthetic coding sequence
atggagggcagctggttccaccggaagcggttcagcttctacctgctgctggggtttctgctgcagggcaggggggttacatttaccattaactgctccggatttggtcaacacggggctgatcccactgctctgaatagtgtattcaacaggaaaccatttaggccagtgactaacatatctgttcccacccaggttaatattagtttcgcaatgtctgccatcttagacgtggtgtgggacaaccctttcattagttggaacccggaggagtgtgaaggtattaccaaaatgtctatggctgcaaagaacctttggctgccagatattttcattatagagctgatggatgtcgacaagactcccaaggggctaacggcttatgtgagcaacgaaggtcgcataagatataagaagcctatgaaggtggattccatttgcaacctcgacatcttctattttccttttgaccaacagaattgtacactgaccttctccagtttcctttacaccgtcgactctatgctgcttgacatggagaaggaggtgtgggaaatcacggatgcttcaagaaacatactgcagactcacggtgaatgggagttactggggttgtcaaaagcaaccgccaaactttctcgtggagggaacctgtatgatcagatagtgttctacgtagccatcaggaggaggccctctctgtatgtgatcaacctgctcgtgccctctggatttcttgttgcaattgacgccctgagtttttatcttcccgtcaagtccggcaacagagtcccgtttaagatcacccttctgcttgggtacaatgtattcttgctgatgatgtctgatctgctgcccacatctgggactccgctgattggagtttacttcgccctttgcttaagccttatggtcggaagtctcctggagacgatctttatcacacatttgttgcacgttgcaaccacacagcctccccctctgcctagatggctgcacagtttgttgctacactgcaatagcccgggaaggtgttgcccaaccgccccccaaaaggaaaataagggacccggactcacaccgacccatctcccaggggtgaaagaacctgaagtctcggccggacaaatgccaggccccgccgaggctgagttgactggaggctccgagtggacccgcgcacagagagagcatgaggcccagaaacagcattccgtggagttatggctccaatttagtcatgcaatggatgctatgctgtttcgtctctatcttctatttatggcgtcatcaattataacagtgatttgtctgtggaacacttag

SEQ ID NO: 177365 - DNA, 1371 bp, Artificial Sequence
  Description of Artificial Sequence: Synthetic coding sequence
atgctggccttcatcctgagccgggccaccccccggcccgccctgggtcccctgagctatcgggagcacagggtggccctgttgcatttgactcacagcatgtcaaccaccggacgtggtgtgacctttacaataaactgttcggggttcgggcagcacggagcggatcctacagccttgaattctgtattcaataggaagccctttcggccggtgactaacatcagtgtgcccacgcaagtaaatattagctttgctatgtccgctattctggacgtcgtttgggataacccctttatctcctggaatccagaggagtgcgaaggtatcactaaaatgagtatggcagctaagaatctctggctgcccgatatctttatcatagagctcatggatgtcgacaagactccgaagggtctcaccgcatacgttagcaacgaagggcgtatccggtataaaaagccaatgaaggtcgacagcatatgcaatttagacatcttctacttcccctttgaccaacagaattgcacacttaccttttcttctttcctttatactgtggatagtatgctgttagacatggaaaaggaggtatgggaaataacagatgccagccgcaacatccttcaaactcacggagaatgggagttactgggactgtcgaaggccaccgccaaattatcgcgggggggcaatctttacgaccagatcgtgttctatgtggctatccgcagacgaccttcactgtacgtgattaatctacttgtgccatccggatttctcgtggctatcgacgccctatctttctacctgcccgttaaaagtggaaatcgcgtaccatttaagattaccttactgctgggttacaatgtgttccttctgatgatgagtgacctgctgccaacaagcgggaccccactgataggcgtatattttgccctgtgcttatccctaatggttggttccctcttagagacaatattcattacacacctactccatgtcgcaacaacccaacctccaccactgccaagatggctgcacagtctcctgttacattgtaatagccccgggagatgctgtccgaccgctcctcagaaggaaaataaaggtcctggtttgaccccaacccaccttcccggtgtgaaggagcccgaggtgtctgcaggacagatgcctgggcctgctgaggccgagctgacggggggttccgagtggactcgtgcacaacgcgaacatgaggcacaaaagcagcatagtgtggagctctggctgcagttttctcatgctatggacgccatgctgttcagattgtacctcctcttcatggcctcctctataattactgtgatatgtctctggaacacttag

SEQ ID NO: 177366 - DNA, 1326 bp, Artificial Sequence
  Description of Artificial Sequence: Synthetic coding sequence
atgctgagcagcgtgatggcccccctgtgggcctgcatcctggtggccgccggcatcctggcgaccgacacacatcaccctcaggattcagccctttaccacttaagtaagcagctcctgcagaaataccataaagaagtgaggcccgtctataattggaccaaggccacaactgtgtacctcgacctgtttgtgcacgccatactggacgtcgacgccgagaaccagatcctcaagacaagcgtatggtaccaagaggtgtggaatgacgagtttctgagctggaatagctccatgttcgatgaaatccgtgaaatatccctccccttgtctgcgatttgggcccctgacataatcatcaatgagtttgtggatattgagaggtaccccgatctgccttacgtctacgtcaattcttcaggaaccatcgagaactataaacctatccaagtggtctccgcttgcagcctcgagacgtatgctttccctttcgacgtccagaactgtagtctgacctttaaatcaattctacacaccgtggaggatgttgatttggcattcctgcgatcgcctgaggatattcaacatgacaagaaggccttcctaaacgattctgaatgggaactgttaagtgtctcttctacgtactcaatcctgcagtccagtgctggaggcttcgctcagatccagtttaacgttgttatgcgcaggcatccactggtgtacgttgtgagcttgctgatcccaagcattttccttatgctggtggacctcggctcattctacttaccccctaactgcagggcccgtattgtcttcaaaacgtccgtgctggtggggtatacggttttcagggtgaacatgagtaaccaggttcccagatcagtcggttcgactcccctgattggtcatttcttcaccatttgtatggcatttcttgtgctgagcttggccaagagcatagtgctggtgaaatttctgcacgacgagcagcgggggggacaggagcagcctttcctttgtctccggggtgatacagatgctgataggcctcgggtagaacctagggcacagcgggcggtggtcacagagtcatcactgtatggcgagcatctggcccagccagggactcttaaagaggtctggtcccagttgcagtcaatttctaactatctccagacacaagaccagacagatcagcaggaagcggaatggctggttctgcttagccgcttcgataggctgctgttccagtcctacctcttcatgttgggaatttacaccatcactctttgttccctctgggctctgtgggggggggtttag

SEQ ID NO: 177367 - DNA, 1293 bp, Artificial Sequence
  Description of Artificial Sequence: Synthetic coding sequence
atgatcgtgtacttccccggcatcctggccaccgacacccaccaccctcaggacagcgccctctaccatctatctaaacagcttctccagaaatatcacaaagaagtgcgccctgtttacaactggacaaaagctacaacagtttaccttgacttgtttgtacatgccattctagacgtggacgcagagaaccaaattctcaagacgagtgtctggtaccaggaagtttggaacgatgagttccttagttggaatagtagcatgtttgatgagatccgtgagatatctctgcctctctctgcaatttgggcccccgacattatcatcaacgagttcgtcgacatcgaaaggtatcctgacctgccctacgtgtatgttaactcatccgggacaattgaaaactataagcccatacaggttgttagtgcatgttcactggagacttatgcattcccctttgatgtacaaaactgcagtctcacattcaagagcattctccacacagtcgaagatgttgacttggcatttctgcgcagccccgaggatatccagcacgacaagaaggcctttctcaacgatagtgagtgggagctccttagcgtcagtagcacctactcaatcctgcagtcaagcgcaggggggttcgcccaaatccagttcaatgtggtgatgagacgacatccactcgtgtatgtggtgagcctgctgatcccatcaatctttctgatgctcgtggacctcgggtctttctatctgccgcccaattgtcgcgctcggatagtgtttaaaacttcagtactagttgggtacacagtttttcgggttaatatgtctaatcaagttccccgctcagtagggtccacgcctcttattgggcacttcttcaccatttgtatggcgtttctcgttttgagcctggccaagtccatcgtactggtaaagttccttcatgacgagcaaaggggcggacaggaacagccctttctctgcttaagaggggacactgacgccgatagaccaagggttgaaccaagagctcagagagccgtggtcactgagtcgtccctgtacggggaacacctggcccaacctggtactctgaaggaggtgtggagtcagcttcagtcaatctcaaattatttacaaacacaggaccagaccgaccagcaagaggccgaatggctggttctattgtctcgatttgaccgccttttattccaaagttacctgtttatgttgggaatttataccattactctgtgctccctctgggcactttggggcggagtgtag

SEQ ID NO: 177368 - DNA, 528 bp, Artificial Sequence
  Description of Artificial Sequence: Synthetic coding sequence
tgagccgagaaccagatcctgaagaccagcgtgtggtaccaggaggtgtggaatgatgaattcctctcctggaatagttctatgttcgacgagatccgcgaaatctcattgcccctgtcagctatctgggctccagatattattataaatgaattcgtggatatcgaaagatatcccgaccttccctatgtgtacgttaattcttctggaacaatcgagaattataagcctatccaggtggtgtcagcttgttctctcgaaacctatgcatttccctttgatgttcagaattgcagcctgacgttcaagtccattttgcatactgtagaagacgtcgacttggccttccttcggtctccagaagatatccaacacgacaaaaaagcatttcttaatgatagcgagtgggagctgctctccgtgagcagtacatattccatactgcagagtagcgcgggaggctttgcccagatccagttcaatggcacatcaagcccatccgcctggccaagctggttttccgcctag

SEQ ID NO: 177369 - DNA, 1449 bp, Artificial Sequence
  Description of Artificial Sequence: Synthetic coding sequence
atgctggccttcatcctgagccgggccaccccccggcccgccctgggccccctgtcctaccgcgaacaccgcgtggcattgctgcacctgactcatagtatgtcgacaacaggacgtggggtgactttcaccatcaattgttctggcttcggacaacacggggctgatccaactgctcttaatagcgtttttaaccgtaaacccttcaggccagtgaccaacattagcgttcccactcaggtcaacattagtttcgcaatgagtgccatactagacgtggtctgggataacccctttatttcttggaacccggaggaatgtgaagggataaccaaaatgagcatggccgcgaaaaatctttggttacctgatatctttattatcgagctgtgtgtgtcgagggccggacagcgggaggtacccagccccggcagccaccgtgaccactctctgcccctgggacccctgatggatgtggataagacccccaaaggcctgacagcctatgtgtctaacgaggggagaattcggtacaagaaaccaatgaaggtagactccatttgcaaccttgacattttttacttcccgttcgaccagcagaattgcactttgacgttctcctcgttcctgtacaccgttgactctatgttgttagatatggagaaagaagtgtgggaaattacggatgccagtaggaacatacttcagacccacggcgaatgggaactgcttggattgtctaaggccacagccaaactcagtagaggcggaaacttatatgaccagattgttttctacgtggcaattcggcggcgcccttccctgtacgtgatcaatctattggttcctagcgggttcctggtggcaattgatgcgttgtctttctaccttcccgttaaaagcggaaatcgcgttcccttcaaaattacactattgctcgggtacaatgtatttctgctgatgatgtctgatctcctgccaacatcaggaactccacttatcggagtttatttcgcactgtgtttgagtttgatggttggaagtctgttggaaaccattttcattacccatctgctgcatgttgccacaacacagccgccgccgttaccaaggtggctccactctctgctgctgcactgcaattcgccaggccgctgttgcccaacggctcctcaaaaggagaacaagggacccggattaacccctacccatctccctggggtgaaggaacctgaagtgtcagccggccaaatgccaggtcccgctgaggccgaattaactggcggcagcgagtggacgcgggcccagagggagcatgaggcacagaagcaacactctgtggaactctggctgcagttcagccatgcgatggatgcaatgctgttcagactgtacttattatttatggcctccagtataatcacagtgatctgcctctggaatacttag

SEQ ID NO: 177370 - DNA, 1137 bp, Artificial Sequence
  Description of Artificial Sequence: Synthetic coding sequence
atggacaagctggacgccaacgtgagcagcgaggagggcttcggctctgtggaaaaggtggtgttgttgacgttcctatctaccgtaatcctgatggctatcctggggaatctgcttgtcatggtcgccgtctgttgggaccggcagcttcggaagattaagacgaactatttcatcgtgagtcttgcgtttgcggatctgttggtgagcgttctggtgatgcccttcggggcgatcgagttggtgcaagacatttggatctacggcgaggtgttttgtcttgtccgcacatccctcgatgtgctgctcaccacggcgtctattttccacctgtgctgtatcagcttagaccgctactacgcgatttgctgccagcctctcgtgtaccgtaataaaatgacccccctccgaattgccctcatgttaggcggatgctgggtgatacccacattcatatctttccttcctatcatgcagggatggaacaatattggcataattgacttgattgaaaagcggaagttcaatcagaattctaattctacgtattgtgtctttatggtgaataaaccctacgcgattacttgtagcgtcgtcgcattttacataccgttccttctaatggttctggcatattaccgcatttacgtgacagcgaaggagcacgcccaccagatacagatgctgcagcgagcgggggcctccagcgagagtagaccccagtccgccgaccaacattcaacccatcgcatgaggacggagaccaaagcagccaagactctgtgcattatcatgggatgcttctgcctctgttgggcgccatttttcgttacaaatatcgttgatccattcattgattataccgtgccggggcaggtatggacagcttttctgtggttaggctatatcaacagcggcctaaaccccttcttgtatgcctttttgaacaagtcctttagacgtgcgtttctgatcattctgtgctgtgatgacgagcgttatcgaagaccttctatactgggacagaccgttccatgctcaaccacaacgatcaacggatcgacgcacgtactttcgggctgctcccccgtctcttcatttctcctgttattttgcaaccgacctgttccggtgtag

SEQ ID NO: 177371 - DNA, 1164 bp, Artificial Sequence
  Description of Artificial Sequence: Synthetic coding sequence
atggacaagctggacgccaacgtgagcagcgaggagggcttcggcagtgtggaaaaagtggttctgcttacgtttttgtccactgtgattttaatggccatccttggaaatttgctcgtaatggtggctgtgtgttgggaccgacagctgagaaagattaagactaattacttcattgtttctctggccttcgctgacttgcttgtgagtgtgctcgttatgcctttcggagctattgaattggtccaggatatatggatctacggtgaagtgttctgccttgtgagaacatctctcgacgtgctcttgacaaccgccagcatttttcacctgtgctgcatctctctcgatcggtactacgctatatgttgccagcctttagtctatcgcaataaaatgactcccctcagaatcgcccttatgctaggcggctgttgggtgatccctacctttatctcctttctccccataatgcaaggctggaacaacattgggattatcgatctgatcgaaaagcgcaagttcaaccagaactcaaatagcacatattgtgtatttatggttaacaaaccttatgccatcacctgcagcgtggtggcgttttatattccctttctcctcatggtcctggcttattaccgaatttacgttacggccaaagagcacgcccaccaaattcagatgttgcagcgggccggagcttctagtgaatctcgccctcagtctgccgaccagcactctactcatcggatgcggacagagaccaaggcggccaaaactctgtgcattatcatggggtgcttttgtttatgttgggcaccctttttcgttactaacattgttgatccttttattgactataccgtgccaggccaagtgtggacagcatttttgtggttaggctatatcaacagtggcttgaatccctttctgtatgccttcttgaataaatcattccgccgggccttcttaatcattttatgctgcgacgacgaaagatacagaagacctagcattcttggacagaccgtgccatgttccacaacaacaattaacggaagtactcatgtgctcaggtacaccgtgcttcacagaggacaccatcaagagctggagaagttgcctattcataacgacccggagtccctcgagtcctgtttttag

SEQ ID NO: 177372 - DNA, 1287 bp, Artificial Sequence
  Description of Artificial Sequence: Synthetic coding sequence
atggacaagctggacgccaacgtgagcagcgaggagggcttcggctccgtggaaaaagtggtgctgctcaccttcctgagtaccgtgattcttatggcaattctgggcaatttactcgtaatggtagctgtgtgctgggatagacagctgaggaagataaagacaaactacttcatcgtcagcctggccttcgccgatttgcttgtgagcgtcctggtcatgccttttggggcaatcgagctcgtgcaggatatttggatttatggtgaggtgttttgcctggtgagaactagcctggacgtcctgctgacgacggcttcaatctttcatctgtgctgcatatctttggatcggtactatgccatctgttgccagccacttgtttaccgaaacaagatgacccccctccggatcgccctgatgctagggggatgttgggtgattccgacattcatcagcttcctgccaatcatgcagggctggaacaatatcggtatcatcgatttgatagaaaagaggaagtttaatcagaacagtaattctacctattgtgtcttcatggtgaataaaccttatgccatcacctgctccgtcgtggccttttacattccattccttttaatggtcctggcttactaccgtatctacgtaaccgcaaaagaacatgctcaccagattcaaatgctgcaacgtgcaggcgcatcctctgagagcagaccccaaagcgctgatcagcactcaacgcaccggatgaggaccgagaccaaagccgcaaagacactctgtattataatgggctgtttttgcctctgctgggcccctttcttcgtgactaacatcgttgacccatttatcgattatactgtacctggccaggtgtggacggcattcctgtggctgggctacatcaattcaggcctcaatcccttcctctacgcttttctgaacaaaagctttaggcgggcctttctaatcatactctgttgcgatgatgagcgctacaggaggccctccatccttgggcaaacagtgccttgtagcactaccaccatcaatggcagcacccatgtgctgcggacagattttcttttcgaccgcgatatactggcccgatattggaccaaaccggctagagcaggacccttttcaggtacactctctatccgctgtttgacagcacggaaacccgtgctgggggatgctgtcgagtgtggtggtcagtgggagagccagtgccatcctcctgccacatcacccctggttgcagctcagccaagtgatacttag

SEQ ID NO: 177373 - DNA, 1209 bp, Artificial Sequence
  Description of Artificial Sequence: Synthetic coding sequence
atggacaagctggacgccaacgtgagcagcgaggagggcttcggcagcgtggagaaagttgttctgctaacatttctcagcaccgtaatccttatggccattttgggaaacctgctggtgatggtggccgtctgctgggaccgccagttgagaaagatcaaaaccaactattttatcgtcagcttggcattcgctgacctgctggtgtccgtgctggtcatgccgttcggggctatagagctggtccaggacatttggatctatggtgaggtgttctgtcttgttaggaccagtctggatgtgttactcactactgcctctattttccatctttgctgcatctccctagaccgatattatgccatttgctgccagcctcttgtctacagaaataaaatgactcctttaaggattgctctgatgctcggcggttgctgggtaatccctacctttatctcattcctgccaattatgcagggctggaacaacatcggtataatagacttggagcggagcctcaaccaaggcctgggacaggactttcatgctattgagaaaaggaagttcaaccagaacagcaattctacctattgcgtgttcatggtgaacaagccctacgccattacctgtagtgtggttgcattctatatccccttcctgttgatggtgctagcatactaccgcatatatgtgaccgcaaaggaacacgcccaccaaatacagatgttacagagagcaggcgcatcctccgagtcccgaccccagagtgccgaccagcacagcacacaccgcatgagaaccgaaaccaaagcagctaagacactctgcatcatcatgggttgtttctgcctgtgctgggcaccattctttgtaacaaacatcgtggatcccttcatcgattacacagtgcccgggcaggtttggactgcctttttatggttgggttacattaactcagggctaaacccttttctctatgcgttcctgaacaagtctttccgccgagcctttctgattatcctctgttgtgatgacgagaggtatcgacgaccatcaatcctggggcagaccgtgccttgctcaaccaccacgattaacggaagcactcatgtactacgtgatgctgtggagtgtgggggccagtgggagagtcagtgtcatccccccgccacaagtccattggtggccgcccagccatccgatacgtag

SEQ ID NO: 177374 - DNA, 1167 bp, Artificial Sequence
  Description of Artificial Sequence: Synthetic coding sequence
atggacaagctggacgccaacgtgagcagcgaggagggcttcggctctgtggaaaaggtggttctgctgactttcctctccacagttatactgatggctattctgggtaacctgttagtgatggtcgctgtgtgctgggaccggcagctgaggaagattaagaccaactatttcattgtgtccctggctttcgctgacctgctcgtgagcgtcctggtcatgcccttcggcgccattgaattggtgcaggacatttggatttacggggaagtgttctgccttgtccgcactagcctggatgtgctactgacaactgctagtatcttccacctgtgctgcattagcctggacaggtattacgctatttgctgtcaaccccttgtatatcgtaataagatgactccattgagaatcgctctaatgctgggaggttgctgggtcattcctacgttcatttcatttctccctattatgcagggctggaataacatcggcattatcgatttgatcgagaagcgaaagttcaaccagaactcaaacagcacatactgtgtcttcatggttaataaaccatatgctattacttgcagtgtcgtggccttttatatcccatttctcctcatggtgctggcatactacaggatctacgtgacagccaaggagcatgcccatcagatccaaatgctgcagcgcgctggggccagctccgagtctaggccccagtccgcagatcaacacagcacccaccgaatgaggacagaaaccaaagccgccaagaccctgtgcattataatgggctgcttctgcctgtgttgggccccattcttcgtgaccaacatagtcgatccattcattgactatactgtgcctgggcaggtgtggactgctttcctgtggttgggatacatcaatagcgggttaaaccccttcctgtacgcctttttaaataagtcattccgacgagctttcctgatcatcctgtgttgcgacgatgagcgttatagacgtccatctattctggggcaaaccgttccatgcagcaccacgacaattaacggttcaacccatgtgctccgggacgccgtggaatgcgggggtcagtgggagtcccagtgccaccctcccgccacaagcccactggtcgcagcccaaccaagcgacacctag

SEQ ID NO: 177375 - DNA, 1083 bp, Artificial Sequence
  Description of Artificial Sequence: Synthetic coding sequence
atggacaagctggacgccaacgtgagcagcgaggagggcttcggctccgtggaaaaggtggtgctgctgacttttctaagtactgtgatcctgatggccatactgggcaatctccttgtgatggttgcggtgtgttgggatcgacaattgcgaaagataaaaacgaactattttatcgtgtccctagcctttgccgacctgcttgttagcgtccttgtgatgccctttggggccatagagcttgtgcaggacatttggatctacggcgaggttttttgtttggtacgtaccagtcttgacgttttgctcactactgcctccatctttcacttgtgctgcatatccctggaccgctactatgccatttgttgtcagcccttagtgtatcggaacaaaatgactccgctgcgcattgccttaatgctggggggttgctgggttattccaacatttattagtttccttcctatcatgcagggctggaacaacatcggcattattgatttgatcgaaaagcgcaagtttaatcaaaattcaaacagtacttactgcgtgtttatggtgaacaagccctatgcgatcacctgtagtgtagttgcattctatattccattcctccttatggtcctcgcatattatagaatatatgtgaccgcaaaggaacacgcccaccaaatacagatgctgcagcgcgcaggggcctcctctgaatcaagaccacagagcgctgaccagcacagcacccaccgaatgcgtactgagaccaaagctgcaaaaactttatgcattataatgggctgcttctgtctgtgctgggcgccgtttttcgtaacgaatatagtagaccctttcattgactacacagttccgggccaggtgtggacagcgttcctgtggctcggctatattaacagcggactgaatccgtttctctacgcctttctgaacaaaagctttaggcgcgcgtttttgatcattctgtgctgcgacgacgaacgctatagacgcccttcaatcctgggtcagacagtcccctgctccaccaccacaatcaatggcagtacacacgtcctaagattttag

SEQ ID NO: 177376 - DNA, 1236 bp, Artificial Sequence
  Description of Artificial Sequence: Synthetic coding sequence
atggacaagctggacgccaacgtgagcagcgaggagggcttcggcagcgtagaaaaggtcgtgctactgactttcttaagtactgtaattctgatggctattctgggcaacctgttagtaatggtggctgtttgctgggacaggcagctgcgcaaaatcaaaaccaactatttcattgtcagtctcgcgtttgccgacctcctggtcagcgtgctcgtcatgccatttggcgccatcgaacttgtgcaggacatctggatttacggagaggtgttctgccttgtgagaacctctttggatgtgttattgactacggcctctatcttccatctttgctgtatcagtttggaccgctattatgcgatttgttgccagcctttggtgtaccggaacaaaatgactcccctgcgcatagcccttatgctcggcggctgctgggtgatccctacttttatctccttcctgcccattatgcaagggtggaataatatcggtatcatagatttaattgaaaagaggaaatttaatcagaattctaacagcacatactgtgtgttcatggtcaataagccttacgcgattacctgttctgtagtggcgttttacatccccttcctacttatggtcctcgcttattatcgcatctatgtgacagccaaggagcacgcccatcagatccagatgctacaacgagctggggcatcctcggagtcccgcccacagagcgccgaccagcactcaacacataggatgcgcacagaaaccaaagcggctaaaacactatgtatcattatgggctgtttctgcttgtgctgggcacctttcttcgtgactaatatagtagatccttttatagactacacagtgccaggccaggtgtggacagcttttctatggctgggatacatcaattctgggctgaatccattcttatatgctttcttgaacaagtcttttcgacgggcctttttgattattctgtgctgcgatgacgagcgataccggcggcctagcatcctcggccagacagtcccctgcagcaccactaccattaatggatccacacacgttctctcctcagggaccgagaccgaccgcaaaaaattatggaacaaggaggaaaagattgaccaaactatccaaatgccaaaacgaaagcgtaagaagaaggcctcactatcctacgaagacctgattctcctgggcaggaaatcatgtttccgggaggggaagtag

SEQ ID NO: 177377 - DNA, 1164 bp, Artificial Sequence
  Description of Artificial Sequence: Synthetic coding sequence
atggacaagctggacgccaacgtgagcagcgaggagggcttcggctccgtggagaaagtggtgcttctcacctttctgtctaccgtgatcctaatggctatcttgggtaacctattggtcatggtcgcagtgtgttgggatcggcagctgcgaaagatcaagaccaattacttcatagtttccctcgcctttgccgatctactggtgagcgtccttgtgatgccgtttggtgctatcgagctcgtacaggacatttggatttacggtgaagtgttctgcctggttagaacaagcctggatgtactgctgacaacagcctccatcttccacctgtgctgtatcagcctggaccggtactatgcaatttgctgtcaaccactggtttaccgcaacaaaatgacccccctccgaatagctctgatgctcggtgggtgctgggtaatcccaacgtttatatcttttctacccataatgcaaggatggaacaatataggaatcatcgatctaattgaaaagaggaagttcaatcagaactccaactctacttactgtgtgttcatggtcaacaagccctacgccatcacatgtagtgtcgttgctttttacataccctttctactgatggtcctcgcctactacagaatctacgttacagccaaggaacacgctcaccaaatccaaatgctccaaagggccggagcctcctccgagtcccggcctcaaagcgccgatcaacacagcacccataggatgcgcaccgaaaccaaggcagccaaaacactttgcattattatgggctgcttttgcctctgctgggccccgtttttcgtaaccaacatcgttgatccatttattgactatacagtgcctggccaggtctggacagcttttctttggctaggttacatcaactccggactgaatcctttcctctacgcatttctgaacaaatccttccgcagagcctttttgattatcctgtgctgtgatgatgagcgctatcgaagaccatctatcctcgggcaaaccgtaccatgttcgacaacgaccattaatggttccacgcatgtgcttcgatacacagtgctgcacagagggcaccatcaggagctggagaaactgccaatccacaacgaccctgagtccttagaaagttgcttctag

SEQ ID NO: 177378 - DNA, 1137 bp, Artificial Sequence
  Description of Artificial Sequence: Synthetic coding sequence
atggacaagctggacgccaacgtgagcagcgaggagggcttcggctccgttgagaaagtagtgttgttgaccttcctgagcacagtgattctgatggctatcctgggaaatctgctcgtaatggttgcggtctgctgggatcggcagctgcgcaagattaagaccaactacttcatcgtctctctggccttcgccgatctcttagtgtccgttttagtcatgccctttggtgccattgagctcgtccaagatatttggatttatggggaggtgttttgtttggtgagaacctctttggacgtgttgctgacaacagcctcgatttttcacctctgttgcatttctttggatagatactacgctatctgttgtcagcccctggtatacaggaataaaatgacccccttgcgcattgcgttgatgctgggtgggtgttgggtgatacccaccttcatttcttttcttcccatcatgcaggggtggaacaatatcggcattatcgacctgattgaaaaacgcaaattcaaccagaattcaaactccacctactgtgtcttcatggtaaacaagccttatgccatcacttgttctgtggtcgctttctatatccctttccttctcatggtgctggcttattatcggatatatgtgactgctaaagagcatgcgcatcagatccagatgctacagagagccggcgcctcttcggagagccgaccgcagtctgctgaccaacactctactcaccgcatgagaaccgagaccaaggccgccaagaccctctgtattatcatgggctgcttttgtctgtgctgggcaccattttttgttaccaatatcgtcgatcccttcattgactatacagtacctggccaggtctggacggccttcctctggctgggatacattaattccggcttaaacccctttttgtacgcattcctgaataagtccttccgcagagcttttctgatcattttgtgttgtgacgatgagcgctaccggaggcctagcatcctgggccagaccgtgccttgctccacaacaaccatcaacgggagcacgcatgtccttagtggctgcagccctgttagctctttcttgctgcttttctgtaacagacccgtgcctgtatag

SEQ ID NO: 177379 - DNA, 1137 bp, Artificial Sequence
  Description of Artificial Sequence: Synthetic coding sequence
atggacaagctggacgccaacgtgagcagcgaggagggcttcggctccgtggagaaagtggtgttactgaccttcctttctacggtcatccttatggcaattctcggcaatctgctggttatggtggccgtatgctgggatagacagctaagaaagatcaagacaaactatttcattgtgtcactcgccttcgctgatttgttggtgagcgtactggtgatgccttttggtgcaatcgaactcgtccaggacatttggatatacggcgaggtcttctgtcttgtgagaacatctctggacgtcctacttactacagcttccatctttcacctctgctgtatcagcctggacagatactatgctatctgttgccagcccttagtgtacaggaataagatgaccccccttcggatcgctctgatgctgggtggctgctgggtaatcccaacattcattagctttctacccataatgcagggctggaacaacatcggcattattgacctgatagagaagcgcaagtttaaccagaacagcaactctacatactgtgtattcatggtcaacaaaccgtacgctataacctgcagtgtcgttgcgttctatattcccttcctgctgatggtcctggcctactaccgaatatatgtgacagctaaggagcacgcccatcaaatccaaatgcttcagcgcgccggcgcgtcttcagaatcacgaccccagtctgccgaccagcattcaacccatcgcatgcgcaccgagacaaaggccgctaagactctgtgcattatcatgggatgtttctgcctttgttgggcacctttctttgtgaccaacatcgttgatccatttatcgattacaccgtgcctggtcaggtctggaccgccttcctgtggctgggatatattaactctggcctaaatccctttttgtacgcctttctgaacaaaagtttccggcgggccttcctcattatactctgctgcgacgacgagcggtataggcgaccatcaatcctagggcagaccgtgccctgtagcaccaccacgatcaatggttccactcacgttctctccgggtgctcacccgtttcctcctttttgctgttgttctgcaatcgacctgtgcctgtttag

SEQ ID NO: 177380 - DNA, 1074 bp, Artificial Sequence
  Description of Artificial Sequence: Synthetic coding sequence
atggacctgcccgtgaacctgaccagcttcagcctgagcaccccctccccacttgagaccaaccactccctcggaaaggacgatctgcggccaagttccccacttctgtccgtgttcggcgtactaatactcaccctacttgggttcttggtcgcggccacattcgcctggaatctgctggtattagcaaccatcctgcgagttaggacattccatagagtcccacataacctcgtagcctccatggccgtctctgacgtcctcgttgccgctctggtcatgcccctgtcccttgttcatgagctttccgggcggaggtggcagctaggtaggagactctgccaattatggatagcttgcgacgtactgtgctgcacagcctccatctggaacgtgactgccatcgcactggacaggtactggtctatcacccgccacatggaatatactttaagaacgcgcaaatgtgtgtccaacgtcatgatcgcccttacctgggcattgtccgccgttatctcactggctccgctccttttcggctggggggagacatattcagagggaagcgaggaatgccaggtgagtagggaaccaagctacgctgtgtttagcacagtaggtgcattctatcttcctctgtgcgtggttctctttgtgtactggaaaatctacaaagctgctaagtttcgcgtcggtagccgtaagactaattctgtctccccaataagcgaggccgtggaggttaaggactctgcaaaacagcctcagatggtctttacagtgagacatgctaccgtgacatttcagcccgaaggtgacacttggcgtgaacaaaaagaacaacgggcagctttgatggtcgggatacttataggggtgtttgtcctgtgctggattccattcttcctgaccgagctgattagtcctctctgcagctgcgacatccccgcaatctggaagtcaatcttcctctggcttggctacagcaatagcttcttcaatccgttaatatatacagcattcaataagaactacaattcagcctttaaaaacttcttctcacggcagcactag

SEQ ID NO: 177381 - DNA, 1323 bp, Artificial Sequence
  Description of Artificial Sequence: Synthetic coding sequence
atggtgcccgagcccggccccaccgccaacagcacccccgcctggggtgcaggcccccccagtgcccctggaggaagtggatgggtggctgccgcactctgcgtggtgatagctctgaccgcagccgccaacagcctgcttattgccctgatttgcacccagccagccctgaggaatacatcaaatttcttcttggtttccctgttcacttccgatctgatggtgggtctcgtcgttatgccacctgcgatgctgaatgcactgtacggcaggtgggttcttgcccggggactctgcctcttatggacagcgttcgacgtgatgtgctgcagcgcttctattctcaacctgtgcctcatcagcctagatcgctacttgctgattctgagtccactgcgctacaaattgcgtatgaccccacttagggccctcgcactggttttaggcgcatggtctctggctgcccttgcttcattcttaccgctgttgctcgggtggcacgaacttgggcatgcccgaccacccgtgccgggacagtgtagattacttgcgtcccttccattcgttctcgtggctagtggcctaacttttttccttccctctggtgctatctgctttacctactgtcggattctgctcgcagcccgtaagcaggcagtccaggtcgcctcactgaccacaggcatggcttcacaggcttccgaaacattgcaggtgccccggacacccagaccgggcgtcgaaagtgcagactctcggcgtctggccacaaaacattctcggaaagcactcaaggcgagcttgaccttggggatcctgctggggatgtttttcgttacgtggcttccattttttgtggctaacattgtgcaggcagtctgcgactgcatcagtcctggactcttcgatgtcttaacatggttgggctactgcaactctaccatgaaccccataatctacccccttttcatgagagacttcaagagagccctcggccgatttttgccttgcccccgctgtcctcgggaacggcaagcgtcgttggcatcacctagcctgcgaacatcccactcaggacccaggccgggactgtcattacagcaagtactacctttacctttgcctcctgacagcgatagtgactcagacgccggctctggtggatcaagtggcctccgtttgacagcccagttactgctgccaggggaggctactcaggatccccccctgcccacaagggccgcagcggccgtgaactttttcaatatcgacccagccgagccggagctgcgcccccatcctcttggaatcccgactaactag

SEQ ID NO: 177382 - DNA, 1338 bp, Artificial Sequence
  Description of Artificial Sequence: Synthetic coding sequence
atgatggacgtgaacagcagcggccggcccgacctgtacggccacctgaggtctttcctgctgcccgaagttggtcgcggtcttccagatctgtctccagacggtggggctgaccctgttgctggaagctgggcacctcacctcctgagcgaagtgactgcatcgcccgccccaacgtgggatgcgccgcctgacaacgcctccggctgcggcgagcagataaactacggtcgcgtggagaaggttgtgatcggttctatcttgacactgatcaccctcctcacaattgccggcaattgcttagtcgttataagcgtgtgcttcgtgaaaaaacttagacaacctagtaactatctgatcgtgagcctggcgctggccgatctttccgttgctgtggccgtgatgccttttgtgtccgtcaccgatttgataggggggaagtggatatttggacactttttttgtaacgtttttattgctatggatgtgatgtgctgtaccgcatccattatgacgctgtgcgttatttcaattgaccgttacctcgggatcacccgcccgctcacctatccagtccgtcagaacgggaagtgtatggccaagatgatcctctccgtgtggctcctgagtgccagcataactctaccacccctgtttggctgggcccagaatgtgaatgatgacaaagtttgccttatctctcaggattttgggtacactatctatagtactgccgtggctttctatatccctatgtctgtgatgctcttcatgtattaccagatttacaaggccgccagaaaatctgcggccaaacacaagtttccaggattcccaagggtggagccagatagcgtgattgcgcttaatggcatagttaagctgcagaaagaagtggaggaatgtgctaacctctctcgtctactgaagcacgagcgcaagaacatctccatctttaagcgggaacagaaggctgcaaccactctcggaataattgttggggctttcaccgtgtgttggctgccattttttctgctgtccactgccaggcctttcatatgcggcacttcttgtagctgtatccccctgtgggtggaaaggactttcttgtggctgggttacgcgaatagcttgataaaccctttcatttacgccttttttaacagggatttgcgcacgacttaccggagcctacttcaatgtcagtacaggaacatcaatcggaagctcagcgccgccggcatgcatgaagccctgaagctggcagagcgtcctgaacggcccgaatttgttctgcagaacgctgattactgccggaaaaagggtcacgattcctag

SEQ ID NO: 177383 - DNA, 1440 bp, Artificial Sequence
  Description of Artificial Sequence: Synthetic coding sequence
atgatggacgtgaacagcagcggccggcccgacctgtacggccaccttagatcgtttttgctcccagaggtgggtcgtggattgccagatctatctccagatgggggagctgacccagtggccgggtcttgggcaccccacctgttgagcgaggtgacagcttcccctgcacccacgtgggatgctccaccagataacgcatccggctgcggtgagcagatcaactacggcagggtggagaaagtggtgatcgggtcaatcttgactttaattacactgctcacaatcgcaggtaactgtctggtagtgataagcgtgtgctttgtaaagaagctgcgccagccaagcaattacctgatcgtcagcttggccctcgcagacctttcagtcgcggtcgctgtcatgcctttcgtgtccgttacagacctaataggcgggaagtggattttcgggcactttttttgtaacgtctttatcgctatggacgtgatgtgctgtaccgcctctatcatgaccctctgcgtgatttccattgacagatacctcggtatcactaggccactcacatatccagtgcgccaaaatgggaagtgtatggccaagatgatactctcggtttggctgctttcggcgagtatcacacttccgcccttattcgggtgggctcagaacgtgaacgacgacaaggtttgtctcattagccaggattttggatataccatctattctaccgcagttgcattctatatccctatgtctgtgatgctttttatgtattaccaaatttacaaagccgcgagaaagagcgcagcaaaacacaaattccctggtttcccgcgcgtggaaccagattccgtaatcgcgcttaatggcattgtcaagctgcagaaggaagtggaggagtgcgccaatctatcacgactgctgaagcatgaacgcaaaaatatttcgattttcaaacgtgaacagaaagctgctactaccttaggaattattgtgggcgccttcactgtgtgctggttgccattctttttactgtctacagcccggcctttcatctgcggtacctcttgtagctgtataccgctgtgggtcgagcgcactttcttatggcttggctatgcgaattctctcattaatcctttcatctatgccttctttaaccgggatctgaggaccacttatcgatctcttctccagtgccagtatcggaacataaatcgaaagctgtcagctgctggcatgcatgaggccctcaagctggcggagcgtcccgagagaccagagttcgtcttgcgagcatgtactagacgagtgctgctgagacctgagaaacgcccaccagtctcggtttgggtcctgcagtcacccgaccatcataattggctggccgataaaatgctcaccaccgtcgaaaaaaaggtcatgatccacgactag

SEQ ID NO: 177384 - DNA, 1299 bp, Artificial Sequence
  Description of Artificial Sequence: Synthetic coding sequence
atgatggacgtgaacagcagcggccggcccgacctgtacggccacctgaggtccttccttctacccgaggtaggccgcggactccctgatctaagtccagatgggggcgctgaccctgtggccgggagctgggcccctcatttgctgagcgaggtcactgcttcccccgctcctacttgggatgcaccaccagataatgcttctgggtgtggcgaacagatcaattatggccgcgtggagaaagtggtcatagggtccatcctcacccttattaccctcctcaccattgccggcaactgtctagtggtgatctcggtctgctttgtaaaaaagctgagacaaccctccaattacctgatcgtgagcctggcccttgcagacttatccgtggccgttgcagtgatgcctttcgtctcggtcacggacctcatcggcggcaagtggatcttcggtcacttcttttgcaacgtgtttatcgccatggacgtcatgtgttgtaccgcatccatcatgactctgtgcgtaatctcaatcgatcggtatttgggcattacccgaccacttacctaccccgtcagacagaatggcaagtgcatggccaaaatgatcctttcggtgtggctgctctcagcctcaattactctgcccccattgttcgggtgggcccagaacgtgaacgacgacaaggtctgtctaatcagccaggattttgggtatacaatttattcaaccgcagtcgcgttttacattccaatgtccgtgatgctctttatgtactaccagatctataaagctgcacgaaaaagcgcagccaagcataaatttccaggattccccagggtggagcccgactccgtgattgcccttaacggaattgttaaacttcagaaggaggtggaggagtgtgctaatctgtctcgccttctgaaacatgagagaaaaaacatttctatcttcaaacgggaacagaaagccgccacaaccctggggatcatagtgggcgcgtttactgtatgctggctgcctttcttccttttgtctactgcccgcccttttatatgtggcacctcctgcagctgcattccactgtgggttgagcggacttttttatggctcggctatgctaacagcctgattaatccttttatctatgccttcttcaacagggatctgcgcaccacttaccggagccttctgcagtgccagtaccggaatatcaaccgcaagctctctgccgccggaatgcatgaggcactcaagctggcggagcggcccgagagacctgaatttgtgctgtag

SEQ ID NO: 177385 - DNA, 1440 bp, Artificial Sequence
  Description of Artificial Sequence: Synthetic coding sequence
atgatggacgtgaacagcagcggccggcccgacctgtacggccacttgcgctctttcctgctaccagaggtggggcgtgggctgcctgacttgtctccagacgggggcgctgatccagtggcgggaagctgggccccacacctgctgtccgaagtaactgcatcccctgcccccacctgggacgccccaccagacaacgcctccggctgtggagagcagatcaattatgggcgtgtggaaaaggtcgtgatcgggtccatcctgacactgatcacccttctgaccattgccggcaactgccttgtggtgatctctgtgtgttttgtcaaaaagttaaggcagccaagcaattaccttatcgtgtctctcgccttagcagacctttccgttgcagttgccgtgatgccttttgtcagcgttaccgacctgatcggaggaaagtggatctttgggcactttttttgcaatgtgtttattgcgatggatgtgatgtgttgtaccgcctccattatgacactgtgcgtgatttccattgaccggtacttaggtattactaggcccctaacttacccggttcgtcaaaatggcaagtgcatggccaaaatgatcctgtcggtctggctgcttagtgcgtcaataacgctgcccccactgttcgggtgggcccagaatgtgaacgacgataaggtttgtcttatctctcaggattttggttataccatctacagtaccgccgtggccttttacatccctatgtcagtaatgctattcatgtactaccagatttacaaggctgccaggaaatctgcagcaaaacataagtttcccggattccctcgagtcgagccagatagcgtgattgcattgaatggcatcgttaagttgcagaaggaagtggaagagtgtgccaatctgtcacgcctattgaaacacgagcgcaaaaatataagtatattcaagcgcgagcaaaaggccgccacaacgttggggattattgtgggcgcttttacggtgtgctggctccccttctttctattgagcaccgcccgcccattcatatgtggtactagttgttcgtgtatacctctctgggtagaaagaacctttctttggctcgggtatgctaacagtctcatcaatcctttcatatacgctttcttcaaccgcgacctgcgaaccacatatcggtccctcttgcaatgccagtacaggaacataaatcggaagctgagcgctgctggcatgcacgaggccctgaagctggccgaacgacctgagcgaccagagtttgtgctgattaccagaacttctggcgtccatcaggcattagagaatttcccatggggcaacgaggtaaatcggtggcgcaaatcatgcgagtatttctgtactgataaaatgctcaccaccgtggagaaaaaggtgatgatacatgattag

SEQ ID NO: 177386 - DNA, 2460 bp, Artificial Sequence
  Description of Artificial Sequence: Synthetic coding sequence
ggcatgctggacggccccagcgccatgacccggttctgcaacctgatcgctagtgagccagatattgccaaagttcccctgtgcatcgattctagcaatttcgccgttattgaggcggggctaaagtgctgccagggtaagtgcatcgtgaactccattagccttaaagagggtgaggcgactgagactgatactaaaataagagtctgcacaagagcctatcatttattggtaaagaaattggggtttaacccaaacgacatcatattcgacccaaacatactcaccatcggcaccgggatggaggaacacaacctgtatgccattaactttattcacgccaccaaagtgatcaaggagactttgcctggagctcggatctccggcgggttgtctaacctgtcctttagttttaggggcatggaggcaattcgggaagccatgcacggcgtttttttgtatcacgctatcaaaagtgggatggatatggggattgtcaatgcaggcaacctgccagtgtacgacgatattcacaaggagctactacagttatgcgaggatctgatctggaataaggatcccgaggcgacagagaagcttctgaggtacgctcagacccagggaacgggtgggaaaaaggtaatccagactgacgaatggcgcaatggcccagttgaggaacggttagagtacgccctggtgaaaggcatcgaaaaacacataatcgaggataccgaggaagcacgactgaatcagaaaaagtacccaaggcccctgaacatcattgagggtccgcttatgaacggtatgaagattgtcggtgacctctttggggctgggaagatgttcctgccccaggtaatcaaatcagccagagtcatgaagaaggccgtagggcatctgataccttttatggagaaagagcgagaggaaacgcgggtgctaaacgggaccgtggaggaggaagacccatatcaggggacaattgttttggccaccgtaaagggcgatgttcacgatatcggtaaaaatatcgttggcgtggtacttgggtgcaataactttcgagtcattgacctcggagtcatgacaccatgtgacaagattctgaaggctgccttagatcacaaggctgatattatcggcttatcagggctcatcaccccttccctcgatgaaatgatattcgtggccaaagagatggagcgccttgctattagaatcccactgctcattggcggggcaactacttccaagactcacactgccgtgaagattgctccccgctactcagcacctgtgattcatgtcctagacgccagcaaatctgtggtggtgtgtagccagctcctggacgaaaatctcaaggatgagtattttgaggagattatggaggagtatgaggacatccgccaggaccactatgagtcattgaaggagcgaaggtacttgcccctgtctcaagcacgcaagtcaggcttccaaatggactggttgagcgagccccatccggtgaagcccaccttcatcggaacgcaagtattcgaggattatgacctccaaaaacttgtcgactacatcgactggaagccattcttcgacgtgtggcagctgcgcgggaagtatcctaaccgggggttcccaaagatctttaacgacaaaacggtcggcggggaagctcggaaggtgtacgatgatgcacataacatgttgaataccctgattagtcaaaaaaagctgagagcccgtggggtcgtggggttttggcccgctcagtctattcaggacgacattcatctctatgcagaggccgcagttccccaggccgcagagcctattgctactttctacggcctgagacagcaagccgagaaagactccgctagtacagagccctattactgcttaagcgattttatagcacctcttcactctggcatccgagactatctcggactctttgccgtggcctgcttcggcgtcgaggagttgagcaaagcctacgaggacgacggcgacgactacagctctatcatggttaaagccctaggcgatagactagccgaggcattcgcagaagagcttcatgaacgtgtccggcgcgaattatgggcctattgtggaagtgaacagcttgacgtggcagacctccgcaggctcagatacaaagggatcagaccagctcctggatacccatcacaacccgatcatacagaaaaattaactatgtggcggttggccgatatcgaacagagcaccggaatccggcttaccgaaagtctcgcgatggcccctgctagcgctgtaagcggtctgtacttctccaatctcaagtcgaaatactttgccgttgggaagatttctaaagaccaggttgaagactatgccctacgaaaaaatatctcggtcgctgaggtggagaagtggcttgggccgattcttggttacgataccgattag

SEQ ID NO: 177387 - DNA, 3798 bp, Artificial Sequence
  Description of Artificial Sequence: Synthetic coding sequence
atgagccccgccctgcaggacctgagccagcccgagggcctgaagaagactctgagggatgagataaacgccatcctccagaagaggatcatggttcttgacgggggcatggggactatgatccagagagagaagctaaacgaggagcatttcagaggccaagaattcaaggatcatgccagaccactaaagggaaacaatgacattttgtccattacacagcctgacgtgatttatcagattcacaaagaatatttactggccggtgctgatatcattgagacgaacacttttagctcaacctccattgcccaagccgactatgggttagagcacctcgcctatcgcatgaacatgtgctccgcgggagtggccaggaaggcagctgaagaggtgacactgcagaccggcatcaagcggtttgtggctggagcgctaggccccacaaacaagaccctgtccgtctcgccctcagtcgagcggcccgattacaggaacatcactttcgacgaactagtcgaagcctaccaagaacaggcaaaggggcttctggatgggggcgtcgacatcctccttattgagacaattttcgacaccgctaacgccaaagccgccctgtttgcgttgcagaacctgtttgaggaaaagtacgcacctagaccaatattcatttctggcaccatcgtggacaagtccggtcggacactgagcgggcaaactggggaaggctttgtgatctcagtcagccatggggagccgttatgcattggccttaactgtgctctgggtgctgccgagatgaggccattcatagaaatcattggcaagtgcacaactgcatacgtgctttgctaccccaacgccggtctgccaaacacttttggcgactacgatgaaactccaagcatgatggccaagcatctgaaagattttgcgatggatgggctggtcaatatcgtgggcgggtgctgcgggtctactccagatcacatacgagaaattgccgaggcagtgaaaaactgcaaaccaagggttccccccgccacagctttcgaaggacatatgctcctctctggcctggaaccgttccgaatcggcccttacacaaactttgtcaatattggcgaacggtgtaatgtcgccggaagtagaaagtttgcaaagctcatcatggctggaaactacgaagaggccctctgcgtggccaaggtgcaggtggagatgggagctcaagttttggacgtgaacatggacgatggaatgctggatggccctagcgccatgacaagattctgtaatctgatagccagcgagccagatatagctaaagtgcctctctgcattgatagctctaacttcgctgtgattgaagctggattgaagtgttgccaggggaagtgtattgttaattcaatttccttgaaggagggcgaggacgacttcctggaaaaagctagaaagatcaagaagtatggagcggcaatggtggtgatggcttttgacgaagaggggcaagccacagaaacagacaccaaaatccgtgtgtgtacccgggcataccatctcctagttaagaaactcgggttcaaccccaacgatatcatatttgatcccaacatcctgaccattggcaccggcatggaagagcataacctttacgctatcaactttatccatgccaccaaagtcataaaggagactttacccggtgcacgtattagcggcgggctgtctaacctgtcttttagctttagaggcatggaggcgatccgcgaggccatgcatggcgttttcctatatcatgcaattaagtctggcatggacatgggtatcgtcaatgccggcaatctcccagtgtatgacgacatacataaagagctacttcagctgtgcgaggacctaatctggaataaggatcctgaggcaacagagaaactgctccggtacgcccagacccagggtaccggcgggaaaaaagttatacagactgacgaatggagaaatggaccagtagaggagcggctcgagtacgcgctggttaaaggaatcgagaaacacattatcgaggatacggaggaggctaggttgaatcagaagaagtatccacggcccctcaacataatcgaggggccactcatgaacggaatgaagatcgtcggggacctcttcggcgctggcaagatgttcttgcctcaggtaatcaaatcagctagagtgatgaagaaagccgtcggtcacttaataccttttatggaaaaagagcgagaagaaactcgggtcctgaatggaactgtcgaggaggaggacccctatcagggcacaattgtgctcgcgactgtgaaaggcgatgttcatgatattggtaaaaacatcgtgggagtggtacttggctgtaataactttagagtgatcgacctgggggtcatgacaccttgcgacaagatattaaaggcagccttggaccacaaggcagatatcattggactaagcggattaatcactccttctctggatgaaatgatcttcgtagcgaaagaaatggaacgcctggcaattagaatccctctgctgatagggggggctactacatcaaagactcatacagcagtcaagattgcgcccaggtacagtgcaccagtgatacatgttctcgacgcatcgaagtctgtggtggtctgcagccaacttctggatgagaacctgaaagacgagtactttgaggagatcatggaagagtatgaagacattagacaggatcactatgaatcactgaaggaaagaaggtacctccccctgagccaagcgagaaaaagcggcttccagatggattggctgagcgagccgcacccagtgaaacctacattcatcggtacccaagtgttcgaggattatgatttgcaaaaattggtggactatattgattggaagcccttttttgatgtttggcagttgcgcggaaagtaccccaatcgcggctttccaaagatcttcaatgacaagacggttggcggggaggcacgcaaagtttacgatgatgcgcataacatgctgaacacattgatttctcagaagaagcttagagcaagaggggtggtggggttctggcctgctcagtccatccaggacgatatccacctttacgctgaggctgcagtcccgcaggctgcagagcccatcgccacgttctacgggctacgacagcaggccgaaaaagattctgcttctactgagccatactactgcctgagcgattttatcgcaccacttcacagcggcattagggattatctcgggctgtttgcagtggcctgcttcggagttgaggaactgtccaaggcatacgaggacgatggtgacgattatagctcaatcatggtgaaggccttaggggatcggctagcagaagccttcgccgaagagctgcatgaacgtgtgcgccgagagttatgggcgtactgcggaagtgagcagctagatgtggccgaccttagacggttgcgatacaagggtatacgtcccgctccaggataccccagccagcctgaccacactgaaaaactgaccatgtggagactcgccgacatcgagcagtcaaccgggatacgcctcacagaatccctggccatggctccagctagcgccgtgtccggtctgtacttctctaatcttaaaagtaagtattttgctgttggcaagatatcaaaggatcaagtggaggactacgctcttagaaaaaacatcagcgtcgctgaagtggagaaatggttggggcccatcctggggtatgacacggactag

SEQ ID NO: 177388 - DNA, 3357 bp, Artificial Sequence
  Description of Artificial Sequence: Synthetic coding sequence
atgagccccgccctgcaggacctgagccagcccgagggcctgaagaagacgctccgtgatgaaattaacgcgatcctccagaagcggataatggtgctggacggcgggatggggactatgatccagcgcgaaaaactcaacgaggagcacttccgggggcaggagttcaaggatcacgcacgccctctcaagggcaacaatgacatcctcagtattacccagcccgacgtgatctatcagattcataaagagtatctgctcgctggggcagacattatcgaaaccaacaccttctcaagcacttctatcgctcaggcagactacgggcttgaacatctggcgtatcgcatgaatatgtgcagtgctggcgttgctcgaaaagcggctgaagaggttacactccagactggcattaaaaggttcgttgctggtgcccttggtcccacaaacaaaacactgagtgtgtctccctcggtcgagcggccagattaccgaaatattacttttgacgagcttgtggaagcttatcaggaacaagcgaagggcttgttggacggcggagtcgacatcttactgattgagaccattttcgacactgccaacgccaaggccgcactgtttgcgctgcagaacttattcgaagagaaatacgccccccgcccaattttcataagcgggaccatcgtagacaaatcgggaaggaccctgtctggccagaccggggaaggattcgtgatctccgtaagccacggagagccactctgcatcgggctgaactgcgctctgggtgcggccgagatgagaccattcatcgaaatcatcggaaaatgtaccacggcatacgtgttgtgctaccccaacgcgggcctgcctaataccttcggcgactacgacgaaactccttccatgatggcaaagcacctgaaggacttcgcaatggacgggttggtgaacatcgtcggcggatgctgcggatccactcccgatcacatacgcgagatagcagaagctgtgaagaactgcaagccccgtgtgcctcctgccacagctttcgagggtcatatgcttctatcaggattggagcccttcaggataggcccatacaccaatttcgtgaatattggagagaggtgcaatgtggccgggagcaggaaattcgccaagctgatcatggccggaaactacgaggaagcactttgcgtggccaaggtgcaggttgagatgggcgcccaggtactggatgtgaatatggacgatggcatgctggatggcccctccgccatgacccgattttgtaacttaattgcttcggaacctgacatcgctaaagtgccactttgcattgactcctccaatttcgcagtgattgaggctggcctcaaatgttgtcagggtaagtgcatcgtcaactcaattagtctgaaagaaggggaagatgatttcctggagaaagctcgcaaaataaaaaaatacggagctgccatggttgtaatggccttcgatgaggagggtcagacccaggggacaggcggcaaaaaggttatccagacagacgagtggaggaacggcccggtggaagaaagacttgagtatgccctggtaaagggcattgagaagcacataatcgaggacaccgaggaagcccggctgaatcagaagaaatatcctcgacctctgaatatcattgaaggacccttgatgaatggaatgaagatcgttggggatttattcggagcagggaaaatgttcttgccccaggtaataaaaagcgcaagggttatgaagaaggcagtaggtcatttaattccatttatggagaaagagagagaggagacaagggtgttgaacggtaccgtcgaggaagaggatccataccaggggacaatcgtgctggcaacagtgaaaggagacgtccatgatataggcaaaaatatagtcggggtagtgctgggctgcaacaattttcgagtgatcgatctgggtgttatgacaccatgcgataagatcctgaaggcagctctggatcataaggccgacatcattgggctgtcaggcctgataactccaagcctcgatgagatgatcttcgtcgccaaggaaatggagcggctggcaatccgtatccctctgcttataggaggggcaaccacctctaagacccacacagccgtgaaaatcgcaccgcgatatagcgcccccgtgatccatgttttggatgcttcaaaaagcgtcgtggtgtgttcgcagttgttagacgagaatctgaaggacgagtatttcgaagagattatggaagagtatgaggatatcaggcaggatcactatgagagtctgaaggagaggcggtatctacctctttctcaggcacgaaagagtgggttccaaatggactggctctctgagccccaccctgtgaaaccaaccttcattgggacccaggtgtttgaagattacgatctgcaaaagctggtggactatatcgattggaagcctttcttcgacgtgtggcaactgagagggaaatatcccaatcgtggctttccaaaaatctttaacgacaagacagtgggcggcgaggctaggaaagtgtacgatgatgctcataacatgctaaacaccttaattagccaaaagaaattgcgcgctagaggcgtggttgggttttggcccgcacagagtatacaggatgacattcacctatacgctgaggctgctgtgccacaggccgccgagccaatcgccacgttttacgggttgcggcagcaggccgaaaaagatagcgccagcactgagccttactactgcctgagcgacttcattgcacctttgcattctgggatccgagactacctgggcctgttcgccgtggcttgttttggtgtcgaagagctgtctaaggcctatgaagacgacggcgatgactactcctctatcatggtcaaggccctgggagacagactcgccgaagccttcgctgaagagctgcatgagagagttcgaagagagctgtgggcctactgcggcagtgaacagctggacgttgcagacctgcggcgtctccggtacaagggcatacgccctgcacctggctacccaagccaacccgatcacacggagaagttaactatgtggcgtctcgccgatattgaacagtcaaccgggatcaggttaactgaatcactcgcaatggctccagcttccgcagttagcggattatattttagcaacctcaaaagtaagtactttgcagtggggaagattagcaaagaccaggttgaggactatgccctgagaaaaaacatttctgtggcagaggtagaaaagtgtatgtctgtttaccgaaagatcggcgagtag

SEQ ID NO: 177389 - DNA, 690 bp, Artificial Sequence
  Description of Artificial Sequence: Synthetic coding sequence
atgagcgccggcctgcgggccggctgccacgtggtgctgctgtgccggttttccttggggagcttctcagtacccagccgcgactccgcgagcgggcgtgcctgtctcgccgctcgacccaccccaaggactggaagggtacccgggaaaaaggctagggccccagcagttgctgccccttctcctgaacggggaccacgtgcccttcgagcattcggggtgagaagtccccctgccacacgggccaacggcagaaggcagaaaacgagagctctgtgcggcagactggcgtggagatggctagcctggcccctggccgtcgtcacatgcggagagcacgtattctcagctgcacctagcgcccagggaggtgattctactacctgtcatccccgttcgaaaacctgtcggaaccccgagtatcttcttgcaggcgcagatattattgaaactaatacttttagttcgacctcaattgcccaggccgactatggtctggaacacctcgcttacagaatgaatatgtgctctgcaggcgtggcacgcaaggccgcggaggaggtgaccctacagactgggattaagcgattcgtagcaggtgccctgggcccaaccaataagaccctaagtgtgagtccttccgtggagagacccgattatcgcaacattaatctaccggtcgggtcgtag

SEQ ID NO: 177390 - DNA, 3645 bp, Artificial Sequence
  Description of Artificial Sequence: Synthetic coding sequence
atgagccccgccctgcaggacctgagccagcccgagggcctgaagaaaacccttagggacgagattaacgctatcctgcagaaaagaatcatggttctggatggtggtatgggcactatgatccaacgcgagaaactgaacgaagagcacttccgcggccaggagttcaaagaccacgctcggcccttgaagggtaacaacgatatcctgtcgatcacacagccagatgtgatataccagatccacaaggaatatttgcttgctggggccgatattatcgagacaaatactttttctagtacatccattgcccaggccgattacggcctggagcatctagcatacagaatgaacatgtgttccgcaggagtcgccaggaaggcagccgaggaggtgacactgcaaaccggaattaaaaggtttgtcgcaggtgccctcgggcctacaaataagacactgtccgtctcaccctcagtcgagagacctgactatcggaacatcactttcgacgagctcgtagaggcatatcaagaacaggcgaagggcctcttggacgggggagtcgacattttgcttattgagactatattcgacacagccaacgcaaaggctgctctattcgcattgcaaaacctgttcgaagaaaagtatgctccccgtcctatttttatctcaggtaccattgtcgacaaatctggcaggactctttcggggcagacgggcgagggtttcgttatctcagtcagccatggtgagcctttgtgtatcggcctgaattgcgcattgggcgcagccgagatgcgcccatttatcgagataatcggcaagtgtactacggcctacgtactgtgctacccgaacgctgggctcccaaacacatttggagactatgacgagacccctagcatgatggcaaaacacctgaaagactttgccatggacgggctcgtgaacattgtcgggggatgctgcgggagcacaccggaccacatccgtgagatcgcagaggcagtaaaaaattgtaagccacgcgtgcccccggcaaccgcattcgaaggtcacatgcttctgagcgggctagaacctttcaggatcggcccctatacgaacttcgtgaacataggcgagcgatgcaatgtggccggatcacgcaaattcgctaagctcattatggccgggaactatgaggaggcattatgcgtagctaaagtgcaagtggagatgggcgctcaggtactggacgtgaacatggacgacgggatgctggatggaccttcggccatgacgcgcttctgtaatttgatcgcttcggagcctgatatcgccaaagtccctctatgtattgactcctctaactttgcagtgatcgaggccggtctgaagtgctgccagggcaaatgcatcgtcaattctatttcattgaaagaaggcgaagacgactttctcgaaaaggcaagaaagatcaagaaatatggggcagccatggtcgtaatggcctttgacgaagagggccaggctacagagacagataccaagatccgggtttgcaccagggcataccacctgctcgtcaaaaagctggggtttaaccccaatgacatcatatttgatccaaatatcctcactatcggaactgggatggaggagcataacctgtatgcaattaactttatacacgccacgaaggtaataaaggagaccctccccggcgcccgtatctcggggggactgtccaatctctccttcagtttcagggggatggaggctatccgcgaagctatgcacggggtctttctgtaccatgccatcaagagtggtatggatatgggaattgtcaacgctggcaatttacctgtttatgatgatatccacaaagagctcctccagctgtgtgaggatctcatttggaataaggaccccgaggccactgaaaagctactacgctacgcacagacgcagggtacggggggtaagaaagttatccagacagacgagtggcggaacggaccagtggaagagcggctcgaatacgccttagtgaaagtgatcaagtcagctcgggtgatgaaaaaggcagtgggacatctcattccgttcatggagaaggagagagaggaaaccagggtccttaacggcaccgtagaagaggaagacccgtaccaaggtaccattgtccttgccaccgtaaagggtgacgtgcatgacataggcaaaaacattgttggcgtagtgctcggctgtaataactttagggtcatcgacttgggggtgatgacaccctgtgataaaatcctgaaggctgctttagatcacaaagccgacatcatcggcctgagcggcttgatcacaccaagcctggacgaaatgatatttgtagcgaaggagatggagcgcctggctattagaattcctctgctaattggaggggcgaccacgtcgaagacccacacggctgttaagattgccccaagatatagtgcccccgtcattcacgtactagacgcatctaagagcgtcgtggtatgttcacagctcctcgatgagaatctgaaggacgagtactttgaggagatcatggaggaatacgaggatattaggcaggaccactacgagtctctgaaggaacgccgatatttgcccctgagtcaagcccgcaagtcagggtttcaaatggattggctgtcagagcctcaccccgtgaaacccacgttcatcgggactcaagtctttgaagactacgatctccagaagctcgtggactacatcgactggaagcccttctttgacgtgtggcaactgcgggggaaatacccgaacagggggtttccgaaaatattcaatgacaaaactgtagggggtgaagccagaaaagtctatgatgatgcccataacatgctgaacactctgattagccaaaagaagctgcgggccagaggagttgtgggcttttggccggcgcagagcatccaggatgatatacatctgtacgcagaggccgcagttcctcaagcggccgagcccattgcaacattctatggacttaggcaacaggcagaaaaggactcagcttccactgaaccttactactgtctctccgactttatcgcccccctgcacagcgggatccgggactatcttgggctcttcgccgtggcctgcttcggcgtcgaagaactgagtaaagcttacgaggacgatggggatgattactcttccatcatggtgaaggccctgggcgatcggctggctgaggcatttgctgaggaattgcatgagcgagtgaggagagagctatgggcttactgtggatctgaacagctggacgtggccgacctgagacggctgagatataagggaataagaccagccccagggtacccatctcagcctgaccacaccgagaaactcacaatgtggcggcttgccgacatcgaacagtccacgggaatccggttaaccgagagtctcgcaatggcccccgcttctgctgtcagcgggctctacttttccaacctcaagagcaagtatttcgccgtcgggaagatcagcaaggatcaggtggaggactatgcactgagaaaaaatataagtgtcgccgaggtcgagaagtggcttgggcccattcttggatacgatacagactag

SEQ ID NO: 177391 - DNA, 2178 bp, Artificial Sequence
  Description of Artificial Sequence: Synthetic coding sequence
atgggcgccgccagcgtgcgggccggcgcccggctggtggaggtggcattatgttcctttacagtgacttgcctggaagtgatgaggcgctttttattgctttacgccacccagcaagggcaggccaaagccatcgccgaagagatctgcgagcaggccgtcgttcacggcttctccgcagacttacactgcatttccgaaagcgacaagtatgacctgaaaacagagacagccccccttgtggtggtcgtatccacaacaggaaccggcgaccctccagataccgcccggaagtttgttaaggagatccagaaccagacgctccccgttgactttttcgcacatctcagatacggactgctcggccttggtgacagcgaatacacatacttctgtaacggtggcaaaatcatcgacaagcgtttgcaggagctgggggcaagacatttttatgatacagggcatgcagatgattgtgtggggctggaattggtggtggagccgtggattgcaggcctctggcccgcgttgcggaagcattttaggtcgtccagaggacaggaggagataagcggcgccctgcctgtagcttctccagcctcttctagaacagacttagtgaagagcgaactccttcacatagaatcccaagtggaactcctgaggttcgatgactcagggcgcaaggattccgaagtgctcaagcagaacgcagtgaatagtaatcagagtaacgttgtaattgaagacttcgagagttctctgactcgcagcgttccgcctttgtcccaagcaagtctgaacataccgggcctccctcctgagtatcttcaggtgcatcttcaggagagcctaggtcaagaagaatcccaggtctccgtcacatctgctgatccggtgttccaggttccaatatccaaagctgtccaactgaccacaaatgatgctatcaagaccactctgctggtggagctagacatcagtaatacggatttttcttaccaaccgggcgacgcattttcagtcatttgtcccaattccgactccgaagtgcagtcactgctgcagcgtctgcagcttgaggacaaaagggagcactgcgtgctgctgaaaattaaggccgataccaagaaaaagggcgctacgttaccccaacatatacccgcaggttgctcattgcaatttatttttacctggtgtctggaaattagggcaatccccaagaaggcatttctgagagcccttgtggactatacctccgatagtgcggagaagcggagactgcaggagctgtgctcgaagcaaggcgcagctgattacagcagattcgttcgggacgcctgtgcttgtctgcttgacctgctcctagcatttccttcttgtcaaccgcccctgagtctcctgctagaacaccttcctaagctgcagccccggccatattcctgtgccagcagcagcttattccaccccggtaagctccactttgtttttaacatcgttgagtttctgtccacagctacaaccgaagtcctgcggaagggggtgtgtacggggtggcttgccttacttgttgcatctgttctccagcctaatatccatgcctcacacgaagattctggaaaagcgctagccccgaaaatctccatcagtccaaggactaccaattcatttcacttacctgatgacccctctattccgatcatcatggtgggccctgggaccggaatcgccccattcatcggattcctgcagcacagagaaaagctccaggaacagcaccccgacggcaactttggggcaatgtggctttttttcggatgtagacataaagatcgagattacctgttcaggaaggaattgagacactttttgaagcatgggatattgacccatctgaaagtctcattctccagagatgcacccgtgggagaggaggaagcaccagcaaagtatgttcaggataacatccaattgcatggccagcaggtcgctcgaattctgttgcaggagaacggccatatctatgtctgcggagacgctaagaacatggcaaaggatgtccacgatgccctcgtgcagatcatcagtaaggaggtgggggtggagaagctggaggcgatgaaaaccttagccacgctgaaggaagagaaacgctacctgcaggacatttggtcctag

SEQ ID NO: 177392 - DNA, 177 bp, Artificial Sequence
  Description of Artificial Sequence: Synthetic coding sequence
atgcggcggttcctgctgctgtacgccacccagcagggccaggccaaggctatcgctgaggaaatctgcgagcaggcagtcgtccacggattttccgctgatctgcattgcattagcgaatccgacaaggtgtctgttatccaaaacacacccacctttgcaatgggggggcgatag

SEQ ID NO: 177393 - DNA, 2097 bp, Artificial Sequence
  Description of Artificial Sequence: Synthetic coding sequence
atgcggcggttcctgctgctgtacgccacccagcagggccaggccaaagccatcgccgaagagatttgcgaacaggccgtggtgcatggattcagcgctgatctgcactgcatctcagagtccgataagtacgatctgaagacagaaaccgctcccttagtggtcgtagtctctaccaccggtaccggagaccccccagacacggcgcggaagttcgtaaaggaaattcagaatcaaaccctacccgttgacttcttcgcgcacttgagatacggcctgctggggctcggcgactcagaatacacctatttctgtaatggtggcaagattatagataaacgcctgcaagaattgggcgcaagacatttctatgatacaggccacgccgatgattgcgtcgggctcgagctagtggtcgagccatggattgcaggactatggccagcattgaggaaacattttcggtctagtcgcgggcaggaggagatcagtggcgccctccctgtggcctccccagcctcctcccgtactgacctggtcaaatccgagctgttacacatcgaatcccaggttgaactcttacgctttgacgatagcggtcgcaaagatagtgaagtcctcaaacagaatgcggtgaacagcaaccagtccaacgtggtgattgaggatttcgaatcctccctgaccaggtcagtgccgccactgtcccaggcatccctgaatattcccggacttcctccggaatatctgcaggtgcacctccaggagtccctcggacaggaagaatcccaggtgtccgtgacttctgcagatccggtgtttcaggtccccatctcgaaagctgtgcagttgactacaaacgacgctataaaaactactttactggttgagctcgacatatccaacaccgatttcagttaccaaccaggtgacgcattctctgtcatctgcccgaactcagattctgaggtgcagagcctgctgcagcgactccagctagaggacaagcgtgagcattgtgtgttgctcaagatcaaggccgatacgaagaagaaaggcgctactctgccacagcacatccctgccgggtgtagcctccagttcatctttacgtggtgcctggaaattcgagctattccgaagaaggcattcctgcgggcactcgtagactacacatcagattcggcagaaaagaggcggctacaggaactttgctcaaagcaaggagccgcagattacagccggttcgttagagacgcctgtgcctgtctgctggacctgctccttgcgtttccatcctgccagccccctttgtcgctgttattagaacacttgcctaaactgcaaccccgcccctactcctgcgcatcctccagcctctttcatcccggcaaactgcactttgtgttcaacattgtcgaattcctgagtacagcaacaactgaagtgctgcgaaaaggggtgtgcacaggatggctggctctgcttgttgccagcgtgctgcagcctaacatccacgcttcgcacgaggactctggaaaagctctggcccccaagatctcaatttccccccgcaccacgaattccttccacctccctgatgaccccagcatccctataatcatggtgggccctggaacggggattgctcccttcattgggtttctgcagcaccgtgagaaacttcaggagcaacacccggacggaaacttcggggctatgtggctgttcttcggttgccgtcacaaggatagagattacctgttccggaaagagctgaggcactttctgaagcacggcatcttaacacacctgaaagtgagtttttctagagatgctccagtgggagaagaggaagcccccgcaaagtacgtgcaggataacattcagttgcatggacagcaggtggcccgcatactgctccaagagaacggccacatttacgtgtgtggagatgccaagaatatggccaaagatgttcacgacgcccttgtgcagataatttcaaaagaagtcggagtggaaaagctagaagcgatgaaaaccctggccaccctcaaggaagagaaaaggtatctgcaggacatatggtcttag

SEQ ID NO: 177394 - DNA, 471 bp, Artificial Sequence
  Description of Artificial Sequence: Synthetic coding sequence
atgcggcggttcctgctgctgtacgccacccagcagggccaggccaaggccattgccgaggagatttgcgagcaggcagtcgtgcacggcttttccgctgatcttcactgtattagcgaatccgacaaatatgatctcaaaaccgaaacagctccactcgtagttgtggtctcaaccaccggtacgggcgacccccctgacacagctagaaagtttgtcaaggagatacagaaccaaacactccctgtggacttttttgctcatctaagatatggcctgctggggcttggcgacagcgagtatacttatttttgtaatgggggaaaaatcattgataagagattgcaggaactcggcgctcgacacttctacgacacaggacacgctgacgactgcgtgggactcgaactcgtcgtcgaaccctggattgccggtctctggccagccctgaggaagcatttccgctcttag

SEQ ID NO: 177395 - DNA, 126 bp, Artificial Sequence
  Description of Artificial Sequence: Synthetic coding sequence
atgcggcggttcctgctgctgtacgccacccagcagggccaggccaaggcaatcgccgaagaaatttgcgagcaggccgttgtccatggctttagtgccgatttacactgtatcagtgagagctag

SEQ ID NO: 177396 - DNA, 339 bp, Artificial Sequence
  Description of Artificial Sequence: Synthetic coding sequence
atgcggcggttcctgctgctgtacgccacccagcagggccaggccaaggctattgctgaggagatttgcgagcaagctgtagtccatggcttttcagccgacttgcactgtatctctgaatccgacaagtatgacctgaaaactgaaacagccccccttgtggtggtcgtatccacgacaggcacaggggatccccccgatacggccaggaagttcgtaaaggaaatccagaatcagaccctcccagtggattttttcgcccatcttcgatacggactgcttggtctcggtgattcagaatacacttacttttgtaatggtggaaaaatcatcgattag

SEQ ID NO: 177397 - DNA, 249 bp, Artificial Sequence
  Description of Artificial Sequence: Synthetic coding sequence
atgctgtgggaccccgccctgccccggctggccgtgtacgccagctgcttattcttttcatgcttggatgcccatgagggtcccgttcacggaccgcgcggacgaggggagggaggtcggggcagcgaacgacagagggtgcgtcctggggggggtggtggggccggctcggtgcacatccatctggaggaagaagacggcgccgaggaccaggatcatcgagacgaggactggataaccaaaaaatag

SEQ ID NO: 177398 - DNA, 1647 bp, Artificial Sequence
  Description of Artificial Sequence: Synthetic coding sequence
atgaccatggccgccgccgccgtggtggcccggggcgccggcgcccgtgctgccacggccgctgctctcagagggggctgtggcaccgccgcacgagggaggccatgcgcgggacctgctcggcccttatgtactgcacccggtaccgcgcccgacatgaagcggtatctgtgggagaggtatcgcgaggccaagagatccacggaggagctcgtcccttctattatgagtaatttactcaacccagatgcaatcttttctaacaatgaaatgagtttatcggacattgagatatacggattcgactacgactacacgctggtcttctactctaaacatctgcacactttgatcttcaatgccgctcgggatcttcttattaatgagcacaggtacccagctgagataaggaagtacgagtatgatcccaattttgcaatccgggggcttcactatgatgtccagagggcagttctgatgaagatcgacgcttttcattatattcaattgggcaccgtgtatcgcggtctgagcgtggtgcctgacgaagaggttattgaaatgtatgaagggtcccacgtgccactcgagcagatgtctgatttttatgggaagagttctcacggcaatactatgaaacagttcatggacatcttcagcctgcccgaaatgaccttgctgagctgcgtaaatgagtactttctgaagaacaacatcgattacgagcccgttcacctgtacaaggatgtgaaggatagtatccgggatgtccatatcaaaggcatcatgtacagagcaatcgaggcggatatcgaaaagtacatatgctatgcggaacagaccagagctgtgttggctaaattggctgaccacggaaaaaagatgttccttatcaccaactcccccagcagcttcgtggacaaggggatgagctatatcgttggcaaggactggcgcgatctctttgatgtggtgatcgtgcaggcagaaaagcctaattttttcaatgataaacgtaggcctttcaggaagatgaacgagaagggagtgctactctgggacaagattcacaagctacagaaaggtcagatatacaaacaagggaacctttacgagttcctaaaactcactggatggcgaggttcccgagtgctgtactttggcgaccatatttactccgacctcgcggacctcaccctgaagcacggatggcggacaggcgccatcatccccgagctgcggagtgagttgaagatcatgaacactgaacaatatatccagaccatgacctggctacagactctgacgggtctactcgaacagatgcaggtacacagggatgctgaatcgcagctagtccttcaagagtggaagaaggagcgcaaggaaatgcgcgagatgactaagtcattcttcaacgcacagttcgggagcctattcaggacagaccagaatcctacctattttctaaggcggttaagccgattcgccgatatctacatggcctcgctttcctgtctgctgaactatgacgtcagtcacaccttttacccgcggcgcacgcccttacagcacgaattgcctgcatggtccgaacgtccacccacgttcggcacaccactcttacaggaggcgcaggctaagtag

SEQ ID NO: 177399 - DNA, 1686 bp, Artificial Sequence
  Description of Artificial Sequence: Synthetic coding sequence
atgagcaccagctggagcgaccggctgcagaacgccgccgacatgcccgcaaatatggataagcatgcattgaagaagtataggagggaggcctaccacagagtatttgtgaatcgttctctagcaatggagaaaatcaaatgtttcgggttcgacatggactatacattagctgtatacaaatcccctgagtacgagagcctgggatttgaactgacagtcgagagactagtttctattggctatccccaagagcttctttctttcgcctatgactccaccttccccacacgcggactcgttttcgatactctgtacggtaacctgttgaaagtcgatgcgtacggcaacctgttggtttgtgcacatggcttcaacttcattcgtggtccagagactcgcgagcagtatcccaacaagttcatacaaagggatgacaccgagagattttacatcctgaatacgctgttcaacctacccgagacctatttgctggcctgccttgtcgattttttcactaactgccccagatatacaagctgtgagaccggattcaaggatggggatctgttcatgtcttatagaagtatgtttcaggatgtcagggatgcagtggactgggtccactacaaaggcagccttaaggaaaagaccgtggaaaatcttgagaaatatgttgttaaggacgggaagctccccctcctgctgagtcgcatgaaggaggtcgggaaggtctttctggccacaaactcggactataaatataccgataaaatcatgacttacctcttcgactttccgcacgggccgaagcccggctcaagccacaggccttggcagagctacttcgacctgatcttagtggatgctaggaagcctctgttcttcggtgaggggacagtcctgcgccaggtagataccaagaccggaaaattgaagatcggcacctatacaggcccccttcagcatggcatcgtgtactccggaggcagttccgacactatttgcgatctccttggagcaaaaggcaaagatattctgtacataggcgatcatatattcggagatatactgaaatctaagaagcgccaggggtggagaacgttcctggtgatccctgagctcgcgcaggagctgcatgtgtggaccgataagtccagcctttttgaggagcttcagtccctggatatattcctggctgagctctacaagcatctggactcttcatctaacgaacggcctgacatttctagcatccaacgacgaattaagaaggtgacccatgatatggacatgtgctatgggatgatggggtcactgttccgatcagggtcccgccaaacactgtttgcgagccaagttatgcggtatgccgatctgtacgcagcttcctttatcaatctcctttactatccctttagctacctattcagagcggcacacgtccttatgcctcatgagtccaccgtggaacacacccatgtggacatcaatgagatggaatctccgctggctaccagaaataggacgtcagtcgatttcaaagacacagactacaaacggcatcaacttacacgctcgatatcagaaattaaacctcctaacctattcccgctcgctccacaagagatcactcactgtcacgatgaagatgacgatgaggaggaggaggaggaggaggaatag

SEQ ID NO: 177400 - DNA, 600 bp, Artificial Sequence
  Description of Artificial Sequence: Synthetic coding sequence
atggactacaccctggccgtgtacaagagccccgagtacgagagcctaggatttgagttgactgtcgagcgacttgtttcaattggctacccgcaggaactgttgtcattcgcctatgactctactttccccactagaggacttgtgtttgacaccttgtatggcaacttactaaaagttgacgcatacggaaacctattggtgtgtgctcacggattcaacttcattagagggtcccaagtagccgtgcagaagaggcccgagacccgggagcagtaccctaacaaattcatccagagagatgacacggaacgtttctatattctgaatacgctgtttaatttgcccgaaacgtacctcttagcttgtctcgttgatttttttacaaactgtccaagatacaccagttgtgaaacaggcttcaaggatggcgacctctttatgtcctataggtctatgttccaagacgttagggacgctgtagactgggttcactacaaaggctcactgaaagaaaaaacggttgagaacctggagaaatacgtggtgaaagattccaagtcgtctcgcattcaatacttcctcaaggtcctgtggtag

SEQ ID NO: 177401 - DNA, 1686 bp, Artificial Sequence
  Description of Artificial Sequence: Synthetic coding sequence
atgagcaccagctggagcgaccggctgcagaacgccgccgacatgcctgccaatatggataagcacgcactcaagaagtatcgacgagaagcctatcatagagtctttgtgaacaggagccttgctatggaaaaaattaagtgtttcggtttcgatatggactacacgctggccgtatataaatcaccagagtatgagagcctggggttcgaactgacagtagagcggctcgtcagcatcggttatccacaggaactcctcagtttcgcatatgactcaacgtttccaacacgaggattagtgttcgacacactgtatggcaaccttctaaaggttgacgcgtatgggaatctgttggtctgcgctcacggattcaattttatccggggtcccgagacgagggagcagtaccctaacaagttcatacagagggacgatactgaacggttctatattctcaatacattgtttaacctccccgagacttacttgctcgcatgcttggtagatttcttcaccaactgcccacgctatacatcttgcgagaccggcttcaaggatggtgatctgttcatgtcctatcgtagtatgttccaggatgtcagagatgctgtcgattgggtgcactataaggggtctctgaaggagaaaaccgtggaaaatcttgagaagtatgtggtgaaggacggaaagcttcccttgctcctgtccaggatgaaggaagttgggaaggtgttcctcgcaacaaactccgactacaagtacaccgacaagataatgacatatctgttcgacttccctcacgggcccaagcccggctccagccacaggccctggcagtcctactttgatctgattctggtggatgctagaaagcccctgttttttggagagggtacggtactcaggcaggtggacacgaagaccggtaaactaaagattggaacctatactggaccccttcagcatggaatagtgtactcgggcggaagcagcgataccatttgtgatctccttggcgccaaagggaaggacatcttgtacattggagatcacatttttggggacattctcaaaagcaaaaagcgtcagggttggagaacctttctcgtaattccagagctggcacaagagctgcatgtctggaccgacaagtcaagcctgtttgaagaactacagagtctcgacatctttctggccgagctgtataagcacctcgacagcagttccaatgagagacctgatatatcgtccatccagaggcgtatcaagaaagtcacccacgacatggacatgtgctacggcatgatggggagcctgtttaggagcgggtcccgacagaccctcttcgctagtcaggtgatgcgctacgctgacctatatgctgccagctttataaacctactgtactacccattcagttacctctttcgagctgcacatgtactgatgccccacgagtctacagttgaacacacccatgtcgatattaatgaaatggagtcacccctcgccacaaggaaccgcaccagtgtagacttcaaagatacagattataaacgtcatcaactcacaagatcaatcagtgagattaagcccccaaacttgtttcctctagccccccaggaaattacacattgtcacgacgaggatgacgacgaggaagaggaggaagaggaagagtag

SEQ ID NO: 177402 - DNA, 444 bp, Artificial Sequence
  Description of Artificial Sequence: Synthetic coding sequence
gtgctgcggcaggtggacaccaagaccggcaagctgaagatcggcacctacaccggcccacttcagcacggcattgtctactctggagggtcctcagacacgatttgtgatttactgggcgcgaagggaaaggacattctatacatcggcgatcacatctttggtgatatcctgaagagcaaaaagcgccaggggtggcgaacattccttgtcattcctgagcttgcgcaagaattgcacgtgtggaccgataagagcagtctgtttgaggagctgcagagtctcgacatcttcctggctgagttgtataaacatctcgactccagttcaaacgaaaggccagacataagtagtatccaaaggcgtataaagatgcctcatgagtccaccgtggagcacactcacgttgacattaatgaaatggagagtccactcgctacctag

SEQ ID NO: 177403 - DNA, 1599 bp, Artificial Sequence
  Description of Artificial Sequence: Synthetic coding sequence
atgagcaaggagggcgtgttcgtgaaccggagcctggccatggagaagatcaaatgttttggattcgacatggactacaccttagccgtgtacaaaagtcccgagtacgagagtctgggattcgaattaactgtggaacggctggtaagtattggttacccccaggaacttctgagcttcgcctacgactccacgttccccacgcgtgggttggtgttcgatacactgtatggaaatcttttaaaggtggacgcttatggcaatctcctggtttgcgcccacggatttaacttcatccgcggccctgagaccagagaacagtatccaaataagttcatccaacgtgatgacaccgaacgattctacatcctgaatacgctctttaatctaccagagacctacctcttagcctgcctagtcgacttttttactaattgcccgagatacacttcttgcgagaccggtttcaaagacggcgacctttttatgtcgtataggagcatgttccaggatgtgcgcgatgccgtcgactgggtccactacaaaggctcgctgaaagagaagacggttgagaacctggaaaagtatgtggtgaaggacggaaagctccctttgctgctgagtaggatgaaggaagtgggcaaggtctttctggcgacaaattcggattacaaatacacagataaaatcatgacttacctgttcgactttccacatggacctaagccaggttcatctcatcggccctggcaatcctacttcgacctgatcctggtggacgcacggaaacctctgtttttcggggagggaaccgtactgcgacaggtggataccaagacaggaaagcttaaaattggcacatacacgggccctctgcagcatggaattgtttattcaggaggatcctctgacactatctgtgatctgcttggggccaaaggaaaggatatcctctatatcggggatcatatttttggagacatcctgaaatcaaaaaagaggcagggttggaggacgttcctggttataccggaactagcgcaggagttgcatgtctggactgataagtcctcattattcgaggagctccaatccctggatatctttcttgcggagctgtacaagcacttggacagcagctcaaatgaacggccagacatttcctccattcagcgaagaatcaagaaggtgacacatgacatggatatgtgttatgggatgatgggaagcttatttcggtcaggcagccgacagaccctattcgcaagtcaagtgatgcgttacgcagatctgtacgccgcgtctttcattaacctgctatactatcccttcagctacttgttcagggctgcacacgttttgatgccacacgagagtactgtggaacacactcacgttgacattaatgaaatggaaagtccacttgccacaaggaatagaacatcagtggattttaaagatacagattataaaaggcaccagctaacacgctcaatttccgagattaagccaccaaatttgtttccactggctccccaggaaatcacccactgtcacgacgaggatgacgatgaggaagaggaggaggaggaggagtag

SEQ ID NO: 177404 - DNA, 798 bp, Artificial Sequence
  Description of Artificial Sequence: Synthetic coding sequence
atgagcaccagctggagcgaccggctgcagaacgccgccgacatgcccgctaatatggacaagcatgcgctgaagaaatataggagggaggcgtatcaccgcgtgttcgttaatcggtcgctggccatggagaaaattaaatgttttgggtttgacatggattacaccctggcggtgtataagagtcctgagtacgaatccctggggtttgagctcactgttgaaaggctcgtcagcattggctatcctcaggagttgctcagctttgcgtatgactctactttcccaactcgcggacttgtctttgacacgctctatggaaatcttctgaaggtggatgcctacggaaatcttctggtctgtgcccacggctttaatttcatcaggggtagccaggtggctgtgcagaaacgtccagaaacccgggagcagtaccccaataaatttatacagcgcgatgatacggaacgattttacatcctgaacaccctattcaatctgcctgagacatatctgcttgcatgcttggtggatttttttacgaattgccctagatataccagctgcgagaccggtttcaaagacggggatctttttatgagctacagatcaatgtttcaagacgtgagagacgctgttgattgggtccactataaggggtccttaaaggaaaaaaccgtggagaacctggagaaatatgtggttaaggatggcaagctccccctgttgctgtcgcgtatgaaggaagtaggcaaggttttcctcgccacaaatagcgactacaaatacacagattag

SEQ ID NO: 177405 - DNA, 525 bp, Artificial Sequence
  Description of Artificial Sequence: Synthetic coding sequence
gtgagcatcggctacccccaggagctgctgagcttcgcctacgacagtaccttcccgacacgcggcctcgtattcgataccctttacgggaatttacttaaggtcgacgcctacgggaatttgttggtgtgcgcccatgggttcaatttcatccggggttctcaagtggccgtgcagaaacggccggagactcgagagcagtaccctaacaaatttatacaaagagacgatactgagagattttacatcctgaataccctgttcaacctgccggaaacctaccttctggcatgccttgtggacttctttaccaattgcccgagatacacttcatgcgagaccggttttaaagatggagacctgttcatgtcataccgctctatgttccaggacgtacgggacgcagttgactgggtgcattacaaggggtccctgaaggagaaaactgtggagaatttagagaaatacgtggtcaaagattccaaaagtagtcgcattcagtatttccttaaggttctctggtag

SEQ ID NO: 177406 - DNA, 1011 bp, Artificial Sequence
  Description of Artificial Sequence: Synthetic coding sequence
atgcgggcccccagcatggaccgggccgccgtggcccgggtgggcgccgtcgccagcgccagtgtgtgtgcactggtagccggagtcgtgctggctcagtacatatttactttaaaaaggaaaacaggccggaagacaaagatcatcgaaatgatgccagaattccaaaagagctccgttcggattaagaatcctacccgggtggaggagattatctgcggactcatcaagggcggcgctgcgaagctgcaaattataactgattttgatatgactctgtcgagattctcctataagggtaaacgctgcccaacttgccacaatatcatcgataactgtaagctcgtcactgacgaatgcaggaaaaaactcttgcagttaaaagaaaagtattatgctattgaggtggatcccgtcctgacagtcgaggagaagtacccatacatggtggagtggtataccaagtctcacggcctcctcgtacagcaagcgcttccgaaagcaaaattgaaagagatagtcgctgaatcggacgttatgctgaaggagggatatgagaatttcttcgacaaactccaacagcactcaattcctgtgttcatattctcggctggcatcggagacgtgcttgaggaagtgataagacaagctggggtgtaccaccccaatgttaaagttgtttccaactttatggattttgacgagactggcgtgttaaaaggattcaagggagagttgatccatgtgtttaataaacatgacggagccctgaggaacaccgaatactttaaccagctcaaagataattctaatatcatcctattaggggattctcagggagatctgagaatggccgacggcgtcgccaacgtggaacatattttgaagattggctacctcaatgatcgtgttgacgagcttcttgagaaatacatggacagttatgatatcgtactggttcaagacgagagcttggaggttgcgaatagcatcctccaaaaaatcctctag

SEQ ID NO: 177407 - DNA, 858 bp, Artificial Sequence
  Description of Artificial Sequence: Synthetic coding sequence
atgcccgagttccagaagagcagcgtgcggatcaagaaccccaccagggtggaggaaatcatttgcgggcttattaagggcggggcagcaaagttacagatcatcactgacttcgacatgaccctcagtagatttagctacaagggcaagcgctgtcccacttgccataatatcatcgataattgtaagttagtgacggatgagtgtagaaagaagctgttacagttaaaagaaaaatattatgccattgaggtcgatccagtgctgaccgtcgaagagaaatatccatatatggtcgagtggtatacaaaaagtcacggcctcctggttcagcaggcactgccaaaagctaagctcaaagaaatcgtggcagaaagtgatgttatgctaaaagagggatatgagaacttctttgacaagctgcagcagcattcaatccccgtctttattttcagcgctggcattggtgacgtgctggaagaagtaatcaggcaggccggggtctatcatcccaacgtgaaagtcgtgtctaacttcatggatttcgacgaaaccggggtgctgaaaggctttaaaggtgagctcatccacgtgtttaacaaacatgatggggcgctgagaaatactgagtacttcaatcaattgaaagataacagtaatatcatcctgctgggggactcgcagggagacctgaggatggccgacggggttgccaatgtggaacacatcctcaagattggttatctgaatgaccgggtggatgagctgttagagaaatacatggatagttacgacatcgttctagtacaggacgaatctctcgaagtggccaatagtatcctccagaagatcctttag

SEQ ID NO: 177408 - DNA, 894 bp, Artificial Sequence
  Description of Artificial Sequence: Synthetic coding sequence
atgaccaaccaggagagcgccgtgcacgtgaagatgatgcccgagttccagaaaagttccgtcaggattaaaaacccaactcgggtggaggagatcatatgcggtctgattaaaggtggcgctgctaaattgcagatcataactgatttcgatatgaccctcagccgatttagttacaaagggaagagatgtcccacctgccacaacatcatagataactgtaaactggtgactgacgaatgccggaaaaaactgctgcagttgaaagagaagtactatgcaattgaggtggatccggtgctgactgtcgaggagaaatatccctacatggtggagtggtacaccaagagccacggacttctggttcaacaggcacttccaaaagccaagcttaaggagattgtggcggaatcagacgtaatgctaaaggaggggtacgaaaacttcttcgacaaactgcagcagcactctattcctgtttttatctttagcgccggaatcggagacgtcctggaggaagtgattagacaggccggcgtgtatcatccgaatgtgaaagttgtctctaattttatggatttcgatgagacaggcgtcctgaagggtttcaagggagaattgatccatgtgttcaacaagcacgatggggccctcaggaataccgagtacttcaaccagctgaaagataactctaacatcatcctgctgggggattcccaaggcgacctgagaatggctgatggggtcgctaacgtagaacatatactgaagattggatacctgaatgacagagttgatgaactgcttgagaagtatatggactcctacgacatcgtgttagtccaggatgaaagtctcgaagtcgcaaacagtatcctacagaaaattctctag

SEQ ID NO: 177409 - DNA, 894 bp, Artificial Sequence
  Description of Artificial Sequence: Synthetic coding sequence
atgaccaaccaggagagcgccgtgcacgtgaagatgatgcccgagttccaaaagagttccgtgagaattaaaaatcctaccagagttgaggaaataatttgtggactaatcaaggggggagctgccaagctgcagatcattacggattttgatatgaccctcagtcgattctcctacaaggggaaacgctgccctacatgccataacattatagacaattgcaaactggtcactgacgagtgtagaaagaaactgttacaactaaaagagaagtattatgccattgaggtggacccagtgttgacagtcgaggagaagtatccatatatggtagagtggtacaccaagagccacggacttttggtacagcaagcactgccaaaagcaaagctgaaagagattgttgccgagtcggacgtgatgttgaaagaaggatatgaaaacttcttcgacaagttacagcaacattcaattcccgtgtttattttctccgcggggatcggcgacgttctggaggaagtgatccggcaagctggagtataccacccgaacgtaaaagtggtatcaaatttcatggacttcgatgaaacaggtgtgctgaagggattcaaaggggagttaattcacgtcttcaataaacacgatggggcattgagaaacaccgagtatttcaatcagctgaaggacaacagcaatattatcttactcggagactctcaaggagaccttagaatggcagacggagttgcaaatgtggaacacatcctcaaaattgggtatctgaacgatcgcgtggatgagcttctggagaagtatatggacagctacgatatcgtgctcgtgcaagacgaatccttggaggtggccaattccattttgcagaagattttatag

SEQ ID NO: 177410 - DNA, 858 bp, Artificial Sequence
  Description of Artificial Sequence: Synthetic coding sequence
atgcccgagttccagaagagcagcgtgcggatcaagaaccccacccgcgtcgaggagatcatctgcggactgatcaaagggggagctgccaagctgcagattattactgactttgacatgacactctcgcgcttcagttataaaggaaaacggtgccccacttgccataacattattgataattgtaaactggttacagatgagtgccggaagaagctgctgcagctgaaagagaagtattatgccattgaagtggaccctgtgcttactgtggaagagaagtacccgtatatggtcgagtggtacacaaagtcgcacggactcctggtgcagcaggccctgcccaaggctaagctaaaagagatagtggctgaatcagacgtcatgctcaaagaaggctacgagaatttcttcgataagctccagcaacattcgataccagtgtttattttctccgctggaattggggacgtgctcgaggaagtaattaggcaggccggcgtctaccaccctaatgtgaaggtggtaagtaacttcatggactttgatgagaccggggtgttgaagggcttcaagggggagttgattcacgtattcaataagcatgatggcgcactgcggaatacggaatattttaatcagctcaaagataacagcaacattatcttgctgggagacagccaaggtgacttgagaatggctgacggcgtggcaaacgtggaacatatcctgaagatcggatacctgaacgatagggtggatgaactattggaaaaatacatggattcttatgatatcgtgctggtccaggacgagtcattagaagtcgccaactccatcctacaaaagatcctatag

SEQ ID NO: 177411 - DNA, 129 bp, Artificial Sequence
  Description of Artificial Sequence: Synthetic coding sequence
atgcccgagttccagaagagcagcgtgcggatcaagaaccccacccgggtggaagaaatcatatgcgggttgatcaagggaggagcagccaagctccagattattaccgactttgacatgactttatag

SEQ ID NO: 177412 - DNA, 1725 bp, Artificial Sequence
  Description of Artificial Sequence: Synthetic coding sequence
atgtgcccccgggccgcccgggcccccgccaccctgctgctggccctgggggcggttctgtggccggctgcgggcgcatgggaactgactatacttcacaccaacgacgtccattcccgcttggagcaaacttcagaagactccagtaagtgtgtcaatgcgtccaggtgtatgggcggcgttgcgagactttttactaaagtgcagcagatacgaagggcggaacctaatgttctgcttctcgacgccggggaccagtaccaagggactatttggtttacagtgtataagggggccgaagtggcccactttatgaacgcattacgctacgacgctatggccctgggaaatcacgagtttgacaacggcgtcgaagggctaatcgaaccattgcttaaagaggccaaattcccaattctttctgcaaacatcaaggcaaagggcccgctggccagccagataagcggactctatcttccatacaaggtgctcccggtgggggatgaggttgttgggatcgtgggctatacttccaaagaaacgccgttcctaagtaatccggggaccaacctggtatttgaagacgagataacggctctgcagccagaggtcgataaattgaaaactttgaatgtaaacaagattattgctctcgggcattctggttttgagatggacaaactgatagcacaaaaggtgcggggcgtggacgttgttgtgggaggacactcgaacacattcctgtatacaggaaaccccccctcgaaagaagtgccagctgggaagtatccctttatagtcacctcagatgacgggcggaaagtgccagtggtgcaggcctacgcatttggaaaatacctaggatacctgaaaatcgaattcgatgagagaggaaatgttatctcctcgcacgggaatccgattctgctcaactcctcaatacccgaggacccctcgatcaaagcagatattaataagtggcggataaaactggacaactactcaacacaggaactcggcaagactatcgtgtatttagacggtagttcccaaagctgcaggttcagagaatgtaatatgggcaacctcatctgcgatgccatgatcaataacaatttgaggcacacagacgagatgttctggaatcacgtcagcatgtgtatcttgaacggaggtggaatccggtctcccatcgacgagcgaaataacgggactataacctgggagaacctggcagcagtgttgccgtttgggggtaccttcgacctggttcaactgaaaggctctacactcaaaaaagccttcgaacactcggtgcaccggtatggtcagagtacgggggaattccttcaagttggtggcattcatgtcgtctacgacctctccaggaagcctggtgaccgtgtagttaaactcgatgtgctgtgcactaagtgtcgcgtgcctagctacgatccattaaaaatggatgaggtttataaagttatcttaccgaattttctggcgaacggcggcgacggttttcagatgatcaaagacgagctcctcaggcatgattcaggggaccaggatattaacgtcgtgagcacttatatatctaaaatgaaggtgatttacccagctgttgagggtcggatcaaattctccacgggatcacattgccatgggtctttctccctgattttccttagcctgtgggccgtaatctttgtgctttatcagtag

SEQ ID NO: 177413 - DNA, 795 bp, Artificial Sequence
  Description of Artificial Sequence: Synthetic coding sequence
atgtgcccccgggccgcccgggcccccgccaccctgctgctggccctaggggccgtcctctggccagcagccggagcatgggaactcaccattctccacactaatgatgttcattctagactggagcaaacgtccgaagatagctcaaaatgtgtaaacgcttcgaggtgtatgggtggagtggcacgactgttcactaaggttcagcagatcagacgcgccgagcccaacgtccttctgctggacgccggggatcagtaccaggggacgatttggttcacagtgtacaagggagccgaggtcgctcattttatgaacgcactgagatatgatgccatggccctcggaaatcacgagtttgacaatggggtcgagggattgatcgagcccttgctgaaagaggccaaatttccaatcttgtctgctaatatcaaggccaagggccctctggcatctcaaatctccggcctgtatctcccatataaggtgctgccagtcggcgatgaggtggttggtatcgtgggctacaccagtaaagaaacccccttcctctctaacccagggactaatctggtgttcgaggatgagattaccgccttgcaaccagaggtagataagctgaagactcttaacgtgaataagatcattgcgcttggacatagcggctttgagatggacaagctgatagcacagaaggttaggggagtagatgtagtggtgggaggacactccaacactttcctgtacaccggtaattgcttcaaacgcattgcgtgggcccggatgtctaggtag

SEQ ID NO: 177414 - DNA, 780 bp, Artificial Sequence
  Description of Artificial Sequence: Synthetic coding sequence
atggacaagctgatcgcccagaaggtgcggggcgtggacgtggtggttgggggccactccaacaccttcctttacacgggcaatcctcctagtaaggaggtgccagctggaaagtacccatttatagttactagcgatgatggaaggaaagtgccggtcgtgcaagcttacgcctttggaaaatacttgggctatcttaagatcgagttcgacgagcgtgggaatgtgataagttctcatggcaatccaattctcctcaattccagtataccggaggatcccagcatcaaggcagacattaacaagtggcgcataaaactcgacaattactctacgcaggagcttggtaaaactatcgtgtatctcgacggctcgtcgcagagctgccgatttagggagtgcaacatgggcaacctgatttgtgatgccatgatcaacaataatctgagacataccgatgaaatgttttggaaccatgtgtccatgtgtatcctgaacggcggcggaattagaagcccaattgacgaaaggaacaatggcacaattacatgggaaaacttggcagctgttcttccatttggcggaactttcgacctggtgcagctgaagggctccactctgaagaaagccttcgagcattcagtccaccgttatggacaatcgacaggggagttcttgcaagtgggggatctcaaggagtgctgtcctatatgtatcaatcaagatgatagttggaaagagcagcctacggcccaaacctatctgaacacttggttttag

SEQ ID NO: 177415 - DNA, 1575 bp, Artificial Sequence
  Description of Artificial Sequence: Synthetic coding sequence
atgtgcccccgggccgcccgggcccccgccaccctgctgctggcccttggtgccgttctatggcctgcggctggagcatgggaactgactatcctccacaccaacgacgttcattccagactggaacagacttcggaggacagttcgaaatgtgtcaatgcttcgcggtgtatggggggcgtcgcgcgtttatttacaaaagttcagcagattaggcgggctgaaccaaatgtgctgcttttagacgctggcgaccagtatcaggggactatctggttcactgtctataaaggcgcggaggtcgcacactttatgaacgcactccgttacgatgctatggcgctaggcaaccatgaattcgataacggcgtagaggggctcatcgaaccattattgaaagaagccaagtttcctattctgtctgcaaatataaaggccaaagggccgttggcaagtcaaatcagcgggctgtatctaccatacaaagtcctgccagtaggggacgaggtagttgggattgtcggctatacaagcaaggagaccccctttctgtccaaccctgggaccaacttggtgttcgaggatgagataacggctctacagccagaagttgacaagcttaaaactctgaacgttaataagatcattgcgttggggcactctggtttcgaaatggacaagctgattgctcagaaggtcaggggcgtggatgttgttgtcggaggacacagcaacaccttcttatatacaggcaaccctcccagtaaagaagtgcctgccgggaagtatccattcatcgtgaccagcgatgatggaagaaaagtacccgtggtccaggcctacgcatttggaaagtacctgggctacctcaaaatcgaatttgacgagcgcggtaatgtgatcagttctcatggcaatcccatactgttaaacagcagcattcctgaagaccccagtattaaagcggatatcaacaaatggcgaataaagctggataattatagcacgcaggagctgggaaaaaccattgtgtacctggatgggtcgtcacaatcatgcagattcagggagtgcaacatgggcaacctgatctgtgatgccatgataaacaataacctgaggcatactgatgaaatgttctggaatcacgtgtcaatgtgtattctaaatggaggagggattaggtctcccatcgatgagaggaataatggaatacatgtcgtgtatgatttgagccggaagcccggtgatagggtggtgaagctagacgtgctctgtacaaagtgtcgtgtcccctcatacgacccattgaagatggacgaagtgtacaaagtaatcttgccaaacttcctcgccaacggcggcgacggttttcaaatgataaaagacgagctgctgagacatgactcaggcgatcaggacataaacgttgtctcgacttacatcagcaagatgaaggtaatttacccagcagtggagggaagaatcaaattctcaaccgggagccactgtcatggaagcttctccctaatctttctgtccctctgggctgtaatatttgtgctctaccagtag

SEQ ID NO: 177416 - DNA, 693 bp, Artificial Sequence
  Description of Artificial Sequence: Synthetic coding sequence
tgagacgtggtggtgggcggccacagcaacaccttcctgtacaccggaaatccaccctctaaggaagttccagccggaaagtacccattcatcgtaacttccgatgacggtcgtaaagtgccagtggtgcaggcgtacgcatttggaaagtacttaggctatctgaaaattgaattcgacgagagaggtaatgtgatctcttcccatgggaatcccattctcctcaacagctcgatccccgaggatccatctattaaagccgacattaacaagtggcgcattaagctcgacaactattccacacaggagctgggaaagacgattgtctaccttgacggttcaagtcagagttgccggtttcgcgagtgcaacatgggcaacctcatttgcgatgccatgatcaacaataacctgaggcacacggacgagatgttttggaatcacgtgtctatgtgtattcttaacggtggtggcatacggagccctatcgacgagaggaacaacggaatccacgtcgtgtacgatctcagtcgtaaaccgggggacagggtcgttaaacttgatgtgctatgcaccaaatgcagagtgcctagttatgaccccctgaagatggacgaagtctacaaggttattctccctaattttctggctaacggaggagacggattccaaatgattaaggacgaattgtag

SEQ ID NO: 177417 - DNA, 540 bp, Artificial Sequence
  Description of Artificial Sequence: Synthetic coding sequence
tgaaaccccatcctgctgaacagcagcatccccgaggaccccagcatcaaggcggacattaacaaatggcgcattaaattagataactactccacccaagagctgggtaagacaatcgtttatctggacggtagcagccagtcctgcagatttcgagaatgtaatatgggcaacctgatctgcgatgcgatgatcaataataacctgcggcataccgacgaaatgttctggaaccatgtcagtatgtgtatactgaacggtggcggcatccggagtccgattgacgaacggaacaatggtaccatcacttgggagaaccttgctgccgtgcttccgttcggaggcaccttcgatttggtgcagttaaaaggtagcacactgaaaaaggcctttgagcatagcgtacacaggtacggtcagagtaccggggagttcctccaggttggagatcttaaggaatgctgtccaatctgtatcaatcaagatgattcgtggaaggagcagccaactgcacaaacatacctcaatacatggttctag

SEQ ID NO: 177418 - DNA, 687 bp, Artificial Sequence
  Description of Artificial Sequence: Synthetic coding sequence
atggtgcggtacagcctggaccccgagaaccccaccaagagctgcaaaagccgcggctccaaccttagggtccactttaaaaacacccgggaaaccgcgcaggctatcaaaggcatgcacattagaaaggccacaaagtacttgaaggatgtaactctccagaagcagtgcgtgccatttaggagatacaatggtggcgtcggaagatgtgctcaggctaagcaatgggggtggactcagggcagatggcctaaaaaatcagccgaattcctgctgcatatgctcaagaacgcagagtctaatgcagagttaaaaggtctggatgtcgatagccttgttatcgagcacatacaggtgaataaggcaccgaagatgcggcgtagaacctatcgggcccacggccgcatcaacccctacatgtcctctccgtgccacattgagatgatcctaaccgaaaaggaacaaatcgttcctaaaccggaagaggaagtggctcaaaagaaaaaactgcgaagcagttccttgggcaaatggtgtgcattcctcgtgtctagttttcagttttgtagcgggagcaccaagaactcatggtctcacatttataccttatggtttcccccaagcctggtcgtgtatggactgcgaaaacagtataaaaatccaatgattcagaccaaggcgaagtag

SEQ ID NO: 177419 - DNA, 816 bp, Artificial Sequence
  Description of Artificial Sequence: Synthetic coding sequence
atgagccccgagatgggcgagctgacccagacccggctgcagaagatatggattccacacagttcaggctcctcacgcctacaaaggagacgcggcagtagtattccgcaatttacgaatagtccaactatggtgattatggtgggactgcctgctcgggggaaaacctatatctcaaccaagctgacgaggtacctgaactggattggcacgccaacaaaagacaacatggaagctctgcaaatccgcaaacagtgcgcgcttgcagcactgaaggacgttcataattatttgagccatgaggaagggcacgttgcagtgttcgacgcgacaaacacgacgcgggagcggcgaagtctgatcttacagtttgccaaggagcatggctacaagggagtgtgcgaggaaatgacctacgaagaaatccaggaacactaccccgaggagttcgcactacgcgaccaggacaaatatcgataccgataccccaaaggagagagctacgaggatttggttcagaggctggaacctgtgatcatggaactggagaggcaagagaacgtcctagtgatttgtcaccaagccgtcatgagatgtcttcttgcctactttttggacaaatcctccgatgaactgccatacttgaaatgtccactccacacagtcctcaagcttacacctgttgcttatggctgcaaggtggagtccatttacctgaatgtggaagcagtaaacactcacagagaaaagcctgaaaacgtagacatcacacgggagcccgaggaagctctggacacagtgccggcgcactactag

SEQ ID NO: 177420 - DNA, 1416 bp, Artificial Sequence
  Description of Artificial Sequence: Synthetic coding sequence
atgagccccgagatgggcgagctgacccagacccggctgcagaagatctggatcccccactcaagcggctctagccggctccagagaaggcgcggcagtagcattccacagtttactaacagccccaccatggttatcatggtcggtcttccggcgcgcgggaagacctacatatctaccaagctcacgagatatctcaattggatcggcactcccacaaaggtgtttaaccttggccagtatcggagggaggccgtatcctacaaaaactacgagttttttctccccgataacatggaggctctgcagattagaaagcaatgtgcattggctgctcttaaggatgtgcataactacctgtctcacgaagaaggccacgtagcagtcttcgatgctacaaatacgaccagagagaggaggtccctaatactgcaattcgctaaggagcacggatataaagtgttctttatcgagtctatatgtaatgatccaggtatcattgctgagaacattagacaagtcaaattgggcagtcctgactacatcgactgtgaccgggaaaaagtcttagaggacttcttgaagcgcattgagtgctacgaggtgaactaccagccactagatgaggagctggactcacatctttcttatatcaagatcttcgatgtgggtacccggtatatggtcaaccgggtgcaggatcatattcagagccgaaccgtttattacctgatgaatattcacgttacgccccgctccatctacttatgcagacatggagagtcagagctcaatatccgtgggaggataggtggcgactccggcttaagcgttaggggcaagcaatacgcttacgcactcgctaattttattcagagccagggcatcagcagtctgaaagtctggacgtcccacatgaagcgtacgatacagaccgcagaggcactgggcgtgccctacgagcagtggaaggctttaaacgagatagacgcgggggtgtgcgaggagatgacatatgaggagattcaggagcactaccctgaggagttcgctctccgagatcaggataagtaccgctataggtaccccaaaggggagtcatatgaggatctcgttcagaggttggagcctgttattatggagcttgagagacaggaaaatgtgctggtcatttgccaccaggctgtgatgcgttgtcttctcgcatatttcctggacaagtcaagcgacgaactcccgtatctgaagtgtccacttcatacggttttgaaacttacgccagttgcttatggctgcaaagttgagagtatttacttgaatgtggaagctgtgaatactcatcgagagaagcctgagaacgtcgacatcaccagagagcccgaggaggccctggacaccgtccccgcccactattag

SEQ ID NO: 177421 - DNA, 1221 bp, Artificial Sequence
  Description of Artificial Sequence: Synthetic coding sequence
atggaggagaagaccagccggatcaaggtgttcaacctgggccagtacagaagggaagccgtatcatataagaattatgaattctttttgcctgataatatggaagctttacagattaggaagcagtgcgcacttgcagcactgaaagacgtgcacaattacctctctcacgaagaaggtcatgtcgccgtttttgacgcgacgaataccaccagagagaggcgctcactgatcttacaatttgcaaaggagcatgggtataaagtgttctttatcgagtcgatatgcaatgaccctggaattatcgccgaaaatatacggcaggttaagcttggctctcccgattacattgactgcgacagggaaaaagtcttagaggatttcttgaagaggattgaatgttacgaagtcaattaccagccgctagatgaagaattggacagccacctatcctatattaagatttttgatgtaggaacaagatatatggttaacagggtgcaggatcacatccagtctagaactgtatactacctgatgaatatacacgtcacccccaggagcatttatttgtgccgccacggtgaatccgaactaaacattcgaggacgaattggcggggacagtggactatcagtgaggggtaagcagtatgcatatgcattggctaatttcatccagagtcagggcatctcttctctcaaagtctggactagccatatgaaacggacaatccagactgccgaagccctaggagtgccatatgagcaatggaaagcattgaacgaaatcgatgccggagtatgcgaagaaatgacttatgaggaaattcaagaacactaccctgaagagttcgccttaagagaccaggataagtacaggtaccggtaccccaagggggagtcatatgaagatctggtgcaaaggttggagcctgttataatggagcttgagcggcaagagaatgtcctggtgatctgtcaccaggcagtgatgcgatgtctgcttgcctacttcctggacaagtcatctgatgaattgccatacctgaagtgtcccctgcacactgtgttgaagctcacccctgttgcttacggatgcaaagtcgagagtatttaccttaacgtcgaagccgtgaacacacatagggaaaagcctgagaacgtcgatataaccagagagccggaggaggcccttgatacggtgccagcccactactag

SEQ ID NO: 177422 - DNA, 1416 bp, Artificial Sequence
  Description of Artificial Sequence: Synthetic coding sequence
atgagcggcgccagcagcagcgagcagaacaacaacagctacgagactaagaccccaaacctgaggatgagtgagaagaaatgtagctgggcaagctacatgacgaactctcccactctcatagtgatgatcgggctacctgctagaggtaaaacatacgtcagtaaaaagctgacaagatacctgaattggattggagtgcctacaaaggtttttaaccttggtgtttaccgacgggaggctgtcaaatcgtacaaatcttacgacttctttagacatgataatgaagaggctatgaagatccgcaagcaatgcgcgctggttgcactggaagacgtcaaggcctacttgaccgaggaaaatggtcagattgcagtttttgatgccactaacacaacaagggaaagaagggacatgatcctgaattttgcggaacagaatagctttaaagtcttctttgtggaaagtgtctgtgatgaccctgatgtgattgctgccaacatactcgaggtaaaagtgagtagccccgattacccagaacggaacagggagaacgtaatggaggactttctgaaacggatcgaatgctacaaggtgacatacaggcctctggatcccgataactatgacaaggatctcagtttcataaaagtcatcaatgtggggcagcggtttctagtgaacagagtgcaggattacatccaatcgaagattgtatactacttgatgaacattcacgtgcagcccaggaccatttacctgtgtcgacacggcgaaagcgaatttaatttgctcggaaagataggaggcgactcaggtttaagcgtgcgcgggaaacagttcgcccaggctcttcgaaaattcctggaggagcaggaaatcacagatctgaaggtttggactagtcaactgaaaaggacaattcaaacagccgagagtcttggagtcccgtacgagcaatggaaaatcctaaacgaaatcgatgctggggtctgcgaggagatgacatatgccgaaattgagaaacgttaccccgaggagttcgcgttacgcgaccaggagaagtatctgtataggtaccctggtggcgaatcgtaccaggatctcgtacagcgtctggagcccgtgattatggagttggagcgacaagggaatgtgctcgtgatttctcaccaggctgtgatgcgatgcttgctggcgtactttcttgataagggagcggatgaattgccctacctcagatgcccacttcacacaattttcaaactgacccctgtcgcctacggctgcaaggttgaaaccattaagctgaatgtcgaggctgttaacacccaccgggacaaacccaccgcggctgaaaccactctggcagtgaggaggagaccatccgcagcgagtctgatgttaccctgctag

SEQ ID NO: 177423 - DNA, 1518 bp, Artificial Sequence
  Description of Artificial Sequence: Synthetic coding sequence
atgagcggcgccagcagcagcgagcagaacaacaacagctacgagacaaagaccccgaacttgcggatgagcgaaaagaaatgcagttgggcgagctacatgacaaacagccctacgctcatcgttatgatcggactcccagcccgcggcaaaacttatgtgtctaaaaaacttactcgctacctgaattggatcggggtcccgactaaagtctttaacttgggggtgtatcgacgggaggccgtgaagtcttataagtcctatgatttttttaggcatgataatgaggaggccatgaaaattagaaagcagtgtgccctcgtggcgctagaggacgtgaaagcctacctgactgaggagaacgggcagatcgccgtctttgacgctaccaacactaccagagagaggcgggacatgatacttaacttcgcagaacagaactcctttaaagtttttttcgtggagtccgtttgtgacgaccctgatgttatagcagctaatattctggaggtcaaggtgtcatcccccgactatcccgaaaggaacagagagaatgtgatggaggatttcttgaagagaatcgaatgctataaggtaacctacaggccgcttgatcccgataactacgacaaggacctgtcatttatcaaagtgattaatgtggggcaaagattcctggtcaacagagtgcaagactacatccagtcgaaaatagtgtattatctcatgaatatccatgtgcaaccccgtacgatttatctgtgtaggcatggcgaatctgagttcaacctgttgggcaaaattggcggggatagcggactgtcagttagagggaaacagttcgcgcaggccctgaggaaattcctggaagaacaagagattaccgacctgaaggtgtggacaagtcagttaaaacgaacgattcaaaccgcagagagtctgggcgtcccctacgaacagtggaagattctcaatgaaatagacgctggtgtatgtgaagagatgacctacgccgaaattgagaagcgctaccctgaggaatttgcacttcgggatcaggaaaaatatttgtacagatacccgggtggggagtcctatcaggacctagtgcagcgcctggaacctgtgatcatggaactggagcggcaggggaatgtgctcgtcatttcccatcaggccgttatgcggtgcctgcttgcatacttcctggacaaaggagccgacgagttaccgtaccttagatgccctctccataccatttttaaactcactcccgttgcctacggatgcaaggtggaaacaataaagttaaacgttgaggcggtgaatacgcacagggacaagcccactaataattttccaaagaatcaaacccccgtaaggatgaggcgaaatagttttacgcccctgtcttccagcaataccatcagaaggcctaggaactattccgttggcagtcgtcctttgaagcctctctcccctctgagagcgcaggatatgcaggagggggccgattag

SEQ ID NO: 177424 - DNA, 1122 bp, Artificial Sequence
  Description of Artificial Sequence: Synthetic coding sequence
atgaagatccggaagcagtgcgccctggtggccctggaggacgtgaaagcctacttaacagaagagaatggtcagattgccgttttcgacgccaccaatacgactcgagaacgtagggacatgatcctcaacttcgccgagcagaacagctttaaggtgttttttgtcgagtctgtctgcgatgacccagacgttattgccgccaatatactggaggtcaaagtgagttcccccgactacccagaaaggaacagagagaacgtaatggaggactttcttaaacgcatcgagtgctataaggtgacctatagaccgctggatccagacaattacgataaagacctgtccttcattaaagtgatcaacgtgggacagaggtttctggtgaaccgagtccaagattatatacagagtaagattgtgtattacctgatgaacatccacgtgcagcctagaaccatatatttatgtaggcacggcgagtccgagttcaatctgctgggcaagatcggaggcgactctggtctatctgtgcgcggaaagcagttcgcacaggccctgagaaagttccttgaggaacaggaaataactgacctgaaggtctggacgagccagctgaagaggactattcagactgctgagtcgcttggcgtgccctacgagcagtggaagatcctgaatgaaattgacgcaggagtgtgcgaggagatgacctacgcggagattgagaagcgttatcccgaagagtttgcccttcgcgaccaagagaaatacctgtacaggtaccctggcggcgagtcctatcaagatcttgttcagcggctggagcccgtcattatggagctggagaggcaagggaacgtgctggttattagccaccaagcagtgatgcggtgcctgttggcatattttcttgacaaaggcgcagacgaactgccctatttgcgctgccctctgcataccatctttaaactcaccccagtggcctatggatgtaaggtggagacaattaagctcaatgtggaggcagtcaacacacatcgtgacaagccaaccgccgctgaaaccacactcgctgtccgaaggcgtcccagcgcagcttccctgatgctgccctgttag

SEQ ID NO: 177425 - DNA, 795 bp, Artificial Sequence
  Description of Artificial Sequence: Synthetic coding sequence
atggaggacttcctgaagcggatcgagtgctacaaggtgacctaccgaccattggatcctgacaattatgacaaggacctgagcttcataaaagtcatcaacgtggggcagcgcttcctggttaaccgcgtgcaggattacattcaaagcaaaatagtctattacctcatgaacattcatgtgcaacctcgaacaatctacctgtgcaggcatggagagtccgagttcaaccttctgggtaaaattgggggtgattctggcctatccgtcagggggaagcagttcgcacaggcattgcgcaagtttctcgaggagcaggagatcacagacctgaaagtgtggacaagccagcttaaacgtactatccaaactgccgagagcctgggtgtcccttacgaacaatggaagatcctcaatgaaatagacgctggcgtgtgcgaggagatgacttatgccgagattgagaaaagatacccagaggagtttgcacttagggaccaggaaaaatacctctatagatatcctggtggcgagagttatcaggaccttgtgcaaagactggaacctgtaataatggagttggaacgtcagggcaatgtccttgtcattagccaccaagcagttatgagatgtctgctggcgtacttcttagataagggggcgggttgcaaagttgaaaccatcaaactgaacgtagaggccgtgaacactcacagggataagcccacagctgccgagacaacgttagccgtgagacgccgtccaagcgccgcgtctttaatgctgccttgttag

SEQ ID NO: 177426 - DNA, 1419 bp, Artificial Sequence
  Description of Artificial Sequence: Synthetic coding sequence
atgaccaacagccccaccctgatcgtgatgatcggcctgcccgccaggggcaaaacatacgtgagcaaaaaactgaccaggtatctgaactggatcggcgttccaaccaaggtgttcaacctcggcgtataccgcagggaggccgtcaagagctacaaatcttacgactttttcagacatgataacgaggaggcaatgaaaatccgaaagcagtgcgccctggtagccctagaagatgtaaaagcatatttgactgaggaaaatggccaaatcgcagtttttgatgccactaacacaacacgcgagcggcgtgatatgatcctgaattttgccgaacaaaactcttttaaggttttctttgtggagtcggtatgtgatgacccggacgttatcgcagctaatatcttggaggtgaaggtctccagtcctgactaccccgaaaggaatcgagagaatgttatggaagatttcttaaagcgaattgaatgctacaaagttacataccgacccttggaccccgacaactacgataaggatcttagcttcatcaaggtcatcaacgtgggccaacggttcttggttaaccgggtgcaggattatatccagagtaagatcgtttattacctgatgaatatccacgtccagccacgcacaatttacctatgcagacacggtgagtcagaattcaatcttctgggaaagatcggaggcgatagtggcctgagtgtcaggggtaaacagtttgcccaggcgctgagaaaattcctcgaggaacaggagataacagacctcaaggtctggacttcacaactcaagcggactatccagaccgccgagtctttgggagttccatatgagcagtggaagatactcaacgagatcgatgccggcgtctgtgaggaaatgacctacgctgaaattgagaaacgatatccagaggagtttgcactgcgcgatcaggagaaatacctatacagatatccaggcggagagagctatcaagacctggtacagcggctggaacctgtaatcatggagctggagcggcagggcaatgtgttagtcattagtcaccaggccgtcatgagatgtctgctggcctattttctggacaagggtgccgatgaactgccatacttgcggtgccccctgcataccatcttcaaactcacacccgtggcctatggctgcaaggtagagacaatcaaactgaacgttgaagcagtgaatacgcacagagacaagccgactaacaattttcccaagaaccaaacgcccgttcggatgaggaggaattcgtttactcctctgtcttcctcaaatacgataagaagaccgcgcaactattcagtgggatcccgtcctctgaagccactgagccctctgcgggctcaggacatgcaggagggagccgactag

SEQ ID NO: 177427 - DNA, 1542 bp, Artificial Sequence
  Description of Artificial Sequence: Synthetic coding sequence
atgcccctggagctgacccagagccgggtgcagaagatctgggtgccggtggaccatcgtcccagtcttcctcgtagctgcggccctaaacttaccaattcacctacggtgatcgtgatggtgggcttgcctgcaagaggtaagacctatattagcaagaaacttacgaggtacctgaattggatcggtgtgcccactaaggtgtttaatgtgggggaataccggagagaagccgttaaacagtactccagttataattttttcaggccagataatgaggaggcaatgaaggtgcgcaagcagtgcgctctagcagctttacgcgacgtgaaatcatatctggcaaaagaagggggccagatcgccgtcttcgacgctacgaacaccacccgggaacggcgccatatgattctccatttcgctaaagagaatgactttaaggcattcttcatcgaaagcgtgtgtgatgaccctacagtggtggcatccaacataatggaggtgaaaatttcttcgccggactataaagattgtaacagcgctgaagctatggacgatttcatgaagcgcatcagctgctatgaggcctcgtaccaacctcttgatcccgataagtgcgatcgtgacctctctttgattaaagtgatcgacgttgggcgcaggtttctcgtaaaccgcgtacaagatcatatccagagccggattgtttattatctcatgaacattcatgtgcagccaagaacgatctatctgtgtcgccatggggaaaacgagcacaacctgcagggccggattggcggcgacagtggactctcatccagggggaagaagttcgccagcgccctatctaagtttgtggaagagcagaaccttaaggacctaagggtttggacttctcagctcaaaagcacaattcaaaccgctgaagccttgcggctgccatacgagcagtggaaagccctgaacgagatcgatgctggtgtttgtgaggaacttacctacgaggagatccgtgatacttaccccgaggagtatgcactccgagagcaggacaagtactattaccgctatcctacgggcgaatcctatcaggatctagtccagagactggagcccgtgatcatggaactagagcgtcaggagaatgtgctggtcatttgtcaccaggctgtgctgcggtgcctactggcctacttcctcgacaaaagcgccgaggagatgccctatcttaagtgcccgctgcacacagtccttaagctcacgcccgtggcatatggatgccgcgttgaatctatctatctgaacgttgagtctgtgtgcacgcaccgcgagcgctctgaagatgctaagaaggggcctaatccactcatgcggcgcaatagcgtgacacccctggcatcacccgagcctacaaaaaaaccacgcatcaactctttcgaagaacacgtcgcgtcaacaagtgccgccttgccctcctgtctgcctcccgaggtcccaacacagttgccaggccaaccactgctcggacaggcttgtctgtag

SEQ ID NO: 177428 - DNA, 1545 bp, Artificial Sequence
  Description of Artificial Sequence: Synthetic coding sequence
atgcccctggagctgacccagagccgggtgcagaagatctgggtgccagtcgatcatagacctagtttgcccaggtcttgtgggcctaaattgaccaacagccccactgtcattgtgatggtgggccttccagcacggggtaagacctacatcagtaagaaactcactaggtatcttaactggattggtgtccctaccaaggtgtttaatgtgggagagtaccgcagagaggcggtcaagcaatactcttcttataacttcttcagacctgacaacgaagaagcgatgaaagtgaggaagcagtgcgcgttagccgcactaagggatgtgaaaagctatctggccaaggagggtggccagatcgctgtcttcgacgcgaccaatacaacaagagagagacggcacatgatcctgcacttcgccaaagaaaacgattttaaggcttttttcattgagagcgtgtgtgacgacccaacagttgtcgcaagcaacatcatggaagtgaaaatcagctcacccgactacaaggattgcaactcggctgaggcaatggacgactttatgaagaggatcagctgttatgaagcatcctatcagcctttggatcccgacaagtgtgaccgggatttgagcttgatcaaagttatcgacgtgggacgaagatttctcgtgaatagggtgcaggatcatattcagtcacggatagtttactatctcatgaacattcacgtgcaaccacggaccatctacctctgtagacacggcgaaaatgagcacaatctgcaaggtagaattgggggagacagtggactgagttcacgcggaaagaaattcgccagcgctctgtcaaagttcgtggaggagcagaacttaaaggatctgcgcgtgtggacctctcagctgaagagcaccatacagacggcggaggcgcttcggctgccatatgagcaatggaaggcattgaacgaaattgatgctggggtctgtgaggaacttacctatgaggaaattagagatacatacccagaggaatacgccttacgggagcaggacaagtattactacaggtatcctacgggtgagtcctatcaggatctggtgcaaagactggaacccgtgattatggagctagaacgccaggagaatgtactggtaatctgtcatcaggcagttctgcgatgtctgctggcatacttcctcgataaatctgcggaggagatgccctatttgaaatgccccctgcacacggtactgaaactcacccccgtagcgtacggttgtagagtggagtctatatacctaaacgtcgagagcgtctgcacacaccgagaacggagtgaagacgctaaaaagggcccaaaccctctgatgcggcggaactcagttactcccctagccagcccggaacctaccaagaagccacggatcaatagttttgaggaacatgtagcttcaaccagcgccgctctacccagttgtcttccccctgaggtgccaacacagcttcccggtcagcctctccttggtcaagcatgcttgacttag

SEQ ID NO: 177429 - DNA, 1545 bp, Artificial Sequence
  Description of Artificial Sequence: Synthetic coding sequence
atgcccctggagctgacccagagccgggtgcagaagatctgggtgcccgtggatcacaggcccagcctgccccgaagctgcggtcccaaattgacgaactccccaacagtgatcgtcatggtgggcctgcccgcccgggggaaaacctacatatcgaagaagctgaccaggtacctcaactggatcggagttcccaccaaggtattcaatgtcggcgagtatcggcgtgaggcagttaagcagtactcatcttacaatttttttcggccagacaatgaagaggctatgaaggttaggaagcagtgtgctcttgctgctcttagagacgtgaaaagctatttggctaaggagggagggcagatcgctgtgttcgacgccactaacacaactcgagagcgtcgccatatgatcctgcatttcgctaaagagaacgacttcaaggccttctttatcgagagcgtctgtgatgacccaacggttgtagcatctaacatcatggaagtgaaaatcagcagtccagattacaaggactgcaattcagcagaggcaatggatgatttcatgaaaaggatctcttgttatgaggcgtcctaccagccactagaccctgacaagtgcgatcgagatctgagtcttatcaaagttattgacgtggggcgcagattcctggttaatagggtccaggaccacattcaatctagaatcgtgtactatctgatgaatatccacgtgcaaccccgcaccatctatctgtgtcgacatggcgaaaacgagcataacctgcagggcagaattgggggtgacagcggcctatcaagtcgcggaaagaaatttgccagcgccctgagcaaatttgtcgaagaacagaaccttaaagaccttcgtgtgtggactagccagctcaagagcacaatccaaacagcagaggcattgagactgccatatgagcagtggaaggcactgaatgagatcgatgcgggggtgtgtgaggagcttacttatgaagaaatccgagatacctaccctgaggaatatgccctccgcgagcaggataagtactactatagataccctactggtgagtcttatcaggatcttgtgcagcgtctggagcctgtgatcatggagctggagcgccaggaaaatgtcttggtgatttgccaccaagcggtgctgaggtgtcttctggcctactttctggataaatccgcggaagagatgccatatctaaagtgtcctctccacaccgtgttgaagttaacgccagtcgcttacggctgtcgggtggagtctatatatctgaacgtcgagtccgtttgcacgcacagggagcggagcgaggatgccaaaaagggccctaaccctttgatgagaagaaacagcgttacaccactcgcctcacccgaaccaacaaaaaagccccgtattaactccttcgaggagcatgtagcatcaacatccgcagcactccccagttgcttgccccccgaggttccaactcagttgccaggacagccactgcttggacaggcctgtctgacatag

SEQ ID NO: 177430 - DNA, 1563 bp, Artificial Sequence
  Description of Artificial Sequence: Synthetic coding sequence
atgcccctggagctgacccagagccgggtgcagaagatctgggtgcctgtggatcaccgcccttctctgccaaggagctgcgggcccaagctgaccaacagccctacggtgatcgtgatggtaggactgcctgctagaggaaaaacatatattagcaagaaactgaccagatatttgaattggataggggtgcccactaaagtgttcaacgtgggggaatatcgacgcgaagcagtgaagcagtatagctcttataacttctttcgaccagacaatgaagaagcaatgaaggtgaggaaacaatgtgccctcgctgctctgcgtgatgtgaagtcatacctggccaaggaaggaggccagatcgccgtgttcgacgcaacaaatactacccgagagcgaagacatatgattctgcattttgctaaggagaacgacttcaaggcctttttcattgaatccgtgtgcgacgaccccactgtggtcgcaagtaatatcatggaagttaagatcagttcacccgactacaaagactgtaactctgcagaggcgatggatgactttatgaagcgaatcagttgctacgaggctagttaccagccactggaccccgataagtgtgatcgagatctcagccttatcaaggtcattgatgtgggtcggcgattccttgtgaacagagttcaggatcacattcagtcccgcatcgtgtactacctcatgaatatacacgtgcagccaagaacaatctatctctgccggcatggagaaaacgaacataacttgcagggtcgcatcggaggggacagcggactgtccagcagagggaagaagttcgctagcgcactgagcaagttcgtggaggagcagaatctgaaagatttgcgggtgtggacctcccagctgaagagtaccatccagacagccgaggcactcagactgccatacgaacagtggaaggctctgaacgagatagacgccggggtgtgcgaggagctgacatacgaggaaattagagacacctatcccgaagagtacgcactgcgcgaacaagataaatactactatcggtaccccactggagagtcctaccaggatctggttcagcggttggaaccagttatcatggagctggagcgccaagagaatgtcctcgtgatttgtcatcaggcggtcctcagatgcctgctggcgtatttcctagacaagagcgccgaggaaatgccatacctgaaatgtccactgcacacagtgctgaagcttacgcctgttgcttacggatgcagagttgagtctatctacttaaacgttgagagcgtgtgtacgcatagagagcgaagtgaggacgcaaagaagggtccaaacccattaatgcgacgaaactccgtgacaccccttgcctctccagaaccaacaaaaaaacccaggattaatagttttgaagaacatgtagctagcaccagcgccgccctacctagttgtctacccccagaagttcctactcagcttccaggacaaaacatgaaaggcagtaggtccagcgccgatagcagccggaagcactag

SEQ ID NO: 177431 - DNA, 354 bp, Artificial Sequence
  Description of Artificial Sequence: Synthetic coding sequence
atgccctacctgaagtgccccctgcacaccgtgctgaagctgacccctgtagcttacggctgcagagtggaaagcatttacctcaacgttgaatctgtttgtactcaccgtgaaagaagcgaagatgctaagaaagggcccaatcccctgatgcgcagaaatagtgtgacgcctctagctagccctgaaccaactaaaaaaccacgcatcaattccttcgaggaacatgtggcgtccacgagcgctgccctcccaagttgcctcccacccgaggtgcctacacagctgcccggccaaccactgctaggacaggcatgcttgaattggaagggggttatgcgcaatgccgcatag

SEQ ID NO: 177432 - DNA, 1581 bp, Artificial Sequence
  Description of Artificial Sequence: Synthetic coding sequence
atgcccctggagctgacccagagccgggtgcagaagatctgggtgcccgtcgatcacaggccatcactgccaaggtcttgtggcccaaaattaaccaactctccaaccgtgattgtgatggtgggtctgcctgctagaggaaagacatacatcagcaaaaaacttaccagataccttaactggataggggtgccaacaaaggtcttcaatgtgggcgaatataggcgggaggctgtgaaacaatacagctcttataatttctttcggcccgataacgaggaggccatgaaagtccgcaaacagtgcgccttggcggccctgcgagacgtgaagagctacctggcaaaagagggcggccagatagctgtgttcgatgcgacaaacaccacgcgggagcgccggcatatgattttgcatttcgccaaagaaaatgatttcaaagcattttttatcgagtccgtctgcgatgaccccaccgtcgtggcctccaacattatggaagtgaaaatttctagtcctgactataaggattgcaactcagcggaagccatggatgatttcatgaaaaggatttcttgttacgaggcatcgtatcagccgctcgacccagataagtgcgaccgggatctttcccttattaaggtaatagatgttggccggcggtttctcgtcaacagagtccaggaccatatacaaagtcgaatcgtgtactatctcatgaatatccacgtacagcctagaacgatctatctctgccggcatggagagaacgagcacaacctccagggcaggattggcggcgacagcggcctgtcctcaaggggaaagaaattcgcgtccgctcttagcaagtttgtggaagaacaaaacctcaaagacttgagagtgtggacctctcaattaaagtccaccatccagactgctgaagcactgcgactgccatacgagcaatggaaggccctgaatgagatcgatgccggggtttgcgaggaattgacatacgaggaaatcagggacacttacccggaggaatatgctctaagagaacaggacaagtattattaccgttatcccacaggtgagagttaccaggatctggtccagagacttgagcccgttatcatggaactggaaaggcaggagaatgtgttggttatctgtcatcaggctgtgttaagatgtctgttggcctatttcctcgacaagagtgctgaagagatgccatatctaaagtgccctctacacacagtgcttaaactgacacccgttgcctacggttgccgagtagaatcaatatacctcaatgtcgaaagcgtgtgcacacacagggagagaagtgaggatgctaagaaaggcccgaatccattgatgaggcgaaactctgtgacaccactggccagccccgagccaacgaagaagcccaggatcaactccttcgaagagcacgtcgcatctaccagcgccgccttgccctcttgtcttccccccgaagtcccgacccaactcccagggcaacccttactgggacaggcgtgtttgcgcaccgtttgtcacatttttagtaagttcagcccctactag

SEQ ID NO: 177433 - DNA, 567 bp, Artificial Sequence
  Description of Artificial Sequence: Synthetic coding sequence
atgaacatccacgtgcagccccggaccatctacctgtgccggcacggcgaaaacgaacacaatctgcaagggagaattggcggcgattcgggcctttcttcacgtggcaagaaatttgccagcgctttgtctaaattcgtggaggaacagaacctgaaagacttacgtgtctggacttcacagcttaagtcaaccatccagactgcagaggcactccggttgccatacgaacaatggaaggctctgaatgagatcgacgcaagctatcaggatctggtgcaacggttggagccagtgatcatggaactggagaggcaggaaaacgtgctggttatttgccatcaggcagtgttaagatgcttactcgcgtattttctggacaagagcgccgaagagatgccatacctgaagtgtccgctgcataccgtgctgaaactgactcctgtggcatacggatgccgggtggagtctatatacctgaacgtggagtctgtgtgcacccaccgcgaaagatctgagaacatgaaggggagcaggtccagcgccgatagttctcgcaagcactag

SEQ ID NO: 177434 - DNA, 1581 bp, Artificial Sequence
  Description of Artificial Sequence: Synthetic coding sequence
atgcccctggagctgacccagagccgggtgcagaagatctgggtgcctgtcgatcacagaccatccttaccacgctcgtgcgggccgaagctgactaattcccctaccgtcattgtgatggtcggcctgccggcaaggggaaagacatatatttcaaaaaagctgacgcgttacctgaactggattggcgtgccaacaaaagttttcaatgttggtgagtatcgaagagaggccgttaaacagtatagttcatataattttttcagaccagataatgaggaggctatgaaagtgcgcaaacagtgcgcacttgccgcgctgagggatgtgaagtcttatcttgccaaggaaggtggacaaattgccgtgttcgatgcgaccaacacaacacgtgagagaagacatatgattctccatttcgccaaagaaaatgatttcaaggcattttttattgaatcagtctgcgacgatcctactgtcgtagcaagtaacataatggaggtaaaaataagctcccctgactataaggactgtaacagtgctgaagcaatggacgatttcatgaagaggatttcttgctacgaagccagttatcagcccttagaccccgacaaatgcgatagagacctctctctcattaaggtgatagatgtcggacgccgcttcttagtcaaccgcgtgcaggaccacattcagagtagaatcgtgtactacctcatgaatatccacgtgcagccacggacaatctacctttgcaggcatggcgaaaatgagcataatcttcaggggaggataggaggtgacagtggactgagctcgagaggtaagaaatttgcatccgccctttccaagtttgttgaagaacagaatcttaaggaccttagggtgtggacctcacagctgaagtctaccatacagactgccgaagctctgcgcctgccctacgagcagtggaaagcccttaatgaaatcgacgccggagtatgtgaagaattgacttatgaagaaatacgtgatacttatcctgaggaatatgctctccgcgagcaggacaaatactactatcgttaccccaccggcgaaagctatcaggatctggtgcaaaggttggagccagtaattatggagctagaacggcaggagaacgtgctggtgatctgccaccaggctgtgcttcgttgtctcctggcctactttctagataaatctgctgaggagatgccatacctgaagtgccccctgcataccgtgcttaagctgacccctgttgcatacggatgtcgggtcgagtcgatctacctaaatgtggagtccgtgtgtacgcaccgcgaacggtccgaggacgctaagaaaggcccaaatccattaatgcgccgcaattctgttacgccgttagcttctccggaacccacaaagaagcctcgcattaatagcttcgaagaacacgtggcttcaacctctgcagcattgccctcctgcttgccacctgaggtgcccacacaactgcctgggcagcctctgctcggccaagcttgccttcgtacagtttgccatatattctcaaaattctctccatattag

SEQ ID NO: 177435 - DNA, 1503 bp, Artificial Sequence
  Description of Artificial Sequence: Synthetic coding sequence
atgcccttccggaaggcctgcggccccaagctgaccaacagccccaccgtgatcgtgatggttggtctcccggcccgagggaagacttatatctcaaagaagctcactcgctaccttaactggatcggtgtgcctaccaaggtgttcaatgttggagagtatagaagagaggccgttaagcaatattccagctacaacttctttcggccggataacgaagaagcgatgaaggtcagaaaacagtgcgccctcgctgccctacgtgacgtaaaatcgtacctggcgaaagagggcgggcagatcgccgtctttgatgctacaaacacgacaagggaacggagacatatgattctgcattttgctaaagagaacgatttcaaggcatttttcatagagtccgtatgcgatgaccccacagtagtggcctccaatattatggaggttaagataagtagtccggactataaggactgtaactcagctgaggcgatggacgatttcatgaagcgcatttcgtgttatgaggcctcttaccagcctctggatcccgacaagtgcgacagggatctatccctaataaaagttattgacgtgggtagaaggttcttggtcaatagagtgcaagaccatatccagagccgaatcgtatactatctgatgaacatccacgtacagcctcgcactatctatctctgtagacacggggaaaatgagcacaatctgcagggacgaatcggaggggattccgggctgtcttccaggggaaagaaattcgctagtgccctgtcaaaattcgtggaagagcaaaaccttaaggacctgcgagtatggacatctcagctgaaatccacaattcagaccgctgaggcactgcggctgccctacgaacagtggaaggctctgaatgagatcgatgccggcgtctgcgaagaactgacatatgaagagattcgcgacacttatccggaagagtacgccttgagagagcaggacaagtactattatcgctaccccacaggggagtcatatcaagacctcgttcagcgcctagaacctgtcatcatggagctggaacgccaggagaacgtgttagtaatatgccatcaagccgtgttgcgatgtctgcttgcctatttcttggacaagtctgccgaggagatgccatacctgaaatgccctcttcacactgtcctgaaacttaccccagtggcgtatggatgccgggttgagagcatctacctgaacgtcgagtcagtgtgtacgcatagggagcgctccgaagatgctaagaaaggccccaaccccctcatgcgccgcaattcagttacacccctggcttcccccgaaccaactaagaagccccgcatcaattcttttgaggaacacgttgcctcaacctccgccgccctcccgtcctgtctgccgccggaagtgcctacccagctgccagggcagaatatgaaaggctccaggtctagtgccgactcttcacgcaaacactag

SEQ ID NO: 177436 - DNA, 279 bp, Artificial Sequence
  Description of Artificial Sequence: Synthetic coding sequence
atctacctgaacgtggagagcgtgtgcacccaccgggagcggagcgaggatgccaaaaagggtcccaatccgctgatgcggaggaactctgtgacgccgttggccagtccagagcctaccaagaagccccggatcaatagcttcgaagagcacgtcgctagcacctcagccgcactgccaagctgcctgccccctgaggtccccacgcagctgcctggccagccgctcctagggcaagcctgtcttaattggaagggtgtgatgcggaatgcagcatag

SEQ ID NO: 177437 - DNA, 96 bp, Artificial Sequence
  Description of Artificial Sequence: Synthetic coding sequence
atctacctgaacgtggagagcgtgtgcacccaccgggagcggagcgagaacatgaagggaagcagatctagtgcagattccagccggaagcactag

SEQ ID NO: 177438 - DNA, 261 bp, Artificial Sequence
  Description of Artificial Sequence: Synthetic coding sequence
atgccctacctgaagtgccccctgcacaccgtgctgaagctgaccccagttgcatacgggtgtagggtcgagtctatctacctgaacgttgaatccgtttgtactcacagagagagatcagagggcttgagcttgttccctcggctcgaatgcggtggggctgtgaccgcccattgcagcctgaacctcttaggctccagcgatcctcccgcaagcgcgtcaagagttgctgaaaccaccggttgcaaggaaggcacctag

SEQ ID NO: 177439 - DNA, 432 bp, Artificial Sequence
  Description of Artificial Sequence: Synthetic coding sequence
tgagtggaggagcagaacctgaaggacctgcgggtgtggaccagccagctgaaaagtactattcagaccgccgaggccttgcgactgccctatgagcagtggaaagcgctcaacgagatcgacgcttcctaccaggacttggtgcaaagactggaacccgtgataatggaactggagcggcaagaaaacgttctggtcatttgccatcaggccgtgctgagatgcttgctagcttacttccttgacaaatccgccgaagagatgccctatctgaaatgccccctgcacactgtgttaaagctcacacccgtcgcatatggctgccgtgtggaatctatctacttgaatgtggagtcagtgtgtactcatcgcgagcggtcggaaaatatgaaggggtcaagaagctctgctgatagttcacggaagcactag

SEQ ID NO: 177440 - DNA, 555 bp, Artificial Sequence
  Description of Artificial Sequence: Synthetic coding sequence
atgcccttccggaaggcctgcggccccaagctgaccaacagccccactgtgatagtcatggtgggactccctgctcgcggaaaaacttacatctcaaaaaaactgacgcgatatctcaactggatcggggtccctactaaagtgtttaatgtaggagaatatcggagggaggctgttaaacagtacagttcttacaatttcttcaggcccgataacgaagaagccatgaaggtgagaaagcagtgtgcacttgccgctctgagagacgtcaagtcttacctagctaaagagggtgggcagatagccgtcttcgacgccaccaacaccaccagggaaaggaggcacatgattctgcatttcgcgaaggaaaatgactttaaggcattctttattgagtccgtatgcgatgatcctaccgtggtcgcctcaaatatcatgcagaaagccttccagagggatttgtctgcaaccccgctatggtgctgcagaaagttgaagtctcctgcacggattaccaaaacagccaccagacagaagccgtggacgaccagctag

SEQ ID NO: 177441 - DNA, 1605 bp, Artificial Sequence
  Description of Artificial Sequence: Synthetic coding sequence
atgggcgagggcggccagaaggagggcgacagccagcaggccggcgctctcccactgttgtgccaactagataccttcagcccaaaagccacagtgttcggcgtatccatcaatcctgcctgtgggcccaagttgaccaactcccccacggtgatcgtaatggtggggctccctgcgaggggaaaaacgtacatctctaaaaaactcacgagatacctcaactggatcggcgttcctacaaaagttttcaatgtaggagagtatcgccgggaggccgtgaagcagtatagtagttataactttttccgcccggacaacgaggaggcaatgaaagtgagaaagcagtgtgcccttgcagccttgcgcgatgtcaagtcttacctcgctaaagaaggaggacagattgccgtattcgacgcaaccaacacaactcgggaacgcagacacatgattctgcactttgcaaaggaaaacgattttaaggccttcttcatcgaatctgtttgcgacgatcctacagtcgtcgcctctaacataatggaagtgaaaattagttcccctgattacaaggactgtaactctgctgaagcaatggatgactttatgaaaaggatcagctgctatgaagcgtcctaccagcccctcgatcccgataagtgtgacagggacctgtccttgattaaggtgattgacgtcggtagaaggtttctcgtcaaccgcgtccaggatcatatccaatctcgaatcgtatactacctcatgaacattcatgtgcagcctagaaccatttacctgtgtagacatggagagaatgagcacaatctgcagggccggattggaggcgattccggactgagctccaggggaaaaaaatttgccagcgcactgagcaagttcgtggaagaacaaaacttgaaggaccttcgggtttggaccagccagcttaaatccactatccaaacagccgaggcactccgcttgccatatgaacagtggaaggccctgaacgaaattgatgccggggtttgcgaggagcttacatacgaggagattagggatacctacccagaggaatacgcattgcgcgagcaggataaatactactaccggtaccctaccggggagtcctaccaggacctcgttcagcgtcttgagccagttatcatggaacttgaacgccaagagaacgtgctggtaatttgccaccaggccgtgcttcggtgtctgctcgcttatttcctcgataagtcggccgaagaaatgccctacctgaaatgcccacttcataccgtccttaaattaactccggtcgcttatggttgtcgggtggaaagtatctatctcaatgtcgaatccgtctgtactcatagggagcgtagcgaagatgccaagaaaggcccgaatcctctgatgcggcggaactccgtgactccactggcctcaccggagcccactaaaaagcccaggatcaactcttttgaagaacacgtcgctagcacctcggccgcgcttccaagttgtctgcctcccgaagtgcccacccaattgcctggccaaaacatgaaggggagccggtcctctgcagatagttcacggaagcattag

SEQ ID NO: 177442 - DNA, 594 bp, Artificial Sequence
  Description of Artificial Sequence: Synthetic coding sequence
atggacccccccgccggcttcgtgcgggccggcaaccccgccgtggccgcacctcagtcacctcttagtcccgagggcgcacatttccgggcagcacatcacccccgttccactggatctcgctgtcctgggtccctccagccctcccggccattagtagcaaattggttgcagtcactccccgaaatgcctgtcgactttacaggctattggaaaatgttggtgaatgaaaatttcgaggagtacttgcgggctcttgacgtgaatgttgccctgcgcaagattgcgaatctgctgaaaccggataaagagatcgtgcaggatggggaccacatgatcatcaggacactgtcgacattccgtaactacatcatggactttcaagtggggaaagagtttgaggaggacctgacggggatagacgacaggaagtgtatgactacagttagctgggatggcgacaaactacagtgcgtgcaaaaaggggagaaggagggacgcggctggacgcagtggatagaaggagatgaattgcatttggagatgagagtggaaggtgtcgtgtgcaaacaggtgttcaagaaggtgcagtag

SEQ ID NO: 177443 - DNA, 528 bp, Artificial Sequence
  Description of Artificial Sequence: Synthetic coding sequence
atgaccaactgccccaccctgatcgtgatggtgggcctgcccgcccgggggaagacatacatatctaagaagctgactagatatctgaactggattggagtgcctaccagagaattcaatgtcgggcaataccgccgcgatgtggtcaaaacatataagagttttgagttttttctgcctgataacgaggaaggactgaaaattaggaagcagtgtgcactggcagcgttaagggacgttagacgtttcttgtcagaggagggaggacacgttgccgtgttcgatgccacaaacaccacgagagaacggcgggccactattttcaatttcggggaacaaaatggctataagacctttttcgtggaatctatatgcgttgaccccgaagtgattgcggcaaacatcgtgcaggttaaactcggctctccggattacgtgaaccgcgactcagacgaagccaccgaggactttatgagaagaattgagtgttacgaaaatagttacgagtcacttgatgaggatttgtag

SEQ ID NO: 177444 - DNA, 1377 bp, Artificial Sequence
  Description of Artificial Sequence: Synthetic coding sequence
atggaccggggcagcctgggcggcagcagcctgaccgacctgggccctggaagctcaaggcgagtgtgcatgactaattgcccaacactgattgttatggtgggtctgccagctcggggaaagacatatatcagcaagaagttgaccagatacctcaactggattggggtccccaccagggagtttaatgtcggccaatatcgacgtgacgtggtgaagacctacaaatcattcgagtttttcttacctgacaacgaggaaggactaaaaatcagaaaacagtgcgccctggccgctctgcgggatgtgcgtaggtttcttagcgaagagggggggcacgtagccgttttcgatgctaccaacactacacgggagagacgggccaccattttcaactttggggagcagaatggctacaagacgtttttcgtcgagtctatctgtgtggacccagaggtaatcgcagcaaacatcgtgcaagtgaaattgggatcacctgattatgtaaatcgggactccgacgaggcaactgaagactttatgcggaggatagagtgttacgagaatagctacgaatccttagacgaagatttggaccgagatctgtcatacatcaaaattatggacgtgggccaaagctatgtcgtcaacagggtggctgaccatatccagtcacgaatcgtgtattacctaatgaatattcacgttaccccgcgttctatatatctgtgccggcatggtgagagcgaacttaacttgaaaggccgaatcgggggcgatccaggcctgagcccacggggaagagagttcgccaagtctctggcccagtttattagtgatcagaacattaaagacttgaaggtctggacctctcagatgaaacgtaccatacaaactgccgaagccctgggcgtgccctatgagcaatggaaagtcctcaatgagattgacgctggagtctgcgaggaaatgacatacgaagagatacaggataactatccgttggagtttgctctgagagaccaagacaagtacagataccgctacccaaaaggtgagtcatacgaggacctcgttcaacgccttgagccagtgattatggagctggagcgccaggagaatgtcctggtcatctgccatcaggcggtcatgcgctgtttgcttgcctattttcttgataaagcggccgagcagctgccctacctcaaatgcccgttacacacagtgctcaagctcaccccagtggcctatgggtgtaaggtggaaagcatattcttaaatgtggcagctgtgaatacgcaccgagaccggccacagaacgtcgatattagtaggcctcctgaagaagcccttgttaccgtgccagcacaccaatag

SEQ ID NO: 177445 - DNA, 1308 bp, Artificial Sequence
  Description of Artificial Sequence: Synthetic coding sequence
atgaccaactgccccaccctgatcgtgatggtgggcctgcccgcccgcggaaagacctacattagcaaaaaacttaccaggtatttgaactggattggcgttcccacccgcgaatttaacgtgggacagtaccgaagagacgtcgtgaaaacatataagagctttgagttttttctccctgataatgaagaggggcttaagatcagaaaacagtgtgcactcgccgcactcagggacgtgaggaggttcctgagcgaggaagggggccatgtcgctgtgttcgacgccacgaatactaccagagagaggagagccaccatttttaacttcggcgagcagaatggctataaaacattcttcgtggagtcaatctgcgtggatccagaggtgattgctgccaatatcgttcaggtgaaactcggcagccccgattacgtgaatcgcgatagcgacgaagccacggaggatttcatgcgcagaatcgaatgctacgaaaacagctacgagtcgcttgacgaggacctggacagggatctctcttacatcaagatcatggatgtgggccaaagttacgtcgtgaaccgcgtcgcagatcatattcagtcacgtattgtgtactacctgatgaacatccacgtgacgcccagatccatttatctctgtaggcacggtgaaagtgaactaaacctgaaaggaagaatcggaggggaccccggcctatcacccagaggtcgagaatttgctaagtcactggctcagtttatctccgaccagaacataaaagatctgaaggtgtggacgtctcaaatgaagcgaaccatccaaacagcggaggctctgggggtgccttatgaacagtggaaagtgctaaacgaaattgacgccggagtctgtgaagagatgacctacgaagaaattcaggacaattacccacttgagttcgccctccgcgatcaagataagtatagatatcgataccccaagggagaatcatatgaagaccttgttcaacgtctcgagccagtgataatggaattagagagacaggagaacgttctcgtaatttgtcatcaggctgttatgcgctgcttactcgcttactttctcgataaagcagccgagcagctaccataccttaagtgccctctccacacagtactgaaactgacacccgtggcctatgggtgtaaagtggagagtatcttcctcaatgtggcagcagttaacacccaccgagatcgacctcaaaacgttgatatctcaagacctccggaagaggcattggtcaccgtgccagcacatcagtag

SEQ ID NO: 177446 - DNA, 429 bp, Artificial Sequence
  Description of Artificial Sequence: Synthetic coding sequence
atggccagcccccgggagctgacccagaaccccctgaagaagatctggatgccttactcaaatggacggccggctctgcacgcatgtcaaagaggggtgtgtatgactaattgcccgactttgattgttatggttgggctgccagcccggggcaagacctacatatccaagaagctgactcgttacctaaattggataggggttccgacccgggagttcaacgttggccagtatagaagggatgttgtgaagacgtataagagttttgaattcttcctcccggataatgaggaggggctgaaaattaggaaattcttgatgccccagaccccgcctgagaatggcgagagacctagccttattctcgagaatagaatggctacaaggccattccttagctcccccagtgtatggatactcagaagctag

SEQ ID NO: 177447 - DNA, 777 bp, Artificial Sequence
  Description of Artificial Sequence: Synthetic coding sequence
atggccgcccccgcccccggcctgatcagcgtgttcagcagcagccaggagctgggtgccgcattggcgcagctcgtcgcccagagagctgcgtgctgtttagccggggcacgcgcccgtttcgccctaggtttatccggcggatctctggtctccatgctggcgcgagaactgcctgcagccgtagccccagcaggaccagcatcccttgcgaggtggaccctaggtttttgcgacgaacgcttagtgccattcgaccacgcagagagcacatacggactgtatcgcacgcaccttctctcccggctgcccattcctgaatcgcaagtaattacaatcaaccctgaattgcccgtagaggaggcagctgaggattatgccaaaaagcttcgccaggctttccagggtgacagtatacccgtgttcgatctgcttattctcggtgtgggtcccgatggacatacatgttccttattccctgaccaccccttgctacaggagagagaaaaaatcgttgctccgatcagtgattcccccaagccacctccacagagagtcaccttgacgttgccagttcttaatgctgctcggaccgtgatctttgtcgctactggagaagggaaagctgctgtgctgaagagaatcctggaagaccaggaagaaaaccctctgccagcggcattagtgcagccacacacaggaaagttgtgttggtttctggacgaggccgccgcgcggctcttgaccgtgccattcgagaaacacagcaccctgtag

SEQ ID NO: 177448 - DNA, 1428 bp, Artificial Sequence
  Description of Artificial Sequence: Synthetic coding sequence
atggccgccaagagccagcccaacatccccaaggccaagagcctggacggggtgactaacgaccggactgcgtcgcaggggcagtggggccgcgcttgggaggttgactggttctcgctggcttcagtgatcttcctgctgctcttcgcacccttcatcgtttattacttcatcatggcatgcgatcagtatagttgtgctctgaccggaccagtcgtagatatagtgacgggccatgcaaggctgtcagacatctgggccaaaacaccacccataaccagaaaagcagctcagctctatactctgtgggtgacctttcaggtcctcttgtacacctccctaccagacttttgtcacaaattcttgcccggatacgttgggggtatacaagagggagccgtcacaccggccggagttgtgaacaaataccagatcaacggacttcaggcctggcttctcacacacctcttgtggtttgcaaatgctcatttactgtcttggttttcccctaccatcatctttgacaactggatccccttactgtggtgcgccaacatcctgggctatgccgtcagtacgttcgccatggttaagggctattttttccctacttccgctcgcgactgcaagttcaccgggaacttcttctacaattacatgatggggattgagttcaatcctcggatagggaaatggtttgacttcaaattattcttcaacgggaggcccggcattgtggcctggactttaatcaatctctcttttgcagcgaaacaacgcgagcttcactcccatgtgactaacgctatggtattggtgaacgttcttcaagccatctacgtgatcgattttttttggaatgaaacgtggtatttgaaaacaattgacatatgtcatgatcactttgggtggtacctcgggtggggcgactgcgtgtggctcccatacctatatactctgcagggactgtacctggtttatcaccccgtccagctgtcaacccctcacgctgttggagtgcttctgctgggtctggtgggatattatatttttagggttgccaatcaccagaaggacttattcaggcggactgacggcagatgcctgatttggggcaggaagcctaaagtgatcgaatgttcttatacctcggctgacggacagaggcatcacagcaaactcctggtgagcggtttttggggcgttgctagacacttcaactacgtgggagacctgatgggttcccttgcctattgtctggcatgcggtggggggcatttactgccctatttttacatcatttatatggccatcctcctgacgcacaggtgccttcgagacgaacaccgctgtgccagcaaatatggccgtgactgggagaggtacacagcggctgtaccttaccgtcttttgcccggtatattttag

SEQ ID NO: 177449 - DNA, 1428 bp, Artificial Sequence
  Description of Artificial Sequence: Synthetic coding sequence
atggccgccaagagccagcccaacatccccaaggccaagagcctggacggtgtcacgaacgaccggaccgcgagccagggacaatgggggcgggcttgggaggtcgattggttctctcttgcctctgtgatcttcctgctgctgtttgccccctttatcgtctattacttcatcatggcctgcgatcaatattcctgtgccttgaccggaccagtcgtggacatcgtgaccggtcatgcccgcctaagcgacatctgggcgaagacaccaccaataactaggaaggccgctcagttatacactctctgggtgacctttcaggtcctcttgtacacctccttacccgacttctgtcataaattcttgccaggctatgtcggaggcatccaggaaggggcagtgacacccgcaggcgtggtgaataagtaccaaatcaatgggttgcaagcttggctgcttacgcacctgctgtggtttgctaacgctcacctcctgtcttggttctcccccacaattattttcgataactggatccccctgctctggtgcgctaacatcctaggatatgccgtatcgactttcgccatggtgaagggctacttcttcccaacgtcagctcgggactgtaaattcacaggcaatttcttctataactacatgatgggcattgagttcaacccacgcatcgggaagtggttcgactttaagcttttctttaatgggcggcccgggatcgtggcatggactttgataaatctgagctttgctgccaagcaaagagagcttcacagtcatgtcacaaatgccatggtcctcgtgaacgtgcttcaagccatctacgtgatcgacttcttttggaatgagacctggtacttgaagaccatagatatatgccatgatcacttcgggtggtacctcggttggggcgattgtgtgtggttaccttacctatatacgctccagggcctgtatctggtgtatcaccctgtccagctttccacccctcatgctgttggcgtgctgctcctcggtcttgttggttactacatatttcgcgtcgcaaaccatcagaaggaccttttcaggcggacggatggacgctgccttatatggggacgaaagcctaaggtgattgaatgtagttacactagtgccgacgggcagcgccatcatagtaaacttctcgtgagcggtttctggggagttgcaaggcatttcaattacgtgggcgatctgatgggaagccttgcttattgcctggcctgtggggggggccatttgcttccatacttttacatcatttacatggcgattctgctcactcatcgctgtttaagagacgagcaccggtgtgcctccaagtacggccgggattgggaacgatatactgcagctgtcccctaccggcttctgcccggaatcttctag

SEQ ID NO: 177450 - DNA, 327 bp, Artificial Sequence
  Description of Artificial Sequence: Synthetic coding sequence
atggccgccaagagccagcccaacatccccaaggccaagagcctggatggagtgaccaacgatagaactgccagccaaggccaatgggggcgggcatgggaggtggactggttctctctggcttctgtcatcttcctgttgcttttcgcccccttcatcgtctactacttcataatggcttgcgaccagtattcttgcgccttgactggaccagtggttgacatcgtgacaggacacgcacgcctgagcgacatctgggccaaaaccccaccgataacacgcaaagcagctcagctatacacactatgggtgaccttccaggtttag

SEQ ID NO: 177451 - DNA, 495 bp, Artificial Sequence
  Description of Artificial Sequence: Synthetic coding sequence
atggccgccaagagccagcccaacatccccaaggccaagagcctggacggagtgacgaatgatcggaccgccagccaagggcagtggggcagggcctgggaggtcgattggttcagtcttgccagtgtaatatttctgctcttattcgccccatttatagtgtactattttatcatggcatgcgatcagtattcctgcgcattgactggcccagttgtggatatcgtgacgggacacgccagactgtccgatatatgggctaaaaccccacccatcacccgaaaggccgcccaactctacaccttgtgggtgacttttcaggtcctgttgtacacttccctccccgacttctgtcataaatttcttccaggctatgtaggcgggatacaagaaggcgcagtcacaccagccggcgtcgtgaacaagtaccagatcaatggcctgcaggcctggttgctgacccatctgctttggttcgctaacgcccacctttag

SEQ ID NO: 177452 - DNA, 276 bp, Artificial Sequence
  Description of Artificial Sequence: Synthetic coding sequence
atggccgccaagagccagcccaacatccccaaggccaagagcctggatggagtgaccaatgacagaaccgcctcccaaggccaatgggggcgtgcgtgggaggttgattggttcagtctggcttccgtgatctttcttcttctcttcgcccccttcatagtgtattacttcattatggcctgcgatcaatactcatgtgcactgaccggacctgtagtggacatcgtgaccgggcacgctagactctccgatatttgggcaaaaacacccccctag

SEQ ID NO: 177453 - DNA, 318 bp, Artificial Sequence
  Description of Artificial Sequence: Synthetic coding sequence
atggccgccaagagccagcccaacatccccaaggccaagagcctggacggcgtaaccaatgatcgcacagcgagccagggccaatgggggagagcttgggaagtcgactggttttccctagcctcagttatctttcttttgctgtttgccccatttatcgtctactactttattatggcctgcgaccaatactcgtgtgcgctgaccggcccagtcgtcgacattgtgaccggacatgcccggctgagcgatatctgggcaaagacccctccaatcacaaggaaagccgctcagctgtacaccctgtgggttacgtag

SEQ ID NO: 177454 - DNA, 846 bp, Artificial Sequence
  Description of Artificial Sequence: Synthetic coding sequence
atggacagctacagcacctacctggccaccgtgaaggtgagcggctcctggctggaagagcaggacgaagacatttacgaggtcgaatccagagtcccacttccccaccccttccctctgtgcgaacaccttgacgaaaataacagcgtgatcgtcaacacctcaatcttccacttcattcacaagagaaatggccacatcttgaaactgatcagcaagattagcctccctacacccccttacagtttagaacacgccaaggtcacacaaaccgagctgatgcgggaatccttccgtcaaaagcaggaggctactgagtccttaaagtgccaggaggaacttagagagcgcttgcatgaagaatctagagcaagggagcagctggctgtggagttgagcaaagccgaaggtgtcatcgacggctacgcggacgaaaaaaccttgtttgagcgccagatacaggaaaagactgacattatcgacaggttggagcaagagctgctgtgcgcaagcaacagactgcaggagctggaggcagagcagcagcaaattcaggaagagcgagaactgctatctaggcaaaaggaggccatgaaggccgaagccggacctgtggaacagcagctattgcaggagacagaaaaactgatgaaggaaaagctggaggttcagtgccaggcagaaaaagtaagggatgacctgcagaaacaggtgaaagcactcgagattgacgttgaggaacaggtgtcacgtttcatcgagctggaacaggaaaaaaacacggaactaatggacttacgccagcagaaccaggctcttgagaagcagctggagaagatgcggtag

SEQ ID NO: 177455 - DNA, 11724 bp, Artificial Sequence
  Description of Artificial Sequence: Synthetic coding sequence
atggaggacgaggagcggcagaagaagctggaggccggcaaggccaagttggcccagtttagacaacggaaggctcagagcgacggccagtcccctagcaaaaagcagaaaaagaaacggaagacctcctcttcaaagcatgacgtctccgcccatcatgatctaaacatcgatcagtcccaatgtaacgaaatgtacatcaatagtagccaacgagttgagtcaacagtaatccccgaatctactatcatgcgtacccttcattccggcgagatcaccagtcacgagcagggtttctccgtcgaacttgaatctgaaatatctacaacggctgatgactgctcttcagaagtcaacggatgttcatttgtgatgagaacaggtaagcccacaaacctgctgagggaagaggaattcggtgtggacgatagttactccgagcaaggagcacaggattcacctactcacttggagatgatggaatcggagctcgcagggaaacagcatgaaattgaggaactcaatcgggaactcgaagagatgcgagtgacatatgggacggagggcttgcaacagctccaggagtttgaagccgctatcaagcaacgcgacggaatcatcacacaacttaccgcgaacttacaacaggctcgacgggagaaagacgagactatgagagagttcctcgaattaaccgaacaatcccagaaattacaaattcagttccagcagctccaggccagcgaaactttgagaaattctactcacagtagcacagcagccgacttactgcaggcgaagcagcagatcctaacacaccagcaacagctagaagaacaagatcacttgctggaggactaccaaaaaaaaaaggaggatttcacaatgcaaataagttttttgcaggagaagatcaaagtatacgagatggaacaagataaaaaggtcgagaactcaaacaaagaagaaatccaagagaaggagactatcattgaggaactcaacacgaagattatcgaggaagagaagaagactctcgagcttaaagacaaattaaccaccgccgataagctgctcggcgaattgcaagagcaaattgtgcagaagaaccaggagatcaagaatatgaagctggagttaactaacagcaagcagaaggagcgccagagtagcgaagagataaagcagctgatggggactgtggaagagttgcaaaaacgcaaccacaaggatagtcagtttgagactgatattgtgcagcggatggaacaagaaacacagcgaaaattggaacaactcagagctgagttggacgaaatgtatggacagcaaattgtgcagatgaaacaggaactgattcgccaacacatggctcagatggaggagatgaagactcggcacaaaggagagatggaaaatgcacttcggagctactcaaacataaccgtaaacgaggaccagatcaagctcatgaacgttgctattaatgagctgaacataaaactccaggacactaacagccaaaaagagaagctcaaagaggagctcggcctgatcctcgaggaaaagtgcgctctgcagcggcagttagaggacctcgtagaggagctgtcattcagccgcgaacagatccagagagcgagacagactattgcagagcaggaaagtaagctgaacgaggcccataaaagtctatcgaccgtggaagatctgaaggccgaaatcgtctcagcaagcgagagcaggaaggagctggagctcaagcacgaggctgaggttacgaattataagattaagttggagatgctcgagaaagagaaaaatgccgttctggacagaatggcggagagtcaggaggccgagctcgagcgcttgcgaacacaactgctattcagccacgaggaagaactatctaagctgaaggaggatttggagatagagcacaggatcaatatagaaaaattaaaggacaatctggggatccactacaaacagcagatcgatggcctgcagaacgaaatgtcccagaaaatagagaccatgcagtttgagaaggataacctcattacaaagcagaatcagctgatcctagaaattagtaaactgaaggacctccagcagagtctcgtcaattccaagtcggaggagatgaccctgcagatcaatgagctacaaaaagagatcgagatcctgcgccaggaggaaaaggagaaaggaactctggaacaggaggtccaagagctccagttgaagaccgagctgctggagaaacaaatgaaagagaaagagaacgaccttcaggaaaagtttgcccaactagaagcagagaacagcattctgaaggacgagaagaaaactctggaggacatgctgaagatccatacaccagttagccaggaagaacggttgatctttctggactctataaagtcaaagtcaaaagactccgtttgggagaaagaaatcgaaatccttatcgaggaaaatgaggatctgaagcaacagtgcattcagctgaatgaggagattgaaaaacagagaaacactttctcctttgcagaaaagaactttgaagtcaactaccaagaactgcaggaggaatacgcctgccttctgaaagttaaggatgacctcgaggattccaagaataagcaggagctggaatataaatcaaaacttaaagccctgaacgaggaactgcacctgcagcgtatcaacccaacaaccgttaagatgaagtccagtgtctttgatgaagataagacctttgtggcggagaccctggagatgggcgaggtggtcgagaaggacacaaccgagctgatggaaaagctggaggtgaccaagcgggaaaaactggaactgtctcagaggctttccgacctgagcgagcaattgaaacagaaacatggcgagatctctttcctcaacgaagaagtgaagtctctcaaacaggaaaaggaacaagtttctcttaggtgtcgagaactggagatcatcataaatcataacagagctgaaaacgtacagtcatgtgacacacaggtgagcagcctgctagacggagtggtcactatgaccagccgcggtgctgagggctcggtgagcaaggttaacaagagctttggggaagagtctaagattatggtcgaggataaggtgagtttcgaaaatatgaccgttggagaggaaagtaagcaggagcagttaatactggaccatttacctagtgtcactaaagagtcctctctccgcgctacccaacccagtgaaaatgacaaactgcagaaagaactcaatgtgctgaagtctgagcaaaatgacctcagactacagatggaagcccagcgaatctgcctctctctagtttatagcacacacgtggatcaggtccgtgaatacatggaaaatgagaaggacaaggcattatgcagcttgaaggaagagctgatcttcgcccaggaagaaaagataaaggagctgcagaaaatacaccagctcgagctgcagaccatgaaaacccaggaaacaggcgacgagggcaagccccttcatctccttatcgggaagttacagaaagctgtttctgaagagtgttcatactttctccagaccttgtgctctgtcctcggcgaatactacacccccgctcttaaatgcgaggtgaacgctgaggacaaagagaattcgggtgactacatctctgaaaatgaagacccagagctacaagactatcgctacgaagtccaggactttcaagaaaacatgcacacattgctgaacaaagtgactgaggaatataacaaactattggtccttcagacacgcctcagtaaaatttggggacagcagaccgacggcatgaagcttgagtttggcgaagaaaatttgcccaaagaagagacagagtttctgagcatccactctcagatgactaaccttgaagacattgacgtaaaccataaatccaagctgtcgagcctgcaggacttggaaaagacgaagttggaggaacaggtccaagaactcgaaagtctaatctctagtctgcaacagcagctgaaggagactgagcagaactacgaggcggaaatacattgcctgcagaagcgcttgcaggccgtcagtgagtccactgtgcccccatcattgccggtggatagtgttgtgatcactgaatccgacgcccagaggacgatgtatccaggatcatgcgtgaagaagaatattgatggcaccatcgagttcagcggcgagttcggagtgaaggaggaaacaaatatcgttaagttactggagaaacagtatcaagagcaacttgaagaggaagtagccaaagttatcgtgtctatgtcaatcgcctttgcccagcagaccgaactgagtagaatttccggtggaaaagagaatactgcttcctctaagcaggcacacgcagtctgccagcaggaacaacattactttaacgagatgaagctctcccaggaccagatcggatttcaaacgttcgagaccgttgatgttaaattcaaggaggaatttaagcccctatcgaaggaactcggagagcacggcaaagagattctgctgtcaaactccgatccccatgacataccggagagtaaagattgtgtgctgaccatatcggaggaaatgtttagtaaggacaagacgttcatcgttcgacagtccatccacgacgaaatctcagttagttctatggacgcctctagacagttgatgctgaacgaggagcagttggaggatatgcggcaggagctggtgcgccagtatcaagaacaccaacaggccactgaattgctgaggcaagcccacatgcgacaaatggagcggcaacgggaggatcaggagcaattacaagaggaaattaagaggcttaaccgccaactcgctcagagatcttcaattgacaatgaaaatcttgtctccgagagagagcgagtcctgctcgaagaattggaggcgttgaaacagctgtccctggctggaagggagaagttgtgctgtgagctgcgcaattcttctactcagacgcagaatggcaacgagaatcagggtgaagtggaagagcagactttcaaagagaaggagctcgatagaaaaccagaggatgtgcctcccgaaattctgtctaatgagcggtatgcactccagaaggcgaacaatcgactcttgaaaattttactagaagtggttaagactactgcggccgtcgaggagactataggccgccatgtactcgggattctagaccggagctcaaagagccaaagctctgcatccctcatttggcggagtgaagctgaggcttccgtaaaatcttgtgttcatgaggagcacacaagagtcactgatgagtctatcccttcttactccggatctgatatgccacgcaatgacattaatatgtggtccaaggtcacagaagaaggaaccgaactgtcccaaagactggtcagatctggcttcgctgggaccgagattgatccggaaaatgaggagcttatgttgaacatctcgagccggctgcaagccgctgtcgagaagctcctggaggccattagtgaaaccagctcgcagctggagcacgcgaaggtgacccagaccgagctcatgcgggagagtttcaggcagaagcaagaagccaccgaaagtctgaagtgccaggaagaacttcgggagagactccacgaagaatcgagggcacgggaacagctggctgtcgaactgagtaaggcggaaggcgtgatcgacggttatgcagatgagaagacgctttttgagcggcagatccaggagaagactgacattattgatcgactcgagcaggaacttctgtgtgccagcaatcggctacaggagctcgaggcagagcagcagcagattcaagaagaacgggaactcctttctcgtcagaaagaggctatgaaagccgaagctggtcccgtagaacaacagctgctacaggagaccgagaaactgatgaaggagaaattagaggttcagtgccaagcagagaaagttagggacgacctgcagaagcaggtgaaggctctcgaaatcgatgtcgaagaacaggtgtccagattcattgagctggagcaggagaagaacacggaacttatggatctgagacagcaaaatcaggctctggaaaaacagctggagaaaatgcggaaatttttggacgaacaggccattgatcgggagcatgagagggacgtattccagcaggaaattcagaagcttgagcaacagctgaaagtagtcccacgtttccaacccatttctgagcaccaaacaagggaagtcgagcaactagcaaaccacttaaaggaaaagactgataaatgctctgagctgcttctgtccaaggagcagctccaaagagacatccaagagaggaatgaggagatagaaaagctcgagtttcgagtcagggagctggagcaggcgcttttggtctctgctgatacattccagaaggtggaagatagaaagcacttcggcgctgtcgaagcgaaacccgagttgtccttggaggtgcagttgcaggcagagcgggacgcaattgacagaaaagaaaaagagataactaacctcgaagaacagttggaacagttccgagaggaattggaaaataaaaacgaagaagttcagcagctgcacatgcagctggaaattcagaaaaaggagtctactaccaggctgcaggaactggaacaggaaaacaaattatttaaggatgacatggagaagttaggccttgccatcaaggaatcagacgcaatgagcactcaggaccagcatgtcctcttcggcaaatttgcacagatcattcaagagaaagaggtcgagatcgaccagctgaacgagcaagttacaaagctccagcaacaattaaaaatcacaaccgacaacaaggtgatcgaagaaaaaaacgaattgattagggacttggaaacacagatcgagtgcctaatgtccgatcaggagtgcgttaagagaaaccgagaggaggagattgagcaactgaacgaagttatcgagaagctgcaacaggagttggcgaatatcggacaaaagacgtccatgaatgcccatagcctcagcgaggaggcagattcgctgaagcatcagctggatgtagtcatcgccgagaagttggccttagagcagcaagtggagactgcgaatgaggaaatgaccttcatgaagaatgtcttgaaggagactaacttcaagatgaatcagctgactcaggagctcttttctcttaagagagaacgcgaaagtgtggagaagattcagagcattcctgaaaattcggtcaacgtggccatagaccacttgtccaaagataagcctgagctcgaggtcgtacttacagaagacgccctaaagagcttagaaaatcagacatatttcaagagctttgaggaaaacggaaaaggatctataatcaacctggaaacccggttgttgcagctggaatctacagtcagcgcaaaggatctagagctcacccagtgctacaaacaaataaaagacatgcaagaacagggccagtttgaaaccgagatgcttcagaaaaagatagtcaatcttcagaaaatcgtcgaggaaaaggtggcagccgctctggtgagtcagatccagctggaggcggtacaagagtacgctaaattctgccaggacaatcagactatctcctccgagccagaacgcacaaacatacagaaccttaatcaactccgcgaagatgagcttggttctgacataagcgcactaacactacggattagtgagctggagtcacaggtggtcgaaatgcacacaagcttgatcctcgagaaagagcaggttgaaattgccgagaagaacgttttagagaaggaaaagaagctgctggagttgcaaaaactgcttgagggcaacgagaagaagcagagagagaaggagaaaaaacgcagcccacaagatgttgaagttttaaaaaccacgactgaactgttccactctaatgaggagtcaggatttttcaacgagctggaagctttgagggcggaatcagtcgccactaaagctgaattggccagctataaggaaaaagctgagaaactacaagaggaactcctggtcaaggagaccaacatgactagtctccagaaagacctcagccaggtgcgtgatcatctggccgaggccaaggaaaagctcagcatcctagagaaggaggatgagactgaggttcaagaaagcaaaaaggcttgcatgttcgagcctcttcctatcaaactgtctaaatccatcgcctcacagaccgatggcacactcaaaatttcctcttccaatcagactccccagattctcgtcaagaacgccggaattcaaatcaacctgcagagcgagtgcagctccgaggaggtaactgagatcatctcccagtttacagagaagattgaaaagatgcaggagttgcacgccgccgagatcttagatatggagagtcgccatatctcggaaaccgagactctgaagagagagcactatgttgctgtccagcttctaaaagaggagtgcggtaccctcaaagcagtcatacaatgtctccgcagtaaggagggcagcagtatccccgagctggctcattcagacgcctatcagacacgtgagatatgctcctccgattcaggctcagactggggacaagggatttacctgacccattctcagggctttgacatcgcttctgaaggacggggggaggagtcagagagcgctacagattcattccccaagaaaattaaaggtctgctaagggcagttcacaacgaggggatgcaggtgctgtcgcttactgaatctccctactcagacggcgaagatcacagtatccagcaggtgtcagagccttggctggaagagcgaaaggcatatatcaacaccatttcctccctgaaagacctcataactaaaatgcaacttcagagagaagccgaagtctatgattcgagccaaagccacgaatctttctcagattggaggggtgagctgctgttggcattgcagcaggtgtttctcgaggaaagatcagtactgctcgctgcgtttcgaaccgagctcacagccttggggacaactgatgctgtgggattgctgaactgcttggagcaacggatacaagagcaaggcgtggaataccaggccgctatggaatgtctccaaaaggccgatcgccggtccctcctttctgagattcaggccctacacgcacagatgaatggacggaagatcactctgaagagggagcaggagagcgagaagccttctcaggagctcctagaatacaatatccagcagaagcaatcccagatgcttgaaatgcaagtggaactttctagtatgaaagacagggcaaccgagctccaggagcagctgagctccgagaagatggtggtcgccgagctcaagtccgaactcgcacaaacaaaactggagttggaaacaaccctaaaggctcagcataagcacttgaaggaattagaggctttccgcctggaagttaaggacaagacggatgaagtccacctgctgaacgacactctcgcctccgagcagaagaagtctcgggagctgcagtgggcattagaaaaagaaaaggctaagctcggacggagtgaagagcgagacaaggaggagctggaagatcttaaatttagcctggaatcccagaaacagaggaacttgcagctcaacctgctgctcgagcagcaaaaacagcttttgaatgaatcccagcagaaaattgagagtcagcgaatgctgtatgatgcacagctgtccgaggagcagggacgaaatctggaactccaggttttgttggagagtgagaaggtccggatcagagaaatgagcagtacactcgaccgggaacgagagcttcacgcgcagctgcagtctagcgacggaaccggacagtcccgacctcccttgccctcagaagatctgctgaaagagttgcagaaacagctggaggagaagcacagccggattgtagaactgctcaatgaaacagaaaagtacaagctcgacagtctgcaaactcggcaacagatggaaaaggacaggcaggttcataggaagaccttgcagactgaacaagaagctaatactgaaggccagaaaaaaatgcatgaattgcagagcaaagtcgaagaccttcaacgccagctggaagaaaagaggcaacaagtctacaaactggacctagaggggcagcgcctgcagggaattatgcaggagtttcagaagcaggagctagaacgcgaagagaaaagggaatcacgcaggattttgtaccagaacctgaatgaacccaccacctggtctctcacaagcgacaggacaagaaactgggtcctacagcagaagatcgaaggtgagacgaaggaaagcaactatgccaaactgattgagatgaacggcgggggtactggctgcaaccacgaattagaaatgatccgccagaaactgcagtgtgtcgcctccaaactgcaagttttgccccagaaggcatccgagagattgcaatttgagaccgccgatgacgaagatttcatttgggttcaagagaacattgatgagatcatactgcagttgcagaaactgacgggtcaacagggtgaagaaccatcattagtgagtcccagtacttcctgcggatcccttacagaacggctccttcgccagaacgcggagcttaccggccacataagccaacttacagaagagaaaaacgatctgcgtaatatggtaatgaagcttgaggagcaaataagatggtataggcaaaccggggccggcagggataattccagtaggttttcacttaacggaggagcaaacatagaagcaatcatcgcgagcgagaaggaagtgtggaatcgggaaaaactcaccctccagaaatccctgaagagagctgaagccgaagtctacaaactgaaagcagagttacggaacgactcgctgctgcagactctttcacctgatagcgaacatgttaccctcaagcgaatctacggcaaatacctaagagccgagagcttccgcaaagctttgatctatcaaaaaaagtacctgcttctactgttagggggatttcaggaatgtgaggatgcgacgctggctctcctcgccagaatgggaggtcaaccagcgtttactgatctcgaggtgattaccaatcgacctaagggtttcaccaggttcagatccgccgtccgggtgtcaattgctatttctcgtatgaagtttttggttcgaaggtggcatagggtaacggggtccgtgtctatcaatataaaccgcgatggttttggactgaatcaaggagccgaaaagaccgactccttctatcactcttctggtggtctagagctgtacggcgagccgcgccacactacctataggtcgagaagtgacctggattatatacgatcaccattgccctttcagaataggtacccggggacgcctgccgactttaatcccgggagcctggcctgttctcagctacagaactacgatcccgaccgagcactgaccgactacataacacgactagaggccctacaacgcaggttggggaccatccagtccggctctaccacacagtttcacgcaggcatgcgaagatag

SEQ ID NO: 177456 - DNA, 11574 bp, Artificial Sequence
  Description of Artificial Sequence: Synthetic coding sequence
atggaggacgaggagcggcagaagaagctggaggccggcaaggccaagatcgaagagctgtccctggcctttctcgtcagacagctggcccagtttcgccaaagaaaggcacaatctgacggtcaatctccttcaaagaagcaaaagaagaagcggaagacttcctccagcaaacatgacgtgtctgctcaccacgacctgaacatcgaccagtcccagtgtaatgagatgtatattaacagctcccaacgggtcgaaagtacggtgataccagagagcacaattatgcgcacgcttcattctggtgaaatcactagtcacgaacaggggttctcagttgagctcgagtcagaaatctccaccacggcggacgattgtagctctgaagttaatggctgctcttttgtgatgcggactggaaagcccactaacctcctccgagaagaggagttcggtgtagatgacagctactctgaacaaggggctcaggattctcccactcacctcgaaatgatggaatctgagctggcaggcaagcaacacgaaatcgaagaactgaatcgggaactcgaggagatgcgggttacctatggcaccgaagggctccagcagcttcaggaattcgaagcagcaattaagcagcgggatggcattatcactcagctgacagctaaccttcaacaggccagaagagagaaggatgagacaatgcgggaatttctagaactgacagagcagagtcaaaagctgcaaatccagtttcagcagttgcaggcaagcgagactctgagaaactctactcatagttctaccgccgcagatctgctgcaggccaagcaacaaattcttactcaccagcaacaactggaggagcaggaccacttgctcgaagattaccagaaaaaaaaggaagatttcacgatgcagattagtttcctccaggagaaaatcaaagtctatgagatggaacaggacaaaaaggtggaaaatagtaacaaggaagaaatccaagaaaaggagaccatcatcgaggagctgaacaccaaaattatagaagaggagaagaaaacacttgaactcaaagataagcttaccacggcagataaattgttgggggaacttcaggaacagatcgtgcaaaaaaaccaggagatcaaaaacatgaagctggaactcaccaactccaagcaaaaagaacgccaaagctccgaagaaataaagcaactgatggggaccgtcgaggagcttcagaagaggaatcacaaggactcccagtttgaaaccgatattgtgcagagaatggaacaggaaacacagagaaagttggagcagctgcgggcggagctagacgagatgtatgggcaacagattgttcagatgaaacaggagctgatcagacaacatatggcacaaatggaagagatgaaaactagacataagggagaaatggagaatgccctccgctcctattcaaacattactgtcaacgaggaccagatcaagttaatgaacgtggccatcaatgagcttaacataaagctgcaggacaccaactcccagaaagaaaaacttaaggaggagttgggattaatcctggaagaaaaatgcgcactacaacgtcagcttgaggacttagtcgaggaactgtcttttagcagagagcagatccagagagcacgccagacaatcgccgaacaggagagtaaacttaatgaggcacataagagtttgtcaacggtggaggatctaaaggccgaaatcgtgtccgcaagtgagtctaggaaggagctggaactaaagcacgaagccgaggtcaccaattacaagatcaaactcgagatgctggagaaggaaaagaatgctgttttagaccggatggccgagagccaggaggccgaactggagcgtctgaggacacaactgctgttcagccacgaggaggagctcagtaagcttaaagaggatcttgaaatcgagcatagaatcaatattgagaagctgaaagataacctagggatacattataaacagcagatcgatggactacagaatgagatgagtcagaaaatcgagactatgcagttcgaaaaggataatctgattacaaagcagaaccagctcatactggagatttccaagctgaaggatctgcagcagtccctcgtaaactcaaagagtgaagaaatgaccctgcaaataaacgagctgcagaaagagatcgagatcttaagacaagaagagaaagagaagggtacactagagcaggaagtccaggagctgcagctgaaaactgaactgcttgagaaacagatgaaagaaaaggagaacgacctgcaagaaaagtttgctcagctggaggcggagaatagtatcctgaaagacgagaagaagacgctcgaggacatgctgaagatccacacccctgttagccaggaggaacggcttatcttcctggactcaattaagtctaaaagcaaagattccgtatgggaaaaagaaatcgagatcctgattgaagagaatgaggacctcaaacagcagtgtatccagcttaatgaggaaatagagaagcagagaaacacattttcctttgccgagaagaatttcgaggtcaactaccaagagctgcaggaggaatatgcctgccttctgaaagttaaggacgatctcgaagactcgaagaataagcaggaactggagtataagtccaaactgaaggcactaaatgaggagctgcacttgcagagaattaacccgaccacagtcaagatgaagtcctcagtgtttgacgaagataaaactttcgttgccgaaacactggagatgggggaggtggtggaaaaagataccaccgagcttatggaaaagcttgaggtgacgaagcgtgaaaaactggagctttcccaacggctcagcgatttgtccgagcagctgaagcagaagcatggggaaatctccttccttaatgaggaggtcaaatctctcaaacaggagaaagagcaggtgtcccttcgctgccgcgaactagaaatcattataaaccacaaccgagccgagaatgtgcagagttgcgacacacaggtgtcaagcctactggatggggtggtcacaatgacttctagaggcgccgagggcagtgtaagcaaggtgaacaagtcatttggcgaggagtccaagattatggtcgaggacaaggtcagctttgagaacatgaccgtgggtgaggagtccaagcaagagcagttaattttagaccacctcccctccgtgactaaggagtcatccctgcgcgccacccaaccctctgagaatgataagttgcagaaagagctgaatgtgctgaagagtgaacagaatgatctgcgcctgcaaatggaggcacagaggatctgcctgagtcttgtgtacagcacacacgtggaccaggtacgcgagtacatggaaaatgaaaaagacaaggctttgtgtagcttgaaggaagaattaatattcgcccaggaggagaagatcaaagaactgcagaaaattcaccagctcgagctacagactatgaaaacccaggaaactggagacgaaggaaagccactccacctcctcatcggcaaactccagaaagcggtgtccgaagaatgtagctactttctacagacactgtgcagcgtgttaggtgaatattatactcctgccctcaaatgcgaggtcaatgctgaagacaaggagaactccggtgattatatctctgagaacgaggatccagagctgcaagactaccggtacgaagtccaagactttcaggaaaatatgcataccctcttgaacaaggtgacagaagagtacaacaagctgctggtgctgcagacccgtctcagcaagatttggggccagcagactgatggaatgaaactggaattcggcgaggagaacttgcccaaggaagagaccgaattcctgtccattcattcacagatgacaaacctcgaggacattgatgtaaatcacaagtccaaattgtcatctttgcaggacctcgagaagacaaagcttgaggaacaggtgcaggagctggagtcacttatctcttccttacagcaacagttaaaggagactgaacagaattacgaggctgagatccactgtctgcagaagcgcctccaagctgtaagtgagagcaccgtgccgcccagcttacctgtggatagtgtcgtgatcaccgaatccgacgcccagcggaccatgtatccggggtcttgcgttaagaagaacatcgacgggaccatcgagttcagtggggaattcggagttaaggaggaaacaaatattgtgaagctgctggagaagcagtaccaggaacagctcgaagaagaagtggctaaggtgattgtctctatgtcgattgcattcgctcagcagactgaactgtccagaatctccggggggaaagagaatactgcttcttctaagcaggcccacgctgtatgccagcaagagcagcattactttaatgaaatgaagctttcccaagaccagattggatttcaaacatttgagacggttgatgtaaagtttaaagaggagtttaaaccactgagtaaagaactcggtgagcacggcaaagaaatactactctcaaacagtgacccccacgacattccggaaagcaaggactgtgtcctgactatctctgaggagatgttctccaaagacaagacatttattgtgcgccagagcatccacgatgagatcagcgtttcgagtatggatgcctcaaggcagctcatgctgaacgaagagcagctggaagacatgcgacaggaactcgtacgccagtatcaggaacaccagcaagcgaccgagctgctccggcaggcgcacatgagacagatggagagacaacgggaagaccaggaacaactccaagaggaaataaagcgcctcaaccggcaattggcgcagagatcttccattgacaacgagaacctggtgtccgagagggagcgggtgctgctggaagaacttgaggcccttaaacaactgtccctcgccggacgcgaaaagctttgttgtgagctaagaaactcgtcaactcagacgcagaatgggaatgaaaatcagggcgaggtggaagagcagacttttaaggagaaggaattggaccgtaagcccgaggacgttccccccgaaatcctgtccaatgaacggtacgcgctgcaaaaggctaataaccgactcctgaaaattctgttggaggtggtgaaaacgacggcagcagtggaagagactatagggagacatgtgctgggtattcttgacagatctagtaaatctcagagctctgccagcctcatttggagaagcgaggccgaggcctccgtgaagtcctgcgtccacgaagagcatacccgggtgactgatgaatccattccctcatactctggatccgacatgcccagaaacgatattaatatgtggagcaaagttactgaggaagggactgagctaagccagaggttagtcagaagtggattcgctggaaccgaaattgaccccgaaaatgaagaactaatgctcaacatctcgagcaggctgcaagcggccgtggaaaagttgttggaggccatcagtgaaacatcgtcacagctagagcacgccaaagtcactcagacagaactgatgagagaaagttttcgtcagaaacaggaggcaaccgagtctttgaagtgtcaggaggaacttcgtgaaagactgcatgaggaatctcgtgccagggagcagttggccgtggagttgtcaaaggcggagggcgtaatcgacggttacgctgacgagaaaacactctttgagcgacagatacaagaaaaaacagacatcattgatagattggagcaggagctactgtgcgcctctaacagactccaggagctggaggcggaacaacagcaaattcaggaagaaagagaactactctcacgccagaaggaggctatgaaagctgaggctggccccgtcgagcagcagctgctgcaagagaccgagaaattaatgaaagagaaacttgaggtccagtgccaagcggaaaaagtacgcgacgatctccaaaaacaagtcaaggctctggaaattgacgttgaggagcaggttagtcggttcatcgaactggaacaagagaaaaacaccgagctgatggatctgcgccagcagaaccaggctctggaaaaacaactcgaaaagatgaggaagtttttggatgaacaggccatcgatcgcgaacatgaaagagacgtcttccagcaggagatccagaagctggaacagcagctcaaagtcgtgcctcggttccaaccaatcagcgagcaccagaccagagaggtggaacagctggccaatcacctgaaagaaaaaacagataaatgtagcgagcttcttctttccaaggaacagctgcagcgagacatccaggagcggaatgaggagattgagaagctggagttccgtgttcgcgaactggagcaggcactcttggtgtccgctgacactttccagaaggtcgaagatcggaaacattttggagctgttgaagcaaagcctgaattgtccctcgaagtccagcttcaagcagaacgagatgccatcgatcgaaaagagaaggaaattactaatctcgaggagcagctcgaacagtttcgagaggagctagagaataagaatgaggaggtgcagcagctacacatgcagttggagatacagaagaaagagtctaccacccggcttcaggaactagagcaggaaaacaaactctttaaggatgacatggagaagctgggtttggctattaaagagtcggatgccatgagcacccaggatcaacatgttctgttcggaaagttcgctcaaatcattcaagaaaaggaggttgaaattgaccagctgaacgaacaggtgaccaaactccagcagcagttgaagatcactacagataataaggtcattgaagaaaaaaatgagttaattcgtgacctggaaactcagattgagtgtctgatgtcagatcaggaatgcgtgaaacgaaatcgagaagaagagatcgagcagttgaacgaagtaatcgagaagctccaacaagagctcgccaatattggacagaaaaccagcatgaatgcgcacagtctgagcgaggaggcggatagcctgaagcatcagctggacgtagtgatagccgagaagcttgcattggagcagcaagtagagacggcaaatgaggagatgacattcatgaaaaatgtgcttaaggaaacaaactttaaaatgaaccagctgacccaggaacttttttctctcaagcgcgagcgcgagagcgtggaaaaaatccaatcaattccggaaaattcggtgaacgtggctatagatcacctgagcaaggataagccggagttggaggtggtgctcactgaggacgccctgaagagtctcgagaaccaaacatactttaagtcctttgaagaaaacggtaaggggtcaattataaatctcgagacgaggctgctgcagctggagagcacagtgtccgccaaggacttggagctcacccagtgctataaacaaatcaaggatatgcaagaacagggccagttcgagactgaaatgctgcagaaaaaaatcgtgaatctacagaagattgtggaggagaaggtggcggcggcactggttagtcaaattcagctggaggctgtccaagaatacgcaaaattctgccaggataaccagaccattagcagcgagccagagcgcacaaatattcagaacctcaatcaactcagggaggacgagctgggcagcgacatttccgcgctcaccctgcgcatctctgaactggagagccaggtggtggagatgcataccagtctcattttggagaaggagcaagttgagatagctgagaagaacgtgctggaaaaagagaagaagctattggagctgcagaagctgctcgaaggtaatgaaaagaaacagagagagaaggagaaaaaaagatccccccaggatgttgaggtccttaagacaaccactgagctcttccattcgaacgaggaaagcggattctttaacgagctggaggcactccgtgccgagtctgtggccacgaaggcggaactcgcgtcttataaggagaaagccgaaaaactccaggaggagctgctcgtcaaagagactaacatgacttccttacagaaggacctcagccaggttagggatcatctcgccgaggccaaggaaaagctctccatcctcgaaaaggaggacgagactgaggtacaagaaagtaagaaagcttgcatgttcgagcctctgcctataaagctgagtaagtctatcgccagtcaaaccgatggaacgctcaaaatcagttctagtaaccagacgcctcagatcttggtgaaaaacgcaggtatccagatcaacttgcagtctgagtgctcgtccgaggaggtgactgagatcattagtcagttcaccgagaaaatagagaaaatgcaggaactacacgcagccgagatcctggatatggagtcacgccacatttccgagacagagacgcttaaaagagagcattatgtcgcggtccagttgcttaaggaggagtgcggaaccctcaaggccgtaatccagtgcctgcgatcaaaggagggactgctgagagcagttcacaatgaggggatgcaggtgctctctctcaccgaatcaccctattccgatggcgaagatcacagtatacagcaagtcagcgagccttggctggaggaacggaaagcctatattaacactatttcctcccttaaggacctcatcactaaaatgcagctgcaacgagaagccgaggtctatgatagcagccagagtcacgaatctttctcggactggcgaggcgaactcctgctggccctgcaacaggtgtttctcgaagagaggagcgtgttactcgcagcgtttaggacggaactgacggccttaggcaccaccgacgcggtggggttactaaattgcttggagcaacgcattcaggagcagggcgtggagtaccaggctgctatggaatgcctgcaaaaagctgaccgtaggagcctcctgtcagaaatccaggcactgcacgctcagatgaacggcagaaagattactcttaaaagagagcaggagtccgaaaagccctcccaggaacttctagagtacaacattcaacagaaacagagccagatgcttgaaatgcaagtggagttaagcagtatgaaggaccgcgccacagaactccaggagcaactatctagcgagaagatggtggtggccgagctgaaaagcgagctggcacagaccaagttggaactggagactaccctcaaggcccagcacaaacacctcaaagagctggaagccttccgactcgaagtgaaggataagacagatgaggtgcatttgcttaatgatactctggccagcgaacagaagaaatctagggagctgcagtgggccttggagaaggaaaaagctaaactcggacggagcgaggagcgggataaggaggagcttgaggacttaaagttttcgctcgagtcgcaaaagcagcgtaacctgcagctcaatttgcttctggaacagcaaaaacaacttctcaatgaaagtcagcaaaaaattgagagccagcggatgctgtacgatgcccagttgagcgaggaacaaggccggaacctagagctacaggtactgctggagagtgaaaaagtgcgcattcgagaaatgtcatccacactcgaccgagagagggagctgcatgcgcaacttcagtctagcgacggaactgggcaaagtcgcccaccactgccttctgaggatttgctgaaggagctgcagaaacagttagaggaaaagcatagtcggatcgtcgaactgttgaatgagactgaaaagtataagctggatagcctccagacacgacaacaaatggagaaggatcgtcaagtgcaccgcaagactctgcagactgaacaggaagcaaatacagaaggccaaaagaaaatgcatgaactgcaaagtaaggtggaggatctgcagcggcagttggaggagaagcggcaacaggtgtacaaacttgacctggaaggccagcggctccaaggcatcatgcaggaattccagaagcaagaactcgaacgggaagagaagcgcgagtcccggcgaattctttaccagaacttaaacgagccaacgacatggagtctgacaagtgatcggacccggaactgggtgctccagcagaagattgagggagagaccaaggagagcaattatgcaaaacttatcgagatgaatggggggggcacgggttgcaaccatgagctcgagatgatccgccagaagctacagtgtgtagcatcgaaactgcaagtgttgccccagaaggccagcgagcgcctgcagtttgagaccgccgatgatgaggattttatttgggtacaggaaaacatcgacgagattatcctacagcttcagaagcttactgggcaacaaggcgaagaaccctccctggtctctccatcaacctcctgtggaagccttactgaacgattactccggcagaacgccgagcttactggccatattagccaactcaccgaagagaaaaatgatctgcgtaacatggtcatgaagttagaagagcagattaggtggtaccggcagacgggcgctggccgcgacaacagctcccgcttctccctgaacggtggagcaaacatcgaagccatcattgcaagcgagaaggaggtgtggaatagggagaaactgacactccagaagagtctgaagagagccgaggccgaggtgtacaagttaaaggcagaattgcggaatgactccttactccaaaccctcagtcccgatagcgagcatgtcaccctgaaacggatctatggcaagtacctcagggcagagagtttcagaaaagctcttatctaccagaaaaaatacctgctactgcttctcggaggctttcaggaatgtgaagacgccaccctggcattgctggctcgcatgggtgggcagcccgcctttaccgatctcgaggtgattactaatcgcccaaagggattcactcgcttcagatcggccgttcgtgtgtctatcgcaattagccgcatgaaatttttagtgaggaggtggcaccgggtgaccggcagcgtgtcgatcaacattaatcgggacggattcggcctaaaccagggagccgagaagactgactctttttatcactcatcaggtggtctggaactgtatggggagccccgccataccacttacaggtctcgaagcgatctcgactacatccggtcgccactccctttccagaaccggtatcctgggacgccagctgacttcaatccaggaagtttggcctgctcccagctgcagaattacgatcccgacagggccctgacagactacataacaagactggaggctctccagagacgtctggggaccattcaaagcggtagcaccacacagtttcatgccggtatgagacgctag

SEQ ID NO: 177457 - DNA, 11736 bp, Artificial Sequence
  Description of Artificial Sequence: Synthetic coding sequence
atggaggacgaggagcggcagaagaagctggaggccggcaaggccaagatagaggagctctccctggcctttttggttcgccagctagcccagtttcgccagaggaaggctcagtctgatggacaaagtccctctaagaaacagaaaaaaaagcgcaaaacatcctcaagcaagcatgacgtgtccgcacatcacgatctcaatattgaccagtcgcagtgtaatgagatgtacataaatagctcgcagagggtggagtccacagtgattccggaaagtaccatcatgcgcactctgcattctggcgaaattacttcgcatgaacaaggtttcagcgtggagctagaaagcgaaatctctacaaccgccgatgattgttcttcggaagttaatggctgttctttcgttatgcggaccgggaagcccacaaatctactgagggaagaagagttcggcgtagatgactcgtattcggagcagggagcccaggacagcccaacgcatcttgagatgatggaaagcgaactagctgggaaacaacatgaaatcgaagagctcaatcgcgagttggaggaaatgagagtcacttatggcaccgaagggctgcagcaactacaggaatttgaagctgcaattaaacagcgagatgggatcattactcagctgacggccaaccttcagcaagcgcggagggaaaaggatgagactatgcgcgagtttctggagctgaccgaacagagtcagaagctgcagattcaattccagcaactgcaagcctctgagaccctgcgcaattctacgcactccagcaccgcggccgacctcttgcaggcgaagcagcagatcttgacccaccagcaacaacttgaagaacaagaccacctgctagaggattaccagaagaagaaggaggatttcaccatgcagataagtttccttcaggaaaaaattaaagtttacgaaatggaacaggataaaaaagtagagaactcaaataaagaggagatccaagagaaggagactatcattgaagaactgaacactaaaataatcgaggaggagaagaagaccctggaactcaaagataaactaacaacagccgacaaactgttgggcgagttacaagagcagatcgtgcaaaagaaccaagaaatcaagaatatgaaactcgagctgaccaatagcaaacagaaagagcgccagtcaagtgaagaaattaagcagctcatgggcaccgtcgaagaactgcaaaagaggaaccataaagattcccagtttgaaactgatatcgtgcagagaatggaacaggagactcagaggaagctggaacagctgagggcagagctcgacgagatgtacgggcagcagatcgtgcagatgaaacaagagctgatcaggcagcatatggcccagatggaagagatgaagacccgccacaagggagagatggagaacgctctgcgcagctattctaatataaccgtgaatgaggatcagatcaagctcatgaatgtggccatcaacgaattgaacattaaacttcaagacacaaattcgcaaaaggaaaagctgaaagaagagttgggtctgatcctggaagagaaatgtgcacttcagaggcagctcgaagatttagttgaggaactgtctttctctcgtgaacagatccagcgcgcccgacagacaatcgcagaacaggaaagcaagcttaatgaggcccataagagcctgagcactgtcgaagatctgaaagcagaaatcgtcagcgcatcggaaagcaggaaggagttagaactgaagcatgaggcagaggttactaattataagatcaagctggagatgcttgagaaggagaaaaacgccgtactggatcggatggcagaatcacaggaggccgaacttgaacggttacggactcagctcttattttcccacgaggaggaactgtccaagctgaaggaggacttggagatcgaacaccggattaatatcgagaagctgaaagacaatctgggaattcactataagcagcagatcgacggcctgcaaaatgaaatgagccagaagatcgaaacaatgcaattcgagaaggataacctcatcaccaagcagaaccagctgattctcgaaatcagcaaattgaaggatttgcagcaatccctcgtgaactctaagtcagaggaaatgaccctgcagataaatgaattgcagaaggagattgagatacttcgtcaggaggaaaaagagaagggcacactcgaacaggaagtgcaggagctgcagctcaaaaccgagctattagaaaagcaaatgaaagaaaaggagaatgacctccaggaaaagttcgcccagctcgaggcggagaacagcattctgaaagacgagaagaaaaccctggaggatatgctgaagatccacacaccagtgtcccaggaggagcgcctgatcttcctggatagtattaagtctaagtccaaggactcagtttgggagaaggagatcgagatcctgatagaggaaaacgaggatctgaaacaacagtgtattcaattgaatgaggaaattgagaagcagcgaaatacattttcttttgccgagaagaactttgaggtgaattaccaggaactgcaggaggaatatgcatgtcttctaaaagtcaaagacgacctggaggacagcaagaataaacaggaactcgagtacaaatctaagctgaaggcactgaatgaggagcttcatctgcagcgaatcaatcccacaaccgtgaagatgaaaagcagtgtgtttgacgaagacaagacattcgttgccgaaacgctagagatgggcgaggtagtggaaaaagataccaccgagctaatggagaagctggaggtgaccaaacgagaaaaactcgagttaagtcagcggctgagcgatctgagcgaacagctgaagcagaagcacggcgagatttccttcctgaatgaagaggtgaaaagtctgaaacaggaaaaagagcaggtgtcactgcggtgccgggaattggagatcatcattaaccacaacagagctgaaaacgtccaatcgtgcgacacccaagtatctagcctgctagacggggtggtcaccatgacctccaggggcgcggaggggtcagtgagtaaggtgaacaaatccttcggggaagagagcaaaattatggtagaggataaagtgtcttttgagaatatgacagtcggtgaagagtctaaacaggagcagctgatactcgatcatttgcccagcgtcaccaaggagtctagtttgcgggccacacaacctagtgagaacgataagctgcagaaggagctgaacgtactgaagtcagaacaaaatgacctccgtctccagatggaagcacagcgcatatgtctgagtctcgtgtatagcacacatgtggatcaggtacgcgagtacatggaaaatgagaaagataaggcactttgctcactcaaagaggagctcatctttgctcaggaggagaaaatcaaagagcttcaaaagatccatcaattggagttgcaaactatgaaaacacaggaaacgggagatgagggcaaacctctgcacctgcttattgggaaactacaaaaggctgtcagcgaggagtgctcatattttcttcagacactgtgctcggtgttgggggaatactacacaccagcgctgaagtgcgaagtgaatgcagaggataaagagaactcgggtgactatattagcgagaacgaggacccggagctccaggattaccgctatgaggtgcaagattttcaggagaacatgcatacattgctcaataaagtgactgaagagtacaacaaactcctggtgctgcagacacgtctgtctaaaatttgggggcaacagaccgacggaatgaaactggagttcggagaggaaaacctcccaaaggaggagaccgagttcctgtctattcattctcagatgacaaatctggaagacatcgatgtaaatcacaagagcaaactttcctctctgcaggacctggagaaaaccaaattggaggaacaagtccaagagttggaaagcctaataagttccctccagcagcagctcaaagagacagagcagaactatgaagctgagatacattgtttacagaagcgtcttcaggccgtatctgagtcgacagtacccccatctctgccagtggactctgtggtgattaccgaatcagatgcacagcgtactatgtaccccggctcatgcgttaaaaagaatatcgatggcacaatcgagttttccggggagttcggagtgaaagaggagacgaacattgtaaagcttttagaaaaacaataccaggaacagctggaggaagaagtagccaaggttattgtgtcaatgagtattgcattcgctcagcagactgaactctctaggatatcaggtggaaaggaaaacaccgctagctccaagcaggcccatgctgtgtgtcagcaagaacagcattacttcaacgaaatgaaacttagccaggaccaaatcgggttccagacatttgaaaccgtcgacgtgaaatttaaggaagagttcaagccgttatccaaagaactgggggaacacgggaaggagatacttctcagcaacagcgaccctcacgatatccccgagagcaaagactgcgtcctgactatctccgaagagatgttctcaaaggacaaaaccttcatagtgcgccagtctatacatgatgaaatctcagtctccagcatggacgctagtcgccaacttatgttaaacgaggagcaactggaggacatgagacaagagttagtgcgtcaatatcaagaacatcagcaggcgaccgagctgctaagacaggcccacatgcgccagatggaacggcagcgcgaagaccaggagcagctccaggaggagatcaagcggctgaaccgccagttggcccagcggtcgtcaatcgataacgaaaacttagtgtccgagagagaacgggtcctcctggaggagttggaggcactgaagcagctgtctctggccggacgggaaaaactgtgttgcgagttgaggaactcctcaactcaaactcaaaacgggaatgaaaaccagggggaagttgaggaacagacatttaaagagaaagaacttgataggaagcccgaggatgtccccccagagattctctcaaacgagagatacgcgctccaaaaggcaaacaacagactgctgaagatcttactggaagtggtcaaaaccaccgccgctgttgaggaaacaattggtcggcacgtgctcggaattctcgatcgctcaagtaaaagccaatcctccgctagcctcatttggcgctctgaagccgaagcgagcgttaagagctgcgtgcatgaggaacacaccagggtcaccgatgagagtatcccaagctactcaggcagcgacatgccaagaaatgatataaatatgtggtccaaagtgactgaggagggaaccgaactttcgcagcgactggtgcggagcggattcgcaggaaccgagatcgatccagagaatgaagagctgatgctgaacatctcctcccgcttacaagccgccgtcgaaaagttacttgaagcaatttctgaaacttccagtcaattagagcacgccaaagtgacacagactgagctgatgcgggaaagctttcgccagaagcaggaagctacggagtcgcttaagtgccaggaagagttgcgggaacggcttcatgaagagtctagggcgcgtgagcagttggcagtagaactatctaaggccgaaggagtgatcgatggctacgcagatgagaaaacactgttcgaaaggcagattcaggaaaagactgacattatcgaccgcctggagcaggagttgctgtgcgcctcaaacagactgcaggaactggaagccgaacagcagcagatccaggaagaacgcgaacttcttagccgacaaaaagaagccatgaaggccgaggctggaccggtggagcagcagctgctgcaggaaactgaaaagctaatgaaagaaaagctcgaggtgcaatgccaggccgagaaagttcgggatgacctgcagaagcaggtgaaggccctcgaaattgatgtagaagagcaggtgtctaggtttatcgagctggaacaagagaagaatacagagctcatggatttgagacagcagaatcaagcattggagaagcagctggaaaagatgcgaaagttcctggatgagcaggctatcgatagggagcacgagagagatgtgttccagcaggagattcagaagctggaacagcagctcaaagtggtgccccggtttcagccgatttccgagcaccagaccagggaggttgaacagctcgctaaccacctgaaagaaaagactgataaatgctctgaattgttgctctccaaagagcagctgcagcgagatattcaagagcgcaatgaggagatcgagaagctggaatttcgagtccgtgagttggaacaggcccttttggtatccgccgataccttccagaaggtggaagacaggaagcacttcggcgctgtagaagctaaacctgagttgtccctcgaggtccagctacaggccgagagagatgctattgatcgcaaagagaaggagatcactaacctggaagagcaactagagcagtttagggaggaactggagaataagaatgaggaggtgcagcagcttcatatgcagcttgagatccagaaaaaagaatccactacacgacttcaggagctggagcaggaaaataagctgttcaaagatgacatggagaagctgggactggccataaaagagagcgacgccatgtccacacaggatcagcacgttctattcggcaagttcgcacaaatcatccaggaaaaggaagtggagattgaccagctaaatgagcaggtcacaaagctccaacagcagctgaagatcaccactgacaataaagtcatcgaagaaaagaatgaattgattagagatttggagacccaaattgagtgtctgatgagcgaccaggagtgtgtaaaacgaaatcgagaggaggagattgaacagctgaatgaggtgattgaaaagctacagcaggaattagctaacattggccagaagacctcaatgaacgctcatagcctctccgaggaagctgatagcctaaaacaccaactcgatgtcgttatagccgaaaagctggccctcgaacaacaggtggaaacagcgaatgaggagatgacgttcatgaaaaacgtgctcaaagagaccaatttcaaaatgaaccaactcacccaggaactgttctcgctcaaaagggagcgggaatccgttgagaaaatccagagtattccagaaaactcggttaacgtggcaattgatcatttgtctaaggacaaacccgagctggaggttgtgctaaccgaagacgccctgaaatccttggagaaccaaacctacttcaagtcatttgaagagaatggtaaaggcagcatcatcaacctggaaactaggctactgcagctggagagcaccgtctccgctaaagatctggagttaacccagtgttataaacagattaaggacatgcaggagcagggccagttcgaaacggagatgttgcagaagaagattgtgaatcttcagaagatcgtggaagagaaagttgccgccgccctggtctcccagatccaacttgaggcggtgcaggaatatgccaaattttgccaagataaccaaactatcagtagcgaacctgagcggactaacattcaaaacctaaaccagttacgggaagatgaactgggtagtgacatttccgctcttactctcaggataagtgagctcgagagccaagttgtggagatgcacacttcactgattctggagaaagagcaggtagaaatcgccgagaagaatgttctggagaaggagaaaaagctgctggagctccaaaagctccttgaaggtaatgagaagaagcaaagggaaaaggagaaaaagcgcagcccccaagatgttgaggttctcaaaaccacaacggagctattccactcaaatgaagagagtgggttctttaatgagctggaggcactgagggccgaatcagtcgccaccaaagccgagctggcttcgtataaggaaaaggctgagaagctgcaggaggaacttctggtaaaagagaccaatatgacttctctccaaaaggacttgagtcaagtgcgggaccacctggcggaggctaaagagaaactctcaattttggagaaagaggacgaaactgaggtccaggagagtaaaaaagcctgcatgttcgaacctctgcccatcaaattgagcaaatctatagcctcccaaacagacgggacactgaaaatctcaagcagcaaccagactccccagattctggtcaagaacgcaggcattcagattaatctccagtctgaatgtagcagcgaggaggttaccgagataatctcgcagttcaccgagaagatcgagaaaatgcaggagctgcacgccgccgagatcctggatatggagtctaggcacatttcagaaacagagacgctgaagcgcgaacactacgtagccgtacagctgctcaaggaggaatgcggcaccctcaaagccgtgattcagtgcttgaggagcaaggaggtgttcgggttttataatatgtgctttagcacactctgtgactccgggtctgattggggccaaggaatctatctcacccattctcagggctttgacatcgctagtgaaggccgcggggaggaaagcgagtccgctacggatagctttccaaaaaagatcaaagggttgctgcgcgccgtgcacaacgagggaatgcaggtcctgagcctgaccgagtccccttattcagacggggaagaccattctattcagcaggttagcgaaccatggctggaagagcgaaaggcatacattaatactatctcttcgttgaaggaccttatcacaaagatgcagctccagagggaggctgaggtgtacgattcatcccagtctcatgaaagcttttctgactggcgcggagaactgctgttagctctgcagcaggtgtttttggaggagcggtccgtgctcctcgcagcatttcggacagagcttactgctctcggcacaacagacgcagtcggcctcctcaattgtttggaacagcgcattcaggagcaaggcgtcgagtaccaggctgccatggaatgcttgcagaaggcggaccgtcggagcctgctctcagaaatacaagctctccacgcccagatgaatgggagaaagatcacgttaaagagagagcaggagagcgagaaacccagccaggagctgctggagtacaacattcaacagaagcagtcacagatgctggaaatgcaggtggaattaagctcaatgaaggatcgcgcaacagaattgcaggaacagctgagttctgaaaaaatggtggtagcagagctgaagtctgaactggcccaaaccaagctagaactcgagaccaccctcaaggcacagcacaagcacctgaaagagctggaagccttccggctggaagtgaaggataagaccgatgaggtgcaccttctaaatgacaccttggcatccgagcaaaaaaagagccgcgagctgcaatgggccttagagaaagagaaagccaagctcggccggagcgaagaaagggataaagaggagctcgaagatctgaaattttctctcgagtctcagaaacaacgcaacctccagctgaaccttctcctggagcagcagaaacaattgttaaatgagagccagcagaagatagaatctcagaggatgctttacgatgcccagctgtcagaggagcagggacggaatttagaactgcaggtcctgctagagagcgaaaaagtgcgcatccgggagatgagcagcacactggatagggaacgagagcttcacgctcagttacagtcttccgacgggactgggcagtcgagaccaccattgcccagtgaagacttgctcaaagaactgcaaaaacagcttgaggaaaagcactcaaggatcgttgagctcctgaatgagacagagaagtacaaactggactctcttcaaaccagacagcaaatggagaaggaccggcaggtgcacagaaagacactgcagacagagcaggaagccaatactgaaggacagaagaagatgcatgaactgcagtccaaggtcgaggacttgcagaggcagctggaagagaaacgccagcaggtgtacaagcttgatctggagggccagcggctgcagggcatcatgcaagaattccagaaacaagagttggaaagagaggagaagagagagtcacgccgtatcctatatcagaatcttaatgaacccacaacttggtccctcacgtcagacagaacccgcaactgggtcttacaacagaagatcgagggcgaaacaaaggaaagcaattacgctaaactcattgaaatgaatgggggaggcacgggatgcaatcacgagttggagatgatacggcagaagctacagtgtgtagcctccaaactgcaggtccttccccagaaggcaagtgaacggctccagttcgagacggccgacgacgaggactttatttgggttcaggagaacattgacgagatcattttacaactgcaaaagttaacaggacagcagggtgaagagccatccctcgttagcccgagtaccagctgcggaagcctcactgagagattgctaaggcagaatgccgaactaacagggcacatctcccagttaacagaggagaagaacgacctgcggaatatggtaatgaaacttgaggagcaaatcagatggtatagacagacgggcgccggacgtgataactccagtagattcagcctgaacgggggggcgaatatcgaagccattatagcctcagaaaaagaggtctggaaccgggaaaagctgacactccagaaaagcctcaagcgggctgaagcagaagtgtacaagctgaaagcagagttgagaaacgattcattgcttcaaaccctcagccccgactccgaacacgtgaccctgaagaggatctacggtaagtacctaagagccgaaagctttagaaaagccctgatctatcagaagaagtatctcttgctgctgcttgggggattccaagaatgcgaagacgcaacactcgcacttctcgctcgcatgggtgggcagccggccttcactgacctcgaggtgattacaaatcggcctaaaggctttactcggtttcgcagcgcagtaagggtcagcatcgccattagccgaatgaagttcctagtcagaaggtggcatagagtgactggctcagtttcaatcaatatcaaccgcgacggtttcggactgaaccagggggcagagaagaccgatagcttctatcactcttccggggggcttgagctgtatggcgagccgcgtcacactacttacagaagccgatccgaccttgactatatcagatctcccctccctttccagaatagatacccagggacacccgcggactttaatcccggcagcctggcctgcagccaacttcagaactatgaccctgaccgtgcactgactgactatatcacacggctcgaggcgctgcagagacggttgggcactatacagagcggctctacgacccagtttcacgctggaatgcgacgttag

SEQ ID NO: 177458 - DNA, 4932 bp, Artificial Sequence
  Description of Artificial Sequence: Synthetic coding sequence
atggaggacgaggagcggcagaagaagctggaggccggcaaggccaagattgaggaacttagcctggcattcctggtacgtcagcttgctcagttcaggcagagaaaagcccagagcgatggccagtccccatccaagaagcagaagaaaaagcgaaagaccagttcttccaagcatgatgtctcagcacaccatgaccttaacatcgatcagtcccagtgtaatgaaatgtacatcaatagctcacagagagtcgaaagcactgtgattcccgagagtactatcatgcggacccttcacagtggcgaaataacttcgcacgagcaggggttttccgtggaacttgagtcagagatcagtacgacagcagatgactgtagttccgaagtcaacggctgtagtttcgtgatgcgtaccggcaaacccacaaatttactgcgggaggaagaattcggtgtggatgacagctactctgagcagggagctcaggactcacccacccacctcgagatgatggagtccgaactggccggcaaacagcacgaaatcgaggaactgaatcgagagctcgaagagatgagggtgacttacggtactgagggccttcagcaactccaggagtttgaggcagccatcaaacaacgggacggaataatcacccagttgaccgcaaacctccagcaggcccgtagagagaaagacgagacaatgagggagttcctggagctgaccgagcaaagtcagaagctgcagatccagttccagcagctacaggcatcagagacccttcgcaatagcactcattcgtctacagccgctgaccttcttcaggcgaagcagcagattttaacccaccagcagcaactggaggagcaggaccatctgctcgaggactaccagaaaaaaaaggaagactttacgatgcagatttcttttcttcaggagaagattaaagtgtatgagatggaacaggacaagaaagtggagaactctaataaggaggagattcaggaaaaggagacaattatcgaggagcttaacaccaagattatcgaagaagagaaaaagaccttagagctgaaagacaagctcacaactgcggataaattgttaggcgagttacaagagcaaatagtgcagaagaaccaggagattaagaacatgaagctcgaactcactaattccaagcagaaagagaggcagagcagtgaagagataaagcaactcatgggtaccgttgaagagttgcagaagcgcaaccataaagactcccaattcgagacagacatcgtgcagaggatggaacaggagacacagaggaagttagagcagctgagagctgagctggatgagatgtacggccagcagatcgtgcagatgaaacaggagctaatacgccagcatatggcccagatggaggagatgaagactcgccacaagggcgaaatggagaatgccctgagatcatacagcaacattactgtcaatgaggatcagatcaaactgatgaacgtggccattaacgagttgaacattaagctacaggataccaatagtcagaaggaaaagctgaaggaggagctaggcctgatattggaagaaaaatgtgcgttgcaacggcagttggaagatcttgtggaagaattgtctttttcaagagagcagatccagagggctaggcagactatagctgaacaagaaagtaagctgaatgaagcacacaaaagcctgtccaccgtagaggatctgaaagccgagattgtgagtgctagcgagtctcgaaaggaactcgagcttaagcatgaagcagaggtgacgaactataagatcaagctggaaatgttagagaaagaaaaaaacgcggtcctcgaccgtatggctgagtcccaggaagccgagctggagcgcttaaggacacaattgctgttttcccacgaggaggagctgagcaaactgaaggaggacttagagattgagcacagaataaatatcgaaaagttaaaagataatctgggtatccattataaacaacagattgatgggctgcagaatgaaatgagccagaagatcgagacgatgcagtttgagaaagataacctgataactaagcagaatcaactcattctggagatctcaaagctgaaggacctccagcagagtctggtgaactctaagtccgaggagatgacccttcagattaacgaattgcaaaaggagatcgagatcctgcgccaggaggaaaaggagaaaggaactctggaacaggaggtgcaggagctgcagctcaagacggaactgctcgagaaacagatgaaagagaaagaaaacgacttacaggagaagttcgcccagcttgaggctgaaaattccattttgaaggatgagaagaaaactttggaggacatgctgaagattcatacaccagtttcacaagaagagcggttaatcttcctggactccataaagagcaagtcaaaagactccgtttgggaaaaagaaatcgaaatactcatagaggaaaatgaggacctcaagcaacagtgtatacaactgaatgaggaaatcgagaaacagcgtaatacattctcatttgctgagaagaacttcgaagttaactaccaggagctgcaagaggagtatgcctgtctcttaaaggtaaaggacgatttagaggactctaagaacaaacaggagcttgaatataaatcaaagctgaaagcactgaacgaggaactgcacctgcagaggatcaaccctaccacagttaagatgaagagcagcgtgtttgatgaagataagaccttcgtcgcagaaacactcgaaatgggagaagtcgtggagaaggacaccaccgaactgatggagaaactggaggtaaccaaacgtgaaaaactggagctttctcaacgtctgtccgacttgtccgagcagctgaagcagaagcacggggagatatcctttctaaatgaggaagttaagtcgctgaagcaggagaaagagcaggttagtctgaggtgtagggagcttgaaatcattattaaccacaatcgagccgagaacgtgcaatcctgcgacactcaggtatcaagcttgctcgatggagtcgtgacaatgactagccgaggcgctgaaggctctgtgagcaaggttaataaatcgtttggagaggagagcaagatcatggtggaagataaggtgagctttgaaaatatgaccgtgggagaggagagcaaacaggagcagctgattctggatcatctcccatccgtaacaaaggaatcttcactgagagccacccaaccctccgagaacgataagctgcagaaagaactcaacgtgttaaagagcgagcagaacgacttgagactgcaaatggaagcccagaggatctgcctatctctggtttactcgacacatgttgaccaggtaagagaatacatggaaaacgagaaggacaaagcgctgtgttctctgaaagaggagctgatctttgcccaggaagaaaagattaaggaactgcagaagatccaccagctggagctccaaacaatgaaaacccaggaaaccggtgatgaaggaaagcccctgcacctgctgatcggtaaattacagaaggccgtaagcgaggagtgctcttattttctccagacactgtgttcggttctaggcgaatattatacccctgctctaaaatgtgaagtcaatgccgaagataaagaaaattccggtgactacatcagcgagaacgaagaccccgagctccaggattaccggtacgaggtacaagatttccaggagaatatgcatacactcctgaacaaggtgacagaggagtacaataagctcctagtcctgcagaccaggctcagcaaaatttgggggcagcagacagacggaatgaagctggaattcggcgaagagaatcttccgaaagaggagactgagttcctatctatccactcccagatgaccaacctagaagacatcgacgtaaatcacaaatctaagcttagctcactgcaggatctggagaaaactaagctggaggaacaggtacaggaactggaaagtctcatatccagtctgcagcaacagcttaaggaaactgagcagaactacgaggctgaaatccattgcctgcagaagcgcctgcaggccgtgagcgaaagtaccgtgccccccagtctccccgtggacagtgtcgttatcacagagtcagacgcacagagaacaatgtaccccggcagttgcgtgaagaagaacatagacggtacgatcgagttttccggtgaatttggagtgaaggaggagacaaatatcgtgaaattgcttgaaaagcagtatcaggaacagttagaagaagaggtcgccaaggtaatagtatccatgagcattgcttttgctcagcagacagagctgtcacggatttcaggaggaaaggaaaataccgcttcaagtaagcaggctcatgccgtgtgccagcaggaacagcactacttcaatgagatgaaactctcccaagatcagattggtttccagaccttcgagacagttgatgtcaaattcaaggaggagttcaagccgctctcaaaggagcttggcgaacacggcaaggagatcctgttatcaaatagcgatccgcacgacatcccagagagcaaggattgcgtactgaccatttctgaagaaatgttttccaaagacaagaccttcatagtgagacagagtatccacgatgagattagcgtgtcatctatggacgctagtaggcagctcatgctgaacgaggaacagcttgaggacatgagacaggagttagtgcggcagtatcaggagcatcagcaggccactgagcttctacgccaggctcacatgcgccagatggagcggcagcgggaagatcaggaacagttgcaagttcgagtgctgtag

SEQ ID NO: 177459 - DNA, 11631 bp, Artificial Sequence
  Description of Artificial Sequence: Synthetic coding sequence
atggaggacgaggagcggcagaagaagctggaggccggcaaggccaagatcgaggagttaagcttggcattccttgtgagacaactggcccagttccggcagcgaaaggcacagagtgacggacagtccccaagcaaaaaacaaaaaaagaagaggaagacgtcttctagtaaacacgacgtctctgctcaccacgatctgaacatcgatcagtctcagtgtaacgagatgtacattaacagctcgcagcgcgtcgagtcgactgtgattcctgagagcacaattatgcgcactctgcattccggcgaaatcacctcgcatgagcaagggttttctgtggaattggaatccgagatttccactacggcggatgattgctccagcgaggtcaatggctgttcttttgtgatgcgcacaggaaaaccgaccaacttactccgggaagaagagttcggtgtggacgacagttattcagaacagggtgcacaggactcacccactcatctggaaatgatggagagcgagctcgctgggaagcagcatgaaatcgaagaactaaatcgagagctcgaggagatgagggtaacatacgggacggaagggctgcagcagctgcaggaattcgaggccgctatcaagcaacgtgatggcatcatcacccagctgaccgccaacctgcaacaggctcggcgcgaaaaggacgagacaatgcgggagttcttggagctaacggagcagagccaaaaactgcagatacagttccagcagcttcaggcctccgagacgcttcgaaactccactcattcgagcacagcagccgacctgctccaggctaagcagcagatcctgacccatcagcaacagcttgaggagcaggaccatcttctggaggattaccagaaaaaaaaggaggatttcacgatgcaaatttctttccttcaggagaagatcaaggtgtacgaaatggaacaggataagaaggttgaaaacagtaacaaggaagaaattcaagagaaagagaccataatagaagagcttaacaccaagatcatcgaagaggagaagaagactcttgaactcaaggataagctgaccactgccgacaagctgcttggggagctgcaagaacagatcgtgcagaaaaaccaggagattaagaatatgaaactcgagctgacaaattcaaaacaaaaggagaggcaatcctccgaggagattaaacagctgatgggcaccgtcgaggagctccagaagcgaaaccacaaagacagtcagttcgagactgatatcgttcagcggatggaacaagagacacaacggaagctcgagcaactgcgagctgagttggacgagatgtatggtcagcagatagttcagatgaagcaggaattaatccgtcaacatatggcgcagatggaagagatgaagacaagacacaaaggcgagatggagaatgcgctgaggtcttacagcaacataaccgttaatgaagatcagataaaattaatgaacgtcgccattaatgagctgaacataaagctccaggataccaacagtcaaaaagagaagctgaaggaggagctcgggctaatcctggaggagaaatgcgcgctccagagacaactcgaggatctggtagaggaattgtcattcagccgggaacagattcagagggcccgccagacaattgctgaacaggaatctaagttaaacgaggcacacaagtctctgagcacagttgaggatcttaaggcggagatagtctctgcctctgaatcccgaaaagagttggagttgaaacacgaggccgaggtgaccaattacaaaatcaaactcgagatgttggaaaaagagaagaacgccgtgttggaccgcatggctgaatcccaggaagcagagttagaaaggttaagaactcagctcctgttctctcatgaggaggagttgtccaagttaaaggaagacctggagatagaacaccggatcaacatcgagaagctgaaagataatctcggcattcactataaacaacagatcgatgggctgcagaacgaaatgagtcagaaaattgagactatgcagttcgaaaaagacaacttgattaccaagcagaatcagctcatccttgaaatatctaaattaaaagacctccagcaatctttggtaaacagcaagtcagaagaaatgaccctgcagatcaacgagctgcaaaaagaaattgaaatactgcgccaggaagagaaagagaagggcacactggagcaggaagttcaggagcttcagctgaaaactgagctgctcgaaaaacaaatgaaggaaaaggaaaacgacttgcaagagaaattcgcacagctagaggcagagaacagtattctgaaagacgagaagaaaacactggaggacatgcttaaaattcacacgcctgtctctcaggaggagaggctgattttcctagatagcatcaagtccaagagcaaggattccgtgtgggagaaggagattgaaatccttattgaagaaaacgaggacctgaaacaacagtgtatacagctgaacgaggagattgagaaacagcgaaacactttctctttcgccgagaaaaactttgaagtgaactaccaggagctccaggaggagtacgcctgcctcttaaaggtgaaggacgatcttgaagacagcaagaataagcaggaactcgaatacaagagtaaactaaaggccctgaatgaggagctgcacctccagagaatcaatcctacgacggtgaaaatgaaaagctccgtgttcgacgaagataagaccttcgtggccgagacgctggaaatgggtgaggtggtagaaaaggacaccacagaactgatggagaagctggaggtcacaaagagagagaaactggagctatcacagagattaagcgatctctctgaacagctgaagcaaaagcacggagagatttcctttctcaacgaggaagtaaagagcttgaaacaagaaaaggagcaagtctcactccggtgtagggagctggaaatcattatcaatcataatcgggctgagaacgtacagagttgcgacacacaggtaagctcactactcgatggagtcgtcaccatgacatctaggggggcggaggggtccgtttccaaggtgaataagagcttcggggaggagagtaagattatggtggaagataaggtctcgtttgaaaacatgactgtaggggaggaatctaaacaagaacagctgatcctggatcatctcccttctgtgacgaaagaaagcagtcttagagccactcagccctccgaaaatgacaaactgcagaaggagctcaacgtcctgaaaagcgagcaaaacgatctgaggctccaaatggaggctcaaaggatatgcctgtccttggtgtatagtactcacgtagaccaggtgagagaatacatggaaaatgagaaagacaaagctctatgtagtctgaaggaggagctgatcttcgcccaagaagaaaagattaaagagctgcagaagatccaccagttggagctgcagaccatgaagacacaggaaacgggagatgaaggcaagccacttcatctgctaattggcaaactgcagaaagctgtgtccgaggaatgcagctactttttgcagaccttgtgtagcgtactgggtgagtactatactccagctttaaagtgcgaagtgaacgccgaagataaagagaacagcggcgactacattagcgagaatgaggatcccgaactgcaggattatcggtatgaggtacaagattttcaggagaacatgcacacactcttgaacaaggtaacagaggagtataataagctcctggtgctgcaaaccagactctctaagatctggggccaacagacagatgggatgaaacttgaattcggcgaggagaatctgcccaaagaggaaacagaatttctgtcaattcacagccagatgacaaacctcgaagacattgacgtcaaccataaaagcaaactctcgtctctccaagaccttgaaaagacgaagctcgaggagcaggtgcaggagctggagtcactaatcagcagccttcagcagcaactgaaggaaactgaacagaattacgaggctgagattcattgccttcagaagcgtctgcaggccgtgtctgaatcaaccgtgcccccatccctgccagtagattcagtggtgatcactgaatctgatgctcagagaaccatgtatcccggctcatgtgtgaagaagaatattgacgggaccatcgagttttccggcgaattcggcgtaaaggaagagacaaatattgtgaaattgctcgagaaacaataccaggaacaactcgaggaagaggtcgccaaagtaatcgtgtctatgagcatcgccttcgcacagcagacagagctgagtcggatctccggcggcaaggaaaacactgcgtcgagtaagcaggcacatgccgtgtgccaacaagagcagcactactttaacgagatgaaactgtctcaggaccagataggatttcaaaccttcgaaactgtagacgtgaagttcaaggaggaatttaagcctctgtctaaagagctgggggaacacggcaaagaaatcttgctctctaacagtgacccacacgacatcccagaatccaaggattgcgtcttgaccattagcgaggagatgttttcaaaggacaagacattcatcgtcagacagtcgattcacgacgaaatcagcgttagttcaatggatgcctctcgccagcttatgttgaacgaagagcagttggaggacatgcggcaggagctggtgcggcagtaccaggaacaccagcaggctacagaattattgcggcaagcccacatgagacagatggaacgccaaagggaggatcaagagcagctgcaggaggagatcaaacggttgaaccggcagctggcacagcggtccagtatcgataatgaaaacctcgtctctgagagagagagggttttgctcgaggagttagaagccctcaagcagttgtccctagctggccgggagaaactctgctgcgagctgcgtaacagtagcactcagactcagaatggtaacgaaaatcagggagaggtcgaagagcagacatttaaagagaaagagctcgacagaaaaccagaggacgttcctccagagattctgagtaatgaacgatacgctctgcagaaagctaacaatagattgctgaaaatcctgttggaagtcgtaaagaccactgcagctgtggaggaaacgatcggccgtcacgtcttgggaatcctggatcgttctagcaagagtcagtctagcgcttctctgatttggcggagcgaggctgaggcctcagtgaagagctgtgttcacgaagagcacacaagagttactgatgagtctatccccagttattccggctcggacatgcctagaaacgatatcaacatgtggagcaaggtcacagaggaaggcactgaactgagccagcgcctggtgagaagcgggtttgccggaacagaaattgaccccgagaatgaggaactgatgttgaatatatcatcacggctgcaggctgcagtggaaaagcttctcgaagccatctcagagactagtagtcagttagagcatgccaaggtgacccagacagagctgatgcgagagtcttttagacagaagcaggaggccacagagtccctgaagtgtcaggaagagctgcgcgaacgcctgcacgaagagtcaagagccagggagcaactggccgttgaactgagtaaagccgaaggagtgattgatgggtacgcagacgaaaaaacattgtttgaacgacagatccaggagaagactgacattattgatagattggaacaggagttactgtgtgctagcaatcgtctccaggagttggaggcggaacagcaacagatacaagaggagagggagctgctgagccgccaaaaagaggcaatgaaagcagaggcaggacccgtggagcaacagctcctgcaggagacggagaaactcatgaaagaaaagctcgaggtccagtgccaggctgagaaggtaagagatgacctgcagaaacaagttaaggcccttgaaattgatgttgaagagcaggtaagcaggttcatcgagcttgagcaggagaaaaataccgaattgatggatctaagacagcagaatcaagccttggagaagcaactcgagaaaatgcgaaaattcctcgacgagcaggccattgacagggagcatgagagagatgtatttcaacaagagatacagaagctggaacagcagctgaaagtagtcccccggtttcagcccatatccgagcatcaaacccgggaagtcgaacagttggcaaatcacttaaaagagaagaccgacaaatgttctgaactcctgctgtcaaaagaacagctgcagcgggacatacaagaacgcaacgaagaaatcgagaaactcgagtttagagtacgtgagctggagcaggcgttgttagtcgaagaccgtaaacactttggcgccgtcgaagccaagcccgagttgagtctggaggtacaactgcaggctgagcgggacgctattgaccggaaagagaaagagattaccaacctggaggagcaattggagcaattccgagaggaactcgagaacaagaacgaggaggtgcagcagctgcacatgcaactcgaaatacagaaaaaggagtcaaccactcgcctgcaagaacttgagcaggagaataagctgtttaaggacgacatggagaagctgggacttgctataaaggagtccgacgcgatgtctacacaggatcagcacgtgctgtttggcaagtttgcgcagatcatccaggaaaaggaagtggaaattgaccaacttaacgaacaggtgactaaactgcagcagcagcttaagataaccactgataataaggttatcgaggagaagaatgaacttatacgggacctcgagacgcagatcgaatgtctcatgtctgatcaagagtgcgttaaacgcaatcgcgaggaagagatcgagcaactgaatgaggttatagagaagctgcagcaggagctcgcaaatatagggcagaagacgagcatgaacgcccattccctctccgaagaggctgattcgctcaaacaccagctggacgtcgtgattgccgagaagctcgctttagaacagcaggtggaaacagcaaatgaggaaatgaccttcatgaagaacgtgctgaaggagaccaatttcaaaatgaatcaacttacgcaggagttattttccctaaaacgcgagcgcgagtcagtcgaaaaaatccagtccatccctgaaaatagcgtgaacgtggctatagaccacctgtcaaaagacaagcctgagcttgaagtcgtgttaactgaggacgctttaaagtcgcttgaaaatcagacttatttcaaatctttcgaggagaacgggaaaggatccatcatcaatctggagactcgccttctgcagctggagtcgactgtctctgccaaggacctcgagctgacacaatgttataagcagatcaaagacatgcaagagcagggacaatttgagaccgagatgctacagaagaaaattgttaacctccagaagattgttgaggagaaggtcgctgctgctctcgtgtctcagattcagctggaagccgtacaggaatatgctaaattttgccaagacaatcagaccatctccagtgagccagaaaggacaaatatccaaaacttgaatcagcttagagaggacgaattgggcagtgacatcagtgcgctcactttgaggattagtgagctggagagccaggttgtggagatgcacacctccctcattctggagaaggaacaggtggagatagccgagaagaacgtgctagaaaaagagaagaagttgctcgaactccaaaaattattggagggcaatgagaagaagcagcgggaaaaggagaagaagagaagcccacaggacgtcgaagtgctcaaaacaacgaccgagctttttcattccaatgaggaaagcggatttttcaacgaactcgaggcactgcgtgccgagtctgtcgctacaaaggctgaactagcctcctacaaggaaaaggcagagaagttacaagaggagctgctcgttaaggagacaaatatgaccagcttgcagaaagatctctcacaggtgcgagaccacctggcagaagccaaggaaaagctctccatactcgaaaaagaagatgagaccgaggtgcaggagtctaagaaagcctgcatgtttgagcccctgccaattaaactgtcgaagagcattgcctcccagaccgatggaacactgaagatctcaagttctaatcagaccccccagatcctggttaaaaatgcaggaattcagatcaacctgcagtccgagtgttcgagcgaggaagtgactgaaatcatctcccagtttacagagaagatcgagaaaatgcaggagctgcacgccgcagaaatcctcgacatggagtcgcgacacatctccgaaacagagaccctcaaacgtgagcattacgtcgctgtacagttgcttaaggaggaatgtggaaccctaaaagctgtgattcagtgtttgagatccaaggaaggatcttcgataccagaactggcccactcggacgcttatcagaccagggaaatctgttcctccgacagtggttcagattggggtcaagggatctaccttacacactcacagggattcgatatcgcgtccgaaggcaggggggaggaatccgagtccgctacagacagttttccaaagaagattaaggggctcttacgggcagtacataacgagggaatgcaggtgttgagtctgaccgaatcaccatattccgacggggaggatcacagtatccagcaggtttcggaaccctggctggaagaaaggaaagcctatataaacacaatttccagcctgaaggatctaataacgaaaatgcagctgcagcgcgaagctgaggtgtatgactcctctcagtctcacgagagcttcagcgactggcggggtgagttgcttctcgcactccaacaggtcttccttgaagagcgcagcgttctgctggccgcatttcggactgaactgacagcattgggaaccaccgacgccgttggactgctcaactgtctggaacaacgaatccaggaacagggcgtcgaataccaggcagcaatggagtgcctccagaaagccgatcggcggtcgctcctgtcagaaatccaggctttgcacgcacaaatgaacggccgcaaaattaccctgaaaagggagcaagagtcagagaaaccgtcacaggagctcctagaatacaatattcaacagaagcagtctcagatgttagaaatgcaggtggagctgagctcgatgaaagaccgtgcaactgaactccaggagcagctcagcagcgagaagatggtcgttgcagaattaaaatcagagctggctcagaccaagctggagcttgagactacgcttaaagcacagcacaaacacctgaaggaacttgaagcctttaggctcgaagtgaaggacaaaaccgatgaggtccatctgctgaacgacactctggcctcagagcagaaaaaaagccgcgagttgcagtgggcactcgagaaggaaaaagccaagctgggccggtccgaagagagagataaagaggagctggaagacctcaaattcagtctcgagagccagaagcaaagaaatttgcagctgaacctgcttctagagcaacagaaacagctgctcaacgagagccagcagaaaattgagtcccaaagaatgttatacgacgctcagctgtcagaagaacaaggtcgcaacctggagctccaagttctgcttgagtcagaaaaggtgagaatccgcgagatgagcagtacactcgatcgcgagagagagctgcatgcccagctgcaaagcagcgacggaacgggccaatctagaccgccactccctagtgaggatcttctcaaagagctccagaaacagcttgaggaaaagcatagccggatcgttgaactgctgaacgagaccgaaaagtataaattggacagtctccagactaggcagcagatggaaaaagacaggcaggtccatcggaagacactccagaccgagcaggaggccaacaccgaaggccagaaaaaaatgcatgaactgcaatcaaaggtggaggatctgcagcgtcagctcgaagaaaagagacagcaggtgtataagctagatcttgaggggcagagactccagggaatcatgcaagagttccagaaacaggagctcgaaagagaagagaaacgagaatccagacgcattctgtaccaaaatcttaacgagcctacaacttggagtctgactagcgacagaaccagaaattgggttctgcagcagaagatcgaaggcgagaccaaagagagtaactatgccaaactcatcgagatgaatggaggaggaacaggctgcaatcacgagttagagatgattagacaaaagttacaatgtgtggcctccaagcttcaggtgctgcctcagaaagctagtgagcggttgcagtttgagacagctgacgacgaagactttatctgggttcaggagaacattgatgagatcatcctgcagctccagaagctgactgggcagcagggcgaggagcctagcttggtctcccctagcacttcatgtggctccttgaccgagagacttctcaggcagaatgcggagcttacgggccacatctcccagcttacggaggagaaaaacgatctgagaaacatggtaatgaagctagaggagcagatccgctggtataggcagactggcgccggaagggacaattccagccggttttccctgaatggaggggccaacattgaagctatcattgccagcgagaaggaagtgtggaaccgggagaaactgaccctacagaaatcactgaagcgagcggaggctgaggtttacaagctgaaagcagaactcagaaatgacagcctgctgcagacattgtctcctgattctgaacacgtcacactaaagaggatttacgggaaataccttcgggctgagagtttccgtaaggctctgatttaccagaagaaatatctcctgctgcttttagggggttttcaggagtgtgaagacgcaaccttagccctgttggccaggatgggagggcagcctgctttcactgacctcgaggtcatcacaaacaggccaaagggctttaccagattcagatcagccgtgcgggttagcatagctatcagccggatgaagttcctcgttagaaggtggcatagagtgaccggcagtgtgtctatcaatatcaaccgtgatggctttgggcttaaccagggagcagagaagacagacagtttttatcactcaagcggcgggctcgagttatacggcgagccccgccacaccacatataggagccggagcgacctcgattatatccgttccccgttaccttttcaaaacagataccccggcacccccgctgacttcaaccccggctccctcgcatgcagccaactacagaactatgatccttag

SEQ ID NO: 177460 - DNA, 1782 bp, Artificial Sequence
  Description of Artificial Sequence: Synthetic coding sequence
atggccatccagttccggagcctgttccccctggccctgcccggcatgctggctttactaggctggtggtggttcttcagccgcaagaaagggcacgtctctagtcacgacgagcagcaagtggaagctggcgcagtgcaactgcgggcggatcctgcgatcaaggaacccctgccagtcgaggacgtgtgtcccaaggttgtgagcacaccaccttcggttactgagcccccagagaaagagctttccacagtgagcaagctacccgcagagcccccagcactgctgcagactcacccaccctgccgtcgttccgagtctagtggtattctcccaaacaccactgacatgagactgcgcccgggtacaagacgggatgactcgaccaaactcgaattggccttaaccggcggtgaagctaaaagcattccgctagagtgtcctttgtccagcccaaagggcgttcttttttcaagcaagagcgctgaggtctgtaaacaggacagccctttcagtcgggtccctagaaaggtgcagcccggctatccagtggtcccggccgagaaaaggtccagcggcgagcgggctagagaaactgggggcgccgaaggaaccggggatgcggtgctcggcgagaaggtgctggaggaggctctgctgtctcgggagcacgtgctggagctcgagaactcaaagggaccctcacttgcttcgctggaaggcgaagaggacaagggcaagagtagcagcagtcaggtcgtcggcccagttcaggaggaggagtacgtggccgagaagttaccctctaggttcatcgaatcagcccacaccgagctggccaaagacgatgccgcgccggcccctccagtcgctgatgccaaggcccaggacagaggggtggagggcgaattgggcaacgaagagtcactagacagaaacgaggaggggctggatcgcaatgaggagggcctcgaccggaatgaggaatcactggataggaatgaagaaggccttgaccgcaatgaggagatcaaacgagcagccttccagattatcagccaagtgatctctgaggctacggagcaggtactggccaccacggttggaaaggtcgccggaagagtgtgtcaggcaagccagttgcaggggcagaaggaggaatcctgtgtccctgttcaccagaaaacagtgcttggtccagatacggctgagccagctaccgccgaggccgctgtcgccccacccgacgcgggtctgcctcttcctgggcttcctgccgaggggagtcctccaccaaagacatatgtgagctgtctgaaatccctgctcagtagcccgactaaggattctaagccaaatatctctgctcatcatatcagtctggcgtcctgcttggcactgacgacgcctagtgaagagttgcccgacagagcgggtattttggttgaggacgccacctgtgtgacttgcatgtccgactcctctcagagcgtgccactggttgccagtcccggccactgctccgacagcttttcaaccagcggccttgaagatagctgtaccgaaacatcctcctcccctcgggataaagctataacacctccattgccagagtccacagttcccttctcaaatggagtccttaaaggcgagctgagcgaccttggtgcagaggacgggtggacaatggacgccgaagccgaccatagtggtgtggcggccccccccccgggtaagcgtggtacgctgattacacgttgccccgggttcttcgagtgctag

SEQ ID NO: 177461 - DNA, 2712 bp, Artificial Sequence
  Description of Artificial Sequence: Synthetic coding sequence
atggccatccagttccggagcctgttccccctggccctgcccggcatgctcgctctcctgggctggtggtggttcttctcaagaaagaagggacacgtaagctcacacgatgagcagcaagtagaagccggggccgtgcagctgagagcagatccggctatcaaggaaccactgcctgtggaggacgtgtgtcctaaggtcgtttccacaccaccgtcggttaccgaacctcccgagaaggagctctcgaccgtgagtaaattgcccgccgagccgccagcccttctgcaaacccaccccccctgccggcgatctgaaagctctggcatactacctaataccactgacatgagactgagacctggcacacgtcgtgatgattccactaaactagaactggcacttacagggggggaggccaaaagcattccgctcgaatgcccattgtcaagtccaaagggcgttctcttcagtagtaagagcgcagaggtgtgtaagcaagatagccccttcagcagggtccccaggaaggttcaacccggatatcctgtggtgcctgccgagaagaggagcagtggcgaacgagccagggagaccggcggcgcggaagggacaggggatgccgtgttgggagagaaggtgctggaggaagccctactgtcccgagagcacgtcctggagcttgaaaatagtaaggggccatctctggccagcctggagggggaggaagacaaaggcaagagctcttcaagtcaggtggtggggcccgtgcaggaggaggagtacgtggctgaaaaacttccatcgaggttcattgaatcagcccataccgagctcgccaaagatgacgccgccccggcgccaccagtagctgacgcaaaggcccaggataggggagttgaaggcgaactgggcaatgaagagagcctcgaccggaatgaggagggactggatagaaatgaagagggactagaccgaaacgaggagtccctcgaccgcaatgaggaagggctcgatcgcaatgaagaaattaagcgagccgctttccaaatcatatctcaggtgatctctgaggctactgaacaagtgctagccactacggtgggaaaagtagctggtcgcgtctgccaagcctcacagctgcagggtcaaaaggaggagagctgcgtgcccgtgcaccaaaagactgtgcttggacctgatactgctgagcctgccacggcagaagctgccgttgctcctcccgatgccggcctgccattgccaggtttgccggccgaaggctctccgccacccaagacctacgtcagctgcttaaagtctctcctgtccagtccgaccaaagacagcaagcctaatatttcagctcatcatataagccttgcctcctgtctcgctctgaccacccccagtgaagagctgcctgatagggcagggattctcgtggaagatgccacatgcgtcacatgtatgtcagacagctctcaaagcgtgcctttggtcgcctctcctggacattgctccgacagtttcagcacgtcagggttggaggattcctgcaccgagactagcagctcccctagagataaagccatcaccccccctttgcccgagtcgactgtacctttctccaatggcgtattgaaaggagagttgagtgaccttggtgccgaggacgggtggacaatggacgcggaggcagatcattcgggtggctcagatcgaaattccatggactctgtggacagctgctgctcgctgaagaagaccgaatccttccagaatgctcaggccggctccaaccctaaaaaggtggacctgatcatctgggaaattgaggtcccgaaacatctggtggggcggctgattggcaaacagggtagatatgtttcttttctgaaacaaacctccggcgccaagatctacatatctactctcccttacacccaatcagttcagatttgccatatcgaagggagccagcatcacgtcgacaaagcactcaacctgatcggaaaaaagtttaaggaactgaatttaacgaacatttacgctcccccattgcccagcctcgcgctgccctccctgccaatgaccagttggctaatgctacctgatggcatcactgtagaagtcatcgtcgtaaatcaggtgaacgccggccacctattcgtgcaacaacacactcaccccacttttcacgccctgcggtctcttgaccaacagatgtatctttgttatagccagcctggtatcccaactctaccaactccggtggagatcacagtcatctgcgcagctcctggggccgatggggcctggtggcgggctcaggtggtggcctcttacgaagagaccaatgaggtggaaattagatacgtggactacgggggttataaacgggtgaaggtggatgtgctgcgccagatccgctccgactttgtcacccttccttttcagggtgcagaggtgctgctggatagcgttatgcctctgagtgacgatgatcagttctcacctgaagctgatgccgccatgtccgaaatgacggggaacacagcactgcttgcccaggtgactagctatagcccaacagggttacccttaatccagctgtggagcgtcgtgggcgatgaggtcgtgctgatcaataggtcattggtggagagagggctggcacagtgggtggattcttattacacctcactgtag

SEQ ID NO: 177462 - DNA, 2838 bp, Artificial Sequence
  Description of Artificial Sequence: Synthetic coding sequence
atgggcgccctgggcgtgagcggcagcagcagccccggcggctgcccagggtggagacgactacctgcagctgtcaataccaaccctgtggacttcgctcctggcgtaatcacacaggcttcacggatggcgatccagtttagaagcctgttccccctcgccctgcctggtatgctcgcccttctgggatggtggtggttttttagtcgcaaaaagggacacgttagcagtcatgatgagcagcaagtggaggcaggagccgtccaactaagagcagatcctgctataaaagagcccctgcctgtggaagatgtctgccccaaagtggtctcaaccccccccagcgtcacggaaccccctgaaaaagagctttctactgtaagcaagctgcctgctgaaccccccgctcttctgcagacccaccctccttgccgacgctcagagagctccgggatcttacctaacactacggatatgcgcttacggcctggaactcggagagatgatagcacaaaattggaattggctctcacaggaggcgaagctaagtcaattcctcttgagtgccctctgtcatctcccaaaggggttctgttcagttccaagagcgctgaggtgtgcaagcaggacagcccgttctctcgggtccccagaaaggtgcaacctgggtacccagtcgtccccgcggagaaacggtcatccggggagagggctcgagaaactggaggcgcagaagggacaggagacgctgtgctgggcgaaaaagtactagaggaggccctgctgtcccgcgaacacgtcttggagctcgaaaatagtaaggggccttccctggcaagcctggaaggggaagaggacaaggggaaatcgtcgtcctcccaggtcgtgggaccagtccaggaggaggagtacgtagctgaaaaactgccctcccggttcattgaaagcgcgcacaccgaactagctaaggatgatgctgcccctgctccaccagtggcggacgccaaagcccaagataggggggttgagggagagctggggaacgaggagtcgctcgacaggaatgaggaaggcctagaccgaaatgaggaggggttggatcgcaacgaagagtctctcgatcggaatgaagaaggactcgacaggaacgaagagatcaaacgggcggcattccagattatttcgcaggtcatatccgaggccaccgaacaggtcctggcgactacagtgggtaaagtggccggccgcgtttgccaggcaagtcagttacagggacagaaagaagagtcctgtgtgcctgttcatcagaagacagtattgggccctgacactgcggaacccgctaccgcagaggctgcggtagccccaccagatgccgggctcccattgcccgggttaccggccgaaggctcccctccacccaagacatacgtcagctgtttaaagtccctgctgagttcccccacaaaggattccaagccaaatatctctgcccaccacatctctctggccagctgtctggcactaactaccccttcggaagaactgcccgaccgcgctggcattctggttgaggacgccacatgcgtgacgtgtatgtcggactctagccaaagcgtgccactcgtagcctctcccggacattgctcggattcctttagcactagcggacttgaggacagctgtactgaaacaagctccagccccagagataaagcaattacaccacctctcccagaaagtacagtcccattttcgaacggcgtgttaaagggggagctgtccgatctgggcgccgaggacggctggaccatggacgctgaggctgaccacagtggggggtctgatagaaatagcatggacagcgtcgattcatgttgttcccttaaaaagacggagtcctttcaaaatgctcaggctggaagtaaccccaaaaaagtggatctgattatatgggaaatagaagtgcccaaacaccttgtcggaaggcttattggcaagcagggacgatatgtgtcttttctcaagcaaacatcaggggccaagatttacatctccacactgccttatacacagtcagtccagatttgtcacattgagggctcgcagcaccatgttgataaggctctgaatctaataggtaaaaagtttaaggagttaaacctcactaacatttatgcccctccactgccctcccttgccctgcctagtttacccatgacatcttggctgatgctacccgacgggattactgttgaggttatcgtagttaaccaagtaaacgcgggccatcttttcgtacagcagcacacccaccctactttccacgcactgcggtccctggatcaacaaatgtacctctgctacagccaacccggtatcccaaccctgcctacacctgtcgaaataacggtaatttgcgctgcacctggagccgacggcgcgtggtggcgcgctcaggtagtggctagctatgaggaaacaaacgaagttgagatcagatacgtcgactatggggggtacaaacgcgtcaaggtggatgtgttaaggcaaatccgcagcgattttgtgaccctcccctttcagggtgcagaggtactgctggattctgttatgcccctctcagacgacgaccagttctcacctgaagcagacgcggccatgtctgaaatgactggtaacaccgccctcctggcccaggttacctcatactcccctacgggcctgccattgattcagctctggtcagttgtgggtgatgaagttgttctcattaatcgctctcttgtcgagagggggttagctcagtgggtggacagttattacacctccctatag

SEQ ID NO: 177463 - DNA, 2712 bp, Artificial Sequence
  Description of Artificial Sequence: Synthetic coding sequence
atggccatccagttccggagcctgttccccctggccctgcccggcatgctcgcgcttctgggatggtggtggtttttctcccggaagaaaggacacgtgagttctcatgacgagcagcaggtcgaggccggcgccgtccagcttcgggcagatccagctatcaaggagcctttgcctgtggaggacgtgtgcccaaaggttgtcagtactccaccttctgtgactgagcccccggagaaggagctgagtaccgtgtccaagctgcccgcagagcccccagctctattgcaaactcaccccccatgccgacgctcagagtccagcggcatactgccgaataccacagatatgcgccttagaccagggaccaggagagatgattctacaaaattagagctcgctttgaccggcggcgaggcaaaaagtatcccacttgagtgccccttgtcgtctcctaaaggcgtcctgttcagtagtaagtctgccgaggtgtgtaaacaagatagcccctttagtcgagtcccacggaaagtgcagccaggataccccgtcgtcccggctgagaagagatcatctggagaaagggctcgggaaaccggaggcgccgaaggcactggcgacgctgtgcttggtgaaaaagtgctggaggaagccctcctcagcagagagcatgtgctcgagcttgagaactcaaaaggcccttcactggcttcccttgaaggagaggaggacaagggcaagtcatcctcctctcaggtggtgggacccgttcaggaggaggaatacgttgccgagaaattaccaagtagatttattgagtctgcacacactgagctggctaaggatgacgcagcccctgcaccacccgtcgcggacgccaaggcccaagataggggcgtggaaggggagctggggaatgaagaatctttagatcgcaatgaagaaggcctggaccgcaacgaggaaggactggatcggaatgaagagtctctggaccgaaacgaggagggtttagaccggaacgaggaaattaagcgggcagctttccagatcatctcacaggtgatatcagaagccactgaacaggtgttggccactacagtaggcaaagtagccggccgggtgtgccaagcttcacagctgcagggtcaaaaggaggaaagctgtgtcccggtgcatcagaaaacagttctcggacctgacacggcagagcctgctacagccgaagcggccgttgctcctcctgatgctggcctgcccttgcccgggctgcctgctgaaggcagtccaccaccgaagacatatgtctcctgtctgaagtccctcctttcttctcctaccaaggattccaagcctaacattagtgctcatcacatcagtctggcgagctgtcttgccctcactacaccctctgaggagctgcctgaccgcgcaggtatcctcgtagaagatgcgacctgcgtcacttgtatgagcgattcttcccagagcgtgcctctggtggcatcgccaggccactgctccgactctttctcgaccagcggtctcgaggattcatgcacagagaccagctcctcccctagggataaagcaattacgcctccacttccggaatctaccgtcccttttagcaacggtgtgttaaagggcgaactgagcgacttgggcgcagaggacggttggaccatggacgccgaagcagaccactcaggagggagcgatagaaacagtatggacagtgttgacagctgctgttcactgaagaaaactgagtctttccagaacgcccaggcgggaagcaatcctaagaaggtcgacctgatcatatgggaaatcgaggtaccaaagcacttggttggtcggttgattggcaaacagggtcggtatgtgtccttcctcaagcagacctccggtgccaagatatatattagcacactgccctatacacagagcgtgcagatctgccacatagaagggagtcagcaccatgtcgacaaagccctcaatctgatcggcaagaagttcaaggagctcaatcttactaatatttatgccccaccacttccgagcctggcactccctagtctgcccatgactagttggttgatgctacctgacggcattacagtcgaggtgatagtggtcaaccaggtgaatgctggacacctgtttgtgcagcagcatactcatcctactttccacgctctgcggtctttagatcagcagatgtatctctgctattctcaacccggcattccgacactccccacgcccgtggagatcacagtgatttgtgcggctcccggcgccgacggagcctggtggcgggcacaggttgtggctagctatgaggagactaacgaagtagagataaggtacgtcgattacggtggatacaagcgagttaaggttgacgtgttacggcaaatacgctctgattttgtaacgctgccatttcagggggctgaggtgttgctggactccgtcatgccgctctctgacgatgaccagttctctcccgaggcggatgcagccatgtctgaaatgacaggaaacacagccctcttggcccaggtcaccagctactcacctacagggttacccctgattcaactatggtctgtggtcggggacgaagtggtcctcatcaaccggagccttgtggaaagaggactagctcagtgggtggacagctactatacatcactgtag

SEQ ID NO: 177464 - DNA, 1095 bp, Artificial Sequence
  Description of Artificial Sequence: Synthetic coding sequence
atgggcatcctggagaagatcagcgagatcgagaaggagatcgcccgcacccagaagaataaggctacggagtaccatctggggctcctgaaagctaaactagctaagtaccgcgcacaactgttggagccctccaaaagcgctagttcgaagggtgaggggtttgacgtcatgaagagcggcgacgcgagggtcgctctgattggctttccatcggtgggcaaaagtacatttctgtctctcatgaccagtaccgccagtgaagccgcttcctacgagttcaccaccttgacctgcatccccggcgtgatcgagtacaagggggcaaatatccagttattagatctgccgggcatcattgagggggccgcacaagggaaaggcaggggcagacaggtgattgctgtggccaggacagcagatgtcatcattatgatgctggacgcaacaaaaggagaagtgcagcgttcactcctggaaaaggaacttgagagcgtcggtatcagactgaataaacacaaaccaaatatctacttcaaaccaaaaaagggtggagggatctcatttaactccacagttacactgactcagtgcagtgagaagctcgtgcaactgattctgcatgagtacaaaatattcaatgccgaggtgcttttcagagaggactgcagccccgacgagtttattgacgtcatagtcggcaatagggtctacatgccttgcctatacgtttataacaaaatagatcaaatcagcatggaagaggtcgatcgactggcacgtaagcccaacagtgttgtgatttcttgcggcatgaaattgaatttggactacttactggaaatgttgtgggaatacctggcattaacatgtatctataccaagaagcgtggccagcggcctgactttacagacgctatcatccttaggaagggagcgtccgtcgaacatgtctgccacaggattcaccgcagcctggcatcccagtttaagtacgccctggtatggggaacctccacgaagtattctccacagcgggtcggcttgacacataccatggaacatgaggacgtaatccagatagtgaaaaagtag

SEQ ID NO: 177465 - DNA, 1815 bp, Artificial Sequence
  Description of Artificial Sequence: Synthetic coding sequence
atgcggggcgccggccccagcccccggcagagcccccggaccctgcgccctgaccctggccccgctatgagtttttttcgacggaaggtaaagggcaaggaacaggaaaagacgagtgacgttaaatccataaaagcttccataagcgtccatagcccacagaaatctaccaagaatcacgcattgctagaggccgctggtcccagtcacgttgcgattaatgctatatccgctaatatggactctttcagttccagtcgtacggcgaccttgaagaaacagccaagtcacatggaggccgctcatttcggcgatctgggcaggtcgtgtctagattatcagacacaagaaactaaatcgtctctctctaagaccctcgaacaagtcctgcacgacactattgtgttaccctacttcatccaatttatggagctgaggcgaatggagcatctcgtaaaattctggttagaggcggaatccttccattccaccacctggtctaggatacgggcgcacagtttaaatacagtgaagcaatccagtcttgctgaacccgtcagcccatcaaaaaagcacgaaaccacagccagtttcctgacagacagcctggacaagaggctggaagactctggctccgcccagctgtttatgacgcactccgagggcatagacctgaacaacaggactaatagtacacaaaaccatctattgctgtcccaagagtgcgattccgctcattcattgcggctggaaatggccagggcgggcacgcaccaggtgagcatggagacccaggagagcagctcaaccctcacagtcgccagccgtaacagtcctgcaagcccacttaaggagctgagtggcaagctgatgaagagtatagagcaggatgccgtcaataccttcacgaagtacatcagccccgatgcggcaaagcccatccccatcacggaggcgatgcgtaatgacattatagcccgcatttgcggagaggatggccaggtggatcctaactgcttcgtacttgcgcagtccattgtgtttagcgccatggaacaggagcattttagcgagttcctgcggagccaccacttttgtaagtatcaaatcgaagtcctgacctccggaactgtttatctggcagatattctgttctgcgagtccgccctgttctacttctcagagtatatggagaaagaagacgccgtgaacattctgcagttttggttggccgcagacaattttcagtcacaactcgcggccaagaaaggacaatacgatggtcaggaagcgcagaatgatgcgatgatcttgtacgataaatattttagcctccaagccactcatccattaggttttgacgatgttgtgaggttggagatagagtcaaacatttgtcgcgaaggcgggccgttaccaaattgttttaccaccccattaagacaagcttggacaaccatggaaaaatcaagcgtgaaaaaagcctcaattaaaatactcaagaattttgacgaagcaatcatcgtcgacgcagcctcacttgacccagagtcactgtatcaacgtacatacgccggcaaaatgacgttcgggcgtgtcagcgacttgggccagttcattcgagagtccgagcccgagccggatgtcaggaagtcgaagggttccatgttttctcaggctatgaaaaaatgggtgcaggggaatacagacgaggcccaggaagaactggcatggaagattgcaaaaatgattgtgagcgacatcatgcagcaggcgcagtatgaccagccactggaaaaatctaccaaggtatag

SEQ ID NO: 177466 - DNA, 8454 bp, Artificial Sequence
  Description of Artificial Sequence: Synthetic coding sequence
atgaagctgaacccccagcaggcccccctgtacggcgactgcgtggtgaccgtcttactcgctgaggaagataaggctgaggacgatgtggttttctatctcgtgtttctgggaagcacgttgagacactgcacatctactcgaaaggtcagctctgatactttggagactatcgcccctggacacgactgctgcgagacagtcaaagtccagctctgcgcctctaaagaaggactgcctgtgttcgtcgtcgccgaagaggatttccatttcgtacaggacgaagcatatgacgcggcgcagtttctggcgaccagcgccggaaatcagcaggccctgaattttactcggttcctggatcagagtgggcctccgtccggggatgttaattccctggacaagaaattggtgctggccttcaggcaccttaagcttccgactgagtggaatgtgctgggtactgatcagtccctgcacgatgcgggaccacgggagaccttaatgcattttgcggtgaggctgggtttgctccgcctgacatggttcctgctgcagaaaccaggggggcgcggggcactctctattcacaaccaggagggggcgacaccagtttcactggccctggaaagaggataccacaagctgcaccagctccttacggaggagaacgcaggcgaacctgatagttggagcagcctctcttatgaaattccatatggtgattgctctgtgcgtcaccatcgggaactggacatctatactctgacaagcgaatcagatagccaccatgaacatcctttccccggcgatggatgtactgggccgatctttaaacttatgaacatccaacagcagttgatgaaaaccaacctgaagcaaatggattctttgatgccccttatgatgacagcccaggacccatcttcagcccccgaaaccgatgggcaatttctcccctgcgccccagagcctaccgatccacagcgcctgtcaagcagcgaagagacagagagcacgcagtgttgcccaggctcacccgtcgcccagacagagagcccttgcgatctgtcttcaatcgtcgaggaagaaaacactgatcgatcttgcaggaagaagaacaagggagtggaacgcaaaggagaggaagtggaacccgccccaattgtggacagcgggactgtaagcgatcaggactcatgtcttcaatctctgcctgactgcggagttaaggggacagaaggtttgtcaagttgtggcaaccggaacgaagagaccggcacaaaatcgtcggggatgcctactgatcaggagagcctgtcaagcggcgacgcggtgttacagcgggatttggtaatggagccgggcaccgctcaatatagctctggaggcgagcttggaggtatcagtaccacaaacgtgtccacccctgacaccgccggcgagatggaacatggcttaatgaatcccgacgctacagtttggaaaaatgttcttcaggggggagagagcaccaaagagcgatttgaaaacagcaatattgggaccgcaggagccagcgatgttcacgtgacatcaaaacccgtggataaaattagcgtgcccaattgtgcccccgccgcctcttcgctggacggaaacaaaccagccgaaagcagtttggctttctcaaacgaggaaacgtctaccgagaagactgcagagactgagacttcacgtagcagagaggaaagcgccgacgctccggtcgatcagaacagcgttgtgatcccagcagctgctaaagacaagatttctgatgggctggagccctatacattgttggccgctggtattggagaagcgatgagcccaagcgatttggccctgctcggcctggaagaagatgtcatgcctcaccagaattccgaaacgaactcgtcccacgctcagagccagaaaggcaagtcgtctccaatctgctctacgacaggtgatgataaactttgcgcagactccgcatgccagcaaaatacagtgaccagttcaggagatctcgtggcgaaactctgcgataatatagtgtctgaatctgagagtactactgcccgccaacccagctcacaggatccgcccgatgcaagccattgtgaagacccccaggcccacactgtgacatcggatcctgtaagagacactcaggagcgcgcagacttctgcccctttaaagtcgtggataacaaggggcaacgtaaggacgtgaagctggacaagccactcactaacatgcttgaggtcgtgagccatccgcaccccgtagtaccaaaaatggagaaagagctagtacctgatcaggctgtgatcagtgattctactttttccctggcaaacagcccaggcagtgaatcagttaccaaggacgacgcactttcctttgtgccctcacagaaggagaagggaacagccacacccgagctccataccgcaacagactacagggacgggcctgacgggaattctaatgagccagatacacggccactggaggatcgagccgtcggattgtcaacatccagcacagccgccgaactgcagcatggcatgggaaatacttcgcttactgggctcggaggcgagcacgagggaccggcgccccctgccatcccagaggccctcaacatcaaagggaatacagactccagcttacagagcgtgggtaaagctactctagctctagattcggtgctgacagaggaaggtaagctgctggtggtgtctgaatcatctgcggcccaggagcaggataaagacaaggctgtgacttgctccagtatcaaagagaacgccctttcttcaggcaccttgcaggaagagcagcgcacgcctcccccgggccaggacacccagcagttccacgagaaatctatcagtgctgactgcgccaaggataaggccctccagctatcaaacagcccaggagcctcttcggcctttttaaaagccgaaaccgaacacaataaggaggtggctcctcaagtttcactcttgactcaggggggagccgctcaaagcttggtgccacccggtgccagcctggccacagaatcccggcaagaggccctgggggccgaacacaattctagcgcgctccttccatgcctgttgcccgatggtagcgatggttcagacgccttgaattgctcgcagccttctcctctcgacgtcggcgtgaaaaatacacagtcgcagggcaaaaccagcgcctgcgaagtaagtggcgacgtgaccgttgatgtgacaggcgttaatgcgttacagggaatggctgagccacgcagggagaatattagccacaacacccaggatatattgatccctaatgtgctgctgagtcaggaaaagaacgccgtcctcgggctgcccgtagctctgcaggacaaggcggttaccgatccgcagggcgtgggcacacctgaaatgattcccttggattgggagaagggaaaactcgagggagctgaccattcctgcactatgggtgacgcagaggaagcccagatcgatgatgaggctcacccagtcctgctccaaccggttgccaaagagttgcctacagacatggaactttctgcccacgatgatggggctcccgccggggttcgggaagtgatgcgcgcgcccccctctggacgggagcgcagtactccctcccttccgtgtatggtgtcagcccaggacgcgccccttccaaaaggagccgatttaatcgaagaagccgcctcaagaatagtcgacgccgtgattgaacaggtgaaggctgctggtgccctcttgaccgagggagaggcatgtcatatgtccctgtctagtccagagttgggtcccctgaccaagggactcgagtctgcatttacagagaaggtatcaacatttcctccaggcgaaagtttgcccatgggctccacacctgaggaggctaccggctccctcgctggctgtttcgccggccgagaggaaccagagaagatcattttgcctgtccaggggcctgaacctgctgctgagatgcctgacgtgaaggcagaggatgaggttgacttccgggcctcttccatctctgaagaggtcgccgtgggctctatcgctgccactctgaaaatgaagcaaggccccatgacccaagccataaaccgcgaaaactggtgtactatcgaaccttgccccgacgcagcttctcttttggcatccaaacagagtcccgaatgtgagaatttcctggacgtggggcttggccgcgaatgcactagtaaacagggcgtgctcaagcgggaatcagggtcagacagcgacttatttcactcaccctcagatgatatggattccatcatctttcctaaaccagaagaagagcatcttgcctgcgatatcactggatcttcgagctctactgatgacactgcatccttggatagacatagttcccacggtagtgatgtaagcctgagccagattcttaaacctaacaggtctcgggatcgacagtcactggacggattttattcgcacgggatgggagccgagggtagagagtctgaatcagaacccgcggatcccggagacgtcgaggaagaagaaatggattcaatcactgaggtgcccgccaattgctcagtacttagatcctctatgaggtcgttgtccccttttcgccgacactcttgggggcccggaaaaaacgcagccagcgacgcagaaatgaaccataggtcaatgtcatggtgtccatctggcgtgcaatacagcgcagggctgtccgcggacttcaactaccgatcattcagcttggaaggtctgacaggaggtgctggcgtgggcaataagccttctagtagcctggaagtttctagtgcaaacgccgaagagctgagacatcccttcagtggagaggagcgagttgatagtctcgtatctctatcggaagaagacctggagtccgatcaacgcgaacatcgcatgttcgatcagcagatctgtcacagaagcaagcaacagggctttaactattgcacttcagccatttcaagtccattgacaaaatctataagccttatgactattagccatccgggtcttgacaacagtcgcccctttcattcaacatttcacaacactagcgctaacctgacagagtctatcacagaggagaactacaattttctgccacacagcccctcgaagaaggatagtgagtggaagtccggcactaaggtttcaaggaccttttcatacattaaaaacaagatgtcgtcttctaaaaaatcaaaagagaaggaaaaggagaaggataaaatcaaggagaaagaaaaggattcaaaggacaaagaaaaggacaaaaaaaccgttaatggacacacattctctagtattcctgtggtgggccctatcagttgttctcagtgcatgaagccttttaccaataaggatgcctacacttgcgctaactgtagcgcttttgtgcacaagggctgcagggagtctctggcttcttgcgcaaaagtaaagatgaagcagccaaaagggtccctgcaggcgcacgacaccagctccctaccaactgtcataatgcggaacaaaccttcacagcctaaggaacgacctcgctcagccgttctgttggtggacgagaccgccactactccaatattcgcgaatcggagatctcagcagtcggtttcactcagcaagtccgtatcaatccaaaacatcaccggcgtaggcaatgacgaaaacatgagcaacacatggaagttcctttcccattcaaccgattctctgaataagattagtaaagtgaatgaaagtaccgaatcactgacagatgagggggtgggaacagacatgaacgagggtcagctgctgggggactttgaaattgagagcaagcaactcgaggcggaatcatggtccagaatcatcgactccaagttcctcaaacagcagaagaaagatgtcgtaaagcgacaggaagtgatatatgaactgatgcagacagaatttcaccacgtgcgtacactcaaaatcatgtccggagtctatagtcaaggtatgatggctgaccttctgtttgaacagcagatggtggaaaagctttttccttgtctggatgagctgatttcaattcacagccagttctttcagagaatcctcgagcgtaagaaagagtcactggtggacaagtcagagaaaaattttctgatcaagcgtattggggatgtgttagtcaatcagttcagcggagagaacgctgagcggcttaagaaaacgtacggcaagttctgcggacagcataaccagagtgtgaattatttcaaggacctgtacgccaaggataagagattccaggcctttgtgaagaaaaaaatgtccagctccgtggttcgtcgcctcggcattcctgagtgcatcttattggtgacccagagaatcacgaagtacccggtgctttttcagcggatcctgcagtgcacgaaagataatgaggtggagcaggaggacctggctcagagcctgtctttggtgaaagacgttattggggcggtcgattcaaaggttgccagttatgaaaaaaaggtgagattaaatgagatctacacaaagaccgacagtaagagcatcatgaggatgaagtcaggacagatgttcgccaaagaggacctgaagcgcaagaaattggtgcgagacggctccgtgtttctcaaaaatgcagctggccgcctcaaggaggtccaggctgtgctcctcactgacattctcgtcttccttcaggaaaaggaccagaagtacatctttgcgtctctagaccagaaaagcactgtgataagtttgaagaagctgattgtcagggaagtggcgcatgaggaaaaaggcttgtttcttatcagtatgggcatgaccgatccagaaatggttgaggtgcatgcctcgagtaaggaggaaagaaatagctggatacaaatcattcaggataccataaatactctgaatagagatgaagacgaggggatcccttcagagaatgaggaggaaaagaagatgttggatacacgggccagagaactgaaggagcagctgcatcaaaaagatcagaagattctgctgctactggaggaaaaagaaatgatcttcagagatatggcagagtgcagtacccctttaccagaagactgctctccaacacactccccacgggttctgtttcggagcaacaccgaggaggccctgaagggaggccctctgatgaagagcgcaatcaatgaagtcgaaatcctccaagggctggttagtggtaatctcgggggaaccctgggcccgactgtatcatcccctatcgagcaggatgtcgttggtccagtaagcctgccccggcgggccgagaccttcggcggctttgactcccatcagatgaacgctagcaaaggcggcgagaaagaggaaggcgacgacggccaggatttgcggcggaccgaatccgactctgggctgaagaaaggggggaatgccaacttggtgtttatgctgaaacggaatagcgagcaggtcgtccaatctgtagtgcacctgtacgaattgctgtctgccctccagggggtagtcttgcagcaagattcatacatcgaagaccagaaattagtgctgtcggagcgcgccctgacccgcagcctctcacggccctcctcccttattgaacaagaaaaacaaagaagcctggaaaagcagcgccaggacctggctaatctgcagaagcagcaggcccaatacctcgaagaaaaaagaagaagagagcgagaatgggaggctcgtgaacgagaactgagggagcgagaggccctcctggcacagcgcgaggaagaagtacaacaagggcagcaggacttagagaaggagagggaagagctccagcagaagaaagggacttatcagtatgacctcgagagactgcgggcagcacagaagcaacttgagcgagagcaggagcagctccgacgggaagctgagcgcctgtcacagcgccaaaccgaacgggacctatgccaagtgtcccatccacacacaaagctgatgagaattccctccttcttcccttcgcctgaggagcctccaagcccgagtgccccctctatagccaaatctggaagtctcgatagtgaattgagtgtctcgcctaagcgaaattccatcagcaggacccacaaggacaagggccccttccatatcctgtcctcaacgtctcagaccaataaagggcctgaaggccagtcccaggctcccgccagtacaagcgctagcaccagactgttcggtttgacaaaacccaaagagaaaaaagaaaagaagaaaaagaataagacatctcgctcccaacctggagatggtccagcaagcgaggtgagtgctgaaggcgaggagattttctgttag

SEQ ID NO: 177467 - DNA, 3177 bp, Artificial Sequence
  Description of Artificial Sequence: Synthetic coding sequence
atgagcagcagcaagaagagcaaggagaaggagaaggagaaggacaagattaaagaaaaggagaaggactctaaagataaagaaaaggacaagaaaactgtaaatggtcacactttttccagcattcccgttgtgggacctatatcctgctctcagtgtatgaaaccttttactaacaaggatgcctacacatgcgcaaactgctctgccttcgtacataagggatgcagagagagcctggcgtcttgtgcaaaggtgaaaatgaagcaaccgaaggggagtctgcaggcccatgacacttccagtctgcccacagttatcatgcgaaacaaaccgagtcagcctaaggagagaccgcgcagcgctgtgttgctggtcgacgaaacagccactacccccattttcgctaatcgaagatctcaacaaagcgtctccttaagcaagtctgtttcaatacagaatataactggtgtagggaacgacgaaaatatgtcgaacacctggaagttcttgagccacagtaccgacagcctgaataaaatctctaaggtcaacgagtcgacagagtctctgacagacgagggcgtgggcacagacatgaacgagggccagttgttaggcgactttgagatcgaatctaagcaattggaagcagagtcctggagccgaattatcgattcgaagttcttgaaacagcagaagaaagatgtggtgaagcggcaggaagtgatttacgagctcatgcagacagagtttcaccacgtgcgaaccctcaaaatcatgagcggggtgtattcacagggaatgatggccgacctgctgtttgaacaacagatggtagaaaaactctttccttgtctggacgagctgatctcaatacacagccagttcttccagaggatcctggagcgtaagaaggagagtttagtggacaaaagcgagaagaatttccttattaaacgaataggagatgtgttggtgaaccagttcagtggtgagaacgctgagcgcctgaaaaaaacatatggtaagttctgcggccagcacaaccagtcagttaactactttaaggacctctacgcaaaggacaagcgcttccaggcatttgttaagaagaaaatgagcagtagtgtagtcaggcgccttgggattcctgagtgtatcctgctagtgacccagcggatcaccaaatatcccgttctgttccagcgcatcctccagtgtaccaaagacaatgaggtcgagcaagaagatcttgcccagtccctttcactcgtgaaggatgtgatcggtgccgtcgatagcaaggtggcgagctacgagaaaaaggtccggctcaacgagatctatacaaagaccgatagtaagtctataatgcggatgaaatcgggacaaatgttcgcgaaggaggatcttaaacggaagaagctcgtcagagatgggtctgtgttcctcaagaatgcagccgggagactaaaggaggtacaggcagtgctgctcaccgacattctggtgttcctgcaggagaaggaccagaaatatatctttgccagcctcgatcagaaatcgaccgtgattagcctgaaaaaattgatcgttcgggaggtggcgcatgaggagaaagggttgttcttaataagtatgggaatgacggaccctgaaatggtggaagtgcacgcatccagcaaggaagagcgaaactcctggatccaaataatccaagacaccattaataccttaaatcgagatgaagatgagggcatcccttctgaaaacgaagaagaaaagaagatgcttgacactagggctagggagctgaaggagcagttgcaccagaaggaccagaaaatactcttactgctcgaggaaaaggaaatgatctttcgcgacatggccgagtgcagcaccccactgcctgaggactgctcgcctactcacagccccagagtgttgtttagatccaatacggaggaagcgcttaaggggggcccgctgatgaagtccgcaattaatgaggtagagatcctgcagggattggtgagcgggaatctggggggcacgctgggacctacggtcagttcgcccatagagcaagacgtcgtgggccccgtgtccctccctaggcgcgcagagacttttggaggattcgactcacaccagatgaacgccagcaagggcggggagaaggaagagggagatgatgggcaagatctcagacgcaccgaaagtgatagcggactgaagaaaggcgggaatgccaatcttgtcttcatgcttaagagaaattcggaacaggtggttcagtctgtggtacatctgtatgagttattgtccgcgctgcaaggtgtggtgttacagcaggacagctatattgaggatcaaaagctggtgctgagcgaacgtgctctaacaagatctctgtcaaggccgagttctctaatcgagcaggagaagcagaggtccttggagaaacagagacaagacctggctaatctgcagaagcaacaggctcagtacttggaggagaagagacgccgggaacgcgaatgggaggccagagagcgtgaattgagagaaagagaggctcttctggcccagagagaggaagaggtgcagcagggtcaacaagacctggagaaggagcgagaggaactacagcaaaaaaagggtacttaccagtacgatctcgaacgcctccgagcagcccagaagcaattagagagggagcaggagcagcttaggcgggaagccgagcgacttagccagcgtcaaacggaaagagacctttgccaagtttcacatccgcacaccaagctgatgagaattccatccttcttcccgagcccagaagaacccccctcaccgagcgccccgtctattgcaaagtcaggaagccttgacagtgaattgtcagtgtcacctaaaagaaattccatctcccgcactcataaggataagggtccatttcacatactgtcatccacaagccaaacgaacaaaggaccggagggccagtcgcaagctcccgcctctacttcagcctctacgcgactgtttggactcactaaaccaaaagaaaagaaggagaagaaaaaaaagaataaaaccagtcgttctcagcccggcgatggccctgcctctgaggtctcagctgaaggggaggagatcttttgctag

SEQ ID NO: 177468 - DNA, 8451 bp, Artificial Sequence
  Description of Artificial Sequence: Synthetic coding sequence
aagctgctggagaagcagccccccatcgagggcgactgcgtggtgactgtgctactagctgaagaggacaaggcagaagacgacgtggtgttctacttggtttttctgggcagcactctccggcattgcacgagcacaaggaaagtgtctagcgatacactggaaacaattgctcctgggcacgactgctgtgagacagtaaaggtgcaactgtgtgcaagtaaagaaggcttgcccgtctttgtggtggccgaggaagacttccattttgtgcaggacgaggcttatgacgccgcccaattcctggccacaagcgctgggaatcaacaggccctaaacttcacaaggttccttgaccagtcagggccacctagtggggatgtgaattctctggataaaaaactggtgttggcgtttcggcacctcaagctccccaccgaatggaacgttttaggaactgaccagagcttacacgacgctgggcccagagagaccttgatgcattttgccgttcggctaggcctgctgagactaacttggttcctgttacagaagcctggcggaagaggggcactgtccattcacaaccaagagggtgcaactcccgttagcttggctctagagcgaggataccacaaacttcaccagctgctgaccgaagagaacgctggagagccggattcctggtcatctctgtcctacgagatcccatatggcgactgctctgtgcgccaccaccgagaactggacatttacactttgacgtcagaatctgattctcaccatgaacaccccttccctggagacggttgcacaggcccaatcttcaaattaatgaacatacagcagcagctgatgaagaccaatttgaaacaaatggactccctgatgccactgatgatgacagcccaggacccttcttctgcacctgaaacagatggccagtttttaccctgcgctcctgaaccgacagaccctcaacgtttgagtagctcagaagagactgagtccacacagtgctgtccaggatcgccggtcgcgcagacggagtccccttgcgacctgtccagcatcgtggaggaggagaataccgatcgctcctgccgcaagaagaacaagggagtcgagcggaaaggcgaagaagtcgaacctgccccgatcgtggacagcggcaccgtatcggaccaggactcatgccttcagagcttgcccgactgtggtgtgaaaggcaccgaaggtctctcttcctgcggaaaccggaatgaagagaccggcacaaaaagcagtggtatgccaaccgatcaggaaagtctatcatcgggcgacgccgtgcttcagagggatctggtgatggaacctggtaccgctcagtatagtagtggcggcgagctgggaggaatttctacaacaaatgtatccacgcccgatacagctggggaaatggaacacggcctcatgaatccagacgctacagtgtggaagaatgtactacagggcggcgagtctactaaagaacggttcgaaaacagtaatatcggcaccgctggcgcttcggatgtccacgttacgtcaaagccagttgataagatcagcgtccccaattgcgcccccgcggcttcatctttagacggaaataagcctgcggaatctagcttagcattttctaatgaggagacttctacggagaagaccgcagagacagagacttccagaagcagggaggaatccgccgacgcccctgtggatcaaaactcagtggttatcccagctgccgccaaagacaagatctccgatggcctagagccttacactttgctggctgccggaatcggagaagctatgtctccttcagatctggcactgctagggctagaagaggacgtcatgccgcatcagaattccgaaaccaacagcagccatgcccagagtcagaagggcaaatccagccctatttgttctaccactggagatgataagttatgcgccgattctgcttgtcagcagaataccgtcacctcgtctggggacctggttgcgaaactgtgcgacaatatcgtgtctgagtctgaaagcaccacggcacgccagccttcatcccaggatcccccagacgcctcccactgcgaagacccccaggcccataccgttactagcgatccagtgcgcgacacgcaagaaagggcggacttttgtcctttcaaagtagtggacaacaaaggtcagcgcaaggatgtcaaactggataagcccctcactaatatgcttgaggtggtctcacatccacatccagtggtgccaaagatggagaaggagctggtccccgaccaggccgtcatttccgactcaactttcagtctcgcgaacagccctgggtccgagtccgtcaccaaggatgacgcgctgtctttcgtaccatcccagaaagagaaaggaaccgctaccccagaattacacacagcaactgattacagggatgggcctgacgggaatagtaatgagcctgacacccggccccttgaggacagagcagtgggtctgtctaccagttcaacagccgctgagcttcaacatgggatgggcaacacctccctgacgggactgggcggtgagcacgaggggccagcccctccagccatcccggaggccttgaacattaagggaaacacggactcttctttgcagagtgtgggcaaggccacactggcgttagactccgtgctgaccgaagaaggtaagctactggtcgtctcagaatcctccgccgcccaggaacaagataaggacaaggcagtgacttgtagttccatcaaggagaatgctctgagttcaggcaccttgcaagaagaacagaggacacctccccccggacaggacacacagcaattccacgagaagtcaatcagcgcagactgcgccaaggataaagctctgcagctgtcaaactcacccggggcctcgagtgcctttctgaaggctgaaaccgaacataacaaggaagtggccccgcaggtcagtctcttgactcaggggggcgccgctcagagcttggtccccccaggtgctagcctggccaccgaatcccggcaggaagctcttggcgcagagcacaactcatccgctctgcttccttgtcttcttccagatggcagcgacggttctgacgccttgaactgttcacaaccttccccgttagacgttggtgtgaagaacactcagagccaagggaagacaagcgcctgcgaggtgtccggcgacgtcacagtggacgtcactggggtgaatgcacttcagggaatggctgagcctagacgcgaaaacatcagccataatacacaggacattctcattccaaacgtgctcttgtcccaggaaaaaaatgcagtattagggttgcccgttgccctccaggataaggctgtcaccgacccacaaggggtgggcacccctgaaatgatccccctcgactgggagaaagggaaactagaaggagcagaccattcttgcacgatgggtgatgccgaagaagcccagattgatgacgaggcccacccagtgctcttgcagcctgtcgctaaggagctaccaaccgacatggagctttccgctcatgacgacggggcacccgccggggtgagggaggtgatgagagccccacctagcggaagagagaggtccaccccttccctcccttgtatggtgtccgcacaggacgctcctctcccgaaaggtgcagatcttattgaagaagcggcctctagaatcgtcgacgccgtcattgagcaggtgaaggccgccggcgccctgctgacggagggcgaggcgtgccacatgtcgctgagcagcccagaactgggccccctgaccaagggactggaatcagcatttactgagaaagttagtacctttccccctggagagtccctcccaatgggcagcactccggaagaggcaaccgggagtctggcgggctgcttcgctggccgtgaagagcccgaaaagattattctgcctgtacaggggcctgagccagccgcggagatgcctgacgtcaaggctgaggacgaagttgatttccgtgcctcatcgatcagcgaggaggtggcggtggggtctatcgccgccacgctgaagatgaaacagggacctatgacgcaagccatcaatcgcgagaattggtgtaccattgagccctgcccagacgccgcatctctcctggcctcaaagcagtcccccgagtgcgagaacttcctcgatgtgggtttgggcagagaatgcacttccaagcagggagtcctcaagcgggaatctggctctgacagcgatctctttcactctccatcagatgatatggacagcataatctttcccaagcctgaggaggaacacctggcatgcgatatcacggggtcgtccagtagtaccgacgacaccgcctctctcgacagacactcatcccacggctccgacgtgtctctttctcagatcctgaaaccaaatcgcagccgcgacaggcagtccctggacggcttttactcacatggaatgggggctgagggccgcgaatcagagagcgaaccggccgatcccggcgacgtcgaggaagaggagatggattctataacagaggttccagctaactgttctgtgcttagaagcagcatgcggagcctatcccctttccgacgacacagttggggccccggtaagaatgccgcatccgacgctgagatgaatcaccgctcaatgtcctggtgccctagtggcgtgcaatactccgctggactctccgccgacttcaattatcgctccttctcactggaaggcctgaccggaggcgcaggtgttgggaacaaaccgagttctagcctggaggtaagctcagcgaatgcagaggagttgcgccacccattcagcggcgaagaacgcgtagactccctggtaagcctctctgaagaggacttggagtcggaccagagagagcatcgcatgtttgaccagcagatttgccaccgttctaagcagcagggattcaactattgcacctccgcaatcagctcacctttaaccaaaagcattagcctgatgaccatctcccaccccggactcgacaatagccgccctttccattccactttccacaacacaagtgctaacttgaccgaaagcattacagaagaaaactataattttcttcctcactccccgagtaagaaagatagcgaatggaaatctggaaccaaggtgagccgtacgttctcctacataaaaaacaaaatgagttccagcaagaaaagtaaagaaaaagaaaaggagaaggataagattaaagagaaggagaaggactccaaagacaaagaaaaggataagaaaaccgtgaatggtcatacctttagtagcatccccgtggtgggccccatctcctgctcccagtgtatgaaaccatttaccaacaaagacgcctatacatgtgccaactgttcagcatttgttcacaaaggctgtcgtgagtcactcgcatcatgtgctaaggtgaaaatgaaacaaccaaaaggcagcctgcaggcccacgacaccagttctctgcctaccgtcattatgcggaacaaacccagtcagcccaaggagagaccccgctctgcagtcctgctagtggacgaaacagccacaacaccgatattcgccaaccgccgctctcagcagtctgtgagcctgtctaaaagcgtgagtattcaaaatatcaccggcgtggggaacgacgagaatatgtctaatacatggaagtttttgtcgcactcaactgactctcttaataagatcagcaaggttaatgaaagtaccgaatccttgactgacgagggcgtgggcactgatatgaatgagggccagctactgggcgacttcgaaatcgaatccaaacagctggaggccgaaagctggtcacgcattattgacagcaaatttctcaaacagcagaaaaaagatgttgtgaagaggcaggaagtaatctacgaactaatgcagacggaattccaccacgtgagaactctcaagattatgtctggggtatacagccagggaatgatggccgatctgctcttcgaacagcaaatggttgaaaagctgttcccttgtctggatgaactcatcagcattcactcacaattctttcagcgaatcttggaacgaaagaaagaaagcctggtcgacaaaagtgagaagaacttccttatcaaaagaattggcgacgtgttggtaaaccaatttagtggagaaaatgctgaaagactgaagaagacttatggcaagttttgtggacagcacaaccagtcggtcaattatttcaaagatctgtatgcaaaagacaagaggttccaggcttttgttaaaaagaaaatgagctcttccgtggtccgaaggttaggcattcccgagtgcattctactcgtgactcaacgcattacaaagtatcccgtgctgtttcagaggattttgcaatgtacgaaggacaatgaggtcgaacaggaagatttagcccagtctctgtcccttgttaaggacgtgataggtgcagtggacagcaaggtggcctcttatgagaagaaagttagattgaatgaaatatatacaaagaccgattctaagtccattatgaggatgaagtccggccagatgttcgccaaagaggatcttaagagaaagaaattagtgagggacggcagtgtttttttaaaaaatgccgcaggacggctcaaggaagtgcaggcagtgctcctgaccgatattctggtgttcctgcaggaaaaagaccagaagtacatatttgcatccctggaccagaagtcaaccgtgatatcattgaaaaagctgatagtccgcgaagtggctcacgaagagaaaggcctgttcctcatctcgatgggcatgaccgatccggagatggtcgaggtgcacgcatctagcaaagaggagagaaatagttggatccagatcatccaagatacaattaatactctcaaccgcgacgaggatgaggggattcctagtgaaaacgaagaggaaaaaaagatgctcgacacacgggctcgcgaactaaaagagcagctgcaccaaaaggatcagaagattctgctgctgctcgaagagaaggaaatgatatttcgagatatggccgagtgcagcacaccgcttcctgaggattgctcccctacgcatagcccgagagtgctgttcagatccaacaccgaagaagccctgaaagggggaccactgatgaaatccgccattaatgaagtggaaattttgcagggcctggtttctggcaacctgggagggactctgggacccactgttagttctccaattgaacaggatgtggtggggcccgtgtctctgccccggagagcagagacctttggcggtttcgactcgcatcagatgaacgctagtaaaggcggcgaaaaggaggaaggcgacgatggtcaagatctgcgtcgaacagaaagcgacagtggcctaaagaaagggggcaacgctaatctggtgtttatgctgaagcggaacagtgagcaagtggtccaatctgttgtacacttatacgaactcctgtctgcattgcaaggggtagtcctacagcaggattcttatatagaggaccagaaactcgtactttcggaaagagcacttaccagatcgctgtctagaccctccagcctgatagagcaggagaagcaacggagtttggaaaaacaacgtcaagaccttgccaacctgcaaaagcaacaggcccagtaccttgaagagaagaggcgtagagaacgggaatgggaggctcgcgaacgcgagctaagagagagagaagcattactggcacaaagagaggaagaggtgcaacagggacagcaagacttggaaaaggaacgggaggagctgcagcaaaagaaggggacgtatcagtatgacctggaacggctgagagctgcacagaagcaacttgaacgcgaacaagagcagctgagaagggaagctgagcggctctcccagcgtcagactgagcgcgatctgtgccaggtctcccacccacacaccaaattgatgcgtataccctccttcttcccctcacccgaggagcccccgtcccccagcgccccgtctatcgcgaagtccggctcactggacagcgaactaagcgtgtcacctaaaaggaattcaataagcaggacgcacaaagataagggcccatttcacatcctgtcttctactagccagacaaacaaggggcctgaaggtcagagtcaagcccccgctagtacatcagcgtctactcgcttattcggtttgactaagcctaaggagaaaaaagagaagaagaaaaagaacaagactagccgctctcagccaggtgacggcccggcgagcgaagtttctgctgagggcgaagagatcttttgttag

SEQ ID NO: 177469 - DNA, 8442 bp, Artificial Sequence
  Description of Artificial Sequence: Synthetic coding sequence
atgaagctgaacccccagcaggcccccctgtacggcgactgcgtggtcaccgtgctgctggctgaggaagacaaggctgaggacgacgtcgtcttctatcttgtctttctcggctcaaccctccgtcattgcaccagcacaaggaaagtgtctagtgacacgttggagacgatcgctccaggtcatgattgttgcgaaactgttaaagtgcagttatgcgccagcaaggagggcttgcccgtgttcgtagtggcggaagaggattttcactttgttcaggacgaagcatacgacgcagcacagtttctggctacttccgctggaaaccagcaggcactgaactttacacgtttcctggatcagtcagggccacccagcggggacgttaatagcctggacaaaaaacttgtgttggccttcaggcacttaaagctccccactgagtggaacgtccttggcactgatcagtccctgcacgacgccgggccccgggaaaccctgatgcatttcgcggtgcggctgggcctcctccgcctgacatggtttttgctccagaagcccggcgggaggggggcattgtcaattcataatcaggagggcgcaaccccggtgtccctggccctggagcgcggctaccataagctgcaccagctcctgaccgaagaaaacgccggggaaccagactcatggagctccttatcgtacgaaatcccgtacggggactgctcagtgaggcaccatcgggagctggatatttatactctcacttcggaatctgattcacaccacgaacatccattccccggggatggatgtaccggcccaatcttcaagcttatgaacatccagcagcagctaatgaaaacaaacctgaagcaaatggacagcctcatgcccctcatgatgaccgcacaggacccaagcagcgctcccgagaccgacgggcagtttctgccctgcgccccggagcccactgaccctcaaaggctgtcttcctccgaggagaccgaatctacccaatgctgccccggttcaccagtcgcacaaaccgaaagtccatgcgatctcagcagcattgtcgaggaggaaaatacagaccggagctgccgcaagaaaaataagggtgtcgaaagaaagggggaagaggtagagccagcccctattgtcgacagtgggaccgttagcgatcaggattcatgtctgcagtcgctcccggactgtggcgtgaaaggcacagagggtctatcctcctgcggtaaccggaacgaggagacgggtacaaagtcaagcggaatgcctaccgatcaggaaagcttgtcgagcggggacgcggtcctgcaacgggatctggttatggagcccggtaccgcccagtattcctccggcggtgagctgggcggaatcagcaccaccaatgtctctacacctgacaccgccggtgaaatggaacacggattgatgaatcccgatgccacagtgtggaagaatgttctccagggtggagagagcaccaaagaaagattcgaaaattctaatattgggacagccggagccagcgatgttcatgttaccagcaaacctgttgacaaaatctcggtgcctaattgcgcaccagcagcgtcatccctcgatggcaataagcctgcggagtctagcttagctttctcaaatgaggaaacctcaacggaaaagaccgctgaaactgagactagcaggtcgcgtgaagaatcagcagatgcgcctgtggaccagaattctgtggtgattcccgccgctgccaaagacaaaatatccgacggactggaaccctatacccttttagcagcaggaattggtgaagccatgtctccaagcgacctggcgctgttggggctggaagaggacgtcatgcctcaccagaactcagagaccaatagttcacacgcccagtctcaaaaggggaagtcatctcctatctgtagcactactggcgacgataagctttgcgccgatagcgcctgtcagcaaaatacagtgacttcaagtggggatttggtggcgaagctgtgcgacaatatagtgtctgaatcggagtctaccactgcccggcagcctagctcacaagatcctccggatgcctctcactgcgaagacccccaggcacacacagtgacatctgatcccgtccgcgatacccaggaaagggccgatttctgcccctttaaagtggtggataacaaaggtcaacgaaaagatgtgaagctggataaacctttgaccaacatgttggaagtcgtttctcacccccaccccgtggttcctaagatggagaaggaactcgtccccgatcaagcggtaatttcagattccactttttctcttgccaactctccgggcagcgaatctgttacaaaggacgatgcactcagctttgtgccatcacaaaaggagaaagggaccgctacacctgaactgcatactgctacagactacagagatggcccagacggaaactctaacgagcctgacacacgccctctcgaggatagagccgtgggtctttctaccagcagcaccgccgctgaactccagcacggaatggggaacacgagcctgaccggactgggcggcgaacatgagggccctgcacccccggccatccctgaagctctgaacatcaagggtaacaccgacagtagtctccaatccgtgggcaaggccacactggcgctggattcagtcctgaccgaggaaggtaagctgctggtggtgagcgagagttccgcagcgcaggaacaggataaggacaaggcggttacttgctcttccatcaaagaaaatgctctgtcttctggcacacttcaggaagagcagcgaacacctccacctggacaggatacccaacaattccacgaaaaatccatttccgcagattgtgcaaaagacaaggccctacagcttagtaatagccctggagcttcctccgctttcctgaaggccgaaacagaacacaataaagaggtcgccccacaagtgagcttactgacacagggcggcgctgctcaaagcctggtgccacctggggcaagtctggccaccgagtccaggcaagaagccctaggggcagaacacaatagctcagctctgctcccttgtttgctgcctgacgggtcggacggaagcgatgctcttaactgttcccagcctagtccacttgatgtaggagtcaagaatacacaaagccagggaaagacctctgcttgtgaggtgagcggtgacgttactgtagatgttacgggtgttaacgcactacagggcatggccgagcctcggcgcgagaacatcagccacaatactcaagatatactgatacctaatgttctcctctcacaggagaaaaacgcagtgctcggattaccagtcgcactgcaggataaagcagtaacggatccacagggggtggggacccccgaaatgatccccttggattgggaaaagggtaagctggaaggggcggaccactcctgcacaatgggggatgcagaagaagcccagatagatgatgaggctcaccccgtcctgctgcagccagtggccaaagaattacctacagatatggaactctccgcacacgatgatggagcccccgccggggtgagagaagtgatgcgagcccccccctctgggcgcgagagatctacaccatcgctcccctgtatggtgagtgcacaggatgctccgttacctaagggtgccgacttgattgaggaagcagcttcccggatcgtggacgccgtcatcgaacaggtgaaagccgcgggggccttattaaccgagggggaggcgtgccacatgtcactgtccagtccggagcttggcccactgactaagggcctagaaagcgcctttacagagaaagtgtccacattccccccaggtgagagcttgccaatgggttccaccccagaggaagctacggggtctctcgcgggttgctttgcaggcagagaagaaccggagaaaatcattctgcccgttcagggacctgaaccagcggccgagatgccagacgtgaaggcagaagacgaggtagactttagggccagttctatttccgaggaggtggccgtcggctcaatcgccgcaactcttaagatgaaacagggtccgatgactcaagcaatcaaccgagagaactggtgcacaatcgaaccgtgccctgatgccgcttcccttctcgcctctaaacagtcccccgagtgcgaaaattttctggatgtgggtctcggccgggagtgcacctccaagcaaggcgtgttaaagcgtgaaagtggatccgactcggacctgtttcatagcccctctgatgatatggacagtattatcttccctaaaccagaggaagagcacttggcatgcgacatcactggttcatcctcaagcaccgacgatactgctagcctcgatagacacagcagccacggcagcgatgtctctctctcccagatacttaagccaaatagatccagggaccggcagtctctggatgggttctattcacatggcatgggtgccgagggaagggaatctgaaagtgaaccagccgatcctggagacgtcgaggaggaggaaatggactccattaccgaagttccagccaattgtagtgtgttaagaagcagcatgaggtcccttagcccttttcgtcgccacagctggggacccgggaagaacgccgcttccgatgcagagatgaaccatagaagcagtatgagagttctgggcgacgtcgtgaggcgtccgccaatccataggcggtccttttcccttgaaggactgactggcggcgcaggcgttgggaacaagccttcgagcagtctggaagtcagttcggccaatgccgaggagctgcgccaccccttctccggagaagagagggtggactcgctggtttcactgtccgaagaagatctggagtccgatcagcgggaacaccgcatgttcgatcaacagatctgtcaccgtagcaagcagcaagggtttaattattgtacttctgcgatctcttctcccctgacgaagagtatatctctgatgacaatctcccatccgggtctcgacaactccagaccattccacagtaccttccataatactagcgcgaatttgaccgagagcattacggaggaaaactacaatttcctgccccactcacctagtaaaaaagattccgaatggaagtcggggactaaagtgtcccgcacgtttagctacatcaagaataaaatgagttccagcaagaagtcaaaggaaaaggagaaggagaaagacaagattaaagaaaaggagaaagacagcaaggacaaggagaaagacaaaaagacggtcaacggtcacaccttcagtagcatccccgtggtgggacctatttcctgttcgcaatgtatgaaaccatttacgaacaaggatgcatatacttgcgcgaactgctcagcttttgttcacaagggctgccgggagtctttggccagctgcgccaaggtgaagatgaagcagcccaaagggagcctgcaagcccacgatacttcctctttacccactgtcatcatgagaaacaagccttctcaacctaaagagcgacccaggtcggccgtgctgttggtcgacgaaacagctacaacgcctatcttcgcgaaccgccggtcacagcaatcagttagcctatcaaaatctgtgagcattcaaaacattactggagtgggtaatgacgagaatatgagcaacacgtggaaattcctgtctcattccactgactcacttaataaaattagcaaggtgaacgagagtaccgaaagcctgaccgacgagggggtcggcaccgacatgaacgaagggcagttgctaggtgactttgagatcgaaagcaaacagttagaggccgaatcgtggtccaggatcattgattccaagttccttaaacagcagaagaaagacgtcgtgaaaaggcaggaggttatttatgagcttatgcagaccgaatttcatcatgtccgcaccctcaagatcatgtctggggtctacagtcaggggatgatggccgaccttctttttgaacagcaaatggtggagaaattgtttccttgtcttgatgaactgattagtatccatagccagttcttccagcgaattctggaaaggaagaaagagtccctggtcgataagtctgaaaagaatttcctgatcaaacgtattggggacgtgttggtcaatcagttcagcggcgaaaatgccgagagactgaaaaagacatatggaaagttttgcggtcagcataatcaatctgtgaactactttaaggacttatacgccaaagacaagcgcttccaagcttttgttaagaaaaaaatgtcttccagcgtggtcaggcgactgggcattcctgagtgtattctgctggtgacacaaagaatcactaaatacccagtgttattccagcggatcctgcagtgcacaaaggacaacgaggtggagcaggaggatctggcgcagtctctctccctcgtcaaagacgtaattggcgccgtagacagcaaagtcgcatcctacgagaagaaagtccggttgaacgagatctataccaaaactgactccaagtcaatcatgagaatgaaaagtgggcagatgttcgccaaggaggatctgaaaaggaaaaaactggtcagggacgggtcagtattcctgaaaaacgcagccggccgactgaaagaggtccaggcagtgcttcttacagatattctggtgtttctgcaggagaaggatcagaaatacatttttgccagtctggatcagaaatccactgtcatatctttgaagaagttgatcgtccgagaggtcgcccatgaggagaaggggctcttcctgatcagcatgggtatgacagatcccgagatggtggaggtgcacgcttcaagtaaagaggagcgtaactcatggattcagattatccaggataccatcaatactctgaacagagacgaagatgagggtatcccatcggagaacgaagaagagaaaaagatgctcgatacgagggctagagagctcaaagagcagcttcatcagaaagaccaaaaaatcctcctgttactcgaagaaaaagagatgatctttcgcgacatggcagagtgcagtactccactgcctgaagactgtagtccaactcactctccaagggttctgtttcgttccaataccgaagaggccctgaaggggggtcctctgatgaaatctgcgatcaacgaagtcgaaattctgcagggccttgtcagcggcaacctgggtggcacactcggccccacagtgtcttctcccatcgaacaggatgtggtgggccccgtgtcactacctaggcgagctgaaacatttggtgggttcgactcgcaccagatgaatgccagtaagggtggcgagaaggaggaaggggatgatggacaagacctgagaagaactgaatccgacagcgggctgaaaaaggggggaaacgctaacctggtctttatgctgaagcggaatagcgagcaggtggtacagtcggtggtgcatttgtacgagctgctatcagccctgcagggagtggtccttcagcaggatagctacattgaggatcagaaactcgttttgtcggaaagggctttgacaaggtccctgtctagaccgagttccttaatcgaacaggagaagcagaggagcctggagaagcagcgtcaggacttggctaacctgcagaagcagcaggcacagtacctggaagagaagcgtcgacgtgagagagagtgggaagcccgggaaagagaactgcgcgaaagggaagctctgctagcccagcgggaagaggaggtccaacagggccagcaggatttggaaaaggaaagggaagagttacagcagaaaaaagggacttatcaatacgaccttgagcggctgcgagccgcccagaagcagctggaaagggagcaggaacagctgaggcgggaggccgaacgactctcccagcgacagacagagcgggacctgtgtcaggtgtcccatccacacacgaagttgatgcgcattccctccttcttcccatctccagaggaacccccttccccgtccgctccatctatcgccaaaagcggctcactggattcagaactgtccgtgtccccaaaacggaatagcatttcccgcacacataaagacaagggcccttttcacatcctttctagtacctcccagacaaataagggaccagagggccagagccaagctcccgctagcacctcagcctctacccgattgttcggcttgaccaagccgaaagagaagaaagaaaaaaagaaaaagaataaaacatcgcgaagccagcccggggacggtcctgcgtccgaggtttctgcagaaggcgaggagattttctgctag

SEQ ID NO: 177470 - DNA, 1245 bp, Artificial Sequence
  Description of Artificial Sequence: Synthetic coding sequence
atgagcaacacctggaagttcctgagccacagcaccgacagcctgaataaaataagcaaggtcaatgagagcaccgaatccttgacagatgaggggacagacatgaacgagggccagctgctgggagattttgaaatcgaaagtaagcagcttgaggctgaaagctggtctcgaatcatcgactccaaatttctgaaacagcagaaaaaggacgtggtgaagaggcaagaggtcatttacgagctcatgcaaacggaattccaccatgtccgtacactgaagattatgagcggcgtatacagccaaggcatgatggccgatttgctgtttgagcagcagatggttgagaagctgtttccgtgtctcgacgagctgatctccatccatagccagttctttcagcggatcttggagcgaaagaaagagtcattggttgataaaagcgagaagaatttcctcattaaacggatcggggatgtgttggtgaatcagttctccggcgagaatgccgagagactgaagaagacatatggtaaattttgcggccagcacaaccagagtgtgaactactttaaagatctgtatgccaaagataagagatttcaggcattcgtgaaaaagaagatgtcttccagcgtggtgcggaggttgggaattccagaatgtattctgctggtcacccaacgcattaccaagtacccagtgctctttcagaggattttgcagtgcactaaggataatgaggtcgagcaggaggaccttgcccagtccttatcactcgtcaaagacgtaatcggcgccgtggactcaaaagtcgcttcttatgaaaagaaggtccgacttaatgaaatatacacaaagactgacagcaaatctatcatgcgtatgaagtccggacaaatgttcgcaaaggaggacctgaagaggaaaaagttagtgagagacgggtctgtgtttctcaaaaacgcagcgggccgcttgaaagaggtccaagcagtgctgctgacggatatcctggtcttcttgcaagagaaggatcaaaaatacatttttgcttccttggaccagaagagtacagtcatctccttaaagaaattaatcgtgcgggaagtagcccacgaggaaaaaggattgtttttgatctccatggggatgaccgacccggaaatggtggaagtccacgctagttctaaagaggagcgcaattcctggattcagatcattcaggacacgataaacacttag

SEQ ID NO: 177471 - DNA, 1158 bp, Artificial Sequence
  Description of Artificial Sequence: Synthetic coding sequence
atgtacgagcggcacaagcggcggtacagcctgtgcgacatcagcaaagttgatcgtaccgtggacgttgtcctgctgaagatcaaccgcgagaactggtgcactatcgagccctgccccgacgcagcttctctgctcgcctccaaacagagcccggagtgtgaaaatttcctggatgtcgggcttgggcgcgagtgtactagcaagcaaggcgttctcaaaagggaaagcggttccgattccgacctcttccattcaccaagcgatgacatggactccatcatatttcctaagccagaggaagaacatcttgcttgcgatattaccgggtctagctcgagtaccgacgacacagcctccctggaccggcacagcagccacggctccgatgtgtctctctcccaaatcctaaagcccaaccgcagcagagatcggcaatctttggacggcttctattcacatgggatgggggctgaagggagggagtcagaaagcgaaccagcagaccctggggatgtggaggaggaagagatggattcaattaccgaagtgccggccaactgtagcgtgctgaggagcagcatgaggtcgctatctcctttccgtcgccattcctggggaccgggcaagaatgcggcaagtgatgccgagatgaatcataggagcttctccctcgaagggctcaccggaggagcaggggtaggaaacaaaccctcttcttcccttgaagtgagctcggcgaacgcagaagagctcagacacccattcagtggggaggagcgggtagacagtttggtctcccttagtgaggaagacttggagagtgaccaaagagaacaccgcatgttcgaccagcagatctgtcaccggagcaagcagcagggcttcaattattgcactagtgcaatttcatctcccttgaccaaatctatcagtctgatgacaatttcccatcctggtcttgataatagcaggcccttccactcaacttttcataatacatctgctaatctgaccgagtccatcacagaggaaaactacaattttttgcctcactctccctctaaaaaggattccgaatggaagtccggaaccaaagtctcccggacatttagctatattaagaacaagatgtcttcaagcaaaaaaagtaaatag

SEQ ID NO: 177472 - DNA, 8379 bp, Artificial Sequence
  Description of Artificial Sequence: Synthetic coding sequence
aagctgctggagaagcagccccccatcgagggcgactgcgtggtgacagtccttctggctgaggaggataaggctgaggatgacgtcgtgttttacctggtctttctcgggtcaacccttcgacactgcaccagcacgaggaaggtctctagtgacactctggagaccatagctcctggtcatgactgttgtgagacggtcaaggtccaactctgtgcctctaaggaaggcctcccagtctttgtcgtggctgaagaggacttccacttcgtgcaggacgaagcctacgacgccgcccagtttctagctaccagcgccgggaatcagcaggcactgaattttacccgatttctggatcagagcggtcctccatcaggtgacgtaaattctctggataagaaactagtgttggccttcaggcatttgaaactcccaactgagtggaatgtgctaggcacagaccaatctctgcacgacgctggccctcgggagacgctgatgcacttcgctgtgcgtttgggacttctcaggctcacatggtttctgctccagaaaccaggcggaagaggcgcactgtcaattcataatcaggaaggcgccacacctgtttctttggcccttgaaaggggatatcacaagcttcatcagctactaaccgaggaaaacgctggcgagccggattcctggtcctcactatcttatgagatcccatacggcgattgcagcgtgaggcaccaccgggaactcgacatctacactcttacttccgaatcggattctcaccacgagcacccattcccgggggacggttgcacaggaccaatttttaagcttatgaatatccaacagcaactcatgaagactaatcttaaacagatggattcccttatgcccctgatgatgaccgcccaggacccttcctccgctcctgagaccgatggccagttcctgccatgcgctcccgagcccaccgacccccagcggttgtctagtagcgaagaaaccgagtcgacgcagtgttgcccagggagtcctgttgcacagaccgagtcaccgtgtgacctgtctagcattgtcgaggaagagaacaccgatcgcagttgccggaagaagaacaaaggagttgaacgaaagggtgaagaagttgaaccagcccccatcgtggactctggcaccgtctcagatcaggattcctgtctccagagtttgcctgattgtggcgttaaaggcacagaaggcctctcctcctgtgggaaccgtaatgaggagacggggactaagtcctcaggaatgcctactgaccaggagtccttgtccagcggggatgccgttctgcagcgggatttagtcatggaacccggcactgcccaatatagtagtggcggtgagctaggcggtatctctacgactaacgtgagtacacccgacactgccggcgaaatggaacatggattaatgaacccagatgccaccgtgtggaagaatgtgctacagggtggggagtcaacaaaggaaaggttcgagaatagcaatattggaacggccggcgctagcgatgtgcatgtgacgagtaaaccggtagataaaattagtgtccccaactgcgccccagctgcgtcttcgctggacgggaacaaaccagccgagagcagcctcgctttctctaatgaagagacatctactgagaaaacggctgagaccgagactagccgctcccgcgaggagtcggctgatgcccccgtggaccagaactcggttgtgatccccgcagctgctaaggacaaaatctccgacggcctggaaccatatactcttctagctgctggcatcggcgaggcgatgtcgcctagtgatttggccttgctggggctcgaagaggatgtaatgccacatcagaattcagaaacaaatagttcccacgctcagtcgcaaaaagggaaaagctcgcctatctgttctactaccggagacgataagttatgcgccgacagcgcgtgtcaacagaacactgttacgagctctggcgacctggtggccaagctctgtgacaacattgtgtcagaatcagaatctaccacggcacgccagccaagctctcaggaccctcccgatgcctcacattgtgaggatcctcaggctcacacggtgacctctgacccagttcgggacacgcaagagagggctgatttttgtccgttcaaggtcgtggacaacaaagggcagagaaaagacgtgaaactggataaacctttgacgaatatgcttgaagttgtaagccatccccatcctgtagtgcctaaaatggaaaaggaactggtacccgatcaggctgtcattagtgactctactttctccctggccaactccccaggctctgagtcagtgaccaaagacgatgccttgtcctttgtcccctcccagaaggaaaagggtacggccacacccgaattacatacggcaaccgactatagagacggcccagatgggaattctaatgagcctgataccagacccctggaagacagagcagtgggccttagtactagctcaactgccgccgaactccagcatgggatgggtaacacaagcctgactggcctcggcggtgagcatgagggacctgcaccccccgccattcccgaggccctgaatattaaaggcaatacagatagtagtctgcagtcagtgggcaaggctacgcttgccttggactctgtgctgacggaggaaggcaaactactggtggtgtcagagagctcggccgcccaagaacaggataaggacaaggcagtgacatgcagcagcataaaagagaatgccttatccagcggaaccttgcaggaggaacaacggacacccccacccggccaggacacacagcagtttcacgaaaaaagcatcagcgccgattgcgcaaaggataaagccctgcaactgtcaaattcccccggagcttctagtgcgttcctgaaggcggaaacggagcacaacaaggaagtcgccccacaggtcagcctactcacgcagggtggagcagctcagtccctggtgccacctggagcgtcactggctactgagtcaaggcaggaggccctgggggccgagcataacagttccgccctccttccgtgcctcttgcccgacggttccgatggctccgatgctctgaactgctctcagccatcgcccctggatgtcggagtgaagaatacacagtctcagggaaagacctccgcttgtgaggtaagcggggacgtaacagttgacgtcactggcgtgaatgcccttcaggggatggcagaaccgcgtagggagaatattagtcacaacacacaggatatattaatacctaatgttcttctctcccaggagaaaaatgccgttctaggactgccagtcgcactgcaggataaagccgttactgatccccaaggcgttggcacgcctgagatgattccgctggactgggaaaagggcaaactggaaggtgcagaccactcctgcactatgggggacgcagaggaggcccagattgatgatgaggcccatcctgtcctgctgcaacccgtagcaaaagagctccccaccgatatggagctttcggctcacgatgacggggcccccgctggggtgagggaggtcatgcgcgctcccccatcagggcgcgagcgtagcacccctagtcttccatgcatggtgagcgctcaggatgcacccctcccaaagggcgctgacttgattgaggaagcggcctctagaattgtcgatgccgtgatcgagcaggtcaaagctgctggagcacttctgaccgagggcgaggcctgccatatgtccttgagctctcccgagcttgggccgctgacgaagggcctggaaagtgccttcactgagaaggtgagcacgttccctcctggtgagagcctgcctatgggatctactcccgaggaagcgactggctcactggccggctgctttgctggccgcgaggagcctgaaaaaatcatattacctgtccaggggcctgagcctgctgctgaaatgcccgatgtgaaagcagaggatgaggttgattttcgcgcctcttccataagtgaggaggtcgccgtcggttcaattgccgcaaccctgaaaatgaaacagggacccatgacgcaggccatcaacagggaaaattggtgcacaattgaaccctgtcctgacgctgcttccctcctcgcttccaaacagtcaccagagtgcgaaaatttcctcgacgtgggtctgggaagggagtgtactagtaaacaaggcgtgcttaagagggagtcaggtagcgattccgacttgtttcattctccctcagacgacatggactccattatatttcccaaacccgaggaagagcacctcgcctgtgatataactggcagttcatcctccactgatgatacagcctccctcgaccgccattcaagccatgggagcgacgtcagtctctctcagatactcaagcctaatcggtcacgggatcgccagtcactggacgggttttactcacatggcatgggggccgagggccgagaaagtgagagtgaacctgccgaccctggggacgtcgaggaagaggagatggatagcattacggaggtgcctgccaactgcagtgtgcttcgttccagtatgcgatcactctctccctttcgccggcacagctgggggccaggcaaaaacgctgcctccgacgctgagatgaaccatagaagcttttctctggaagggcttacagggggagctggagtcgggaacaagcccagcagcagcctagaggtgagctcagcaaatgcggaggagctcaggcatcctttttcaggagaggagcgggtagactccctggtgtcattaagcgaagaggatctggagagcgaccagcgtgagcaccggatgtttgaccagcaaatctgtcatcgcagcaagcagcagggatttaattattgtacgtcagccattagttcgcctctgacgaaaagtatttcactgatgactattagtcatcctgggctggacaactcccgcccctttcacagtacttttcacaacactagcgccaatctcacagagagtatcactgaagagaactacaatttcctgccacacagcccctcgaagaaagactcagagtggaagtccggaactaaggtctccagaacgttctcttatatcaaaaacaagatgtctagttcaaagaagagcaaggaaaaagaaaaggaaaaagacaagataaaagagaaagagaaagactcaaaggataaagaaaaagataagaagactgtaaatggccacactttctcttccatccctgttgttggtcctatcagctgttcacaatgtatgaaaccatttactaacaaagatgcttacacttgtgccaattgcagtgccttcgtgcataagggttgtagagaatccttggcctcttgtgccaaagtcaaaatgaaacagcctaaaggctcactgcaggcccacgacacttccagtctgcccacggtcattatgcgaaataaaccttctcaaccaaaggagaggccacgctctgcggttctgctggtcgacgaaacagctacaacacccatcttcgcgaatcggcggagtcagcagtcggtatccctgtcaaagtcagtcagcatccagaatattactggggtgggaaatgatgagaatatgtctaacacgtggaagttcctctcccatagcaccgattcactgaacaagatctctaaagtgaacgaaagtactgaatccttaactgatgaagggactgatatgaatgagggccagctcctcggagattttgaaattgagagcaagcagctggaggctgaatcatggtcgcggatcattgattctaaatttcttaagcagcagaagaaggatgtcgttaagagacaggaggtgatctacgaactgatgcagactgagttccatcacgtgcgaacccttaagataatgagtggcgtttactcacagggtatgatggctgacctgctatttgagcagcaaatggtagaaaagctattcccatgtcttgacgagctcatcagtatccacagtcaattttttcagcgcatcctcgagaggaagaaggagtctcttgtggacaagtctgaaaaaaactttctgataaagcgtattggggacgtgctggtgaatcaattttcgggagagaatgctgagagactcaaaaagacgtatgggaaattctgcggccaacataaccagagcgtaaactattttaaggacctatatgctaaagataaaaggtttcaagcgtttgttaagaagaagatgagctcttccgtggtgcgccgcctggggatcccagagtgtatactgctcgtcacccagcgtatcacaaaataccctgtccttttccagagaatactccagtgcactaaggacaatgaagtggaacaagaggacctggcacagtcccttagcctagttaaggacgtaattggagccgtggattcaaaagttgcaagctatgagaaaaaggtgcggctgaatgagatctacactaaaaccgacagcaaaagtatcatgcggatgaaatccggacagatgttcgccaaagaggatcttaaacgaaaaaagctggttcgggatggatccgtgttcctcaaaaatgctgcgggccgcctgaaggaggtgcaggcggtcctgctcacagatatcctggtgtttctccaggagaaagatcagaagtatattttcgccagcctggaccagaagtcaactgtaataagtttgaagaagctcattgtgagggaggtagctcatgaagagaaaggcttattcttaataagtatgggtatgacagatccagagatggtggaagttcacgctagctccaaggaagaacggaatagctggattcagataatccaagacaccataaataccctaaaccgcgacgaggacgaaggcattccatccgagaatgaggaggagaagaagatgctggacacacgcgcgagagagctgaaggagcagctgcaccagaaggatcagaagatcctccttctgctagaggagaaagagatgatatttcgggacatggcagagtgcagtaccccgttgccggaggattgttccccaacgcactctccaagggtcttgtttcgatcaaatacagaggaagccttgaaaggaggccccctgatgaaatcagctattaatgaggtcgagatccttcagggcctcgtctccggaaatctgggcgggacacttggacctactgtgtcttcacctatcgagcaggatgtagtaggtcctgtgtccttgccaagacgagccgagacattcgggggatttgattctcaccagatgaacgcaagcaagggtggcgagaaagaagagggcgatgatggtcaggatctacggcgaacagaatctgacagcgggctgaaaaaaggaggaaacgctaatctcgtattcatgctgaagcgcaattctgaacaggtcgtccagagtgtggtacacctttatgaactcctttctgctctccagggcgttgtgctacagcaggatagctacatcgaggaccaaaagctggtcctaagcgagcgggcactcactcgctcactttcgcgaccttctagcctgatcgaacaggaaaaacagagatccttggaaaaacagagacaggatctcgccaacctgcagaagcagcaagcacagtacttggaggagaaacgcaggcgagaaagagaatgggaggctcgtgagagagagctcagagaacgtgaagctctcctggctcagcgcgaagaggaagtacaacaaggtcagcaagacttagagaaagagagagaagaattgcagcagaagaaagggacttaccaatacgatctggagaggttgagagcagcacagaagcagctggaaagggagcaggaacagctccggagagaggccgaacgcctgagccagaggcaaacagaacgtgatttgtgtcaggtgagtcatccgcacacaaagctaatgagaataccttcgttcttcccctcacccgaggaacccccctctccaagcgccccttctattgcaaaatcaggcagcctggactccgaactgagtgtgtctcctaagcgaaatagtatctcaagaacgcataaggacaagggaccctttcacattctctcctctacctctcaaaccaacaaagggcccgaaggccagtcacaggcccctgcatcaacgtccgcctcaacccgattatttggactgaccaagcccaaggagaaaaaggagaagaagaagaaaaataagacctctcgatcacagccaggcgacggtccagcatcagaggtttccgccgaaggggaagagattttttgttag

SEQ ID NO: 177473 - DNA, 5238 bp, Artificial Sequence
  Description of Artificial Sequence: Synthetic coding sequence
atgaagctgaacccccagcaggcccccctgtacggcgactgcgtggtaaccgttcttttggcagaggaagacaaagccgaagacgacgttgtcttttatctggtgtttctcgggtctaccctccggcactgcacatcaactaggaaggtgtcctccgatacactcgaaactattgctccaggccacgactgctgtgaaactgtgaaagtgcagctgtgcgcatccaaagaaggccttccggtttttgtggttgccgaggaggatttccattttgtgcaggacgaggcctacgacgctgcgcagttcctagcaacatccgcaggcaaccagcaggctctcaacttcacacgatttctagatcagtccgggcctccctcaggagatgtaaacagtttggataagaaactggtgctggctttcaggcaccttaaacttcctacagaatggaatgtgctggggaccgatcagtccttgcacgatgctggacctcgtgaaaccctgatgcacttcgctgttcgtctgggattgctcaggctcacctggttcctgctacagaagcctggaggcaggggcgcgctgtcaattcacaaccaggagggggctacccccgtctctctggcactggaacgtggttaccacaaattgcaccagctgctgacagaggagaatgcgggggagcctgatagctggagcagcctgtcttacgagatcccatacggagattgctcagtgcggcaccaccgtgaactcgacatctatacactgacctcagagtccgattctcatcatgagcatccattcccaggcgacggctgtactggaccaatctttaagctgatgaacattcaacagcagctcatgaagaccaatctgaagcagatggatagcctgatgcccctgatgatgactgcccaagatccctccagcgccccggagacagacggccagtttcttccctgtgcccccgagccgacggacccccagcgactgagctcctccgaagaaactgagagtacccagtgttgtccagggtctccagtcgctcagacagagtccccctgcgacctctcctctatcgtggaggaggaaaatacagatcgctcctgtcggaagaagaataaaggcgtggaaaggaaaggcgaggaggtggagccagcaccgattgtggatagtggcaccgtctctgatcaggatagctgtctgcagtcactgccggactgcggcgtcaaagggacagaagggctctcctcttgtggcaacaggaacgaggagacgggaactaagtctagtggaatgccaaccgaccaagagagtctaagcagcggtgatgcggtgttacagcgagatcttgtgatggagccaggaaccgcacaatatagcagtggtggcgagctgggaggcatctccacaactaatgtttccacccccgacactgcgggcgagatggaacacgggctgatgaaccctgacgcgacagtttggaaaaacgtactccaaggcggcgagtcaaccaaggagaggtttgaaaacagcaacatcgggacagctggtgcatctgatgtccatgtgacaagcaagcctgtcgacaaaatcagcgtgccaaactgtgctcctgcagcctctagtctggatggcaataagccagcagaatcttctctcgccttttccaacgaagagactagtacagagaaaaccgccgagaccgagacatcccgcagcagggaggagtcggcagatgctccggttgatcagaacagcgtcgtgattccagccgctgcgaaggataagatatcagacggtttagagccgtatacccttctcgccgccggtataggcgaggctatgagtcccagcgacttggctctcctaggcttagaagaggatgtcatgccccatcaaaatagcgagaccaattcctcacatgcccagtcgcagaagggcaaatcttcgccaatttgcagtactacgggggatgacaaattatgtgcagacagcgcatgccaacaaaacaccgtgacgtcttctggcgatcttgtagccaaactctgcgataacatcgtctcggaatctgagtcaaccactgctagacagcctagctcacaagatcccccagatgcaagccattgtgaagacccacaggctcataccgtcacctccgaccccgtcagggacacacaggaacgagccgatttctgcccatttaaagtagtagacaacaagggtcaacggaaggacgtgaaactggataaacccctcaccaacatgctggaggttgtcagccacccccaccctgtggtgcccaaaatggaaaaagaactcgtacccgaccaggccgtgatctcagactccactttctccctggctaactcacccggatccgagagtgtgacgaaagacgatgcactaagctttgtgccttcacagaaagagaaaggtaccgcaacacctgaattgcacaccgcaacagactaccgggacgggcctgatgggaatagcaatgagcccgatacaagaccgctggaagacagggcagttggtttgagtacgtcttccacagcggccgagcttcagcacggtatggggaacacctctctgacggggctcggaggggaacatgagggccctgctccccccgccatccctgaagctcttaacatcaaaggtaatacagactcatccctgcagtccgtcggaaaggcaacacttgccctcgactccgtgctcaccgaggaggggaagcttctggtagtgtcagaatcgtccgccgcgcaggagcaggacaaagataaagcggtcacgtgctcttctattaaggagaacgcattgagctccggcacactccaggaggagcaacgtacacccccccccggacaagacacccaacagtttcacgaaaagtccatctctgccgattgtgccaaggacaaagcccttcagcttagtaattctcccggagcttcttctgctttcctgaaggccgagactgaacacaacaaggaagttgctcctcaggtgagcctgttgacccaggggggagcggctcagtctttagtgccacccggtgcgtccttggcgacggaatcgcgacaagaagccctgggcgcggaacataatagctcagccctcttaccttgcctgctccctgatggatcagatggcagcgatgcgctgaattgtagccagccatctcccctagatgtcggggtgaagaatacccagagtcagggaaagacctctgcatgtgaggtgagcggcgacgtcacggtcgatgtgaccggtgtgaatgcactgcagggtatggctgagcctcggcgggagaacatcagccataacacccaggacatccttattccaaacgttctgctctcccaggaaaaaaatgctgtgctcggcctgccggtcgcattacaggacaaggcggtcaccgatcctcagggtgtcggcacccctgagatgatcccactggactgggaaaaaggtaagctcgagggggcggatcacagttgtaccatgggagacgccgaggaagctcagatcgacgatgaagctcatcccgtgcttctacagccggttgctaaagaacttccaacagatatggagctatccgctcacgacgacggcgctcccgccggggtgagagaggttatgcgggcaccgccttcaggcagggaaaggtcaaccccatcattaccatgtatggtgagcgcccaggacgcacccctgccgaaaggcgccgatctgatcgaggaggcagcctcccgcatcgtggatgctgttatagaacaagtcaaggcagcaggagcgctgctaacagaaggcgaggcgtgtcacatgagcctgtcttcccccgaacttggcccacttacaaagggcttggagagtgctttcacagagaaggtcagtacttttccacccggggagtctttacccatgggaagcacaccggaagaggctaccgggtccttggccgggtgcttcgccggccgtgaggagcccgagaaaatcatcctgccggtacagggccctgagccagccgcggagatgccagacgtgaaggctgaggatgaagtggattttcgcgcgagcagtatcagcgaggaagtggccgtgggctccattgctgcaaccctgaaaatgaagcagggccctatgacgcaggcaatcaatagggaaaattggtgcactatcgagccatgcccggacgcagcatcactattggcctcaaaacagagtcccgagtgcgagaacttcctggacgtcggtctgggccgcgagtgtacgtctaaacagggcgtcctcaagcgagaatcaggcagtgatagcgaccttttccacagtccttccgatgacatggattcaattatcttccctaaacctgaggaggaacatctagcttgtgacatcaccgggtccagctcctctacagacgacactgcttctctggatcggcacagttcccatgggtccgacgtaagcctatctcagatcctgaaacctaataggtcccgtgatcgtcagtctttggacggcttctactcccatggaatgggcgctgaaggcagagaatcggaatccgagcccgcagatcccggtgacgtggaagaggaagagatggattccatcacggaggtgccagccaattgcagtgtgttgaggtcgtcgatgcgttccctgtccccctttcgcaggcactcgtgggggcctgggaagaacgctgcatctgacgctgagatgaatcatcgtagcttctccctcgaagggctcactggcggagcaggcgtcggtaacaaaccctcatcttcgctggaggtcagcagcgccaatgctgaggagctaagacaccccttctccggggaagagcgggttgactctttggtctctctcagcgaagaagacctggaaagcgaccagagagaacataggatgttcgatcagcagatttgtcatcgcagcaagcagcagggatttaattactgcaccagtgcaatctcctcccctttaactaagtccattagcctgatgacaatctcacatcctgggttagataattcaagaccgttccatagcacatttcacaacacaagcgctaacctgactgaaagtatcacagaggagaattacaatttcctgccgcactccccctcaaagaaggacagtgagtggaagtctggaaccaaagtgtcacgcacttttagctacattaagaataagatgtctagcagcaagaaatcaaagtag

SEQ ID NO: 177474 - DNA, 828 bp, Artificial Sequence
  Description of Artificial Sequence: Synthetic coding sequence
cccagcgacgacatggacagcatcatcttccccaagcccgaggaggagcatttagcttgtgacatcacaggatcctcaagcagcacggatgacacggcttctttggacagacattcttctcacggttctgacgtgagtctgagccagattcttaagcctaataggtcaagagacagacaatccttagatggcttttactctcatggaatgggagcagaagggcgggagtccgaatctgaacccgcagatcccggcgatgtggaagaagaggagatggactctattactgaggttcccgccaactgtagcgtcctcagatcctccatgcggtccctgagccccttccggagacacagctgggggcctgggaagaacgctgcctctgacgccgagatgaatcatcgaagctctatgagggtgctcggagacgtggtacggcgcccccccatccataggcgcagcatgtcttggtgtccctctggagtgcagtattcagccggcttgagcgctgacttcaactatcggtcattttccctagaagggctgacaggcggggcgggcgttggaaataaaccaagtagttccctcgaggtaagctcagccaatgcagaggaactccgacatcccttctccggggaagaacgtgtggatagcctggtgtctttgagcgaggaggatctggagtcggaccaacgtgagcaccggatgttcgaccagcagatctgtcaccgctcgaagcagcaaggcttcaactactgcacctccgccatctcatcaccgttaactaaatccattagcctcatgaccatcagtcacccaggcctctag

SEQ ID NO: 177475 - DNA, 117 bp, Artificial Sequence
  Description of Artificial Sequence: Synthetic coding sequence
atgaagctgaacccccagcaggcccccctgtacggcgactgcgtggttaccgtcttgttagcagaagaggataaggccgaagacgatgtggtgttctatctggtgttcctgggctag

SEQ ID NO: 177476 - DNA, 540 bp, Artificial Sequence
  Description of Artificial Sequence: Synthetic coding sequence
atgaagctgaacccccagcaggcccccctgtacggcgactgcgtggttacggtgttgctcgctgaagaagataaggccgaagatgatgtggttttctacttggtttttctgggatcaacacttcgacattgcactagcaccagaaaagtgtcctcggatacattagagactatcgctccaggtcatgattgctgcgagacggttaaggttcagctgtgcgcctctaaggaaggacttccggtttttgtggtagctgaagaagactttcactttgttcaggacgaagcttatgatgcggcccagtttctggcaacctctgctggcaaccagcaggctctgaactttacccgatttttggaccagtcaggaccaccgagcggagatgtgaacagtttggataagaaactagttcttgcttttagacatttgaagctccccaccgagtggaatgtgctcgggacggaccaatccctgcatggcgaaaatttatatgacctgcagacccatttcaagtttgtcatctttctcctgttcttttag

SEQ ID NO: 177477 - DNA, 414 bp, Artificial Sequence
  Description of Artificial Sequence: Synthetic coding sequence
atgagcgagacccagaacagcaccagccagaaggccatggacgaggacaataaagctgcatcccagacaatgccgaatacacaagacaaaaattatgaagacgaactgactcaggtggctctggcactcgtcgaagatgtgatcaactatgctgtgaagattgtcgaggaagagagaaaccctctgaagaacatcaagtggatgactcacggcgagttcactgtcgagaagggattgaagcagattgatgagtattttagcgacgcccccatagtcgtttcctacgttggcgatcaccaggctctggtgcaccgccccggtatggtgaggtttagagaaaactggcagaaaaaccttaccgatgctaaatactccttcatggagtcctttccctttctgttcaaccgagtctag

SEQ ID NO: 177478 - DNA, 270 bp, Artificial Sequence
  Description of Artificial Sequence: Synthetic coding sequence
atgagcgagacccagaacagcaccagccagaaggccatggacgaggacaataaggccgcttcccagaccatgccaaatactcaggataaaaattacgaagacgaactgacccaggttgccctcgctttggtggaggatgttattaactatgccgtgaagatagtcgaggaagagcgaaatcccctcaagaacatcaaatggatgactcacggggagttcaccgtggaaaagggtcttaaacagattgatgaatacttttcagtgtcatag

SEQ ID NO: 177479 - DNA, 417 bp, Artificial Sequence
  Description of Artificial Sequence: Synthetic coding sequence
atgagcgagacccagaacagcaccagccagaaggccatggacgaggacaacaaggctgcatctcagactatgccaaacactcaagacaagaattatgaagacgaattaacccaggtggcactagctttagtagaagacgttataaactatgccgtcaagatcgtggaagaagagaggaacccgctcaagaacatcaaatggatgacccatggagaatttaccgtagaaaagggacttaagcagattgacgaatatttctcccccgatgctccgattgtggtatcatacgtaggggaccaccaggccctagtccatcgcccaggcatggtgcggtttcgagaaaattggcagaaaaacctcaccgacgctaagtatagtttcatggagagctttccctttttgtttaacagagtgtag

SEQ ID NO: 177480 - DNA, 414 bp, Artificial Sequence
  Description of Artificial Sequence: Synthetic coding sequence
atgagcgagacccagaacagcaccagccagaaggccatggacgaggacaataaagccgcctcacaaacaatgcctaatacgcaggacaaaaactatgaggacgaattgactcaggttgcactcgctctggttgaggacgtgatcaactacgctgtgaagattgtggaagaggaacgaaatcccctgaagaacataaagtggatgactcacggagagttcactgtagagaaaggcctcaaacagattgatgagtatttcagcgacgcgccaatcgtggttagttacgtgggggatcaccaggcactggtgcataggccagggatggtgagatttagggagaattggcagaaaaacctgactgacgccaagtattcttttatggagtcattcccattccttttcaaccgtgtctag

SEQ ID NO: 177481 - DNA, 594 bp, Artificial Sequence
  Description of Artificial Sequence: Synthetic coding sequence
atgagcgagacccagaacagcaccagccagaaggccatggacgaggataataaagcagcctcccagaccatgccaaacacacaggacaaaaactatgaggatgagttgactcaggttgctctggccctggtggaagatgtcattaattatgccgtgaagatagttgaggaggaaagaaaccccctcaagaacattaagtggatgacccacggtgagttcacagttgaaaagggtcttaaacagatcgacgaatacttctcaaaatgtgtgtccaaaaagtgttgggcccatggtgttgagtttgtggagcgaaaggatctgatacattccttcctttacatatactacgtgcattggtccataagcaccgccgatctgcccgtcgccaggatctcggccggaacttacttcacaatgaaggtatccaaaactaagcccccagacgccccaattgtggtctcatatgtgggggatcaccaggccctcgtgcaccggcctggcatggtgcggttcagagagaactggcagaagaaccttacagatgcaaagtacagttttatggagtcatttccgttcctgttcaatcgcgtgtag

SEQ ID NO: 177482 - DNA, 270 bp, Artificial Sequence
  Description of Artificial Sequence: Synthetic coding sequence
atgagcgagacccagaacagcaccagccagaaggccatggacgaggacaacaaagctgcaagccaaacaatgcctaacacccaggacaagaattacgaggacgagctgacccaggtcgcgctggccctcgtggaagatgttattaactacgccgtcaaaatagttgaggaggagcggaacccactgaaaaatattaagtggatgacccatggggagtttacagtagagaaaggtctgaagcagatagacgagtatttcagcgtttcttag

SEQ ID NO: 177483 - DNA, 2088 bp, Artificial Sequence
  Description of Artificial Sequence: Synthetic coding sequence
atggccgccgccaccatcgtgcacgacaccagcgaggccgtggagctgtgtccggcctatggattgtacctgaaacccatcaccaaaatgacgataagcgttgcgctgccacagttgaagcagccaggaaaatccatttccaattgggaggtaatggagcgactcaagggcatggtgcagaaccatcagttttcaacgttacgtattagcaagagtacaatggattttatccgctttgaaggggaagttgagaataagtccctggtgaaatcttttctggcttgcctggacggcaagaccattaagttaagtggtttctccgatattctgaaagtgcgcgccgccgaatttaaaatagatttcccaaccagacacgactgggactcctttttccgggatgcaaaggacatgaatgaaaccctgccaggcgaaaggcctgacaccattcatctggagggccttccctgtaagtggtttgcgctcaaggaatccggatccgagaaaccgtcagaagacgtcctggtgaaagtctttgagaagtttggagagattcgtaacgtggacatcccaatgctcgacccttaccgggaggagatgacaggccgcaactttcatacattctctttcggcggacatctgaactttgaggcctacgtacagtacagagaatatatggggtttatccaggctatgtctgcactgaggggaatgaagctaatgtataagggtgaggatggcaaagctgttgcttgcaatatcaaagttagttttgactctactaaacatctgtcagacgccagcatcaaaaagagacagcttgaaagacagaaattgcaggagcttgaacaacagagggaggagcagaagcgaagagagaaggaagccgaagagcgacagcgtgctgaggaaagaaagcagaaagaactggaggagctggaaagagagcgcaaacgggaagagaaactgcgaaaaagagagcagaagcagcgggatcgagaactccgtagaaaccagaaaaagttggagaagctgcaggctgaagagcagaagcagctacaagagaaaatcaaattagaagaaagaaagcttctgcttgctcagcgcaatctgcagagcatccgtcttatcgctgaattattgtccagggcgaaagccgttaagctgcgcgagcaagagcaaaaagaagaaaagctgaggcttcagcaacaggaagagcggcgtagactgcaggaagcagaacttcgcagggtggaagaggaaaaggagcgtgctctgggcttgcagcgaaaggagagggagttgagagagcgcctgctgagcattttgctgtccaagaagcctgatgacagccacacacatgacgagctgggcgttgcccacgccgatctcctgcagcctgtactcgacatactacagaccgtatcctccggttgtgtttccgcaaccaccctgcacccgctaggcggccagccacccgcgggggccccaaaggagtcacccgcgcatccagaagcagacggagctcctaagtccgtgaatggatcagttgccgaagaggcaccctgcaaggaggtccagtctagttgtcgcgtagtacccgaggatgggagtcctgaaaagcgctgtccagggggagtgctgagttgtatccccgataacaaccagcagcccaaaggaatcccggcttgcgaacagaatgtaagcagaaaagatacccgcagtgagcaggataaatgcaatcgagagccttcaaagggccgaggtcgcgctactggcgacggcctggccgaccgccacaaacgcgagcgaagccgggcccgtcgcgcttcctcccgcgaagacggccggccccgcaaggagcgccgcccccacaaaaaacacgcctacaaggacgactccccaaggagaagatcaactagcccagatcacacccgatcgcgtaggagtcattccaaagataggcatcgacgggaacggagccgggagcggcgcggttccgcaagtagaaaacattcaagacataggaggaggtccgaacgatctcggtctcgttccccatcccggcacagatcaacttggaataggtag

SEQ ID NO: 177484 - DNA, 1341 bp, Artificial Sequence
  Description of Artificial Sequence: Synthetic coding sequence
atggccgccgccaccatcgtgcacgacaccagcgaggccgtggagctgtgtcctgcgtatgggctgtacctgaaacctatcaccaagatgacaattagtgttgctttgcctcaactgaagcagcccggaaaatccatctctaattgggaggtgatggaacggttgaagggaatggtgcagaatcaccaattcagtactttgcgcatcagcaagtctacaatggattttatacgctttgaaggagaagtcgagaacaagtccctggtcaagagcttcctagcttgtttagacgggaaaactattaaactctccggattcagcgatatcctaaaagtccgggcagccgaattcaagattgatttcccgactcggcacgactgggactcattctttcgcgatgccaaggacatgaatgagacccttcctggcgagagacccgacactattcatctggaagggctgccatgcaagtggttcgcccttaaggagagcgggtctgaaaagccaagcgaagacgtgctggtcaaggtgtttgaaaagtttggagaaattcggaatgtcgacattccaatgctcgacccataccgggaagagatgaccggaagaaactttcacactttttcctttggcggccacctgaacttcgaggcctacgtgcagtatcgcgaatatatggggtttattcaggctatgtcagcactccgcggtatgaagctgatgtacaagggcgaagatggcaaggctgtcgcgtgcaacatcaaggtctccttcgattctactaagcacctttcagacgcaagcattaagaagcggcagctggagaggcaaaaactccaagagctcgagcagcagagagaggaacagaaaaggcgcgagaaggaagctgaagagagacagcgggccgaagagaggaagcaaaaggagctggaagaactggagagggaacggaaacgagaagaaaaattgcggaagcgcgaacagaagcagagagaccgggaattaaggcgtaaccagaagaagcttgagaaacttcaggctgaagaacagaagcagttgcaagagaagatcaagttagaggaacgaaaactgcttctcgcccaacgcaacctgcagagcattcgactgatcgcagagttgctaagtcgcgcaaaagtccccggaggcagcctgtgctcgagacagccaaggcccgggtgtccccagtgcccccccctgaaatgcggaaggcggcatggtgcagttagtccgcccgccgccgccgtggccaccaaacctgccctcatgccacgcatgactgccccatctagagagggcgtggccctggtctgtcgaagcaggtag

SEQ ID NO: 177485 - DNA, 2580 bp, Artificial Sequence
  Description of Artificial Sequence: Synthetic coding sequence
atggagatcgaggtgagcgtggccgagtgcaagagcgtgcccggcatcacatctacaccccacccaatggatcacccttctgccttctactcacctccccataacgggctattgaccgaccaccacgaatcgctagacaacgacgtggctagggaaatcagatatctcgacgaggttcttgaagcaaattgctgtgatagcgccgttgacggcacctacaacggcacctccagtccagaaccaggagccgtcgtactggtggggggactcagcccccccgtccacgaggcaacacaacccgaacctactgagcggacagccagccgccaagccccaccccacattgaactgtccaatagttcccccgacccaatggccgaggctgagagaaccaatggacacagcccatcccagcccagagacgctctgggcgactccctgcaggtccccgtgtcaccaagctccacgacctcctctcggtgctccagtcgtgatggcgaattcacacttaccacactgaagaaggaagcaaaatttgagttgcgtgcgtttcacgaagacaagaaacctagcaagttgttcgaggacgacgagcatgagaaagagcagtattgtattcggaaggtgcggcctagtgaggaaatgctagagctagagaaggaaagacgggaactgataaggagtcaggccgttaaaaagaacccaggcatcgcagcaaaatggtggaacccaccccaagagaaaaccatcgaagagcaacttgatgaggagcatctcgagtctcataaaaagtacaaggaacggaaagagcgacgtgcacaacaggagcagctactcctacagaagcagttacagcagcagcagcagcagcctccatcccagttgtgtactgctcccgccagctcacatgagagggcatcgatgatcgacaaggcaaaagaggatatcgtcacagaacagatcgacttctctgcagctaggaagcagtttcagctaatggagaattccaggcaggccgtagcgaaagggcaatccaccccacggctgttcagtattaaacccttctatcgccccctgggaagtgttaattcagataagcctctgacaaatcctaggccaccatcagtgggcggaccgcccgaggatagtggggcttcagccgccaaaggacagaagtccccaggcgcactggagactccgtcagctgctgggtcccagggaaatactgcttctcaggggaaggagggtccatacagtgagccgtccaagagaggccccctctcgaaactgtgggctgaagacggcgagttcacttctgctcgcgctgtgctgacggttgtgaaggatgacgatcatggaattttggatcagttttcccgctcagttaacgtgtccctcactcaggaggagctcgatagtgggttggacgagctcagtgtgcgatcacaggatactacagtactcgaaaccttgtcgaatgacttctccatggataatatctctgatagcggtgcatcaaacgaaacaactaacgccctccaagagaactcactggccgatttctccctgcctcagacccctcagacggataatccttccgagggtcgtggggagggcgtcagcaaaagcttcagcgaccacgggttctactctcccagcagcacattaggggactcccccctggttgatgaccctttagagtaccaggccggcctcctcgtgcagaacgccattcaacaggccatagccgagcaggtggacaaggctgttagtaaaacatcgcgggacggggccgagcagcagggaccggaagcaaccgtcgaagaggcagaggcagcggccttcgggagtgagaaaccccaaagtatgttcgaaccgccgcaggtttccagccctgtgcaggaaaagcgagatgtcctccctaagattctgcccgctgaggacagggctctgcgagaacggggccctccccagcctttgccggcggttcagcctagtggacccattaatatggaggagacccgccctgaggggagctatttttctaagtactcagaagccgccgagctgcggtcaaccgcctcgctgctagctacccaggagtctgatgtgatggtgggcccgttcaagctgcggtctaggaagcagagaactctgtcgatgattgaggaggagattagggcggctcaggaacgcgaggaggaacttaaacggcagcgacaagtgctgcaaagtactcaatctcctcgcacaaagaacgccccttccctccccagtaggacgtgctataaaaccgctccgggcaagattgaaaaggtgaaacccccgccgtcacccactaccgaggggccctctctccaacccgatctggccccggaggaagcagcagggactcagaggcccaagaatcttatgcagactctaatggaagattatgagacccataaaagtaaacgccgcgaaaggatggatgattcttccgttttagaggctactcgggtaaacagacgaaagagcgccctcgcgcttcgctgggaggcgggcatctacgctaaccaggaagaggaggataatgaatag

SEQ ID NO: 177486 - DNA, 2847 bp, Artificial Sequence
  Description of Artificial Sequence: Synthetic coding sequence
atgcggtggccccagcccggcgccgccgcccggctgccccccgagtctcccggaccccccgaatctccaggtccaccagaacgggaggcagctgccgcgcgcagatggactggagctgagccgcaggattgtgcacctgggtccggccgacccgaaaaacctccccagctgagtgaggacgatatctggctgaaatcagagggagacaactactcggccaccctactagaacccgcggcaagctcattgagtcctgaccacaaaaacatggagatcgaggtgtcagtggccgaatgcaagtcagtgccagggattacttcaacacctcatccgatggaccatccctctgccttttattcaccccctcacaatggtcttctgacagaccatcacgaatctctggataatgatgtggctagagaaatcaggtatcttgatgaggtccttgaggcgaattgctgtgatagcgccgtagacgggacctacaacgggaccagttctcccgagcctggagccgtggttctcgtgggtgggctgagccctccagtgcacgaagccacacaacctgaacctaccgaaaggacagcatctcgacaggcccccccacatattgagttgtccaactcctcccccgaccccatggctgaagctgaacgtaccaacggacacagcccatctcagccaagagatgctctaggcgacagcctacaggtgccagtctcgcccagttctacgacttctagtagatgctcatctcgagatggcgaattcaccctgactacactgaaaaaagaagcaaaattcgagcttcgggcctttcacgaagataagaaaccatctaagttgttcgaagatgatgaacacgaaaaggagcagtactgtattcggaaggtccggccatccgaagagatgctcgagctggagaaggagaggcgggagctcataagatcacaagcagtgaagaagaatccaggcatcgccgctaagtggtggaaccctccccaggaaaaaacaatagaagagcagctggatgaagaacatctggaaagccacaaaaaatacaaggaacggaaggagaggcgggcgcaacaagagcagctacttctccagaaacagctacaacaacagcaacagcagcccccctctcagctgtgtactgcccccgcatcatcgcacgaaagagccagtatgatcgacaaagccaaagaagatattgtgacagagcagattgattttagcgccgcgagaaaacagtttcagctgatggaaaactcgcggcaggcggttgcgaaagggcaatccacccctagactcttttccataaagcctttctaccggccattgggtagtgtcaactcggacaagccactcaccaatcctcgtccacccagtgtgggcggacctcccgaagattctggggcgagcgcagctaaaggacagaagtctccgggtgccctagagacaccatccgccgctggatcacaaggcaatacggcttcacagggaaaagaaggaccttatagcgagccgtctaaaagaggaccactgagcaagctgtgggctgaggatggcgagtttacttccgcacgcgcggtcttaactgtggtaaaggatgacgaccacggcatccttgatcagttttcccgaagcgttaacgtaagcctgacacaagaagaactcgatagcggtctggacgaactttcggtccgctcccaggacaccactgtgctggagaccttgtctaacgacttttcgatggacaacattagcgactccggagcatcaaacgagaccactaatgcactccaggagaatagcctcgccgactttagtctgccccagacaccccagacagacaatccatctgaaggtaggggggagggagtctctaaatccttttccgaccatggtttctacagtccatccagtacacttggggacagcccccttgttgacgatcccctggaatatcaggctggtttgctcgttcagaatgccatacagcaagctattgcggagcaagtggacaaagctgtgagtaaaactagcagggacggcgccgagcaacagggacccgaagccacagtggaggaggccgaagccgccgccttcggtagcgagaagccccagagtatgttcgaaccacctcaagtgtcttctccagtgcaggagaaaagggatgtcttgccaaagatccttcccgccgaggatcgggctctgcgagagaggggcccgccacaacccctgcctgctgtgcagccttccggaccaataaatatggaggagacaagaccagaggggagctacttcagcaagtactcggaagctgcagagctgagaagcacagcgtcacttctggctacccaggagagcgacgtgatggtgggaccttttaagctccgctctagaaagcagcgaactttgtctatgatcgaagaggagatccgcgctgcacaggaacgggaggaagagctgaaacgtcagagacaagtgctgcaaagtactcagagtccacgcacgaaaaatgcgcccagtttgccatcacgaacatgctacaaaaccgccccaggcaaaatagagaaggtgaaacccccaccttcgccaaccaccgagggaccttctctgcagccggatctagccccagaagaggccgccggaacccaacgacctaagaatctgatgcagacactgatggaggactacgagacgcacaaatccaaaaggcgtgagcgcatggacgacagcagtgtgcttgaggccacaagggtcaacagaaggaaatcagctctcgccctacgttgggaggcggggatctatgcaaaccaagaagaagaggataatgaatag

SEQ ID NO: 177487 - DNA, 3273 bp, Artificial Sequence
  Description of Artificial Sequence: Synthetic coding sequence
atggccgaggccgagctgcacaaggagcggctgcaggccatcgccgaaaaaaggaaaagacagacagagatcgaagggaagagacagcagctggacgagcagatcctcctgttacagcatagcaagtcaaaagttctgcgggagaaatggctcttgcagggcattcctgccggtactgcagaggaagaggaggcccgccgccggcagagcgaggaggatgaatttcgggtcaaacagctcgaagataacatccagagactggagcaagaaatacagactcttgaaagcgaggagagtcagatttcagctaaggagcagattatcctagagaaactcaaggaaactgagaagtctttcaaggatttccagaaaggcttttcctcaactgatggcgacgctgtaaattatatcagcagtcaactccccgaccttcctattctgtgctctaggacagccgagccaagtcccggccaagacggtacctccagggcagccggcgtaggctgggagaacgtgttactaaaggaaggggagtccgcatctaatgctacagagacctcgggacccgatatgacaatcaagaagcctccacagttgagtgaggatgacatctggctaaaaagcgaaggggataattacagtgctacccttcttgaaccggccgccagctcgctttcccctgaccacaaaaacatggagatagaggtgtctgtggctgaatgtaagtccgtgccagggattacaagcacccctcaccctatggatcacccgtcagcattctactctccaccccataacggcctcctaaccgatcatcatgagtcgttggacaacgacgtggcgagggagattagatacctcgacgaagtgctggaagcaaactgctgtgattctgccgtggatggaacctacaacggaacgagcagtcctgaacctggagctgttgtactggtcggcgggctctccccaccggttcacgaggcgacacagcctgaacccactgagcggaccgcgtcgcgccaggcgccaccacacattgaactgtctaactcctcgcccgaccctatggccgaagcggaacgcaccaatggccactccccctcacagcctcgggacgcattaggagatagcttgcaggtgccggtatccccatcctccacaacatcctcacgctgttcttcgagagacggagagttcactctcacgacattgaaaaaggaagcgaaattcgaactgagggcctttcatgaagataaaaagccaagcaagcttttcgaggatgacgaacatgaaaaggaacagtactgtattcgaaaggtaagaccgtctgaggaaatgcttgagctggagaaggaacgccgggagctcattaggtcacaggccgtaaagaaaaatccaggcatcgcagcaaagtggtggaacccgccccaggaaaagacaatcgaagagcagctagatgaggagcaccttgagagccacaaaaagtacaaggagagaaaagaaaggcgtgcacaacaagagcagctgcttctgcagaagcagttgcaacagcagcaacaacaaccacccagccagttatgtacagctcctgctagcagccacgagcgtgcgtctatgattgataaggccaaagaggatatcgtgaccgagcaaattgacttttccgctgcccggaaacagttccagctgatggagaattcaagacaggcggtcgcaaaaggccagtcaaccccccggctgttcagcattaagcctttttacaggccactcgggtcagtgaactcagataagccactgacaaacccgagaccaccctccgtcggcggtcctcctgaggatagtggcgcatccgccgctaagggccagaagtctcccggcgcattagagactccaagcgctgctggatcacaaggtaacacagcgtctcaaggcaaagaaggcccatatagcgagcccagcaaaaggggcccgctgtccaaattatgggcagaggacggggagtttacgtccgcacgcgctgtattgacagttgtgaaggacgacgaccacggcatcctcgaccaattttcccgcagcgtgaatgtgtccctcactcaggaggagctggattctggtctggacgagttaagtgtccgcagtcaggatactacagtgctggagacactgtctaatgacttttctatggataatattagcgacagcggcgcttcgaatgaaaccactaacgccctgcaggaaaacagtctggcagactttagcctcccccagacccctcaaacggacaatccaagtgagggaaggggcgagggggtgtcgaagagcttttcagaccatggattttacagtccatcttcgactctgggagacagcccactggtggatgatccactggagtatcaggccgggctgctggtgcagaacgctattcagcaggcaattgctgaacaagtggataaggctgtcagcaaaacttccagggacggcgccgagcagcagggtccagaggcaaccgtcgaagaagccgaggctgctgccttcgggagcgaaaaaccccagtctatgtttgaacctccccaggtgagtagtcccgtgcaagagaaacgcgatgtcttgcctaaaatcctacccgctgaggatcgggctttgcgggagcggggacctcctcagccgcttcccgccgtccagccaagtgggcctattaacatggaagagacgcggcccgaggggtcttactttagcaaatatagcgaggcagctgagctccgatcgaccgcttccctactggcgacgcaggaatccgacgtgatggtagggccgtttaaactccggtcccggaaacaaaggactttgagtatgattgaagaggagattcgggcggctcaggagcgagaagaggagctaaaacggcagcgccaggtcctccaatcaactcagtccccacggactaagaacgcccccagcctgccctcccgcacttgctacaagaccgcaccaggaaagatagaaaaggttaaacctcctcccagtcctactacagaaggcccttcgctgcagcctgatttggctcccgaggaagcagctggaacgcagagaccaaagaatttgatgcaaacacttatggaagattatgagacacacaagtctaaacgacgcgagaggatggatgatagtagtgtcctcgaggccacaagggtgaataggcggaagtcggccctcgcattgcgttgggaggcaggaatctatgccaatcaggaggaggaggacaacgagtag

SEQ ID NO: 177488 - DNA, 3312 bp, Artificial Sequence
  Description of Artificial Sequence: Synthetic coding sequence
atggccgaggccgagctgcacaaggagcggctgcaggccatcgccgagaaaagaaaaaggcagaccgagattgaggggaagaggcagcagctcgatgagcagatattgctcctccagcactcaaagtctaaggtgttgcgcgaaaaatggcttctacagggcattcccgccggaaccgccgaagaggaggaggctcgacggcgccagtccgaggaggacgaatttcgcgtgaaacagctggaggataatattcagcggctagagcaggagattcaaacactggaatcagaggaatctcaaatttctgctaaggaacaaattatacttgaaaaattgaaagaaaccgagaaatctttcaaggattttcagaaaggcttctcatccacagacggtgacgctgtgaactacataagttcccaactgcccgatcttccaattttatgttccaggacagcggaaccgagccctgggcaagatggaacgagccgtgcagcgggtgtgggctgggaaaacgtattgctaaaagagggtgagagtgcatccaatgcaaccgagactagcgggcctgatatgactataaaaaaacctcctcagctgtccgaggacgatatctggttgaagagtgaaggggataactactccgcaaccctgcttgagcccgccgcaagctccctgagtccagaccataaaaatatggaaatcgaggttagcgtcgccgaatgtaaatcagtacctgggattacaagtacaccccacccaatggaccaccccagtgcattctactcacctccacacaacgggttgttgactgaccaccacgagtctttggataacgacgtggcaagggagattagatacctggacgaggtccttgaggccaattgttgtgatagtgccgtcgacggcacttacaatgggacatcttcccccgaacccggagccgtcgtgctggtgggcggattgagcccacctgtgcatgaagccacccagccagaaccaaccgagcggacagcctctagacaagctccacctcatatagagttgtccaactcctcccccgatcccatggctgaggctgagagaaccaatgggcatagtccttctcagccacgggacgccctgggagactccttgcaagtgccagtctctccaagctctacgacatctagccgctgctccagccgcgacggagagttcactctgaccaccttaaagaaggaggccaaatttgaactacgagcttttcatgaagacaaaaagccctccaaactcttcgaggatgatgagcatgaaaaggaacaatactgtatacgcaaagtgagaccatccgaagagatgctggagctggagaaggagcgccgcgaactgatcagaagtcaagcggtgaaaaaaaatccgggcatcgccgccaagtggtggaatcccccccaggagaagaccattgaagagcaactggatgaagaacacttagaatctcacaaaaagtacaaggagcgaaaggagagacgggcccagcaagaacaattattgctgcagaagcaactacagcagcagcaacagcagcctccttcacagctgtgcaccgcccctgcttcatcccacgagcgcgcttccatgatagacaaggcaaaggaagatatcgtaactgaacagatcgatttcagtgccgctagaaagcagtttcaactaatggagaattctcgccaggctgttgctaagggccagtcgactcctcgcttattttccataaagcccttctatcgcccactgggatccgttaacagcgataagccgctgacaaaccctcggccaccttctgttggaggccccccagaggattctggcgcctccgccgctaagggtcagaagagccctggagcactggagaccccatccgccgcaggaagccagggcaatacagcgtcccagggcaaggaaggtccatattcagagccttccaagcggggaccactgtctaagttgtgggccgaagatggggagttcacctccgcccgggccgtattaactgtggtaaaggatgacgatcatgggattctggaccagttctcccgctccgtaaatgtttctttaactcaagaggagttggactcaggccttgacgagctatcagtccggagtcaggacactaccgtgctagagacgctctcgaacgattttagcatggataatatttcagatagcggggcctctaacgagactacaaacgcgctccaggaaaatagcctcgcagatttttctctcccacagactccccagactgacaatccgtcagaagggcgaggcgagggtgtgagtaaatcattttctgatcacggcttctacagtcccagctctaccctgggggattctccacttgttgatgacccgttggagtatcaagccggtctcctggtgcagaacgctatccagcaggccattgccgagcaggttgacaaggcagtgagtaaaacatcaagggacggtgctgagcagcagggccctgaggccacagtagaagaagccgaagccgcagccttcggctccgaaaaaccccagagcatgtttgagcctccacaggtatcctcccctgttcaggaaaagagagatgtgttaccaaagatactgccagccgaagatcgcgcactaagggaacgcggcccaccccagcccctgcccgcagtccagcctagcggcccgataaatatggaagagactcgtcccgaggggtcatatttttctaagtactctgaagccgccgaactccgctcaactgcaagcctattggcgacccaggagtccgacgtgatggtgggccctttcaagctccggagtcgcaaacagaggaccctgagcatgattgaagaagaaattcgggccgcccaagaaagggaggaagaactgaagcgtcaacggcaggtcctgcagagtacccagtctcccagaacgaaaaacgctccaagcctcccaagccgcacctgctacaagacggcacccggcaaaatagagaaggtaaagccccctccttcccctaccactgagggacctagcctccagcccgatttagcccctgaagaagccgccgggactcaacgaccaaaaaatttaatgcagactctcatggaagactacgaaacccacaaaagcaaacggcgcgaaaggatggacgattctagctatactagcaaactcctgtcttgcaaggtaacctccgaagtcctggaagcaaccagagttaaccgccgcaaatccgcactggccctgagatgggaggccggcatctacgcaaaccaggaggaagaagataatgaatag

SEQ ID NO: 177489 - DNA, 2886 bp, Artificial Sequence
  Description of Artificial Sequence: Synthetic coding sequence
atgcggtggccccagcccggcgccgccgcccggctgccccccgagagtcctggacccccagaatcccccggaccccccgaacgagaggcagccgcggcacggaggtggactggcgccgaaccgcaggactgcgcccctgggagtgggcggcccgaaaagcctccgcagctgtccgaagacgacatctggttgaagagcgagggtgataattattccgctacactgcttgagcctgctgcatcaagcctctctccggatcacaagaacatggaaatagaggttagcgttgccgagtgcaagagcgtgccaggtatcacttcaacaccccacccgatggaccacccgtccgccttctactcgccgccccacaatggactcctgaccgaccaccatgaaagcctcgacaatgatgtggcccgtgaaattcggtatctggacgaggtcttggaagccaattgctgtgacagtgctgttgacgggacttataacgggacatcttctcccgagccgggagctgttgtgctagtgggaggtctgtcccctcccgtgcacgaggcaacccagcctgaacccaccgagaggactgcatccaggcaggcccccccgcacatcgaattatcaaactctagccctgacccaatggccgaagccgagaggactaacggccattcaccatctcagccccgggatgcattgggggattctctccaggttcccgtgagcccttcaagcaccacctctagccggtgctcatctcgggatggcgaattcaccctgactactctaaaaaaagaagcaaagtttgagctgagggctttccacgaggataaaaaaccgtctaaactgttcgaggatgatgagcacgagaaggagcagtactgtattagaaaggtgagaccctctgaagagatgttggaactggagaaggagaggcgagaactcatccgctcacaggcagtgaaaaagaatccaggaatcgcagctaagtggtggaaccccccacaggagaagactatcgaggaacagctggatgaagagcatctcgagagtcacaaaaaatacaaggaacggaaggaacggcgggcccagcaagaacagttgctgctccaaaagcagctacagcagcaacagcagcagccaccctctcaactctgcaccgctcccgcatcttcacatgaacgcgcgtctatgattgacaaggctaaagaagacatcgtgaccgaacagatagatttctcagccgctcgaaagcagttccagctgatggagaattcccgccaagctgtcgccaagggtcaaagcacccccagactcttcagcatcaaacccttttataggcctctgggatctgtgaattcagacaaaccattgactaacccccggcctccatccgtgggtggacccccagaggattccggcgcctctgccgccaaaggacaaaagagtccaggcgcccttgaaaccccctccgccgcggggagccagggcaacactgcctcccaaggtaaggagggcccttacagtgaaccatccaagaggggtcctctctctaagctgtgggcagaagatggagagttcacctcggctcgagccgtgctgaccgtcgtgaaggacgatgaccatggcatcctggaccagttttcccggagcgttaacgttagtcttacacaggaggagctggacagcggcttagacgaactgagtgtgaggagtcaggacactaccgttctcgagacgctgtctaatgacttctccatggataatatcagcgactccggcgcatctaacgagacaacgaacgccttgcaggagaacagtctggcagatttttccttgcctcagaccccacagacagataatccaagtgaggggcgtggagaaggagtatcaaagagcttcagcgatcacggcttttatagtccatccagtactctgggcgattcacctttggtcgatgatcccttggaataccaggctggtctcctggtgcaaaatgccatccagcaggcgatcgccgaacaggtcgacaaggccgtctccaagacttctagagacggagcggaacaacaggggccagaagccacagtggaggaggcagaagctgctgcctttggcagcgaaaagccccagagcatgttcgaacctccacaggtgagctcccccgttcaggaaaaaagagatgtgctgccaaaaatcctgccagcagaagatagggctttgagggagcgtggcccgccccagccactccccgcagtgcagccttcgggacccattaacatggaggagactaggcccgagggctcatatttctcaaaatactctgaggccgcggaactgaggagtactgcttcgctgctggctacacaagaaagtgacgtgatggtggggccttttaagctcagatcaagaaagcagcggactttaagtatgatagaggaagagattagagccgctcaggagcgtgaggaagaactgaagcgccaacggcaggtccttcagtcaacacaaagtcctcggaccaaaaatgcccccagtctgcccagcaggacctgttataaaactgccccgggaaaaattgagaaggtgaagccccccccgagtcctactacggaaggcccttctctacagccggacctggccccagaggaggccgccggcactcagaggcctaagaatttgatgcagaccctcatggaggactacgaaacacacaagtcgaagcgacgcgaacggatggacgattcctcatatactagtaagttgctctcttgtaaggtgacgagtgaagttctagaagctacccgcgtgaaccgcagaaaatccgcattggctctacgatgggaagctggaatttacgctaaccaggaggaagaagataatgagtag

SEQ ID NO: 177490 - DNA, 2565 bp, Artificial Sequence
  Description of Artificial Sequence: Synthetic coding sequence
atgatggcctacagcgacaccaccatgatgagcgacgacatcgactggcttagatcccatcggggggtgtgcaaggtggacctctacaatcccgaggggcagcaagatcaggataggaaggtcatttgttttgtagacgtaagcactcttaatgtggaagacaaggattacaaagatgccgcgtcaagttctagtgagggtaacctgaacctgggatccctggaagaaaaggagattatcgtcatcaaggatacagagaaaaaggatcaaagtaagacagaggggtctgtttgcctctttaagcaggctcccagcgatccagtgtctgtactgaactggctcctttccgacctgcagaaatacgccctcggcttccagcacgccctcagcccttctacgagtacctgtaagcacaaagtcggcgacactgagggtgaataccatcgagctagctctgagaattgttattccgtgtacgcggatcaagtgaacattgactacttgatgaatcggccccagaacctgagactcgagatgaccgctgcaaaaaatacgaataataatcagagtccgtccgcccccccagccaagcctcctagcacccaacgggccgttatcagccctgatggggagtgcagcatagacgatcttagtttttatgtaaaccggctctctagtctggtgatccagatggcccataaggagataaaagagaagctcgagggcaagtccaagtgcctccatcactccatctgccccagccccggaaacaaagaacggatatccccccggacgcccgcaagcaaaattgctagcgagatggcttatgaggccgtagagctcactgcggctgagatgcgcggcacgggggaagagtcaagggagggcggccagaagtccttcctgtactctgagctgtctaataagagtaagtctggcgataaacagatgtcccagcgggagtccaaagaatttgctgactccatttccaaaggcctcatggtgtatgctaatcaagtcgcaagtgatatgatggtcagcttgatgaagacactgaaagtccactcttccggcaagcccatacctgccagcgtggttctgaagcgtgtgctcctccgacacaccaaagaaatcgtgtcagatctgattgacagttgtatgaaaaacctgcacaacatcaccggcgtattgatgactgatagtgacttcgtctctgcagtgaaacggaacctgttcaatcaatggaagcagaatgcaacagacatcatggaagccatgttgaagcgccttgtgagtgcacttatcggcgaagaaaaggaaacaaaatctcagtcactcagctatgccagtttgaaggccggatcacatgatcctaaatgccggaaccagtcactagaatttagcactatgaaggcagaaatgaaagaacgagataagggaaaaatgaagagcgatccatgcaagagcctgacaagcgctgaaaaggtgggtgaacacattttaaaggaggggttgaccatttggaaccagaaacagggcaatagctgcaaagtcgcaacgaaggcttgctccaataaggacgagaagggcgagaagattaacgcttcaacagactcacttgctaaagacctgatcgtgtctgcactgaaattaatccaatatcacctcactcagcagacaaagggaaaagatacatgcgaagaagattgtcctggctcgaccatgggatacatggcacagtctacacaatacgagaagtgcgggggcggtcagtctgctaaagcactgtctgttaaacagctggagtcccatagggcaccaggaccctccacttgccagaaagagaaccagcacttagactcccagaagatggacatgtctaatatcgttcttatgctcattcaaaaattgctcaatgaaaacccattcaagtgcgaggacccttgcgagggagaaaacaagtgttcagagcccagagcttctaaagctgcctctatgtctaaccgttccgataaggctgaagagcaatgccaggagcatcaggagctggactgcacctccggtatgaaacaggcgaatggacagttcatcgacaaattagtggagtctgtgatgaaactctgtctgatcatggcaaaatactccaatgatggggcggccctcgccgaacttgaggagcaggcggcgagcgccaacaagcccaacttccggggaactcgctgcatccactctggggccatgccccagaattaccaggacagcctgggccacgaggtgatagtcaataatcaatgcagcactaacagcctccagaagcagctccaagcggtcctgcagtggatcgcggccagccagttcaatgttccaatgctgtattttatgggggataaggatgggcaactggagaaattacctcaggtgtcagctaaggcggccgaaaagggatatagtgtgggagggctgctccaggaggttatgaagttcgctaaggaaagacagccagacgaagcggtgggcaaagtagctcggaaacagcttctggactggctgttggctaatctttag

SEQ ID NO: 177491 - DNA, 2538 bp, Artificial Sequence
  Description of Artificial Sequence: Synthetic coding sequence
atgagcgacgacatcgactggctgcggagccaccggggcgtgtgcaaggtcgatctgtacaatcctgaaggccagcaggatcaggaccgcaaggtaatctgctttgtcgatgtgagcactttaaatgtcgaagataaagattataaagatgccgcatcttcctcctcagagggcaacctgaacctggggtcccttgaggaaaaagaaataattgtcatcaaggacaccgagaaaaaagaccagtctaagacagagggatctgtctgtttgtttaagcaggccccctccgatcctgtctctgtgctcaactggctgctgtctgatttacaaaagtacgccctcgggtttcagcacgcactgtctccatccaccagcacctgcaagcataaggtgggggatactgaaggtgaataccatcgggcttcatccgagaattgttattcggtctacgctgatcaagtgaatatcgactacctgatgaacagaccccagaatttgagactcgagatgaccgccgccaaaaataccaataacaatcaaagtccgtctgctccgcctgcgaaacctccctctacccagcgagcagtaatatccccggacggagagtgcagcattgacgacttaagcttttacgtgaacaggctgtcgtcgctcgtaatccagatggcgcacaaggaaataaaggaaaaacttgagggtaagtctaagtgcctccaccacagcatttgtcccagccctggaaataaagaaaggatcagccctcgaacacctgcctctaagatcgcttccgaaatggcgtacgaagccgttgagcttacagctgccgagatgcggggaactggagaagagtcacgggagggcggacagaagagctttttgtactcagagttgagtaataagtctaagtctggcgataagcagatgtcgcagcgggagtccaaagagttcgcagatagtatttccaagggccttatggtctacgccaaccaggtggcctctgacatgatggtttctctcatgaaaaccctgaaagtgcacagcagtggaaagcccattcctgcctccgtggtcctgaaacgggtgctattaagacacacgaaagagatagtgagtgatctgatcgattcctgcatgaaaaacctgcacaatatcactggagtcttgatgacggattctgacttcgtgtctgctgtgaagcgcaacctcttcaatcagtggaagcaaaacgcgactgacatcatggaagccatgctgaaacgcctggttagcgctctgatcggtgaagaaaaagagacgaagagccagagtctttcatacgcttccttaaaagcggggtcacatgaccccaagtgccgcaaccagtctctggagtttagcaccatgaaggcagaaatgaaagagagggacaagggcaagatgaagtcggacccatgcaagtctctaacctccgctgagaaagtgggtgagcatatcctcaaggaggggcttacaatctggaaccagaaacagggcaatagctgtaaggtggcgaccaaggcctgcagcaacaaagacgagaagggcgagaagattaacgcttcaacagacagtttagctaaggacttgattgtgtctgcactgaagctgattcagtaccaccttacacagcagacgaagggcaaggatacctgcgaggaagactgcccaggtagcaccatgggttacatggctcagtctacccaatatgagaagtgcggcgggggacagagtgccaaagcactctcagtcaaacagttggagtctcacagggcacccggaccctccacctgccaaaaggagaaccagcatttggattcacagaagatggacatgtctaacatcgtgcttatgttgattcagaagctcctgaacgagaatccattcaagtgtgaggatccgtgcgagggggagaataaatgctccgaaccgcgcgccagcaaggcagcaagtatgtccaaccgctctgataaggctgaagaacagtgccaggaacatcaggagctggactgcaccagcggcatgaagcaggctaatgggcagtttattgataagctagttgaatccgtaatgaagctttgtctgatcatggctaagtacagcaatgatggggctgccctcgctgagctggaagaacaggcagcctccgccaacaaaccaaacttccggggaacacgctgtattcacagcggcgctatgccacagaattatcaggattccctgggacatgaagtcattgttaataaccaatgtagcacaaactcactccagaagcaactgcaagcggtcctgcagtggattgctgcaagccagtttaacgtgccaatgctttacttcatgggtgacaaagacggccagcttgagaaactgccccaggtctctgccaaggctgcggaaaagggttactccgtgggcggcctacttcaggaagtgatgaagttcgccaaagaaagacaacccgacgaggccgttggaaaggttgcccgtaaacagctactcgattggcttcttgccaatttatag

SEQ ID NO: 177492 - DNA, 1416 bp, Artificial Sequence
  Description of Artificial Sequence: Synthetic coding sequence
atgagcgacgacatcgactggctgcggagccaccggggcgtgtgcaaagtggacctctacaatcctgaaggtcagcaagatcaagatagaaaggtgatctgttttgtggacgtgtccaccctgaatgtggaggataaggattataaggacgccgcttcaagcagcagtgagggcaacctgaaccttggttcattagaggagaaagagatcattgttattaaagacaccgaaaaaaaagaccagagtaagacggagggctctgtctgcttattcaagcaggccccctcagaccctgtgagtgtactgaactggctgttgtcagatctgcagaagtatgcactgggttttcagcacgcgctgtctcctagtacaagcacctgtaaacacaaagttggtgacactgaaggcgaataccaccgcgcaagctcagagaattgctatagcgtctacgctgatcaggtgaacattgattatctgatgaatcggccacaaaatctccgcctcgaaatgacagcggctaaaaacaccaacaacaaccagaacacatgcgaggaggactgtccaggatctacaatggggtacatggcacaatcaacccagtacgaaaaatgtggtggaggccagagcgccaaggcgttatcagtgaagcaactggaatcccaccgggctccgggaccttcaacttgccagaaagagaatcagcatctagactcccagaagatggacatgtcgaacatcgtgctcatgcttattcaaaagctcctcaacgagaatccttttaaatgtgaggatccgtgcgagggagaaaacaaatgctccgagccgagagctagtaaggccgccagcatgtcaaacaggtctgataaagccgaggagcagtgtcaagaacatcaggagctggattgcacctccggaatgaagcaggctaatggccagtttatagacaaacttgtggaatcagtaatgaagctgtgtctcattatggccaaatattctaatgatggcgcagcgctggcagaactagaagaacaggctgcaagcgccaacaagccaaactttcgggggacgcgctgtatccactcaggtgctatgccccagaactaccaagattctctgggacacgaggtgatcgttaataatcagtgctcaacaaactctctccagaaacaactccaagctgtgctgcagtggatcgccgcctctcagttcaacgtcccaatgctgtacttcatgggcgacaaggacggccaactggaaaagctgccccaagtgtccgccaaagccgctgaaaagggatactccgtgggagggctgctgcaagaggtgatgaagttcgcaaaagagagacagccagatgaagccgtaggtaaggtggctcgaaaacagttactggactggctcctggccaacttatag

SEQ ID NO: 177493 - DNA, 2538 bp, Artificial Sequence
  Description of Artificial Sequence: Synthetic coding sequence
atgagcgacgacatcgactggctgcggagccaccggggcgtgtgcaaggtcgatctctataacccagagggacagcaggaccaagaccggaaagttatctgttttgtggacgtctccacactgaatgtagaggataaagattataaggatgccgccagctcctcctcagagggtaatctcaatcttggttccctcgaggagaaggagatcatcgtgataaaagacacagagaagaaagaccagtccaagaccgaggggtccgtctgtctgttcaagcaggctccctctgatccagtaagcgttctgaactggcttctgtcggatctgcagaagtacgcattagggtttcagcacgcactctcgccatccacatccacgtgcaaacacaaagtgggcgacactgagggagagtaccaccgcgcttcaagtgaaaactgctattccgtttacgcagatcaggttaatatcgattatctaatgaatcggccacagaacctaaggttggaaatgacggcggctaaaaatacaaacaacaaccagtccccgtccgctcctcccgcaaagccgccgtccacacagcgtgcagtgatcagccctgacggggagtgcagcatcgacgatctctctttttatgttaaccgtctcagctccctggttatccaaatggcccataaggagataaaagagaaactagagggcaaatccaaatgcctgcatcattcaatttgcccctctccaggcaacaaagagagaatctccccaagaactccagcatcaaagatcgcttccgagatggcctacgaagccgtcgagctcacagccgcagaaatgcggggtaccggagaggagagcagagagggcgggcagaaatcattcctctactctgaactcagcaacaaatctaagtctggcgacaagcaaatgtcgcagagagagagcaaggagttcgcggatagtatcagtaagggccttatggtttatgcgaaccaggttgcctctgatatgatggtgagtctgatgaaaaccctcaaggtccactcctcaggcaaaccgattcccgccagcgtggttctgaagagggtgcttctccggcatactaaggagattgtttccgacctgatcgactcatgtatgaagaatctgcataatatcacaggagtgctgatgacagattccgactttgtctccgctgtgaagaggaacctgtttaaccagtggaaacagaacgcaacggatatcatggaggctatgttaaaacgtctggtcagtgcactcatcggggaggagaaagaaactaagtcccagagcctgtcctacgcctccctgaaggctggttcccacgatccgaaatgcaggaatcaatccttagagttcagcactatgaaggctgagatgaaagagcgtgataagggtaagatgaagtccgacccttgtaaaagcctgactagcgccgaaaaggtcggggaacatattctgaaggaaggtctgactatttggaatcagaagcaggggaatagttgcaaagtcgcaacaaaggcatgctccaacaaggatgagaagggcgagaagatcaatgcctcgacagactcactcgcaaaagacctaatcgtgtcggccctgaaactgattcagtaccacctcacacagcagaccaagggaaaggatacctgcgaagaggattgccccggctctacgatgggatacatggcacagtccacccaatacgagaaatgcggcggagggcaatccgctaaggccttgagcgttaagcagctagaatcccaccgcgcacccggcccttctacttgccaaaaggagaatcagcacttggattcccagaagatggacatgtccaatatcgtgctcatgctgatacaaaaactgcttaatgagaatccctttaagtgcgaggacccgtgcgagggggagaataagtgctctgagcccagggccagtaaagcagcttccatgtctaatcgctcagataaggccgaggagcagtgccaggaacatcaggaactggactgcacgtctggaatgaaacaggctaacggccagtttatcgataaactggtagaatctgtgatgaaattgtgccttataatggcaaaatactctaacgacggtgctgctctggcggagttggaggagcaggccgcttccgccaataagcccaatttcagaggaacacggtgcatccattcgggcgcaatgcctcagaactaccaggacagcctggggcacgaggttatcgtgaacaaccaatgctcgaccaactcactgcagaagcagttgcaagcagtgctgcagtggattgccgctagccagtttaatgtaccaatgctttacttcatgggcgataaagacgggcagcttgaaaaactgccgcaagtgtcagctaaagccgcagaaaaagggtatagcgtggggggcctcctgcaggaggttatgaaatttgccaaagaacgacagccagacgaagctgtgggtaaagtggctcggaaacagctgctcgattggctgttagctaacctatag

SEQ ID NO: 177494 - DNA, 765 bp, Artificial Sequence
  Description of Artificial Sequence: Synthetic coding sequence
atgagcgacgacatcgactggctgcggagccaccggggcgtgtgcaaagtagacctctacaacccggagggccagcaggaccaggatcggaaggtcatatgctttgtggacgtctctacgctgaacgtggaagacaaggattacaaggacgcagctagcagttcatctgaaggaaatctaaatcttgggtccctggaggagaaagaaatcattgttattaaggacactgagaagaaagatcagtccaagactgaaggctcagtgtgtctgttcaaacaagctcctagcgaccccgtgagtgtcctcaactggttgctgtctgatcttcagaaatatgcactcggcttccagcatgctctatccccatccacctcaacctgcaagcacaaggtgggcgataccgaaggcgagtatcaccgggcatcaagcgaaaattgctattccgtgtatgcagaccaggtcaatatagactacctcatgaaccggccccagaatctccggctggagatgaccgcagccaagaatactaacaataaccagtctccttcagcgccacccgccaaacctcctagtactcagcgggccgtaatttcccctgacggggaatgttctatcgacgacctgtccttttacgtgaaccgactgagttccctcgtgatccaaatggcccacaaggaaattaaagaaaaactggaaggcaagagcaagtgccttcatcactcgatatgcccctctcccggtaacaaggagcggatcagcccttag

SEQ ID NO: 177495 - DNA, 642 bp, Artificial Sequence
  Description of Artificial Sequence: Synthetic coding sequence
atgagcgacgacatcgactggctgcggagccaccggggcgtgtgcaaagtggatctatacaacccagagggccagcaagatcaggatagaaaggtgatctgctttgtcgacgtatctactctcaacgtggaagataaggattataaggacgccgctagttcttcgtccgagggaaatctcaacctggggtccctcgaggagaaggaaatcatcgtcattaaagatacagaaaagaaagatcaatccaagaccgaaggtagtgtgtgtctcttcaagcaggctccgtccgacccagtgtctgttcttaactggctgttaagcgacctgcagaagtacgctctagggtttcagcatgccctctcccctagcacttcaacatgtaagcacaaagtgggggacacagaaggggaataccatcgtgctagctcggagaactgttactccgtctatgccgatcaggtaaacatagactacctgatgaatcgccctcagaatcttcgactcgaaatgactgccgccaagaacaccaacaacaaccaaaatacctgcgaggaagactgcccaggatctaccatggggtatatggcccaatccactcaatacgagaagtgcggaggaggccaatctgccaaggccttgtag

SEQ ID NO: 177496 - DNA, 552 bp, Artificial Sequence
  Description of Artificial Sequence: Synthetic coding sequence
atggacaactgcctggccgccgccgccctgaacggcgtggaccggcgatcactccagaggtcggccagactcgccttagaagtgctcgagcgagctaaacggcgcgcggtggactggcacgctttggagcggcctaaaggatgcatgggggtgctggctcgagaggcaccgcatctggagaagcagcctgccgccggtccccagcgcgttctgcctggggagaaatattatagcagcgtccccgaggagggcggtgcgacccatgtgtataggtatcaccgcggggagtccaaacttcacatgtgcttggatatcggaaatgggcagcgaaaggacaggaaaaagacgtctctcggtcctggcgggtcttaccagatctccgagcacgccccagaagcatctcagccagccgagaatatctcgaaggacctgtacatcgaggtttacccaggcacatattccgttaccgtaggctccaatgacctgacaaaaaaaacacacgtagtggcagtcgacagcgggcaatcagtggaccttgtatttcccgtgtag

SEQ ID NO: 177497 - DNA, 552 bp, Artificial Sequence
  Description of Artificial Sequence: Synthetic coding sequence
atggacaactgcctggccgccgccgccctgaacggcgtggaccggcggagtcttcagcgttcagcgcggctggcactggaggtgctcgaaagggcaaaaaggcgagcggtcgattggcacgctttggaacggcctaaagggtgcatgggagtgcttgcacgcgaggcaccccacctggagaaacagcctgccgctggaccacagagggtgctgccaggcgaacgtgaagagagaccccctaccttatcggcttcatttcgcacaatggctgagttcatggactacacaagctcacaatgtggcaaatattactcatccgtccctgaagagggcggcgctacccatgtctatcggtaccatcgcggggaaagcaagctacacatgtgcttggatattgggaacggacaagctgaaaacatatccaaagacctatatatcgaggtttatccaggcacgtattcggtgacagttggaagtaatgacctgaccaaaaaaacacacgtggtagcagtcgactcgggtcagtcagtagatctggtctttccagtgtag

SEQ ID NO: 177498 - DNA, 633 bp, Artificial Sequence
  Description of Artificial Sequence: Synthetic coding sequence
atggacaactgcctggccgccgccgccctgaacggcgtggaccggcggagcttgcagcggtccgcacgcctggctcttgaggtgctggagagggccaaaagaagggcagtggactggcatgccctcgagcgccctaaagggtgtatgggagtcttggctcgagaagcaccccacctcgaaaaacagccagcagcaggccctcagcgcgttctgccaggcgaaagagaggagaggcctcctacactatcagcatctttccgaaccatggctgagtttatggactacacctccagccagtgtgggaagtattacagctcagtgcccgaagaggggggagcaacgcatgtctacagataccaccggggcgaatccaagctacacatgtgcttggacatcggcaatggacaacgtaaggatcgtaagaaaacatccctggggcctggggggagctatcaaatttcagagcacgctccagaggcctctcagcccgccgagaacatcagcaaagatctctatatcgaggtatatcccggcacctacagtgttaccgtggggtccaacgatttgactaaaaaaacccacgtcgttgcagtggactcaggccagagcgttgatctggtgttcccagtgtag

SEQ ID NO: 177499 - DNA, 552 bp, Artificial Sequence
  Description of Artificial Sequence: Synthetic coding sequence
atggacaactgcctggccgccgccgccctgaacggcgtggaccggaggtcgttacaaagaagtgcccggctggctctcgaagtgcttgagagagccaagagaagggctgtcgactggcacgccctggagcgcccgaagggctgtatgggcgtgctggccagggaggcccctcacctggagaaacagccagccgcagggcctcaaagggttctccctggcgaaaagtactactcatctgtgccagaggaaggcggggccacccacgtgtatcgttaccatcgcggagagtcaaaactccatatgtgcttggatatcggtaacggtcagcgcaaagaccgcaagaagacttcactcggccctggtggtagctaccaaatctctgaacatgctcctgaggcatcccagccagccgaaaatatttctaaggacttgtacattgaggtctacccgggtacctattcagtgaccgtgggtagtaacgatctcaccaaaaaaacacacgtggtggcagtggattctggtcagtcagtggacctggtgtttcccgtgtag

SEQ ID NO: 177500 - DNA, 633 bp, Artificial Sequence
  Description of Artificial Sequence: Synthetic coding sequence
atggacaactgcctggccgccgccgccctgaacggcgtggaccggcgtagcttacaacgtagcgctagactcgctctcgaggtgttagagagggccaagcgccgtgcagtggactggcatgccttagagcgaccaaagggatgtatgggcgtcctggcacgagaggcgccgcacttggaaaaacagccagctgcgggaccacagcgcgtccttccaggcgagcgggaggagcgcccgccaactctatccgcctcattcagaactatggctgagttcatggactataccagcagccagtgtggcaagtactactcttcagttcctgaggagggaggtgccacccatgtgtataggtaccaccgcggggagagtaagttgcacatgtgtctagatatcgggaatgggcagaggaaggaccgcaaaaaaaccagtctgggccctggggggtcttatcagatttcggagcacgctccagaagcttcccagcctgccgagaacatctcaaaagacttgtacattgaagtgtaccctgggacctatagtgttactgtaggcagcaacgacctgaccaaaaaaacccatgttgtggctgttgatagtggacaaagcgtggacctggtgtttcctgtttag

SEQ ID NO: 177501 - DNA, 1479 bp, Artificial Sequence
  Description of Artificial Sequence: Synthetic coding sequence
atgggcttccagcggcggttcttccaccaggaccagagccccgtggggggcctaacagctgaagatatagagaaagcccggcaggctaaagctcggcccgagaacaagcagcacaagcagaccctgtcagagcacgctcgggaacgaaaggtgccagtcacacgaattgggaggctggccaatttcggtggcctggctgtggggctcggctttggcgctttggccgaagtggccaaaaagtctctgcgcagcgaggacccatctggaaagaaagcggtcctcggctcttcacccttcttgagcgaagcgaacgccgagcgaatagtccggaccctgtgtaaggtgcggggtgccgctctcaaactggggcagatgcttagtatacaggacgacgcattcatcaatccacacctggctaagattttcgagcgggtgcgtcagtctgccgattttatgcccctgaaacagatgatgaaaactttgaacaatgaccttgggcccaactggcgtgataagcttgagtattttgaggagaggcctttcgctgcggcctctatagggcaggtccacttagccagaatgaaggggggcagggaagtcgcaatgaagatccagtaccctggcgtggcacagagtataaatagtgacgtcaacaacctgatggctgtcctcaacatgtctaacatgctgcctgaaggtctcttcccagaacatctaattgacgtgctccgcagagaactggctctagagtgcgattaccagcgcgaggcggcatgcgcaagaaagttcagggacctgctgaagggccacccgttcttctacgtgccggaaattgttgatgagttatgttcacctcatgtcctgaccactgagctggttagcggtttcccgcttgaccaggcagagggactgtcccaggagattcggaatgaaatttgttacaacatcctcgttctctgcctccgcgaattgtttgagtttcacttcatgcagacggacccaaactggtccaattttttctatgatcctcagcagcataaggtcgcccttctagatttcggagctaccagagagtatgataggagcttcacagatctgtacatccagattatccgggcagcggctgatagagatcgggagaccgtgagggctaaatctatcgaaatgaagttcctcactggctatgaggtcaaggtaatggaagacgcacacctggacgccatcctgatccttggagaggccttcgcgtcggatgagcccttcgatttcggcactcagtctacgacagaaaaaatccacaatctcatcccggtcatgctgcgccacaggctggtgccaccaccagaagaaacctatagcttgcatcggaagatgggcgggagtttcctgatttgcagcaaattgaaggctcgttttccttgcaaggcaatgtttgaggaagcatatagtaactattgcaagaggcaggcgcagcagtag

SEQ ID NO: 177502 - DNA, 1719 bp, Artificial Sequence
  Description of Artificial Sequence: Synthetic coding sequence
atggccgccatcctgggcgacaccatcatggtggccaagggcctggtgaagctaacccaggcagcagttgaaactcatttgcagcaccttggaataggtggcgagctgataatgggccccgccccagcttatgttgcttccgggccgttcagggaggcgggatttcctggccaggcttcttctcctctgggaagagcaaacggccgactctttgctaatcctcgagacagcttctctgcaatgggattccaaagaaggttctttcatcaagatcaaagtcctgtgggcggcttgaccgctgaagacatcgagaaggctcggcaggccaaggcgagacccgagaacaagcaacacaaacaaacgctgagcgaacacgcccgggaacgtaaagttccagttacgcgtattggacggctggccaactttggaggtctcgcagttggattgggcttcggcgctctggctgaagtggcaaaaaaatctctgcgatctgaagatccttccggcaagaaggccgtattgggttcctccccttttttgagtgaagctaacgctgagcggatcgtaagaacattatgcaaggtgcgcggcgccgctttaaagctgggccagatgctgagtatacaagacgatgcttttatcaacccccatctcgccaagatattcgaacgagtgaggcagtcagccgatttcatgccgcttaagcaaatgatgaaaactctcaataacgacctgggccctaattggagggacaaactggagtattttgaggaaaggccgttcgccgcagctagcatcggccaggtgcatcttgcacggatgaaagggggtagggaggtggctatgaagatccagtatccgggcgtggcgcagagcattaattccgatgtgaataacctgatggccgttttaaacatgagcaacatgttacccgagggactgttccctgagcatctaatagacgttctgcgtcgcgagctggctctggaatgtgactaccaacgcgaggctgcttgcgctcgcaagttcagagatctgctcaaaggacatccgttcttctatgtgcctgaaattgtggacgaactgtgttcaccccacgtccttacgaccgagctagttagcgggttccctctggatcaggctgagggactgtcccaggagatccgcaacgaaatctgctataatatcctagtcctgtgtctgagggaactcttcgaattccactttatgcagaccgacccaaactggtctaattttttctacgatcctcagcaacataaggtggctttgttggatttcggagctaccagagagtatgatcggagctttactgatctgtacatccagataattagagccgcagccgatcgcgaccgcgaaaccgtgcgggccaagtctatcgagatgaagttcctgacaggatatgaggtgaaagtcatggaggatgcacacctggatgcgattctcattctgggagaagcttttgccagcgacgaaccatttgatttcggaacacagtccactaccgaaaagattcataatcttatacccgtgatgctccgccaccggctcgtccccccccccgaggagacgtacagcctgcatcgcaaaatgggtggtagcttcctgatttgcagcaagctaaaggcaagatttccttgtaaagcaatgtttgaagaagcgtattcaaattactgcaagcgccaggcacagcaatag

SEQ ID NO: 177503 - DNA, 1944 bp, Artificial Sequence
  Description of Artificial Sequence: Synthetic coding sequence
atggccgccatcctgggcgacaccatcatggtggccaagggcctggtcaagcttacccaagccgctgtggagactcacctacaacacttgggaattggtggcgaactaattatggccgccagagctctccagtcaactgctgtggaacagatcggaatgttcctgggcaaggtgcagggacaggataagcacgaggagtacttcgcagaaaacttcggtggacctgaaggggaatttcatttctctgtacctcacgccgccggcgcaagtaccgatttttcatccgcttcggccccagaccaatctgccccaccctcgctgggtcatgcccattcagaaggccctgcgcctgcatacgtggcgtctggtccattcagggaggccggcttccctggacaggcctcttctccactgggacgggccaatggtaggctctttgcaaaccccagagatagcttttccgctatgggctttcagcgccggttcttccaccaggatcagtcccctgtcggaggtttgaccgcagaagacatcgagaaggcaagacaggctaaagccaggccagagaataaacaacacaagcagaccttgagtgagcacgcccgcgaaagaaaggttccagtcaccaggataggcagactagccaacttcggagggcttgcagtgggcctcggtttcggcgcactcgccgaagtggccaagaaatcgctgcgatccgaagacccgtcaggaaagaaggctgtactgggtagctcccccttcctgagcgaagcaaacgctgagaggattgtgaggaccctgtgtaaggtgagaggcgcagcgttgaagctcgggcagatgctctctattcaggacgacgcctttataaacccacacctggccaagattttcgaacgcgtaagacagagtgctgatttcatgccactgaagcagatgatgaagactctgaacaacgacctgggccccaattggcgcgacaagttggaatacttcgaggagcggccattcgcggcagcttcaataggccaggtccatttggctcggatgaaaggggggcgcgaggttgctatgaaaatccagtatccaggcgtagcacagagtatcaacagcgatgttaacaacctgatggcagtgctgaatatgtccaacatgttacctgagggcctattccctgaacacctaatcgacgtgttacgccgagagttggccctggaatgcgactaccagagggaggccgcctgtgcccgcaagtttcgcgacctgctcaaggggcatccatttttctacgtgcctgagatcgtggatgagctgtgttcgcctcacgttctgaccacggagctcgtcagtgggtttcccttggaccaggctgaaggcctatcccaagaaattaggaacgaaatctgctacaacatcctcgtgctgtgcttgcgcgagttgtttgagtttcacttcatgcagactgatccaaattggtcgaacttcttctacgatcctcagcaacacaaggtcgctctcctggactttggagcaacaagagaatatgatcgcagtttcaccgacctctacatacagataattagagctgctgcggaccgagaccgggagacggtgcgagcaaaatctatagaaatgaaattcctgaccggctatgaggtgaaggttatggaggacgcccacctggacgccatccttatactgggggaggcctttgcttcggatgaaccgtttgatttcggcacacagtcaactaccgagaagattcataatctaataccggtgatgcttcgacacagacttgtgcctcctccagaagagacctactctcttcatcgaaaaatggggggtagcttcttaatctgctcgaaactgaaggcgagattcccttgcaaggctatgtttgaagaggcatactccaattactgtaaacggcaagcacagcaatag

SEQ ID NO: 177504 - DNA, 1788 bp, Artificial Sequence
  Description of Artificial Sequence: Synthetic coding sequence
atgttcctgggcaaggtgcagggccaggacaagcacgaggagtacttcgcagagaacttcggaggcccggaaggagagttccacttctcagtaccgcacgcagctggggcctccacggattttagctccgcgagtgccccagaccagagtgcccctccaagtcttgggcatgcgcatagtgagggcccggccccagcctacgtcgcttctggcccctttcgggaggcagggttcccgggacaggcatctagtccactcggtcgtgccaatggacgcttgttcgctaacccgcgagactccttcagcgcaatgggcttccagaggcggttttttcaccaagaccagtctccagtgggcgggctcaccgcggaggatatcgaaaaggctaggcaggcaaaagcccgtcccgagaacaagcagcacaagcagaccctgtccgagcatgccagagagcgcaaggtaccggttactcggatcgggcgcctggcaaattttggcggtcttgccgtcggacttggatttggagccctggcagaggtggccaagaaatctctccggagcgaggatccgtccggcaagaaagcagtactaggtagctctccgtttctgtccgaggctaatgccgaacgcatagttaggacactttgcaaggtgaggggagccgcccttaaactcgggcaaatgctgtctatacaggacgacgcttttatcaatccgcatttagccaagatcttcgagcgtgtccgacagtcagcggatttcatgcccctcaagcagatgatgaaaacgctgaacaatgaccttggccccaattggcgggacaagctcgaatacttcgaagagcggccctttgcagccgcgagcataggccaggttcacctagctcgcatgaagggcggaagggaggtggctatgaaaatccagtaccccggcgtggcccaaagcatcaactccgatgtgaataatctgatggcagtactcaatatgagtaacatgctaccagagggtctgtttcctgaacatctgatcgatgtgctgcgtcgcgagctggccttggagtgcgattaccagcgtgaggcagcctgtgctagaaagtttcgagatctgcttaaggggcacccattcttctacgtgcctgaaattgtggacgaactttgcagcccacacgtactaaccacagaactggtttctgggtttcctctggaccaggccgaggggctttctcaggagatcagaaatgagatatgctacaacatcttagtcctctgcctgagagagcttttcgaattccacttcatgcaaacggaccctaattggtcaaactttttttatgacccccagcagcataaagtggcgctgcttgacttcggcgcaaccagagagtacgaccgctcatttactgacctatatatacaaatcatacgggcagccgcagaccgagatagagaaaccgtaagggcaaagtcaatcgagatgaaatttctgaccggatatgaggtgaaagtaatggaagacgcacacctagacgctatcttgatcctcggagaagcctttgcctccgacgaaccctttgatttcggtactcagagtaccacggaaaaaatacacaatctgataccagttatgttacggcaccgtttagttcctcccccagaagagacatattctctgcacaggaagatgggcgggagtttcctcatatgctctaaactgaaagcgcggtttccttgcaaggcaatgtttgaggaagcatattctaactactgtaagcgccaagctcaacagtag

SEQ ID NO: 177505 - DNA, 1944 bp, Artificial Sequence
  Description of Artificial Sequence: Synthetic coding sequence
atggccgccatcctgggcgacaccatcatggtggccaagggcctggtgaagctgactcaggccgccgttgagacacacttacagcatcttggaattggtggcgaattgatcatggcagcacgagcgctgcagtcaaccgccgtggagcagattgggatgtttctggggaaagtccaaggtcaagataagcatgaggaatatttcgcagaaaacttcggggggcccgagggtgagttccacttcagcgttcctcacgccgctggagcctcaaccgactttagttccgcgtccgcccccgaccagtcagccccgccctccctcggtcacgcccactcagaaggtccggcaccggcctatgttgcgtccgggccgtttagggaggcaggttttcctggccaagcgtcatccccgcttggacgggccaatgggagactcttcgccaaccctcgcgacagcttctccgcaatggggttccaacggcggttcttccaccaggaccagtctcccgtgggaggcctgactgccgaagatatagagaaggctaggcaggcgaaagctagaccagaaaacaaacaacataagcagacgctgtccgagcatgctagagaacgcaaggtaccagtgacccggattggaagactggccaactttggaggtctggctgtaggcctcggcttcggggcgttggccgaggtagctaaaaagagtctgaggagcgaggacccttccggcaaaaaggctgtgctgggaagcagtcctttcctctccgaagctaatgctgagcgtattgtcagaactctgtgtaaggtgcgcggtgccgcgcttaagctgggacagatgctttcaatacaggatgacgcttttatcaatcctcacttagctaaaattttcgagagggtcagacagtccgctgattttatgcctttaaagcagatgatgaagacactgaacaatgatctgggcccaaactggcgcgacaagcttgaatactttgaagaacgccctttcgccgccgcctcgatcggacaggtccatctggcgcggatgaaagggggaagggaggtcgccatgaaaatccagtatcctggggtggcccagagcatcaacagcgatgtcaacaatttaatggctgtcctgaatatgagcaatatgttgcctgagggtcttttcccggaacacctcatcgatgtccttcgaagggagttggcactggagtgtgattaccaaagggaggccgcatgcgctcgtaagtttcgggatctgttgaaaggtcacccctttttctatgtgcctgaaatagtggacgagctttgtagcccccacgtcctcacaactgaattggtttctggattccctctagatcaggctgaagggctttctcaagagattaggaatgaaatatgctataatatactggttctgtgccttcgcgagttgtttgagttccactttatgcagacggatccgaactggtcgaacttcttttacgatccacaacagcataaggtcgccctgttggattttggagccactcgggagtatgatcgatcatttacagatctttatattcagatcatacgggcagctgctgatcgtgatcgtgagacagttagagcaaaatctatcgaaatgaaattcctcacaggatatgaggtgaaagtgatggaggacgcacaccttgacgctattcttatcttaggcgaagcattcgcatccgacgagcccttcgattttggcactcagagtacaactgagaagatccacaatttgatccctgtcatgctgcgccatcgactggtgcctccccccgaggaaacctactccctccatcggaaaatgggtgggtcattcttaatttgttccaagcttaaagcccggttcccctgtaaagcaatgtttgaagaggcctattcaaactattgcaaacgacaggcacagcagtag

SEQ ID NO: 177506 - DNA, 1797 bp, Artificial Sequence
  Description of Artificial Sequence: Synthetic coding sequence
atggccgcccgggccctgcagagcaccgccgtggagcagatcggcatgtttttaggtaaggtgcagggccaggacaaacatgaagaatactttgccgaaaatttcggggggccagaaggggaattccatttctccagtgcaagcgctccagaccaatcagctcccccttcccttggccacgcccatagtgagggcccagccccagcctatgttgcctcggggccattccgagaggccggcttccctgggcaggcaagctcaccactgggccgtgcaaatggccgcttgttcgcaaatccaagggactcttttagtgcgatggggttccagcgcaggttcttccaccaggaccaaagccccgtcggcggactgacagccgaggacattgagaaagcacgccaggcaaaagctcgcccggaaaataaacagcataaacagactctcagcgaacacgcccgggagagaaaagtcccagtcacccgaattggtagactagctaattttgggggactcgctgttggccttggcttcggcgcgttggccgaagtggctaaaaagagcctacggagtgaggacccttctgggaagaaagccgtccttggttcatcacctttcctttccgaagcgaacgcggagagaatcgtacgtaccttgtgcaaggtgagaggggctgcgcttaagcttgggcagatgctcagtatccaggatgacgcgtttattaatccccacctggctaaaatatttgaacgcgtccgccagtctgccgactttatgccgctgaagcagatgatgaagacgctaaacaatgatctgggtccaaactggagggataagttagagtactttgaagaacggccctttgctgccgccagcataggacaggttcatctggccaggatgaagggagggcgcgaagtggctatgaagattcaatacccgggcgtggcccagagcattaattccgatgtgaataatctgatggctgtgctgaatatgtcgaatatgttgcctgagggcttgtttccagaacacttaatcgacgtgcttcgcagggagctcgctctggagtgcgactaccaacgggaggcagcatgtgcccggaagttcagggacctccttaagggccacccgttcttctacgtgcccgaaattgtggacgaactgtgctcaccccacgtgctgactactgaacttgtatcaggatttccgctggatcaggcggagggcttgtcccaggaaattaggaacgaaatttgctataacattttggtgttatgtcttcgtgaactgttcgaattccactttatgcagacggacccaaactggagtaattttttctatgaccctcagcagcacaaggtggcactcctggactttggagctacgcgggaatatgaccgaagctttactgacttatacatccagattattagggcggccgctgatcgcgatcgcgaaactgtaagagcgaagagcatcgagatgaaattcctcacagggtacgaagtaaaggtcatggaagatgctcacctggacgctatcctcatcctgggggaggcttttgcttctgacgaacccttcgatttcggtacgcagtcaaccactgagaaaattcataacttgatccccgtcatgctgagacatcgcttggtcccaccccccgaggagacatattcgcttcataggaagatgggtggctccttccttatctgctctaaactgaaagctcgctttccatgtaaggctatgtttgaagaagcgtacagtaactactgtaagcggcaggcccagcagtag

SEQ ID NO: 177507 - DNA, 966 bp, Artificial Sequence
  Description of Artificial Sequence: Synthetic coding sequence
atgctgagcatccaggacgacgccttcatcaacccccacctggccaagatcttcgaaagagtgagacagtcagccgacttcatgcccttaaagcagatgatgtaccccggcgtagcgcaatcgattaattccgatgtgaacaacctgatggcggttctcaacatgtcaaacatgctgcctgaggggctgtttcctgaacacctcatcgacgtactccggagggaactggcattagaatgcgactatcaacgggaggccgcctgtgcaagaaaattccgagatctgctcaagggtcaccccttcttctatgtccccgaaatcgtggacgagctgtgcagccctcatgttctaactacagagttggtctccgggtttcccctcgaccaggctgagggcctgtctcaggagatccggaacgagatctgctacaacatcttggtcctgtgcttaagagagctgtttgagtttcactttatgcagacggaccccaattggtcgaatttcttttacgatcctcagcaacataaagtagctttgctggatttcggcgctaccagggagtacgataggtcctttacagacctgtacatccaaattattcgggccgcagcagacagggatcgcgagacagtgagggcaaaatctattgagatgaaattcctcacaggctatgaggtgaaagtaatggaggatgcacatctggacgctattcttatcctgggcgaggctttcgccagtgatgagccgttcgactttggcactcaatctacaaccgagaaaattcacaacctaatcccggtcatgcttaggcacagactcgtgccacctcccgaagaaacatactctctgcaccgtaaaatgggcggatcatttctgatttgctccaagctcaaagcaaggtttccttgcaaggccatgtttgaggaggcatatagcaattactgtaaacgccaggctcagcagtag

SEQ ID NO: 177508 - DNA, 1107 bp, Artificial Sequence
  Description of Artificial Sequence: Synthetic coding sequence
atgctgagcatccaggacgacgccttcatcaacccccacctggccaagatctttgagcgagtccgtcagtctgccgacttcatgcctcttaagcagatgatgaagacattaaacaacgatctgggccccaactggcgcgacaagttggagtattttgaggaacggccatttgcggctgcctccatcggacaggtgcatcttgcaaggatgaagggcggaagagaagtcgcaatgaaaattcagtaccctggggtagcccagtccatcaattccgatgtcaataacctaatggctgtcttgaacatgtctaatatgttacccgagggtctttttcctgaacacctcatcgacgtattgcgcagagagctcgcactcgagtgcgactaccagagggaagctgcctgcgcccgtaagtttcgcgatctgctcaaaggccatccatttttctacgttcctgagattgttgacgagctgtgctccccccatgttctgacaaccgaacttgtatcaggttttccgctcgatcaggcagagggactttcacaggagataagaaacgaaatttgctataacatcctcgttttgtgtctccgagagctgttcgaattccactttatgcaaacggatccaaactggtccaatttcttttatgacccgcagcagcacaaagtagccctcctggattttggagccacccgtgagtacgatcgctctttcactgatctgtacatccaaatcattcgcgccgcagcagatagagatagggagacagtccgggcaaagtccatcgaaatgaagttcctgactggatacgaagtcaaagtgatggaggatgcccacctggacgcgattctgatcttgggcgaggcatttgccagcgacgagccctttgacttcggtacccaatccacaacagagaaaatacataacctgattccagtgatgctgaggcatagacttgtgcctcctcccgaggagacttacagcctgcatagaaaaatgggtggcagcttcctcatttgttctaagctcaaggccaggttcccatgcaaagctatgtttgaggaagcctacagcaattattgcaagcggcaggctcagcaatag

SEQ ID NO: 177509 - DNA, 3591 bp, Artificial Sequence
  Description of Artificial Sequence: Synthetic coding sequence
atgcccaccgccgagagcgaggccaaggtgaagaccaaggtgcggtttgaggaactcctcaaaacgcattcagacctaatgcgtgaaaagaagaaactcaagaagaaactggtgcgcagtgaagagaacatctcgcccgatacaatacggtcgaacctacactacatgaaggaaacaacttccgacgatcccgataccattcggagtaacctgccccacattaaagagactacgagcgatgatgttagcgccgctaatactaataatctcaaaaagtctaccagagtgaccaaaaacaagctgaggaatacgcagctggctacagaaaatcccaacggagatgcttctgttgaagaggataaacaggggaagcctaataagaaggtaattaagacagtacctcagttaacaactcaggaccttaagcctgagactcccgagaacaaagtggattccactcaccagaagactcacaccaagccgcaaccaggggtagatcaccagaagtccgagaaagccaacgagggcagggaagaaacagacctcgaggaagacgaggaattgatgcaggcatatcaatgccatgtgaccgaggagatggcaaaggagatcaaacggaaaatcaggaaaaagttaaaagagcagctgacctacttcccatcagatactttgttccacgacgacaaactgtcatccgagaagcgaaagaagaaaaaggaagtgccagtcttttccaaggcggagaccagtaccttaaccatttctggggatacagtcgagggcgagcagaagaaggaatctagcgttcgatctgtgagttcagacagccatcaagacgatgaaatctctagtatggaacagagcactgaagatagcatgcaggatgataccaaaccaaagccgaagaagaccaagaagaaaacaaaagccgtcgccgataacaacgaggacgtcgatggcgacggagtgcacgaaattaccagccgagatagccccgtttaccctaaatgcctgcttgacgacgatctggtgcttggcgtctacatccataggactgaccggctgaagtctgactttatgattagccacccaatggtgaagatacacgttgtcgacgaacacacaggtcagtacgtgaagaaagacgattcaggcaggccagtctctagctactacgaaaaggaaaacgtggactatattctgccaattatgactcagccatatgatttcaagcagcttaagtcgcgactccctgaatgggaagaacagatcgtctttaacgagaactttccataccttctgagagggtctgatgagagtcccaaagtgatactgttttttgaaattctggacttccttagcgtcgacgagatcaaaaataactctgaagttcagaaccaagaatgcggattccggaagatcgcttgggcctttttgaaactgctgggagcaaatggaaatgccaacattaattctaagctgaggcttcagttatattaccctccaaccaaacccagatctcccctctccgtcgtcgaagcctttgagtggtggtcgaagtgtcccaggaatcattaccccagcaccctgtatgttaccgtgcgtggcctaaaagtgcctgattgcatcaaacccagttacaggagtatgatggccctgcaggaggagaagggcaaacccgtgcattgcgaacgacaccatgagagctcgtcagtggacaccgaacctggactggaagaatccaaagaagtgatcaagtggaaacggctccctgggcaggcctgtcgaataccaaataagcatctatttagtctcaacgcaggcgagcgcgggtgcttctgtctcgatttcagccacaatggacggatcctggcggctgcgtgtgcttcccgagacggttacccaatcattctatatgaaatcccaagcggaagattcatgcgcgaactctgtggtcacttgaacatcatctatgacctgagctggtctaaggacgaccattatattttgacatcctcaagcgacggcaccgcgcgcatctggaaaaatgaaatcaacaacaccaacacatttagagtgctcccccatccttcattcgtatacacggccaaatttcaccctgcagttagggagctggttgtcacagggtgttacgacagcatgatccggatatggaaggtggagatgcgcgaggacagtgctattctcgtccgccagttcgacgttcacaagtcttttatcaattctctgtgcttcgatacagagggccatcacatgtattccggagactgcaccggcgtcatcgtggtgtggaatacctacgtgaagataaatgatctcgagcatagcgtgcatcattggaccatcaataaggaaatcaaagagacagagtttaaaggtatccctatcagctatctcgagatccatcctaacggaaaaaggctcctgattcacacgaaagattctaccctcagaatcatggatttgagaatccttgtagccagaaagttcgttggtgcagctaattaccgagaaaagatacactctactttgaccccatgtggtacttttctttttgccgggtccgaggacggcattgtgtatgtctggaatcccgagactggcgaacaggtggcgatgtattctgatttacccttcaaaagtcccatccgagatatcagttatcatccattcgagaacatggtggccttctgtgccttcggccagaatgaaccaattctcctctatatatatgactttcatgtagctcagcaggaagctgaaatgtttaaaagatataacggaacctttccgttacccgggattcatcagtcccaggacgcactgtgcacctgtcctaagctaccacatcaggggagcttccagatagatgaatttgttcacacggaatcatcttcgacaaagatgcagttggtgaaacagcggctcgagacagtcacagaggtgataaggagttgtgcggccaaggtgaacaaaaatctatcctttacttcaccaccagctgttagttcccagcagagcaaactcaagcagagcaatatgctcacagctcaagaaatactccaccagttcggctttactcagactggaatcatcagtatcgagcgtaagccttgcaaccaccaggtcgatacagcacccactgtcgtagccctttatgactatacagcgaataggagcgatgagcttaccattcaccgcggggacatcattcgggtcttcttcaaggataatgaggactggtggtacgggtctattggtaaaggccaagaaggatatttccccgcaaaccatgtcgctagtgaaacattgtatcaggagctcccacctgagattaaggagcgctcacccccgctgtctccagaggaaaagaccaagatagagaaaagcccagcaccccagaagcagagtatcaacaaaaacaaatcacaggactttagacttggttccgagagcatgacccactctgaaatgaggaaggaacagagccatgaggatcagggacacataatggacactagaatgaggaagaacaagcaggccggccgaaaggtgaccctgatcgagtag

SEQ ID NO: 177510 - DNA, 3162 bp, Artificial Sequence
  Description of Artificial Sequence: Synthetic coding sequence
atgcccaccgccgagagcgaggccaaggtgaagaccaaggtgcggtttgaggagttgcttaagactcactcagacctgatgcgcgagaaaaaaaagttaaagaaaaagttggtgagatctgaagaaaatatctccccagacacgataagatctaatctgcattatatgaaggaaaccacgagtgatgacccggatacaatccgctctaacctgccccatattaaggagacgacatcggacgacgtctccgctgctaatacaaacaatctgaagaagagtacaagggtgaccaagaataagctcaggaacactcagttggctactgagaatccaaacggcgacgcctctgtggaggaagacaagcagggtaagccgaacaagaaggttattaaaacggtgccacaacttactacccaggatttgaagccagagacccctgagaacaaagtcgattctacccaccagaagacacacaccaaacctcagcctggggttgatcatcagaagagcgagaaggccaacgagggccgagaagagacggacctggaggaagatgaagagctcatgcaggcgtaccagtgccacgtgacggaggaaatggccaaggaaattaaacgtaagattagaaaaaaactgaaggagcagctaacctacttcccttctgacaccctatttcacgacgacaagttaagctccgagaaaagaaagaaaaaaaaggaggtccccgtgttcagcaaagctgagactagcacactgacaatcagcggggatacagtagagggagagcagaagaaggagtctagtgtgaggagcgtgtcatctgactcccaccaagacgacgaaatcagttccatggaacagtcaactgaagattctatgcaagatgatactaagcctaagccgaaaaagacaaagaaaaaaacgaaagccgttgctgacaataacgaagacgtggacggtgacggagtgcacgaaattacttccagagacagcccggtataccctaaatgccttctggacgatgacttggttctgggtgtctacatccatcgcaccgataggcttaaatcggattttatgatctcccatcccatggtcaagatccatgtggtggatgaacacaccggccaatatgtcaagaaggatgactcgggacgacctgtatctagttactacgaaaaggagaacgtagactacatcctgcctattatgactcagccttacgacttcaagcagctgaaatcgcggctaccggagtgggaggagcaaatcgtgttcaacgagaactttccttacctgctgcgtgggtccgatgaaagtcccaaggtcatcttgttctttgaaatacttgacttcctgtctgttgacgagattaaaaacaattctgaagtccagaatcaagagtgtggtttcaggaagattgcctgggcctttctcaaactcctaggtgccaatggaaacgccaatatcaattctaaactgcgcttgcagttgtattatccaccaacaaaacctcggagtcccctctctgtggtagaagcatttgagtggtggagcaaatgccctaggaatcattatcctagcacgttatacgtgacggtccgcggtctcaaggtgcccgattgcattaagccatcatataggtccatgatggcactgcaagaggagaagggcaagccagtgcattgtgagcggcatcacgaaagcagctcagtggataccgagcccggcctggaggagtcaaaagaagtcataaaatggaagagattgccaggccaggcatgtcgaatacctaacaaacaccttttctcgctgaacgcaggggagcggggatgcttttgtctcgacttctcacataacggcagaatccttgccgccgcttgcgccagccgggacgggtaccctatcatcctatacgagatccctagcggcagatttatgagagagttgtgcggccacctaaacattatctacgacctgagctggtctaaagatgatcactatatcttgacctcgtcctcagacggtactgcgcgcatctggaagaacgagattaataacacgaacacattccgggtgctgccacaccctagctttgtgtacacagccaagttccatcccgccgtcagggaactcgttgtaaccggctgctacgacagcatgattagaatttggaaagttgagatgagggaggattctgctatattggtgagacagtttgatgttcataagtcttttattaactccctgtgtttcgatactgaaggccaccatatgtatagcggcgattgtacaggagttatcgtggtgtggaatacctacgtgaaaattaacgacctggaacactctgtccaccattggaccatcaacaaagagattaaagagaccgagtttaaaggaatcccaatttcctatcttgagattcacccaaatggcaagagattgttgattcacaccaaagattcaactctgcgcataatggacctccgcattctagttgcacgtaaattcgtaggggcagccaattatcgcgaaaagattcatagtaccctgacaccctgtggcactttcctgttcgccggctccgaagacggaattgtttacgtttggaatccggagaccggcgagcaggtggccatgtactccgacctccctttcaagtctcctatcagggacatttcttatcatccttttgagaacatggtagcgttctgcgcattcgggcagaatgaaccaatcctcttgtatatttacgactttcatgtggcccagcaggaggccgagatgttcaagagatataatgggaccttcccgctgcccgggatccatcagagtcaggacgccctgtgtacctgccccaaactcccccaccagggctcttttcaaattgatgaatttgtccacaccgaaagctcaagtactaaaatgcaactcgtcaaacagagactggaaacggtgactgaggtgattcggagttgcgcagccaaagtcaacaaaaatttgagcttcacgagtccccctgccgtgtcatcacagcagtcaaagttaaagcaaagtaacatgctcaccgcccaggagattctgcaccagttcggcttcactcagacggactcacattttgcagagttcaacacgtgcattctctggtggaaaaagcattag

SEQ ID NO: 177511 - DNA, 165 bp, Artificial Sequence
  Description of Artificial Sequence: Synthetic coding sequence
atgcccaccgccgagagcgaggccaaggtgaagaccaaggtgcggttcgaggaacttctcaagactcattcagacttgatgcgcgagaagaagaaacttaagaaaaagcttgttaggtccgaagagaacatttccaatcaggagaaaagcatggctgtgtggtag

SEQ ID NO: 177512 - DNA, 3591 bp, Artificial Sequence
  Description of Artificial Sequence: Synthetic coding sequence
atgcccaccgccgagagcgaggccaaggtgaagaccaaggtgcggttcgaagaactactaaagacccacagcgaccttatgcgagagaagaaaaaactcaagaagaagctggttcggtcagaggaaaatattagtcctgatacaattagatccaacttgcactacatgaaggagaccactagtgacgaccctgacacgatccgaagtaatctcccacacattaaagagactacctcagacgatgtgagcgctgcaaatactaacaaccttaagaagagcacacgagtgaccaaaaataaactgaggaatactcagctagcaactgaaaatcccaacggcgacgccagtgtggaagaagataagcaggggaaacctaacaagaaagttatcaaaaccgttccccaactgacgactcaggatttaaaaccggagacacctgagaacaaagtggactcaacccatcagaagacacacaccaagccacagcccggcgtggaccatcagaagtcagagaaggccaacgagggacgggaagaaaccgacctcgaagaggacgaggagctcatgcaggcctatcagtgccacgtgaccgaggagatggctaaagaaataaaaaggaagattaggaaaaagctcaaggaacagctcacgtacttcccatccgataccctctttcacgacgacaagctgtcatccgaaaagcgaaaaaaaaagaaagaggtacctgtgttctctaaggccgaaacttcaactctgacaattagcggagacaccgtggagggggagcaaaagaaagagagttcagtccggtccgtgtctagtgacagccaccaggacgatgaaattagctctatggagcagtcaacggaggactccatgcaagatgatactaagccgaagccaaaaaaaacaaaaaaaaagactaaagcggtggccgacaataatgaggacgtggacggagacggagttcatgaaatcacctcgagggatagtcctgtctatcccaaatgcttactcgatgacgacttggttctgggagtatacattcacagaaccgacagattgaagtcagatttcatgatctcgcaccccatggtgaagattcatgtggtcgacgaacacaccggccaatatgtgaagaaggacgactcaggccgtccggtttctagttattacgagaaagagaacgtagactatattctgcccattatgacccagccctacgactttaagcagctgaagagccgcctgcctgaatgggaggagcaaatcgtgttcaatgagaactttccatacctcctacggggttccgatgagtctccaaaggttatcctgtttttcgagatcctggacttcctctccgttgacgagattaagaacaactccgaggtgcagaatcaggagtgcgggttccgtaaaattgcatgggccttccttaaactgttgggagccaatgggaacgctaacatcaattctaaactcagactgcagctttactacccaccaactaagccacgcagcccactgtccgtggtggaggcattcgagtggtggtctaagtgccctcgaaatcattaccctagcactctttatgtgactgtccggggactcaaggtgccagattgcatcaaaccttcttaccggtccatgatggccctccaagaagagaaggggaaacctgtacattgcgaaagacatcacgaatctagcagtgtcgacaccgagcctggccttgaagagtctaaagaagttattaagtggaaaaggttgcctggacaggcctgccggataccaaataaacatttattctccttgaacgcgggggaaagaggctgtttttgtctcgacttctctcataacggccgaatcttggctgccgcatgcgcttcacgcgacggatatccaattattctctatgagatcccgtccggtagatttatgagggagctgtgtggtcatcttaacataatttatgacctcagctggtctaaggatgatcattacatactgacctctagcagcgatggcacggcaaggatctggaagaatgagattaacaacaccaacacattccgagtgctcccgcacccgtcctttgtctataccgctaagttccaccctgccgtgagagagttagtggtcacaggctgctacgatagcatgatccgcatatggaaagtcgagatgagggaggattccgcaatcttagtcaggcagtttgacgttcacaagagcttcataaacagtctgtgctttgacacggaggggcaccacatgtactcaggcgattgcacaggtgtgattgtcgtatggaacacctacgtaaaaataaacgatctggaacatagcgtacaccactggacaattaacaaggaaatcaaggagaccgagtttaagggcattccaatctcctatcttgaaattcacccaaatggtaaaaggttgcttatccacacgaaggattccaccctaaggatcatggacctgcgtatcctggtggcaaggaaattcgtcggagcggctaactatcgagagaagatccactctaccttgaccccttgcggaacattccttttcgccggcagtgaggatggcatagtctacgtgtggaacccagagactggggaacaggtcgctatgtattctgacttgccgtttaagagcccaattcgagatataagttatcaccctttcgaaaacatggtcgcgttttgcgcctttggccagaatgagcctattctcctctacatttatgacttccacgtggcccagcaggaggctgaaatgttcaaacgctataatggcactttccctctaccaggcatccaccagtctcaggatgctttatgtacctgtcctaagctgccccaccagggtagtttccagatcgacgagttcgtccatacagaaagttctagcactaaaatgcagctcgtgaagcagcggttggagacagtgacagaagtcatccgcagttgtgctgccaaagtgaataagaatctgtcgtttacgagtccacccgcagtgtcgagtcagcagtccaagcttaagcaatcaaacatgctcaccgcccaagagattttacatcagtttggcttcacacagacagggatcatctccatcgagaggaagccttgtaatcaccaggtggataccgcccccacagttgtggccctgtacgattatactgctaatagatctgacgagctaacgatccataggggcgacattattcgcgtgttttttaaggacaatgaggactggtggtacggaagcatagggaaggggcaggagggctatttccctgcaaaccacgtcgcgtctgaaacgctgtaccaggaactgcctcccgaaataaaagaacgaagtcccccccttagtcccgaagaaaaaacaaagatcgagaaatctcccgcccctcagaagcagtctatcaacaagaacaagagtcaagatttcagactgggatccgagtccatgactcattctgaaatgcgaaaagagcagtcccacgaggaccaaggccatataatggatacgaggatgcggaaaaacaagcaggctggcagaaaagtgactttaatcgagtag

SEQ ID NO: 177513 - DNA, 3162 bp, Artificial Sequence
  Description of Artificial Sequence: Synthetic coding sequence
atgcccaccaccgagagcgaggccaaggtgaagaccaaggtgcggtttgaagaacttctgaaaactcactctgatctcatgcgagagaaaaaaaaactaaagaaaaagctcgtgcggtccgaggagaacatatcccccgacactatacggagcaacctccactatatgaaggaaactacatccgacgatccagacactattcgctcaaacctcccacatataaaagagacaactagcgatgacgtctctgctgcaaatactaataatctgaagaagtcaaccagagtcacaaagaacaaattgcggaatacccagctggctaccgagaacccaaatggggacgcttcggtcgaggaagacaagcaaggaaagcctaataagaaagttattaaaaccgtccctcaactcaccactcaggacttgaagcccgagacacctgaaaacaaagtggatagcactcatcaaaagacccataccaaacctcagccgggggtggaccatcagaagtcggagaaggctaatgagggaagggaggaaacagatctggaggaagatgaagagttaatgcaggcgtaccagtgtcacgtgactgaagagatggccaaggagattaagagaaaaatacgcaaaaagcttaaggagcagctgacatacttccctagtgacacattgtttcacgacgataagctctcatccgaaaaaagaaagaaaaagaaggaggtacctgtatttagtaaagcagaaacatccacactgactatcagcggggacacagtggagggtgaacagaagaaggagtcctccgttcgctcagtctcaagcgatagtcatcaggatgacgagatcagttcaatggaacagtccaccgaagattctatgcaggacgatacaaagcctaaacctaagaaaactaaaaagaagacaaaggccgtcgcggacaataacgaagatgtcgacggggatggtgtgcacgagatcacctctcgagacagtcccgtgtatcctaagtgtcttttggacgacgatctggtgctgggggtgtacatccatcggaccgatcgcctgaagagcgactttatgatcagccacccgatggtgaagatccatgtcgtcgatgaacatacgggtcagtacgtgaaaaaagacgactctggacgtcctgtgagctcctattacgaaaaagaaaatgtggactatatcctgcctattatgactcaaccttacgactttaagcagctaaagagccgcctgccagagtgggaggagcaaattgtgtttaacgaaaacttcccttatctgctgcggggcagcgatgagagcccaaaggtcatcctcttcttcgagattctggactttctgtccgttgacgagatcaagaacaactcagaagtgcagaatcaggagtgtgggtttcgcaaaatagcctgggccttcctgaagctgctcggagcaaacggcaacgctaacattaacagtaaactccgtctgcagctttactacccacccaccaagccccgctcccccctgtcggtagtcgaagccttcgaatggtggtccaagtgtccaaggaatcattacccctccactctatacgtgaccgtgcgtggcctgaaggttcccgactgcataaaaccgagctaccggagtatgatggcattacaggaagaaaaggggaaacctgttcactgcgagcgccaccatgaatcttcaagtgtagatacagagcccggcctcgaggagagcaaggaagtgattaaatggaaacgccttcccgggcaggcctgtaggattccgaacaagcatcttttctccctcaatgctggagaaaggggttgtttttgtctggatttcagtcacaacggcagaatcttggccgcagcatgcgcaagtcgtgatggataccctataattttgtacgaaattccatcgggccggttcatgcgggagttgtgcggccatctgaacatcatctatgatttgagctggagcaaggacgaccactacattctaacatcgagctccgacggaacagccaggatttggaaaaatgaaatcaataatacaaacacttttcgcgtactgccccacccaagttttgtctatacggctaagttccaccccgccgtccgcgaactggttgtgaccggctgctacgattctatgatccgtatttggaaggtggagatgagagaagattccgctatacttgtccgacagttcgatgtacataagtctttcatcaatagcttatgttttgacacagagggccaccacatgtattccggagattgtaccggagttatcgttgtgtggaatacctatgtgaaaattaacgatctcgagcacagcgtccaccactggactatcaacaaagaaatcaaagagactgagtttaagggtattccaatatcttacctggaaatccacccaaacggcaaacgccttctgattcacacgaaggacagtacgctgcgcataatggacctgagaattttggtggctcgcaaattcgtcggcgccgctaactatagagaaaagattcatagtacactcacaccttgtggaacttttctcttcgctggtagcgaagacgggattgtatatgtttggaaccctgaaacaggcgagcaagtcgccatgtactcggatctcccgtttaagtcccccatcagggatatttcatatcaccctttcgagaacatggttgcattctgcgctttcggacaaaatgagcccatccttctttacatctatgatttccacgtggctcagcaagaggcagagatgtttaagcgatacaatggtacattccccctccccggcattcatcagagccaagacgccctttgcacctgccctaagctcccccaccaaggatccttccaaatcgatgagtttgtacataccgagtcatccagtacaaagatgcagttagtcaaacagcggctggaaacagtcaccgaggttatccggagctgcgccgccaaggttaataagaatctctcctttacctctccacccgcggtgtcaagccagcagtccaagctgaagcaaagcaatatgctgactgcacaagagatcttgcaccagtttggattcacacagacagactcccattttgcagaatttaatacttgcatcctgtggtggaagaaacattag

SEQ ID NO: 177514 - DNA, 1497 bp, Artificial Sequence
  Description of Artificial Sequence: Synthetic coding sequence
atgcgggagctgtgcggccacctgaacatcatctacgacctgagctggagcaaggacgatcactacattcttaccagttccagcgacggcaccgctagaatttggaaaaatgaaattaataacacgaacacctttcgtgtgctgccacatcccagcttcgtctacacagcaaagttccatccggccgtccgggaactagtagttacagggtgctacgacagcatgataagaatttggaaggtcgagatgcgcgaggattcagccatcctcgtgcggcagtttgacgttcacaaatcattcatcaattccttatgctttgacactgaagggcaccatatgtactctggggattgtaccggtgttatagtggtgtggaacacctatgtcaagatcaacgatcttgagcactctgtacatcattggactatcaataaggagatcaaagagactgagtttaaggggatccctatatcctacctggaaattcaccctaacggcaagagactgctgattcacaccaaagactcgactctaagaatcatggacctgcgtatactagtagcaagaaaatttgtgggggcggctaactatagggagaagatccactcaactctgactccctgtggaacctttctattcgctgggagtgaagacggaattgtctacgtctggaaccccgaaaccggggagcaggttgccatgtacagtgatctccccttcaagtcccccattagagatatctcctaccatccattcgaaaatatggtggcattctgcgccttcggacagaacgagccaatcctcctgtatatttacgacttccacgtggcgcaacaggaggcggagatgtttaaaagatataacgggaccttcccactccccggcatccaccagagtcaagatgctctgtgcacctgtccaaagcttccacatcagggatcttttcagattgatgaattcgtgcacactgagagctcctcaaccaagatgcaactggtcaaacaacgattggagactgtaactgaagtcatccgcagctgtgcagcaaaagttaacaagaatctgagctttactagcccgcctgcagtgtcctcacagcagtctaagctgaaacaatccaacatgcttacagctcaggaaatcctacatcagttcggctttacacaaacaggcatcatctcaattgagcggaagccatgcaatcatcaggttgacaccgcacccacggtagtagctctctacgactataccgccaaccgatcggatgaattgaccatccatcggggggatatcatcagggtgttcttcaaggacaatgaggactggtggtatggatcaatagggaagggtcaagagggctatttcccagcgaatcatgtcgcatcagagaccctctatcaggaactgccgccagaaattaaagaaaggagtccaccattgtctccagaggaaaaaactaaaatcgaaaaatccccagcacctcaaaaggttaaatag

SEQ ID NO: 177515 - DNA, 3591 bp, Artificial Sequence
  Description of Artificial Sequence: Synthetic coding sequence
atgcccaccgccgagagcgaggccaaggtgaagaccaaggtgcggtttgaggaattactgaaaactcactccgacctgatgcgggaaaagaaaaaactgaaaaaaaaactggtgaggtcagaagagaacattagcccagatacgatcagatccaacctccattatatgaaggaaaccacatccgatgatcccgacaccatcaggtctaatttaccgcatatcaaagagaccaccagcgacgatgtgtctgctgctaatactaacaacctgaaaaagtctactcgggtaaccaaaaacaagcttaggaatacacagttggcgaccgaaaatcctaatggcgacgcgtctgtcgaggaagataagcagggaaaaccaaataagaaagtcataaagactgtcccgcaactgactacccaggacctcaaaccagaaactcctgagaataaggtcgattccacacaccagaagacacataccaaacctcagccgggggtggatcaccagaaaagcgaaaaggcgaacgagggtagggaagaaacagacctggaagaggacgaagaactgatgcaggcataccagtgtcacgttaccgaagaaatggccaaagaaattaaaagaaaaatccggaagaaactgaaagagcaattaacatattttccttctgacaccctgtttcacgatgataaattatcatcagaaaagaggaagaaaaaaaaagaggttcccgttttttccaaggccgagacaagcactctgacaatctcaggagatacagttgaaggcgaacagaaaaaggagtcatctgtacggtccgtgtccagtgattctcaccaggacgatgagattagcagcatggagcagagcactgaggacagcatgcaagacgacacaaaaccaaaaccaaagaaaactaagaaaaagacaaaagctgtcgcggacaataatgaagatgtcgatggggacggagtacacgaaatcacatctcgggatagtcccgtgtacccaaagtgtcttctggacgacgatctggtgctgggggtttacatacatagaaccgacaggctcaaatctgactttatgatctcgcaccctatggtcaagatccatgtggtggacgagcacactgggcagtatgtcaagaaagatgactctggacgacctgtttcatcttactacgagaaggagaatgttgattatattctgccaatcatgactcaaccatatgattttaagcagttaaaatccaggctgccagagtgggaagaacagatcgtattcaatgagaattttccgtacttgcttcggggaagcgatgaatcacccaaagtcattctcttcttcgaaatactcgactttctgagtgtcgatgaaattaaaaataactccgaagtgcaaaatcaggaatgtggcttcagaaagatagcctgggctttcctcaagctactgggggccaacggcaacgctaatattaactcgaagctgagactccaattgtattacccgccaacgaaacccagaagtcccctgtccgtggtcgaggcctttgagtggtggtctaagtgtccccgcaaccattacccttcaacactgtatgtgaccgtaagaggattaaaagtgcctgattgtatcaaaccatcgtatcgaagcatgatggccctgcaggaggagaagggtaagccagtgcattgtgaacgccaccatgagtcaagttcagtggacactgagcctggtcttgaggaatctaaggaagtgatcaagtggaagaggcttcctgggcaagcttgtaggatcccaaacaaacacttatttagtttaaatgccggggagcgaggctgtttctgcctcgacttcagccataatgggcgtatacttgccgcagcctgtgcttcccgcgatgggtatcccataatcctctacgagatcccatcaggccgattcatgcgggagctctgcggccatcttaatataatctacgatctctcttggtcaaaggacgatcattacatcctgacatcgtcctccgacggcactgctcggatatggaaaaacgagatcaataataccaacaccttccgggtgctgccacaccccagttttgtttatactgccaagttccatccggctgtgagggagctagtggtgaccgggtgctacgactccatgatccgcatctggaaagttgagatgcgcgaagactctgcaatactggtacggcagttcgatgtgcacaagtcctttatcaacagcctatgtttcgatactgaggggcaccacatgtatagcggcgactgtaccggagtgatcgtggtttggaacacctacgtgaaaatcaatgacttagaacacagcgttcaccactggacaattaataaggagatcaaggagactgagttcaagggaatccctatttcctacctcgagatccacccaaacggcaaacgtctgttgattcacacaaaggacagcacgctgcgcatcatggacctgcgcattttggttgcccgcaagttcgtcggggcagcgaattacagggagaaaatacatagtacgctgactccttgcggcaccttcctgtttgccggctcagaagacggtatcgtgtacgtctggaacccagaaacaggcgagcaagtggccatgtatagcgacctgccttttaaatctccaatccgagatatcagctatcacccttttgaaaatatggtggccttctgcgctttcggtcagaatgagcccatattgctgtacatatacgactttcatgtagcccagcaagaggccgaaatgtttaagagatacaatggcaccttccctcttccggggattcatcaaagtcaagatgcattatgtacgtgtccgaaactcccccaccaggggagcttccaaatcgacgagttcgtgcatacagagtcatcttctaccaagatgcagctcgttaagcaaaggctggaaacggtaacagaagtgatccggtcttgtgcagctaaagtaaataaaaacctcagtttcacttcaccccccgctgtatcctcacaacaatccaaactgaaacagtcgaatatgttgactgcccaggagatcctgcaccagttcggattcacacaaactggcattatttcaatcgagaggaaaccttgcaaccaccaggtcgacacagcccctaccgtggtggccctgtacgattacaccgcgaaccggtctgacgaactaaccattcaccgcggggatattatccgggtatttttcaaggataacgaagactggtggtacggcagtattggcaaagggcaggaggggtactttccagccaaccacgtggcatctgagacgttataccaggagcttcctcctgagattaaggagcggagccccccactaagtcccgaagaaaagaccaaaatcgagaaatcccctgcccctcagaaacagagcattaacaaaaataagtctcaagactttcggctgggcagcgagtccatgacgcattctgagatgagaaaggaacagtcgcatgaggaccaggggcatatcatggatacccgcatgcggaaaaataagcaggctggacggaaggtgaccttgattgaatag

SEQ ID NO: 177516 - DNA, 1218 bp, Artificial Sequence
  Description of Artificial Sequence: Synthetic coding sequence
atgctgagcagcttcctgagcccccagaacggcacctgggccgacaccttttccttgctgctagctctcgcggtggcactgtacttaggctactattgggcctgtgtgctgcaacgcccccgcctggtggcaggtcctcaattcctggcgttccttgagccccattgttccattacgacagagaccttctaccccaccctatggtgtttcgagggtagactgcagtcaatatttcaagttttattgcagtcccagcccctcgttttgtatcagagcgatattttgcaaacacctgatggcggccagctcctactggattgggcaaaacagcccgactcctcacaggatccagacccaacaactcaacccatagtgctcctccttcctggaatcacagggtcaagtcaggacacatatgtgctgcacctagtaaatcaagcccttcgagatgggtatcaggctgtggtcttcaataataggggctgccggggcgaggaactgcgcactcatagagccttctgcgcttccaatacagaagacctggagacagtagttaaccacattaaacatcggtacccccaggccccgctgctggcagtggggatctcttttggcggcattctggtactgaatcaccttgcccaggcccggcaggctgctgggctcgtcgccgccctgaccttgtctgcctgctgggacagcttcgaaactaccagatctttagagacgcctctgaactccctcctgtttaatcagccccttaccgccggcctgtgtcaactcgtcgagaggaacaggaaggtcattgaaaaggtcgtggacatcgattttgtgctgcaggcgaggactatcagacagtttgatgaacgctatacttccgtcgccttcggctatcaagattgcgtcacatactataaggccgcgtcgcctagaactaaaatcgacgcaattcggatccctgtactttacttgagtgccgcagacgaccccttcagccctgtgtgtgctctgcctattcaagcagcccagcactctccttacgtcgcactgttgattacagctcgcggcgggcatatcggcttccttgagggccttctgccctggcagcattggtacatgtctagacttctgcatcaatacgccaaagctattttccaggacccggagggcctgcctgacctgcgagccctgttgccatccgaggaccggaattcgtag

SEQ ID NO: 177517 - DNA, 1197 bp, Artificial Sequence
  Description of Artificial Sequence: Synthetic coding sequence
atgcggaagcggaccgagcccgtggccctggagcacgagcggtgcgctgccgctggatcttcctctagcggttccgcagcggccgccttagatgcagattgccgcctgaaacaaaacctgcgtctgaccggcccagctgctgctgagccacgatgtgccgccgatgctggcatgaagcgggctctcggcaggcgaaagggagtgtggttacgtttaaggaaaatactgttttgcgttttgggactgtatatcgccatcccctttctgataaaactgtgcccaggcattcaggcgaagctgatcttcctgaactttgtgcgcgttccttacttcatagacctgaaaaaaccccaggaccagggtcttaatcacacctgcaattactacctgcagcctgaggaagatgtcaccattggagtctggcatacggtccctgccgtttggtggaagaatgctcaaggcaaggatcagatgtggtatgaggacgcccttgccagcagtcaccctatcattctctacctccatgggaacgctggtacccggggcggggatcatagggtggaactctacaaggtgctaagttctttaggctatcacgtggttactttcgattaccgcggctggggtgattccgtgggcacaccctccgagagaggaatgacatatgatgccctccacgttttcgactggattaaggcgcgatctggagacaaccccgtgtacatctggggtcactccctcggaacaggcgtcgctactaacctggtaagacgtctgtgcgagagggagacgcccccagatgctctgatattggagagcccctttacgaatattagggaagaagctaaatcgcacccattctcagtgatctaccgctactttcccggtttcgattggttctttttagaccctatcacttcaagcgggattaaattcgccaacgatgagaatgtcaagcacattagctgccccctcctcattctacacgctgaggatgaccccgtggtgccttttcagttaggtcgcaagctttatagcatcgctgctcctgccaggtcgttcagggacttcaaggtccaatttgttccgtttcattctgatctgggctacagacataaatatatttacaaaagccctgagcttcctcgcatcctccgcgaatttctgggcaaaagcgaacctgaacatcagcattag

SEQ ID NO: 177518 - DNA, 1215 bp, Artificial Sequence
  Description of Artificial Sequence: Synthetic coding sequence
atgcggaagcggaccgagcccgtggccctggagcacgagcggtgcgcggcagctggatccagttcctctggctcagctgccgctgccctcgatgcggactgcaggctgaagcagaatctacgcctgactggtcccgccgcggccgagccccgctgtgctgctgacgcgggcatgaagcgtgcccttggccgacggaagggcgtctggctaagattgcgcaaaatcctcttctgcgtgctgggtttatacatcgcaatacccttcctgattaagctatgtcccgggatccaggcaaagctgatattcctgaattttgtacgcgttccatacttcatagatttgaaaaagccacaggaccagggattgaatcatacatgtaattactacctgcaacccgaggaggatgtgactatcggagtgtggcacaccgtgccggccgtgtggtggaagaacgcccaaggcaaagatcaaatgtggtacgaagacgccctagcttcaagtcaccccatcatcttatatctccacgggaacgccggaactcgtggcggggatcacagagtagagttatataaggttctctcctctctcggctatcatgtcgtcacgttcgattaccgcggatggggcgacagcgtgggaaccccttctgaaaggggcatgacatatgacgcgctccacgtcttcgattggatcaaggcacggtcaggcgataatcctgtgtacatttggggccacagcttggggaccggcgtggcgacaaatctagtccgtcgactttgcgaacgagaaacacctccagacgccctcatcctggagagcccctttaccaatattagggaggaggcaaagtcccatccttttagtgtgatatatcgctattttcccggattcgattggttctttctggacccaattactagttccggcatcaaatttgccaatgatgaaaatgtgaagcacatttcctgccccctgctgatcctgcacgctgaggatgaccccgtagtgccattccagctggggaggaagctctacagcatagccgcaccggcaaggtcctttcgggacttcaaagttcaatttgtcccttttcattcggacctgggatatcgacataaatacatatacaaaagtcccgagttgccccgaattctccgcccacagcagggacccggcagtagcccagacccatccatgtggagtgaattggtctag

SEQ ID NO: 177519 - DNA, 564 bp, Artificial Sequence
  Description of Artificial Sequence: Synthetic coding sequence
atgagcggcggcggccacggcggcgtgtgcttcctgtgctgcatcctcctgcaggggaggaagggcgtttggctcagactgcgaaagatccttttctgcgttcttggtctgtacatcgctataccattcctgatcaaattgtgcccgggcatacaggccaagctgatctttctcaattttgtccgggtgccttattttatcgatctgaagaagccccaggatcaggggcttaaccatacctgcaattattaccttcaacccgaggaggacgtgactattggtgtgtggcacacagtgcctgctgtctggtggaaaaacgctcaggggaaagatcagatgtggtatgaagatgccttggcgagttcacatcctataatcctctatctccatgggaatgctggtacaaggggcggagatcaccgggtggagctctacaaggtgctgagttctctgggctatcatgtggtgacatttgactatagaggatggggtgactccgtggggaccccgtcagagagaggaatgacatacgacgcgctgcacgtctttgattggatcaaatag

SEQ ID NO: 177520 - DNA, 1083 bp, Artificial Sequence
  Description of Artificial Sequence: Synthetic coding sequence
atgcggaagcggaccgagcccgtggccctggagccccggtgcgccgctgatgctggcatgaaaagagccctgggccgtcggaagggtgtgtggttgaggttgaggaagattctgttttgcgtgctgggcctttatattgctatcccctttctgatcaaactttgtccagggatacaggctaagctgatctttctcaacttcgtgagagtcccctactttatcgatctgaaaaagccacaagatcagggcttgaatcacacatgtaattactacttgcagcccgaagaggacgtgacaataggagtgtggcatacggtcccggccgtgtggtggaagaacgcccaagggaaggatcagatgtggtatgaggacgcgctagcttcctcacaccccattatcctgtatcttcatggcaatgcaggcacccggggtggtgaccatcgcgtggagctatataaggttctgagtagtctgggataccatgtagtaacttttgattacaggggctggggcgatagcgttggaaccccatcggagagggggatgacctacgatgcccttcatgtgtttgactggattaaagctcggtccggcgacaacccagtttacatatggggccatagcctgggtaccggcgtcgccaccaatctggtccgaaggctgtgcgaacgcgaaactcctcctgatgctttgatcttggagagcccgttcactaatatcagagaggaggcaaagtcccacccgttctccgtcatctaccgctacttccccggattcgattggttctttttagaccccataacatctagcgggatcaagttcgccaacgatgagaacgtgaaacatatcagctgcccactccttatcctgcatgctgaggacgatcctgttgtgccttttcagctggggcgcaagctctactccatagctgctccagctcgatcctttcgtgacttcaaggtccaattcgtgccctttcactccgacctagggtaccggcataagtatatatataagtccccagaactacccagaatcttgcgagagttcttaggcaaaagcgagccggagcatcagcattag

SEQ ID NO: 177521 - DNA, 1020 bp, Artificial Sequence
  Description of Artificial Sequence: Synthetic coding sequence
atgctgtaccccggcagcgtgtacctgctgcagaaggccctgatgccggttcttttgcagggccaggcccgacttgttgaagagtgtaatggaaggcgtgcgaagctgctggcttgcgatggtaatgagatcgatactatgttcgttgacaggcgcggaacggccgagccgcaaggacagaaacttgtgatatgctgtgaaggaaacgctgggttctatgaagttggctgtgtgtccacacctttagaagccggatatagcgttttaggatggaatcaccctggctttgcgggatcgacgggtgtgcctttcccacagaacgaggccaacgccatggatgttgtagtgcagttcgctatacaccggctgggattccagccccaggatattatcatctacgcttggagcatcgggggcttcactgccacctgggccgctatgtcctaccccgatgtgagcgccatgatcctggacgccagtttcgatgatctggttccgcttgcgttgaaggtcatgccagattcttggcgtggcctcgttacaagaacagtgagacagcacctgaacctgaacaacgcagaacagctttgccgctatcaaggaccggttttgttgattagaagaacaaaagatgaaatcatcactaccactgttcccgaggatattatgagcaacagaggtaatgatctcctcctgaagctgcttcagcataggtatccccgggtgatggcggaagaggggttaagagtggtgcgtcagtggctagaagcctcttcacagctggaggaagcctcaatatactccagatgggaggtcgaggaggactggtgtttatctgtccttcgcagctatcaggctgagcacgggcccgactttccttggagtgtgggtgaagacatgtctgctgatggtcggagacagcttgccctgtttctggcacgcaaacatctgcataacttcgaggccactcattgcactccgctgcccgcccagaatttccaaatgccatggcacttgtag

SEQ ID NO: 177522 - DNA, 1677 bp, Artificial Sequence
  Description of Artificial Sequence: Synthetic coding sequence
atggccaagctgctgagctgcgtgctgggcccccggctgtacaagatataccgggaaagggattctgagagagcacccgcgagcgtgccagagacccccacggcagtgacggccccccattcgtcctcgtgggacacttactaccagccccgcgctctcgaaaagcatgccgactccattcttgcactggcgtccgtgttctggtccatctcctactacagcagcccttttgcttttttttacctttataggaagggttatctcagtctctccaaagtcgtgccgttttcacactacgcaggtactctgcttctgttgttggccggcgttgcatgcctcaggggtatcggcagatggacaaacccacaataccgacaatttatcactattctggaagctacgcacagaaaccagtcgagtgaaaacaagcgccaactagctaactataatttcgactttagaagctggccagttgatttccactgggaagagcccagttcaagaaaagaatctcgggggggtccatcaaggcgaggggtcgctctgctgcggccagaaccactacatcgtggcaccgctgatactctactgaatagagtcaaaaagctgccatgtcagataacctcttacttggtggcccatactcttggacgcagaatgttataccccgggtcagtgtaccttctgcagaaggctctgatgcccgtgctcctccagggccaggcacgcctggtggaagagtgcaatggaaggagagctaagctgctggcatgtgacggtaacgagatagacactatgttcgtggatcgcagggggaccgctgagcctcagggacagaagcttgtgatttgctgtgagggcaatgctggcttctatgaagtgggctgcgtgtcaacgccattagaagctggttactctgtcttaggatggaaccacccggggttcgcaggaagtaccggtgttccattccctcaaaacgaggcaaatgcgatggatgtggttgtgcaattcgccatacatcgattgggattccagccccaagacatcattatatacgcgtggtctatcggtggcttcaccgctacatgggctgccatgtcttatcccgacgtgtccgccatgatattggacgccagcttcgacgacctggtacctctggctctgaaagtcatgccagactcttggagagggcttgtcacaagaactgttcgccagcatctgaacctcaacaacgccgaacaactttgccgctaccaagggcccgtcttgctcatcaggcggacaaaggacgaaataattacaacgaccgtgccggaagatattatgtcgaaccggggtaacgacctcctgctgaagttgttacagcatcgatatcctcgcgtcatggccgaggaaggcctgagagtggtaagacaatggctcgaggcgagttcccagttggaagaggcctctatttattctaggtgggaggtcgaggaagattggtgcctctccgtattgcgaagctaccaggccgagcatggacctgatttcccatggtcggttggggaggacatgtctgcagatggacgccggcagttggcattattcctcgctcgcaagcacttgcacaattttgaggccacccactgcacaccactgcccgctcaaaacttccagatgccctggcatctgtag

SEQ ID NO: 177523 - DNA, 1806 bp, Artificial Sequence
  Description of Artificial Sequence: Synthetic coding sequence
atgagccagctggcccggcggcggagccggtacggcctgaccagccgggcgcacaataccagtgaagcaggccgggccgggcctgctggcggacctgcagccggacgagccgcggcgcgcgctggggccatggctaaactgctgtcatgcgtcctaggacccaggctctacaaaatctaccgagagagggactcagagagagcccccgccagtgttccagagactcccaccgctgtcacggccccacacagctcttcatgggacacatattatcagccaagggcgcttgaaaagcacgccgactctatattagcactggcctccgtattttggagcattagttactacagttcccctttcgcatttttttacctctaccgcaaggggtacctgtcactcagcaaggtcgtgcctttcagccactacgcaggaaccctacttctgctgctggccggcgtggcttgcctcaggggcattggcagatggaccaacccacaatataggcagtttatcactattctcgaagcaacccataggaaccaaagcagcgagaacaagcgccagttggcaaattataatttcgattttaggtcatggccggtcgacttccattgggaggagccaagtagccgcaaagagagccgaggagggccttctcgcaggggcgtggccctcttgcgcccggagcccttgcacagaggcacagccgacacactgctcaacagagtgaagaaactcccatgccagataacttcgtatctagtggcacatacactcgggaggagaatgctgtaccctggctccgtctacctcctccagaaggcacttatgccagtgctgttgcagggccaggcccgccttgtggaagagtgcaatgggaggagggctaagctactggcttgtgacgggaacgaaatagatacaatgttcgtcgacaggagggggaccgccgagccgcaagggcaaaagcttgtgatttgctgtgaagggaatgccggcttctacgaggttggttgcgtctccacaccgctggaagcgggatattcagtcctgggttggaatcaccctggcttcgcgggatcaaccggcgtgccctttccccagaacgaggccaatgccatggacgtcgtggtccagttcgcaatccacaggttagggttccagccccaggatattatcatatacgcatggtctattggcggcttcaccgcgacatgggcagctatgtcttatccagatgtttctgccatgatcctggatgcctccttcgatgaccttgttccattagccctgaaggttatgccagactcctggcggggcctggtgacccgaacagtgaggcagcacctcaacttgaacaacgcagagcagctttgtagataccagggcccggtgctgcttattaggcggacaaaagacgaaattattaccactaccgtgcctgaggacatcatgagcaaccgaggtaatgatctgctgttaaagcttttgcaacaccggtatccccgtgtcatggccgaagagggtttgagagttgtgagacagtggctggaagctagcagccagttggaagaagcttctatatactcccgttgggaggtcgaagaggactggtgtctctcggttctgcgaagctaccaggctgaacatggccccgacttcccttggtcagtgggagaggacatgtcagcggatgggaggcggcaattagccttattcctggccaggaagcatttgcacaactttgaggcaacacactgcactcccttgcctgcacagaatttccagatgccatggcatctgtag

SEQ ID NO: 177524 - DNA, 795 bp, Artificial Sequence
  Description of Artificial Sequence: Synthetic coding sequence
atgcccccccccgccctgttcctgagcagcctgtacccccggctggagttccaaaacgatttctatcgatcttgtattcggcggagctccccccagccgccgccaaatctggcctggcggccagagagtctgtatagtggggaactggcagggggaggctacctatctctgtccaaagtcgtgcccttctcccactatgccgggactctgttgctgctgctggctggggtcgcatgtcttcgcggaattggaaggtggactaatccccaataccgacagtttattactattttggaggcaacacaccgcaatcagtcgtctgagaataagcggcagcttgccaattacaatttcgatttccgatcttggccagtagactttcattgggaagaacccagcagcagaaaggagtccaggggggggccttccaggaggggcgtggcccttcttcgccccgaacctcttcatcgaggaaccgctgacacattgttgaaccgagtgaagaagctgccttgccagattacatcgtacttagttgcccacaccttagggcgtagaatgttgtatccaggcagcgtttatctgcttcaaaaggccctgatgccagtactcctccaggggcaggcgcggctcgtcgaagaatgcaacggacggagggccaaactgctggcctgcgatggtaatgaaatcgatacaatgttcgtagatcgtaggggaaccgctgaaccacagggccagaagctcgtgatctgctgcgaaggtaatgctggcttttacgaagttggctgtgtgtag

SEQ ID NO: 177525 - DNA, 795 bp, Artificial Sequence
  Description of Artificial Sequence: Synthetic coding sequence
atgcccccccccgccctgttcctgagcagcctgtacccccggctggagttccagaacgacttttatcgaagttgtattagaaggagttctccccaacctccacctaacctcgcatggcggcctgaaagcctctattcaggtgagctggccgggggagggtatctatctttgtccaaagtggtgcctttttcacattacgcgggtacactgctccttctgctggccggcgtggcctgccttagaggaatcgggcgctggaccaatccccagtatagacagttcattacaattttggaagccacacatcgtaaccagtccagcgagaacaaacgtcaattggcaaattacaatttcgacttcagatcttggcccgtggattttcactgggaagagcctagctccagaaaagagagccgagggggaccctctcgaagaggagtggctctgctgaggcctgaacccctacaccgaggcactgccgacacacttctgaatcgagttaaaaagctcccctgccagattaccagctacctggtggctcacacactgggaaggcggatgctgtatcccggctcggtgtacctactgcagaaagcgcttatgccggtcctgctgcaggggcaggccaggctggtcgaagagtgtaatggtcgccgagctaagctactggcttgcgacggtaatgagatcgacactatgtttgtggaccgcagaggcacagctgaacctcagggccagaaactggtcatctgttgcgaaggtaacgccggattctacgaagtcggatgtgtgtag

SEQ ID NO: 177526 - DNA, 795 bp, Artificial Sequence
  Description of Artificial Sequence: Synthetic coding sequence
atgcccccccccgccctgttcctgagcagcctgtacccccggctggaattccagaatgatttttaccgttcctgtatacggcggtcctccccacagcctccaccaaatctcgcttggcgcccagagagtctttattccggggaactggcgggagggggctacctcagtctttccaaagtggtgccattctcacactatgcggggacactgctgctactgctggccggtgtagcatgcctgagaggaattggacggtggactaatccccagtaccggcaatttatcaccatcttggaagccacacataggaatcaatcctcagagaacaaacgtcagctggccaactacaatttcgatttcagaagttggcccgtagatttccactgggaggagccgtctagcaggaaagagtcacggggtgggccttcacgacgcggtgtcgccctccttaggcccgagccccttcatagagggaccgccgataccctactaaatagggtgaagaaattaccctgccaaatcacttcctacctggtggctcatacactaggcagaaggatgctctaccctggttccgtgtacttactgcaaaaggcactcatgcccgtgctcctccaggggcaggctcgtctcgtcgaggagtgtaacggccgccgggcgaaactcttagcttgcgatggcaatgagatcgataccatgtttgttgatcgtcgcggaacagcggagccccagggacaaaaacttgtcatttgctgcgaaggtaacgctggattctacgaagtgggctgcgtgtag

SEQ ID NO: 177527 - DNA, 1806 bp, Artificial Sequence
  Description of Artificial Sequence: Synthetic coding sequence
atgagccagctggcccggcggcggagccggtacggcctgaccagccgcgcccacaacacatctgaggctggacgcgccggccccgcaggtggcccggccgctggacgagccgccgcccgggccggagcgatggctaagctgttgagctgtgttctaggcccacgactgtacaagatctatcgtgaaagagactccgagcgcgcacccgcgtcagtcccagagacccctactgccgttacagctccacattcctcctcctgggacacttattatcagccgagggccttggaaaagcatgccgactcgatcctcgctctggcaagcgtgttttggtccattagctactactcctctccctttgcctttttctacctatacagaaaaggctacctgtctctaagcaaagtggtgcctttctcacattatgctgggactctcctcctgctcctggcaggcgtggcgtgtctgcggggcattgggcggtggaccaacccacagtataggcagtttatcacaattctggaggctacacatagaaaccagagtagcgagaacaagcggcaattggccaactataactttgattttcgcagctggcccgttgactttcactgggaagagccctccagcaggaaagagtctcgcggaggacctagcaggcgcggcgtggcccttttacggcccgaacccctgcacagagggaccgccgacaccctactgaatcgggtgaagaagctcccctgtcagatcacatcttacctcgtcgcgcacaccttgggccggaggatgctgtatcccggatctgtgtatctgctgcaaaaggctctgatgccggtcttactccaaggacaggctagactcgttgaggagtgtaatggccgacgcgccaagctcctggcttgtgatggtaatgagattgataccatgttcgtggatagacgggggacagcagagcctcagggacagaaactcgtaatctgctgcgagggtaatgctggcttttatgaggtaggatgcgtgagcacccccctggaggcgggatatagcgtcctgggctggaaccatccaggattcgctggttcaactggagttccgttcccccagaatgaagccaatgctatggacgttgtggtacaattcgccatacacagattgggctttcaacctcaagatatcataatttacgcctggagtataggggggttcacagccacatgggcagcaatgtcatatcctgacgtgtcagctatgattttggatgccagctttgatgacctggttcctctcgccctgaaggttatgcctgactcgtggagaggcttggtcaccaggactgtgcggcagcatctgaacctgaataacgccgagcagttatgtcgctaccaggggcccgtcttgctgattcgacgaaccaaggacgaaatcattaccactactgttccagaggacatcatgagcaatagaggcaacgacctgctgttgaaactgcttcagcaccgctacccacgggttatggctgaagaaggtctccgggttgtgagacagtggctagaggcgagctcacagttggaggaagcatctatctattcccgttgggaagttgaagaggactggtgtctgagtgtgctgagaagttaccaggcagaacacggtcccgactttccatggagtgtgggcgaagatatgtccgccgacgggcggcgccaactggcactctttttggcccgcaaacacctgcacaactttgaagctacccactgcacccccctccctgctcagaatttccagatgccctggcacctctag

SEQ ID NO: 177528 - DNA, 795 bp, Artificial Sequence
  Description of Artificial Sequence: Synthetic coding sequence
atgcccccccccgccctgttcctgagcagcctgtacccccggctggagtttcagaatgacttttaccgctcttgtatacggaggagttccccgcaaccacctcccaatcttgcttggcgccccgaatccttgtacagtggcgaactggcaggtgggggctacctgtccctgagtaaggtcgtgccattcagtcactacgctggtaccttgttacttctcctggcaggcgtagcctgcctgcgaggtattggaaggtggactaacccacagtacaggcaattcatcacgatcttagaagccacacaccggaaccagagtagtgagaacaagaggcaactcgctaattataactttgattttcgctcctggcccgtagacttccattgggaagagcccagcagccgcaaggaatctcgggggggtccctccagacgaggggtagctttgctgcggccagaaccattgcaccgggggacagccgacaccctgctgaatagggtaaagaaattgccttgtcagatcacttcctacctggtcgctcacacactcggacggaggatgctttatcctggttcagtgtacctgttacagaaagctctcatgccggtgttgcttcaaggtcaagctaggttagtggaagaatgtaatggaaggagggccaagctgctcgcctgtgacggtaacgagattgatactatgttcgtcgaccgccgggggaccgcagagcctcagggtcagaagctggtgatctgctgcgaaggaaacgctggattctacgaagttggctgtgtgtag

SEQ ID NO: 177529 - DNA, 1806 bp, Artificial Sequence
  Description of Artificial Sequence: Synthetic coding sequence
atgagccagctggcccggcggcggagccggtacggcctgaccagcagagcacacaataccagcgaggccggacgggctggaccggccggcgggcctgccgcagggagagctgcagcacgcgccggagccatggctaaacttctgagctgcgttctggggccccggctgtacaaaatttatcgggagagggacagcgaaagagcccccgcctccgtgcctgagaccccaaccgccgtcaccgccccccacagttctagctgggatacgtactatcagcctcgggcgctcgaaaagcatgcggatagcattctggcgcttgcctccgtgttttggtccatctcatattactcctcacccttcgcgttcttctatttatatcgcaagggctatctttctctcagcaaagtggtgcccttttcacactatgccgggacgcttctgctgctcttggctggagttgcctgtctgcgaggtatcggaaggtggacaaacccccaatacaggcagttcataaccattctagaggcaacacacagaaaccagagcagcgagaacaagcggcagctggcaaattataacttcgattttagatcctggcctgtggacttccattgggaggagccatcctcaagaaaggaatcccggggggggccatctcggcgtggggtagcactactccggccagaacctctccatcgaggcacagccgacaccctgttgaatcgtgtcaagaagcttccgtgccagattacctcatacctcgttgctcacactctgggtcgaagaatgttgtatcctggttctgtttacttactgcagaaagctctgatgcccgttctcctgcaggggcaggccaggctggtagaagaatgcaatggcagacgcgcaaaactgctggcgtgtgacggtaatgagattgataccatgttcgttgacaggcgaggcactgcagagcctcaggggcagaaactggttatctgttgtgaaggcaacgccggattctacgaagtagggtgtgtaagtacccctctggaggcaggttatagtgtcttggggtggaatcatccaggatttgccgggtcaaccggcgtgccattcccgcagaatgaggcgaacgctatggatgttgtggtgcagttcgctattcatcggttgggatttcaacctcaggatattatcatatacgcctggtccattggcggattcacagccacttgggccgcgatgtcataccccgatgtctctgcaatgatcctcgacgcgtctttcgacgacctggtgccactggctttgaaagtcatgccggatagctggcgaggattggtgacccgaacagttcgacagcatttgaaccttaacaacgccgaacagctatgtcggtaccaaggtccagtgctcttaattcgcaggactaaagatgaaattatcacgaccacagtgccagaagatatcatgtccaataggggaaacgatctcttactcaagctgctacaacacaggtatccacgcgtcatggctgaagaagggctgcgcgttgtgagacaatggcttgaggcttcatcccaactagaggaggccagcatctatagtcggtgggaggttgaagaagactggtgcctcagtgtactcagatcgtaccaagcagaacatggccccgacttcccttggagtgttggggaggacatgtccgctgatggccgcaggcagctggccttgtttctggcccgtaaacacctacacaatttcgaggcaacgcactgtacccctctgcccgcccaaaacttccagatgccttggcacttgtag

SEQ ID NO: 177530 - DNA, 795 bp, Artificial Sequence
  Description of Artificial Sequence: Synthetic coding sequence
atgcccccccccgccctgttcctgagcagcctgtacccccggctggagttccagaatgacttctaccgcagctgcataagaaggtctagtcctcaacccccccccaacttggcctggcggccagagtctctgtacagcggcgaactggccggaggcgggtacctgtctctcagtaaggtggtccccttctctcactatgcaggcactctgctcttattgctggccggcgtggcgtgcctgaggggaataggtcggtggactaatccgcaataccgtcagttcattaccattctggaggctacacacaggaatcagtccagtgagaacaagaggcagctcgctaactacaacttcgacttcagatcgtggcccgtggatttccattgggaggaacccagctctcggaaagaaagtagaggaggcccaagcagacgtggcgtggctctcctgaggccagagccactgcatcgtggcaccgctgataccttattaaaccgcgtgaaaaagttgccctgccaaatcacatcctatctcgtggcccacacgctcggcagaagaatgctgtaccccggaagcgtatacctactgcagaaggccctcatgcctgttctcctgcaggggcaggctagactcgtggaggagtgtaacggtcgcagggcaaagcttctagcctgtgacggaaacgagatcgacacgatgttcgtggaccgtaggggcacggcagagcctcaagggcagaaactcgtgatttgttgcgaaggtaatgcaggattctacgaggttggttgtgtatag

SEQ ID NO: 177531 - DNA, 1806 bp, Artificial Sequence
  Description of Artificial Sequence: Synthetic coding sequence
atgagccagctggcccggcggcggagccggtacggcctgaccagccgagcccacaacacatccgaagcggggcgagccggccctgccggtggcccagcggcgggcagggcagcagcgagggccggcgcgatggctaaattgctcagctgcgttctgggccctcgtctgtacaaaatctacagggaacgggatagtgagagggctccagcctccgtgcctgaaacccccacggctgtaacagcccctcattcgagctcatgggatacatactatcaacccagggccctggagaaacatgccgactccatcctcgctctggccagcgttttctggagtatctcttattactccagtcctttcgcttttttttatctgtatcgaaagggctacctcagcctttccaaggtggtgcccttttcccactatgcgggaacacttttactactgcttgcaggggtcgcctgtcttcggggaatcggaagatggaccaatcctcagtacagacaattcatcaccatactggaggcgacccaccgcaatcaatccagcgagaacaagagacagctggcgaactacaacttcgatttcaggtcttggccagttgatttccattgggaggagcctagcagccgcaaggagagccggggtggcccctctaggaggggtgttgcactcctacggcccgagcccctccaccgcggtaccgcagacactctgttgaatcgagttaagaagttgccttgtcagatcacgagctatcttgtagcacacacactaggcagacggatgctgtaccctggcagcgtgtatctgttgcagaaagctctcatgccggttcttctgcaaggtcaagctagactggttgaggagtgtaatggccggcgagcaaagctgctcgcctgtgacggcaatgagatcgacaccatgttcgtagaccggcgcggcactgcggaaccccagggccagaagcttgtgatttgctgcgagggaaatgctggcttttatgaggtgggttgcgtaagcacacccttggaggccggatactccgtcttgggatggaatcatcctggatttgctgggtctaccggtgtgccctttcctcaaaacgaagctaatgccatggatgtggtcgtccagttcgccatacaccgactgggattccagccacaggatattattatttacgcctggtctataggcggtttcactgccacctgggccgcaatgtcctatcctgatgtatccgcaatgattcttgacgccagttttgacgatttggtgcccctcgcgctgaaagtgatgcctgattcctggcgcggattggtgacgcggacggtgcggcagcatctgaatttgaataacgcggagcagctgtgcaggtaccagggccccgtgctcttgatcaggcggacaaaagacgagatcattaccaccactgtgcccgaggatatcatgagtaaccgggggaacgatctgcttcttaaattgctgcagcacagatatcctcgagtgatggctgaagagggactaagggtggtccggcaatggctagaagcatcatctcaattagaagaggcttctatctactctcgttgggaggtagaggaagactggtgcctctcagtcctgcgcagctaccaggcggaacacggaccggattttccttggtcggtgggcgaggacatgagcgccgacggcagaaggcaactcgctctctttttagcccggaaacacctccataatttcgaggctacacattgtacccctctgcccgcccagaatttccagatgccctggcatctttag

SEQ ID NO: 177532 - DNA, 795 bp, Artificial Sequence
  Description of Artificial Sequence: Synthetic coding sequence
atgcccccccccgccctgttcctgagcagcctgtacccccggctggagttccagaatgacttttaccggagctgcattaggaggtccagtccgcaacctccgccaaatttggcttggaggcctgagtccctgtactccggcgaactggctgggggcggctatctctcattaagcaaggttgtgcccttttcccactacgccggtaccctgctgcttctgctcgcgggcgtcgcgtgcctgagaggtatcgggcgctggactaatcctcagtacaggcagtttattactatcttggaagccacccatcggaaccagtccagtgagaacaagcgccagctggcaaactacaacttcgactttaggagctggccagttgactttcattgggaagaaccgagctctaggaaggaaagccgaggaggaccttcacgacgaggggtggcactcctgagacccgaacctttgcataggggcacagccgacactctgctgaaccgagtaaagaagctcccttgccaaatcacttcttatctcgttgcacatacactgggacgccggatgctgtacccaggatcagtctacctgctgcagaaagccctgatgcccgtcttgttgcaaggtcaggcacggctcgtggaagaatgtaacggaagacgtgcaaagctgctggcctgcgacggaaatgagatagacacgatgttcgtagacaggaggggtactgccgagccccagggccagaagctggtgatttgctgcgagggcaatgcgggcttttatgaggtgggctgtgtttag

SEQ ID NO: 177533 - DNA, 1677 bp, Artificial Sequence
  Description of Artificial Sequence: Synthetic coding sequence
atggccaagctgctgagctgcgtgctgggcccccggctgtacaagatttatagagagagggactctgagcgtgctcccgcatctgtcccagagaccccgaccgcagtaacagcaccccatagctcttcctgggatacatattatcaaccacgcgctctggaaaaacacgctgattctatcttggcacttgcttcagtcttttggtccattagctattacagttcacccttcgcctttttctatctgtaccggaaaggctatctttccttaagcaaagtggtgccattttcccattatgcagggacactgcttctattgctcgcaggtgtagcttgtttaagaggaatagggcgctggacgaacccccaatacagacagtttatcacaattttggaggctacacatagaaaccagagctccgagaataagaggcaactcgccaactacaactttgactttaggtcatggcccgtggatttccattgggaggagccgagcagtcggaaggagtcacgcggcgggccgtctcgtaggggagtggcccttctcaggcccgaacccttacatcggggtactgcagacaccctcctcaaccgcgtcaagaaactgccgtgtcagataacctcttatctcgtggcccatacgctcggaaggcgaatgctctaccccggcagcgtttatctgctccaaaaagccctcatgccggtgctgctacagggccaggcacgcctcgtggaggagtgtaacgggcgtcgggctaaattgctcgcctgcgacgggaacgagatagataccatgttcgtggaccgcagggggacagccgaaccacagggtcaaaaactcgttatatgctgcgaaggaaacgctggcttctacgaggtgggttgtgtctctacaccactcgaagcagggtacagtgtgctcggttggaaccatcctggtttcgcaggcagcaccggggtcccctttccacaaaacgaagctaacgctatggacgttgtggtgcagttcgctatccataggctcggcttccagccccaagacatcattatttatgcttggtccatcggcggattcacagctacctgggccgctatgagctaccccgatgtaagcgccatgatcttggacgcctcctttgacgatctggtgcctctggctctgaaggtaatgcctgattcttggaggggactggtcacacgcacagtcaggcagcacctgaatttgaacaatgctgagcaattgtgtagatatcagggtccagtcttgttgatccggaggaccaaggatgaaattatcacaaccactgtgcccgaggatatcatgtctaacagaggaaacgatctgctcctcaagctgctgcagcatagatatccacgggtaatggcagaggagggattgcgcgtggttcgacagtggctggaagcttcatcccagctggaggaagcatctatttactcccggtgggaagtggaggaggattggtgcctctccgtcctgaggtcctatcaggctgaacatggtcctgactttccttggtccgtcggcgaagatatgtcagctgatggtagacgtcagctcgccctctttctagcaaggaaacacttacacaattttgaagcgacccactgtactcccctccccgctcagaatttccagatgccctggcacctgtag

SEQ ID NO: 177534 - DNA, 1806 bp, Artificial Sequence
  Description of Artificial Sequence: Synthetic coding sequence
atgagccagctggcccggcggcggagccggtacggcctgaccagccgagcacacaacacgtccgaggcaggtcgagctgggccagcaggcggacctgcagccggccgtgccgcggcgagagctggcgcaatggccaagctgctcagttgtgtccttggacctcggctctacaagatctatcgggaacgcgatagcgagagagcgccggcttcagtgcccgaaacccctacagctgtgacagcgccccactccagcagttgggacacatactaccagcctcgtgctcttgaaaaacacgctgattctattttagctcttgcctccgtcttttggagcatatcctattattcaagcccgtttgctttcttctacctctacagaaaaggttatctctccctgagtaaggtagttccattctcgcactacgccggtacactcctcttactgctggcaggggtcgcgtgcttgcgcggtatcgggcggtggactaacccccagtaccgacaattcattaccattttggaggccacacaccggaatcagagctcagagaacaagcgtcagctggcaaactataacttcgattttagaagctggccagtcgactttcactgggaggagcctagctctagaaaagagtcccgcggtgggcccagtcgtcggggggtggctctgcttcgtccagaacctctccatcggggcactgccgatacactgctgaacagagtcaagaagctcccttgccagatcaccagttacctggtggcgcacactctcggacggcggatgctgtatcctggttcggtttacctgctgcagaaggccttgatgccagtgttgctacagggacaagcccggctggtcgaagagtgcaatggaagacgcgctaaactcttggcttgtgacgggaatgagatcgacaccatgttcgtggatcggcgaggcacagcagagccccagggccagaaactggtgatctgttgcgaaggtaatgctggattctacgaggtggggtgcgtgagcactcctctggaagccggatactccgtgcttggttggaaccatccgggattcgctgggtctacgggggtgcccttcccccagaatgaagccaatgccatggacgtggtcgtgcagtttgctatccaccgactaggatttcaaccacaggacattattatctatgcttggtcaattggcggctttactgcaacatgggccgcaatgagttaccctgatgtgagcgctatgatccttgacgcctcttttgatgacttggtccctctcgctctgaaggtgatgccagattcatggcgcggccttgtcaccaggactgtgcgccagcatttgaaccttaataacgccgagcagctctgccgttaccaaggccctgtgctccttattcgccggactaaggatgaaatcatcacaactacagtgcctgaggacattatgtcaaacaggggaaatgacttattgcttaaactcctgcagcatagataccctcgagtgatggctgaggagggtctgcgagtggtccgacagtggctcgaggcatcttcgcagctcgaggaagccagtatctacagtaggtgggaagtcgaggaagactggtgcttatcagtgttaagaagctatcaagccgaacacggaccagactttccatggagtgtcggggaggacatgtctgccgatggcagacgacaactggcgctgttcttggcacgcaagcatctgcataatttcgaggctacccattgtacacccctcccagcccagaactttcagatgccttggcatctctag

SEQ ID NO: 177535 - DNA, 438 bp, Artificial Sequence
  Description of Artificial Sequence: Synthetic coding sequence
atgctgggccactgctgctacttctggcaggtgtggcccgccagcgaagccttggcagcaggcccaaccccctccacagggagcagttccccctcgtggaagcagcacataggaacttccctccagaaaaccagaggttctctgccaaccaccacactaacatcgggcgccgggcagtcaacaagcaccggcaagaatccagccgcaggacgctccttggagggggccctcccagctggagtctggccttgctttgcgcagtcaccatgtactggcggtcagcagaccccctcctctaccggcctccggtcttgcttagtcaggagcccaggcgggaagcaacagcgcggagaggcccactgggggggtggggcaatatcaggcgtgttatgggagtgggcccttcattgcaaaatcgcagtgacccactgggcctag

SEQ ID NO: 177536 - DNA, 1677 bp, Artificial Sequence
  Description of Artificial Sequence: Synthetic coding sequence
atggccaagctgctgagctgcgtgctgggcccccggctgtacaagatctacagggagcgggactcggagagagcccccgcaagtgtccccgagaccccaaccgcagtgactgccccccactcaagctcgtgggatacctattatcagccgcgggctcttgaaaagcatgcggattcaattctggctctagccagcgttttttggtcgattagttactacagtagtccattcgccttcttctacctgtatcgaaagggatatctttcactgtctaaggtggttcctttttctcattacgctgggacgttgcttctcctgctggctggcgtagcctgtctaagaggtataggcaggtggacaaaccctcagtatcggcaattcatcacaatactggaggccacccaccggaatcagagttcagaaaacaagcgtcaattggccaattataacttcgattttagatcgtggcctgtggatttccactgggaagaaccttccagccgcaaggagagcagaggtgggccctcaaggcggggagttgccttgctgaggcctgaaccgctccacagaggaaccgccgacacgctgcttaacagagttaagaaacttccttgccagattacatcataccttgtggcccacacccttggcaggcggatgctatacccgggctctgtgtatctgctgcagaaggctctcatgcccgtcctgctccaaggacaggcacgactggtggaggaatgcaatggtagaagagcgaagctcttggcatgcgatggcaacgagatcgatacgatgttcgttgatagacgtgggacagcagagcctcaggggcagaaactggttatctgctgtgagggcaacgccgggttttatgaagtaggttgcgtctcgacaccattggaggctggttacagtgtcctcgggtggaaccaccccgggttcgcggggtctaccggggtgcccttccctcaaaacgaagcgaacgccatggacgtcgtggttcagtttgcaatccatcggctgggcttccagccgcaggacattatcatctacgcctggagcattgggggttttacggccacgtgggccgccatgagttatcccgacgtgagcgccatgatcctggacgcatccttcgatgacttggtgcctctagccctgaaagtgatgcctgactcatggcgaggtctggttacaaggactgtacggcagcacctgaatctgaataacgccgagcaactctgccggtaccagggcccagttcttcttatccggcggaccaaggatgagattataacaacaaccgtgcccgaggacatcatgagtaacagaggaaacgatttgctgctgaaactgctacaacataggtatccacgggtaatggctgaggaggggttgagggtcgtgaggcagtggctggaagcctcttctcaactggaagaggcatcgatttacagtcgttgggaggtggaggaggactggtgcctgagcgtgttgaggagttaccaggccgagcacggccccgacttcccatggagcgtcggcgaagatatgtcagcagacggccggcgtcagctggccttgttcctggcccgaaagcacctccacaacttcgaagctacccactgtactccactacctgcacagaactttcagatgccatggcatttgtag

SEQ ID NO: 177537 - DNA, 1677 bp, Artificial Sequence
  Description of Artificial Sequence: Synthetic coding sequence
atggccaagctgctgagctgcgtgctgggcccccggctgtacaagatttatagagagcgggactctgaacgggccccggccagcgtgcctgaaactcccaccgcagtgacagctccccactctagctcgtgggatacttattaccaaccccgcgcattggagaagcacgcggattcaattttagccctcgcctccgtgttctggagcatatcctattactcctcaccatttgccttcttctacctttaccgaaagggctacctatccctgtcaaaagtggtgcctttcagtcactatgctggtacgcttctactgctactcgctggagtagcctgtctacgtggaatcgggaggtggacgaatccccaatatcggcagttcatcacaatattagaagctacacacagaaatcagagttcagaaaacaaaaggcaactcgcaaactacaatttcgactttcgcagttggcccgtggattttcactgggaagagccttcaagcagaaaggaaagccgtggcggcccttcgcgccgcggtgttgccctcctgaggccggagccgctgcaccgcggaacagccgatactctgctgaacagggtgaagaagttaccctgtcaaataacttcctacctggtcgcccatacattaggacggcggatgctataccccggaagcgtgtatctattgcagaaggcactgatgccagtcctcctgcagggacaggcacggctggtcgaagagtgcaatggcaggcgcgcaaagctactagcttgcgatggaaacgaaatagacaccatgtttgtggaccggcggggcaccgccgagccccaggggcaaaagctggttatctgttgcgagggcaacgctggcttctatgaagttggctgtgtgtccactcctctggaagccgggtacagtgtcttgggttggaaccatcccggattcgctgggagcactggggtcccttttccgcagaatgaagccaatgcgatggacgttgtggttcagttcgcgattcaccggttggggtttcagccacaggacattataatctatgcttggtccatcggggggttcacggcgacctgggcagcaatgtcttatcccgatgttagtgctatgattcttgacgcctccttcgatgatcttgtacccctagccctcaaggtgatgcccgattcctggcgagggctggttactcggacggtgcggcagcatctaaatctgaacaatgccgagcaactgtgccgctaccagggcccggtactgctcatcaggaggacaaaagacgaaatcattactaccacagttccagaagatataatgtcgaataggggtaacgacttgttgctaaaactgttgcagcaccggtatccaagggtgatggccgaggaaggattacgcgttgtacggcagtggctagaggctagcagccaattggaagaggcctcgatttatagtcggtgggaagttgaggaagattggtgtctgtctgttctgcgatcctatcaggccgagcatggtcccgattttccgtggtcagtgggggaagatatgtcggctgacggacgacggcagctcgccttattcctggcccgcaaacaccttcataacttcgaggcaacccactgtactccactcccagcacagaatttccagatgccatggcacttatag

SEQ ID NO: 177538 - DNA, 1677 bp, Artificial Sequence
  Description of Artificial Sequence: Synthetic coding sequence
atggccaagctgctgagctgcgtgctgggcccccggctgtacaagatctatcgggaacgcgactccgaaagggcacctgcgagcgttcccgagactcccaccgcggttacggctccacattcctccagctgggatacctattaccaaccacgggccttggagaaacatgccgatagcattctggctttggcatctgtattctggtccatcagttactacagctctcccttcgctttcttttatctatatcgaaaaggctacctgtccctgagcaaggttgtccccttcagtcactacgccggaacactgctgcttctcttggccggggtggcttgcttacgaggcattggcagatggaccaacccccagtataggcagtttatcactattcttgaggccacacacaggaatcagtccagtgagaataagcggcagctggcgaactataattttgacttccgctcgtggcccgtcgatttccattgggaagagccatccagccgtaaagagtcccgcggtgggcccagtcgaagaggtgtagctctcctgcggcctgagcctttgcacagaggcacagctgacaccctgcttaatagagtaaagaagcttccttgtcagatcacttcataccttgtggcccatacactcggacgccgcatgctgtatcccggcagcgtgtacctccttcaaaaggctctcatgccagtcctcctgcagggacaggcgaggctggtcgaggaatgcaacggtcgccgcgccaaactgttagcttgtgatggcaatgagattgatacaatgttcgtggataggcgaggcacagcggaaccccaagggcagaagctggttatctgttgtgagggaaacgcgggcttctatgaggttggttgtgtgtccacgcctcttgaggcaggctactctgtcctgggctggaatcaccctggcttcgccggctccactggcgtgccatttccacagaatgaggcgaacgcgatggatgttgtcgtacagttcgccattcatcgattgggatttcagccccaggacataattatttacgcctggagtatcggaggatttacagcgacttgggccgccatgtcgtacccggacgtgagcgcaatgatcctggatgcaagcttcgatgacctcgtgccactggccttgaaggtcatgcctgatagctggagggggctggttacccgaaccgtcagacagcacctgaatctcaacaatgcagagcaattgtgtcgctaccagggccccgtccttctcatcagaagaaccaaagatgaaattatcactacgaccgtacctgaggatatcatgagcaatcgggggaacgatctgttgctgaaacttctgcaacatcgctaccctcgtgtcatggcagaggaggggctaagggtggtgagacagtggctggaggccagctctcagttggaagaggcttctatctattcacgttgggaagtagaggaagactggtgtctgagtgtgcttcgcagctaccaggcagagcatggacctgattttccatggagcgttggagaggatatgtcagctgatggcagaagacaactcgcactgtttctcgctcgaaagcatctgcacaacttcgaggccacccattgcacccccctgcccgcccaaaatttccagatgccctggcatctgtag

SEQ ID NO: 177539 - DNA, 438 bp, Artificial Sequence
  Description of Artificial Sequence: Synthetic coding sequence
atgctgggccactgctgctacttctggcaggtgtggcccgccagcgaagctctggctgccgggcccacaccttccaccggtagctccagcccatcttggaagcagcacatcggaacaagcctccaaaaaacaaggggctccctgccgaccactacactcacaagtggagcgggacaatccacaagcaccggcaaaaatcccgctgcaggtcggtctctggagggcgccctcccagccggtgtttggccgtgctttgcacaaagcccatgcacaggaggccaacagacccccagctccaccggacttcgatcctgcttggtacgcagccctgggggaaagcagcagcgcggtgaggctcactggggcgggggagccatcagcggagtgctctgggagtgggccctgcattgcaaaattgccgtgacccactgggcctag

SEQ ID NO: 177540 - DNA, 438 bp, Artificial Sequence
  Description of Artificial Sequence: Synthetic coding sequence
atgctgggccactgctgctacttctggcaggtgtggcccgccagcgaggccctggccgccggccctacccctagcacagggagcagttcaccaagctggaagcagcatattggcaccagcctgcaaaagacacgcgggtccttgcccaccaccaccttaaccagtggggctggccagagtacatctacagggaaaaaccctgccgctggtaggtcactggaaggcgcattaccagcaggcgtgtggccttgcttcgcacaaagtccatgtacgggagggcaacagactccctcatccacagggttacgttcgtgcttggtacgcagcccaggcggaaaacagcagaggggggaggcacattggggaggcggggccatttctggagtgctctgggagtgggctctgcattgtaaaattgcagtgacgcattgggcctag

SEQ ID NO: 177541 - DNA, 438 bp, Artificial Sequence
  Description of Artificial Sequence: Synthetic coding sequence
atgctgggccactgctgctacttctggcaggtgtggcccgccagcgaagccctagccgcgggccctacccctagcaccggttcatcatctcccagttggaaacagcatatcggaactagcctccaaaaaacccggggtagcctcccaacaacaactctcaccagtggtgcaggtcagtcaacctctacaggcaagaatccggcagctggacgatccctagagggcgctttgccagctggggtctggccatgtttcgcacagtcaccatgtaccggaggccagcagaccccatcctcaaccggactgcgcagctgcctcgttcgctcccccggcggtaaacagcagcgtggagaggctcattggggggggggtgcaatctccggcgtgctatgggagtgggctcttcactgtaaaattgctgtgacacattgggcttag

SEQ ID NO: 177542 - DNA, 1578 bp, Artificial Sequence
  Description of Artificial Sequence: Synthetic coding sequence
atgcccccccccgccctgttcctgagcagcctgtacccccggctggagtttcagaacgacttctacaggtcctgcataagacgcagtagcccccagccccctcctaacctggcatggaggcccgagagcttgtatagcggcgaattggctggtggcggctacctttcactttctaaggtggtccccttctctcactacgctggtacacttctgctcctgctggccggggtcgcttgtctccgcggtattggtcgatggaccaaccctcagtaccgtcagttcatcacaatcctggaggctacacacaggaatcaatccagtgagaacaagaggcagttagccaattataacttcgactttcgttcctggcctgttgacttccattgggaagagccaagtagccgcaaggagtcccgagggggtcccagcaggaggggtgtggctttgctgcggcccgagccccttcataggggcaccgcagatactctgctgaacagagtcaaaaagctaccatgccagattacctcctatctcgtggcccacactctcgggcggcgcatgctttacccgggatccgtctatctattacagaaagccctgatgcccgtgctcctccaaggccaggcccggcttgtggaggagtgcaacggacgaagggccaagcttctcgcctgcgacgggaatgagatcgacaccatgttcgtggaccggagagggaccgcagagccacagggacagaagttagtgatttgctgtgaaggcaatgctggtttttatgaagttgggtgcgtgtcaactcctctggaggccggatacagtgttcttggatggaatcacccgggtttcgccggttccaccggcgtaccctttccccaaaatgaggctaacgctatggacgtggttgtacagtttgctatccacagactcgggtttcagcctcaggatataatcatatatgcttggtctatcgggggcttcacagccacctgggccgctatgagctaccccgacgtgagtgcgatgatcctggacgccagttttgatgacctggttcccctcgctctcaaagtgatgccagactcttggcggggactagtcactagaacagtgcggcagcacctgaacctaaacaacgccgagcaactgtgtagatatcaggggccagtgttgttgattagaagaacaaaggatgagattattacaacaacggtgcccgaggatataatgtcaaacaggggaaatgatcttctgctgaaactgttgcaacacagataccctagagtgatggctgaggaggggctcagggttgttaggcagtggctcgaggcaagtagccaactcgaggaagcgagcatctactcacgctgggaagtggaagaggactggtgcctgtcagtgctacgatcttaccaggctgagcatggccccgacttcccctggtcggtgggggaagacatgtcagccgatgggagaagacagctggccctctttcttgctaggaaacatctccacaattttgaagccacccactgtacccctctgccggcccagaactttcagatgccatggcatctgtag

SEQ ID NO: 177543 - DNA, 1677 bp, Artificial Sequence
  Description of Artificial Sequence: Synthetic coding sequence
atggccaagctgctgagctgcgtgctgggcccccggctgtacaagatatacagagagcgggactccgaacgtgccccagcgtcagtacccgagacacccactgcagtgacagctccgcactcgtctagttgggacacctactaccaaccgagggcgttagagaaacatgcagatagcatcctcgcgttggccagtgtgttttggtcgatttcttattacagcagtccgttcgccttcttctacttatacagaaaaggatacctgtccctttcaaaagtagtgccgttctcgcactatgccggaactctgctgctgttgctggctggtgttgcgtgtcttcgggggattggccggtggaccaacccacagtaccggcagttcatcaccattctggaagcgactcaccgcaatcagagttcagagaacaagcgtcagctcgccaactacaattttgacttcagatcatggcccgtggacttccattgggaggagcccagttcgagaaaggaatcgcggggcggaccatcccgaaggggcgttgccctgctcagacctgagccacttcacaggggcactgctgatacactactcaatagggttaaaaagctgccttgccaaatcacttcttacctggtggctcacaccctcggacggaggatgctttatcccggttcagtctacttgttgcaaaaggctctgatgcccgtactcctgcaaggccaggctagactcgtcgaggaatgcaatggacggagggccaagctgctcgcctgcgatggcaatgagattgacaccatgttcgttgatcggagaggtacagcagaaccccagggtcagaagctggtcatctgttgcgaggggaacgctgggttttatgaggtagggtgtgttagcactccccttgaagccggctatagcgtgctgggatggaatcatcccggtttcgcaggatcaacgggcgtgcccttcccccagaacgaggccaatgctatggatgtggttgtgcagttcgccattcaccgactggggttccaaccacaagatattattatctacgcttggagcatcgggggttttacagctacctgggccgccatgtcttacccagacgtgtcggcaatgatcttggatgctagcttcgacgatctggtgcctcttgcgctgaaagtgatgccagactcatggagagggctggtgactcggacggtccgtcaacacttaaatctgaacaatgcagagcagctgtgtcgttatcaagggcctgttctcctcatacgtcgaaccaaagatgagatcattactactactgtgccagaagatatcatgtcgaaccggggaaacgatctgctactgaaactcctgcagcatagataccctcgcgttatggccgaggagggcttacgtgtagtcagacagtggctagaggcgtccagccagctcgaagaggctagtatctacagtcgatgggaggtcgaggaagactggtgtctgtcagtactgcgatcttaccaggcagagcatggtccggatttcccctggagcgtaggagaggacatgagcgcagacgggaggcgtcagctggcgttgtttctcgctagaaagcatctccacaattttgaagctacgcactgcacgccacttcccgctcaaaattttcaaatgccttggcatttatag

SEQ ID NO: 177544 - DNA, 1578 bp, Artificial Sequence
  Description of Artificial Sequence: Synthetic coding sequence
atgcccccccccgccctgttcctgagcagcctgtacccccggctggagttccagaacgatttttataggagctgcatccggcgaagctcacctcagccaccacctaacctcgcttggaggcccgaaagtttgtactccggagaactggcaggggggggatatctttccctctcaaaggtggtaccgttctcccattacgccggtactctgctcctgctgctggcaggggtcgcttgcctgcgggggattggccgttggaccaaccctcaataccgccagtttataaccatcctggaagccacacatcggaatcagagttcggagaacaaaagacagcttgcaaactacaatttcgattttcgatcgtggcctgtggacttccattgggaggagccttcctctcggaaggaaagtcgcgggggcccaagccgccggggggtcgctctgctgcgccccgagcccctacatcgaggaacggccgacactctgctgaaccgagtgaagaagcttccatgtcaaattacctcttacctggtggctcacactctcgggagaagaatgctctatccagggagcgtgtatttactccagaaagccctgatgcctgtgctgctgcagggacaggctcgtcttgtggaagaatgcaacggcagacgggcaaaattgttggcgtgcgacggtaacgagatcgataccatgttcgtagatcgccgtggaacggccgaacctcaggggcagaagttggtgatttgctgcgaaggcaacgcgggtttctacgaagtcgggtgcgtctccacccctctcgaggccggatatagtgtccttggttggaaccatccaggctttgcagggtccacgggagtccccttccctcagaacgaggctaatgcaatggacgtggtggttcaatttgccatccatagactgggcttccagccccaggacatcatcatatacgcttggagcatcggtggtttcacagccacgtgggctgccatgtcctaccccgacgtgtcagctatgatcctggacgcgtctttcgacgaccttgtacccctcgccttaaaagtcatgcctgattcctggagggggctggtaacccggactgtcagacagcacctgaatcttaacaacgccgaacagctctgccgatatcaggggcccgtgctgctcattagaaggacaaaagatgaaatcattactacaactgttccagaggatatcatgtcgaatcggggaaacgatctccttctaaaactgcttcagcaccgctatcctcgagtgatggccgaggaggggcttcgggtcgtgaggcaatggcttgaagctagcagtcagctggaggaagcgagcatctatagccgttgggaagttgaagaggattggtgcctgtccgtcttgcggtcttaccaggcagaacacgggcccgatttcccctggtctgtcggcgaggatatgtcagcggacgggcgccgacagttggctctttttcttgccaggaagcatctccacaactttgaggcaacacattgcactcctctgcccgcccagaattttcagatgccgtggcacctctag

SEQ ID NO: 177545 - DNA, 1578 bp, Artificial Sequence
  Description of Artificial Sequence: Synthetic coding sequence
atgcccccccccgccctgttcctgagcagcctgtacccccggctggaatttcagaacgatttctatcgcagttgtatcagacgctcgagcccccagcctccgcccaatctggcatggcggccggagagcctgtactcgggagagctagcaggtggtgggtacctatcattgagcaaggttgtgcctttttctcactacgccggcaccctgctgttgcttctcgctggcgtcgcttgcctccgaggaattggacggtggacaaatccacaatataggcaattcatcacaattctggaggcaacgcatagaaaccagagcagtgaaaacaagaggcagttggccaactataattttgatttcaggagctggccggtggacttccactgggaagagccctcaagcaggaaggaatctcgggggggcccgagccggaggggggtggctctacttcgtccagagccactgcacaggggaaccgctgatacactcttgaatcgcgtgaagaagctgccctgccagatcacatcttacctcgtcgcacatactttggggcggcgcatgttataccccgggagtgtatatttgctgcagaaggcactgatgcccgtcctgctacagggccaagctaggttagtggaagagtgtaatggtcgtcgcgccaagctcctcgcctgtgacgggaatgagatcgacactatgtttgtggacaggcgaggtaccgccgaaccgcaaggacaaaagctcgtgatctgttgcgagggtaatgctggtttttatgaggttggatgcgtcagcacccccttggaggctggatatagcgtgttaggctggaaccaccctggttttgctggttctacgggcgttccctttccacagaatgaggccaacgctatggacgtggttgtacagtttgctattcaccgtctgggtttccagccccaggacattattatctacgcgtggagcattggcggcttcacagcaacctgggccgctatgagctatcctgatgtgtcagcaatgattttggacgccagctttgacgacctcgtccctctcgctctgaaggtgatgcctgactcctggagaggcctggtcacccgcactgtccggcagcatctcaatctgaataatgcggagcagttatgccggtaccagggacctgtactgctgatccgtaggactaaagatgaaatcatcacaacaaccgtccctgaggacatcatgagtaacagggggaatgacttactgttgaaactcctgcagcatcgctacccccgggtgatggctgaggagggcttgagggtggtcagacagtggcttgaggcttcctctcagttagaagaagcatccatttactcccgttgggaggtagaggaggattggtgtttgagtgtgctccgctcctatcaagcagaacacgggccagacttcccatggtccgtaggggaagacatgagtgctgatgggcgcagacagcttgctctcttcctggcgaggaagcacctgcacaacttcgaggccacacattgcacgcctctaccggctcaaaacttccagatgccctggcacttgtag

SEQ ID NO: 177546 - DNA, 438 bp, Artificial Sequence
  Description of Artificial Sequence: Synthetic coding sequence
atgctgggccactgctgctacttctggcaggtgtggcccgccagcgaggcactggctgccgggccaacaccctcaaccggaagctccagcccgtcctggaaacagcatataggcaccagcctgcagaagacaagggggagccttcccacaaccacgctgacgagcggcgccgggcagagcaccagcacagggaagaatcccgcggccggcaggtctctcgagggagctctccctgccggggtatggccatgcttcgcccagagcccttgcaccggcgggcagcaaaccccctcttcgactgggctgcgctcttgcctggttcgctccccaggcggcaagcaacagaggggcgaagcacactggggcggaggcgcgatttccggagtgctctgggagtgggcactgcattgcaagatcgccgtgacacattgggcctag

SEQ ID NO: 177547 - DNA, 1578 bp, Artificial Sequence
  Description of Artificial Sequence: Synthetic coding sequence
atgcccccccccgccctgttcctgagcagcctgtacccccggctggagtttcagaatgatttttatcggtcgtgcatccggaggtctagcccccagcctcctccaaaccttgcctggaggccggagagcctatattccggagagctcgcaggtggagggtacctgtctcttagtaaggtcgttcccttctctcattatgcaggcaccctgctcctcctgctggccggtgtcgcatgcctgaggggcatcgggcggtggacgaatccacagtaccggcagttcatcaccatcctggaggccactcacaggaaccaatcctctgaaaataagcggcaactcgccaattacaattttgatttcagaagttggcctgttgatttccattgggaagagccctcttcacgcaaagagagtagggggggcccctcccgacgtggggttgccctgctcagaccggagcccctgcataggggcacagcagataccttactcaatcgggtgaagaagttgccgtgccaaatcacaagttacctggtcgcccataccctggggaggcggatgttgtacccaggctcagtctatctgctgcaaaaagctctgatgcctgtgttgctacaaggtcaggccagacttgttgaagaatgcaatggacgaagagctaagctgctggcatgtgatggcaacgagattgacacaatgttcgtggacagacgagggacagccgaaccacaggggcagaaacttgttatttgttgtgaaggcaacgcaggattctatgaagtcggctgtgtcagtactcccctggaagcgggctattcagtgctcggctggaatcacccgggcttcgcggggagcacaggtgtgccgttcccccaaaacgaggccaacgctatggatgtggtggtgcagttcgctatacacaggcttggcttccagccacaggacatcataatctacgcatggagtatcggggggttcacagcaacatgggcggcgatgagttatccagatgtgagcgctatgattctcgacgcgtcttttgatgatctggttccattggccctgaaggtgatgcccgactcttggcgaggacttgtgaccaggaccgtccgccagcatctaaatctcaataatgctgagcaactgtgtcgctaccaagggcccgtcctcctcatacggaggaccaaggatgagatcataactacaacggttccagaagacataatgagtaaccgaggtaacgatctgttgctaaagctgcttcagcatagatacccgcgcgtcatggccgaggagggcctgagggtcgtcaggcagtggttggaagccagctcacagttggaggaagcctctatatattcccggtgggaggtggaagaagattggtgcttatccgtgctgagatcttatcaggcggaacacggccctgactttccttggtctgtcggtgaagatatgtccgccgacggccggcgccagcttgcactgttcctggcccgcaaacacctgcacaactttgaagctacacattgcacccccctgccggcccagaattttcagatgccatggcatctttag

SEQ ID NO: 177548 - DNA, 1677 bp, Artificial Sequence
  Description of Artificial Sequence: Synthetic coding sequence
atggccaagctgctgagctgcgtgctgggcccccggctgtacaagatctacagggaacgcgattctgagagagctccggcgtccgtccctgagactccgacggctgtgacagccccacatagttcttcatgggatacctactaccagcctagagcactcgaaaaacacgcggattccattcttgccctcgccagtgtgttttggtcaatcagctattactcgagtccattcgcgttcttctatctctaccgaaaaggatatttgtcactgtctaaagtcgtgccattcagtcactacgcagggactctcctactgcttctggcgggcgtcgcctgcctcagaggcattggaagatggaccaatccccaatatcgtcagttcataactatacttgaggcaactcatcggaatcagtctagcgagaataaacgtcagcttgctaactacaattttgacttccgatcctggcccgttgattttcattgggaagagccgtccagccggaaggagagccggggaggaccttcacgccggggggttgcccttcttaggcctgaacctctccaccgtgggactgccgacacactcttgaacagagtgaaaaaactgccttgccaaatcaccagctacctggtagcccataccctgggacggaggatgttatatccagggtcagtctatcttctacagaaagccctgatgcccgttctcctgcaaggacaagcccggctggtggaggagtgcaacggccggagggccaagctcctcgcatgtgacgggaacgaaatcgatactatgttcgtagatagacgtgggactgcggagcctcaagggcagaagcttgtgatatgttgcgaaggaaacgctggtttttacgaggttggatgtgtctcgacaccattggaggcgggatattccgtcctggggtggaaccatccgggtttcgcagggtccactggggtgccattccctcaaaacgaggcaaacgccatggatgttgtggtccaattcgctattcacagattgggttttcaaccacaggatattattatctacgcatggtctattggtggctttaccgccacatgggctgccatgagctatcctgacgtatcagccatgatcttggacgcttcctttgacgatctggtccccctcgcacttaaagtaatgccagattcttggcgcggtctggtaacacgaaccgtgcgccaacacctgaacctgaataatgccgagcagctctgtcggtaccagggtcctgtcctgctgattagacgcaccaaagacgaaataattactacaactgttccagaagatatcatgagtaataggggcaatgacttactcctaaagttgctacagcatcgctatccacgggtcatggccgaggaggggctgcgtgtggtgaggcagtggctggaagcatcttcacagctagaagaagcaagcatctactccagatgggaagtggaagaggactggtgtctgagtgtgctgagatcctatcaggcagagcatggccctgattttccatggagcgtaggagaggacatgtcagcagatgggaggcgccagttagccttattcctggctaggaagcacttgcacaacttcgaggcaactcattgcacccctctgcccgctcagaatttccaaatgccttggcatctgtag

SEQ ID NO: 177549 - DNA, 1578 bp, Artificial Sequence
  Description of Artificial Sequence: Synthetic coding sequence
atgcccccccccgccctgttcctgagcagcctgtacccccggctggagtttcagaatgacttctaccgaagctgcatccgaagaagcagtcctcagcccccccccaatctcgcgtggcgacccgagtccctttactccggcgaactagcaggcggggggtacttgtccctgagcaaggttgtgccgtttagtcattacgcaggcaccctgctgctcctgttagccggagttgcatgcctgaggggaatcgggcgttggaccaatcctcagtatcgtcagtttattactattttggaggccactcatcgaaatcagtcatctgagaacaagcgccagttagcaaattacaatttcgattttcgatcttggcctgtagacttccattgggaggagccctccagccgcaaagagtctcgtgggggacccagccgtcggggggttgcactgttgagacccgagccacttcatagagggactgcggacacactgctgaaccgggtcaagaagctgccctgtcagattaccagctatctggttgctcatacgctgggcaggcgtatgctctatccaggttcggtgtatctgctgcagaaggcacttatgcctgtgctcctgcaggggcaggcccgcctggttgaagaatgcaatggcaggcgagccaagttgttagcctgcgacggaaatgagattgacaccatgttcgttgaccggcggggcactgcggagccgcaaggtcagaaacttgtcatctgctgcgagggaaatgctgggttctatgaggtcggctgtgtctccacccccttggaggctggatacagcgtactaggctggaaccatcctggattcgcaggttctacaggggtgcccttcccacagaacgaggccaacgcgatggacgtagtggtgcagttcgctatacacagacttggctttcaaccccaggacatcatcatctatgcttggtctattggcggattcaccgcaacatgggcagcaatgtcctatccggatgtaagtgcgatgattctggatgcaagtttcgatgacctggttccccttgccctcaaagtaatgccggattcttggcgcgggctagtcactcgaaccgtccggcagcatctgaatctaaacaatgcagagcagctgtgccggtaccagggcccagtcttattgatcagacgcacgaaggatgaaattataacaacaacagttcccgaagacattatgtcgaatagaggtaacgatctcctgctgaagcttctgcaacatcgctaccccagggtgatggctgaggaagggttacgggtggtccggcagtggctcgaggccagttcacagcttgaggaagcaagtatctatagccgatgggaggttgaggaagactggtgtctcagcgttctaaggtcgtaccaggccgaacacgggcctgacttcccctggagcgtgggcgaagacatgtcggccgacggccggagacagctggccttgttcctggccaggaagcacctccataactttgaagcaacacactgtactcctctgcctgcccagaattttcagatgccctggcatctgtag

SEQ ID NO: 177550 - DNA, 438 bp, Artificial Sequence
  Description of Artificial Sequence: Synthetic coding sequence
atgctgggccactgctgctacttctggcaggtgtggcccgccagcgaagccctggccgctggcccgacgccaagcacgggtagctcaagcccttcgtggaaacagcacatcggcacgagcctgcaaaagactagaggctcattgccgacaactaccctgacttcaggggccggccaatccactagcaccgggaaaaaccctgcggccggtagatccttggagggagctttaccagcaggagtgtggccctgttttgctcagtccccatgtacaggcggacagcaaacgcctagtagtactggcctgcgttcctgcctcgtgagaagtcccggagggaagcagcagcgcggcgaggcacactggggcgggggagccatcagtggagtactgtgggagtgggccctgcactgtaaaatcgccgtgacccattgggcatag

SEQ ID NO: 177551 - DNA, 1578 bp, Artificial Sequence
  Description of Artificial Sequence: Synthetic coding sequence
atgcccccccccgccctgttcctgagcagcctgtacccccggctggaatttcagaatgatttttacaggtcatgtattcgccggtcttcccctcaaccacccccaaatttggcttggaggcccgagtcattatacagtggcgagctagccggaggtggctatttaagcctgagtaaagtggtgcccttttcccactacgccggaaccttgctcttactcctggcgggagtggcttgcctgcgcggcatcgggcggtggacaaatccgcagtacaggcagttcattactatactcgaggcaacacatcgcaaccagtctagcgagaacaagagacagctcgctaactataattttgattttcggagttggccagtcgatttccattgggaagaaccctcttcaagaaaggaaagtcgggggggcccgtctcgccggggggtcgccctacttagaccggagccattacatcgcgggacagccgacacccttctgaatagagtcaagaaattgccctgccaaataacgtcgtaccttgtagctcacaccctgggcagacgcatgctgtaccccggatcggtgtatttgctgcaaaaggcgctgatgccagttttgctgcagggccaagcacgcctggtcgaggagtgtaacgggagaagggctaagttattggcctgtgatggcaacgagattgataccatgttcgtcgatcggcggggaacagctgaaccacagggacagaagcttgttatttgttgcgaaggaaacgccgggttttacgaggtaggttgcgtttccacccccctcgaggcaggatactctgtgcttggttggaatcatcccgggttcgccggctctactggtgttccattcccccaaaacgaagccaacgccatggatgttgttgtgcaattcgccattcatagactgggcttccagcctcaagacattatcatatatgcctggtccataggggggtttactgccacttgggccgcaatgagctaccccgacgtttctgctatgatactagacgcctctttcgacgatctggtccctcttgctctcaaagtgatgcccgactcatggcgcggcctggttacgcgtacggtgcgccagcatctcaacctgaataacgctgagcaactttgtcgataccaggggccggtcttgctgatcagaagaactaaggacgagattatcacaacaaccgtcccagaagatatcatgtctaatagagggaatgatctgctgctgaagctattgcagcaccgctaccctcgcgtgatggccgaggaggggctacgggtggttcggcagtggctggaggcatcctcacagctggaagaagcttcgatctacagccggtgggaagtggaagaggattggtgcttaagcgttttgcgcagctaccaggccgaacatggcccagacttcccctggtccgtgggggaggacatgtctgccgacggaaggcgccagttggcccttttcctggctcggaaacatctgcacaacttcgaggcaacacactgtacgccattacctgctcagaactttcagatgccctggcacctttag

SEQ ID NO: 177552 - DNA, 438 bp, Artificial Sequence
  Description of Artificial Sequence: Synthetic coding sequence
atgctgggccactgctgctacttctggcaggtgtggcccgccagcgaagcattggcggccgggcctacaccgtccaccggcagttcctccccttcctggaaacagcacatcggaacgagtctacagaagacccgcggatcactccctaccacaacactgaccagcggcgctgggcagtcgacatccaccggtaagaacccagccgctgggcgatcgctggaaggggcccttcctgctggagtgtggccatgttttgcacaaagcccgtgtacaggcgggcagcagacacctagcagtaccggactccgttcatgcctggtaagatccccggggggcaagcagcagcggggcgaagcccattggggtggcggagccatcagcggggtgctgtgggaatgggccctgcactgtaaaattgccgtgacccactgggcatag

SEQ ID NO: 177553 - DNA, 1578 bp, Artificial Sequence
  Description of Artificial Sequence: Synthetic coding sequence
atgcccccccccgccctgttcctgagcagcctgtacccccggctggagttccaaaatgacttctatcggtcttgtatccgccgctccagccctcaaccaccgcccaaccttgcctggaggcctgaaagtctgtacagtggcgagctagctggaggcggatatctgagcctttctaaggtggtcccatttagccattatgccggaaccctgttgctgctgttagcaggggtggcatgtctccgagggattggacggtggacgaatccccaataccgtcagtttattaccatcttggaggcaactcacagaaatcagtccagcgaaaacaagcgtcagcttgccaactataactttgacttccgcagttggcccgtggacttccactgggaggaaccctcttccagaaaggaaagccgcggtggcccaagccggcggggcgtggctctgctaagaccagagccacttcaccgcgggaccgctgacacattgcttaaccgtgttaaaaagctgccatgccagattacctcgtatctagtggcccatactctcggccggagaatgctgtatcccgggtcagtctatctactccagaaggcccttatgcccgtgctcctgcagggccaggcgcgattagtggaagaatgtaatggaagaagagcaaaactcctcgcctgtgatggtaacgagatcgatacaatgttcgtggatagaagagggacggccgaaccccaggggcagaagctggtaatttgctgcgagggtaatgccggcttctatgaagtgggctgcgtgtctacaccacttgaggctggttattcagtactcggatggaaccacccgggatttgctgggtccactggcgtcccgttcccccaaaatgaagcaaatgccatggacgtcgtggttcaatttgccattcatcgactaggcttccagccccaagatatcataatctacgcatggagtattgggggcttcactgccacatgggctgccatgtcttacccagacgtttcagccatgatcctagatgcctcattcgatgatctggtccccctggcacttaaagttatgccggactcatggagggggcttgtgaccagaactgtccgtcagcaccttaatctgaacaacgcagaacagctttgtcgctatcagggcccagtcctgctaataagaagaacgaaggatgagatcattacgacgaccgttcccgaagacatcatgagtaaccgcggcaacgacctgctcctgaagctgttacaacatcggtatccaagggtgatggcggaagagggcttgcgcgtggttagacagtggcttgaagcaagctctcagctcgaggaggcttctatctattcgcggtgggaggtcgaagaagactggtgtctctcagtcctcaggtcctatcaagccgaacacggccccgactttccctggagtgtcggagaggacatgagcgcagacggaagacgccagctggctcttttcctcgcgagaaaacacctacataactttgaggcgacccactgcacgcccctgcctgcacaaaattttcagatgccatggcacctctag

SEQ ID NO: 177554 - DNA, 1278 bp, Artificial Sequence
  Description of Artificial Sequence: Synthetic coding sequence
atgaacgccatgctggagacccccgagctgcccgccgtgttcgacggcgtgaagcttgcagcggttgcagcggttctatatgtgattgtgagatgtctgaaccttaagagtccaacagctccaccggatttatattttcaggactctggcctgtctcgcttcctcttgaagagctgtccactactcactaaagagtatattcccccacttatctggggaaaatcaggccacatccagaccgccctgtacgggaagatgggacgcgtgcggagcccccatccctacggacaccgtaaatttatcactatgtctgacggcgcgacgagcaccttcgacctgttcgagcccctcgccgaacactgcgtgggggacgatattaccatggtcatttgcccgggaattgctaatcattcagaaaaacaatacatcaggacctttgtcgactacgcgcaaaaaaacggatatcgctgcgccgtgctcaaccacttgggggcactccccaatatcgaactgacctccccccgcatgttcacatacggatgcacctgggagtttggcgctatggtgaactacatcaaaaaaacctaccctctgacccagttagtcgtggtcgggttctcacttggaggcaacatcgtttgtaagtatctaggggagacgcaggcaaaccaagagaaggttctctgctgtgtatctgtgtgccagggctactccgctctgagggcccaagaaaccttcatgcagtgggaccagtgtagacgattctacaacttcctcatggccgacaatatgaaaaaaattattctgagccaccgacaggccctatttggggaccatgttaagaaaccccagagcctggaagatactgaccttagtcgattgtacaccgccacatccctgatgcagatcgacgataacgtgatgaggaagttccacggttataactcccttaaagaatattatgaggaagagtcatgcatgcggtacctacaccggatctacgtgccactcatgctggtgaacgccgccgacgacccgctggtgcatgaaagtctgctcactattccgaaaagtctctctgagaagcgggagaacgtcatgttcgttctcccgcttcatggcggacacctgggattctttgaagggtccgttctgtttcctgaacccttaacatggatggataaattggttgtggaatacgccaatgccatttgccagtgggaacggaacaagctccagtgctccgatacagaacaagttgaagcggatttagagtag

SEQ ID NO: 177555 - DNA, 1278 bp, Artificial Sequence
  Description of Artificial Sequence: Synthetic coding sequence
atgaacgccatgctggagacccccgagctgcccgccgtgttcgacggagtgaagctagccgccgtcgcagcagtgctctacgtgatagtccgatgtctcaatttaaagtctccaactgctcctccagacttgtacttccaagactccgggctgagcaggtttctactgaagtcatgcccgttgctgacaaaggagtatatacctcccttgatctgggggaagagtggccacatacagaccgccctgtatggcaaaatggggagagtaaggtctcctcatccgtatggacatcgcaaattcattactatgtcagacggtgcaacaagtacttttgacctgttcgaaccccttgctgagcactgcgtgggcgatgatatcacaatggtgatttgtcccggaatcgctaatcatagcgagaaacagtatatccgaacattcgttgactacgcgcagaagaacgggtatcgttgtgccgtcttgaaccatctcggcgccctcccaaatatcgagttgacgtctcctcggatgttcacctatggctgcacctgggagtttggtgccatggtcaattatatcaaaaaaacctacccccttacccagctagtggtggtgggctttagtttaggcgggaatatagtctgtaagtatctcggcgaaacgcaagccaaccaggagaaagtattgtgttgcgtcagcgtgtgccaagggtattcggctctcagggcgcaagagacgttcatgcagtgggatcagtgtcgtcgtttttataatttcctaatggccgataatatgaaaaaaattattctgtcccaccggcaggcactctttggagaccacgtcaagaaaccccaatccctggaggacacagatctgagcaggctttatacagccacctcccttatgcaaattgacgataatgtgatgagaaagttccatggttataactcccttaaggaatattatgaagaagaaagttgtatgaggtacctgcaccgaatatacgtgcccctgatgctcgtgaacgcagcagatgatcctctcgttcacgaaagccttttaaccatcccaaaatccctttctgagaaacgagagaacgtgatgttcgtcctgcccctacacggcggccacctaggcttctttgaggggagtgttctgtttccagaacctctgacatggatggacaaactcgtcgtcgaatacgctaatgcaatttgtcagtgggagagaaacaagttgcaatgctccgacaccgagcaggttgaagccgacctggagtag

SEQ ID NO: 177556 - DNA, 1230 bp, Artificial Sequence
  Description of Artificial Sequence: Synthetic coding sequence
atgcagcggctggccatggacctgcggatgctgagccgggagctgtcgttgtatctggaacaccaggtgagagttggcttctttggctctggcgtggggttgagtttaattctgggattcagtgttgcatacgccttctactacctgtctagcatcgctaagaaaccccaacttgtcacgggtggtgaaagctttagcagatttctgcaagaccattgtccagtggttaccgaaacatattaccctacagtgtggtgttgggagggaagagggcagacgctgctacggcccttcataacttccaagccccctgtacagtacagaaacgagctgattaaaacagccgacggcgggcagattagtctcgactggtttgacaatgacaatagcacctgttacatggacgcttctacaaggccgacaatcctactccttccagggctaaccggaacttcgaaggagtcttatatactgcatatgatccacctttcagaagaactaggatatcggtgtgtggtctttaacaaccggggggtggcgggagagaacctgctaacaccccgaacctattgctgtgccaacacagaggacctggaaaccgtgattcaccacgtacacagcctttatccgtccgcaccttttttggctgccggcgtgtcaatgggcggcatgctgttgctcaattacctggggaaaatagggagcaagactcctttgatggcagccgccacctttagtgtcggatggaataccttcgcatgtagcgagtccttagagaagccgttgaactggctacttttcaattactaccttaccacatgcctgcaatccagcgtcaataagcaccgccatatgttcgtgaaacaggtagacatggatcatgttatgaaggccaagtcaatcagggagtttgataagaggttcacctccgtcatgttcggatatcagactatcgatgattactacactgacgccagtcccagtccaaggctcaaatctgtgggcatcccggtcctctgcctgaacagtgtagacgatgttttttccccctcacacgctattcctatcgaaacggctaagcaaaatcctaacgtagcactcgtactcacatcttatggcggacacattggttttttagaagggatctggccccgccaaagcacctacatggatcgcgtctttaaacagtttgtgcaagcaatggtggaacatgggcatgagctgagctag

SEQ ID NO: 177557 - DNA, 1050 bp, Artificial Sequence
  Description of Artificial Sequence: Synthetic coding sequence
atggccgccgaggaggaggaggtggacagcgccgacaccggcgagaggtcagggtggctgaccggttggctgcccacatggtgtcctacttcaatttcacacctgaaggaagccgaagaaaagatgcttaaatgtgtgccatgtacatataagaaggagccggtgcgaatctccaatggcaataaaatatggactctgaagttttcccacaatattagcaacaagacgcccctggtgcttctccatggcttcggaggcggcctggggctttgggccctgaactttggagatctttgcaccaacagacccgtttacgcattcgatttgctaggctttggacgaagcagcagacccaggttcgactctgatgcagaggaagtggaaaaccaatttgtcgaaagcatagaagagtggcgatgtgcgctgggactggataaaatgatcctgctcgggcacaacctgggagggtttctggccgcagcttattcactaaagtatccctctcgagtgaaccatctgattcttgtcgaaccttggggtttcccagagaggcctgatctcgccgatcaagatagacctatcccagtatggattcgggcgctgggtgctgctctcacaccctttaatccattagccggactccgcatcgcgggccctttcgggttgagcttagtacagcgcctgagacccgatttcaagagaaaatatagctctatgttcgaggacgacaccgttaccgagtatatctaccattgcaacgttcagactcctagcggtgaaaccgcctttaagaatatgacaataccctacggctgggccaagagaccaatgttgcagcgtatcggaaagatgcatccagatatccctgtgtccgtaattttcggagcacggtcatgtatcgatggaaattctggtacgtcaatccagtcactgcggccacacagttacgtcaaaactatcgcgattctcggggcaggccattacgtatacgctgaccaacctgaggagttcaaccagaaggttaaagagatctgcgataccgtggattag

SEQ ID NO: 177558 - DNA, 1491 bp, Artificial Sequence
  Description of Artificial Sequence: Synthetic coding sequence
atggccgagctgcagatgctgctggaggaggagatccccagcggcaagcgcgccctgatcgagagttaccagaatttgacgcgcgtggccgactattgcgagaacaactacatccagaggcacggcttcgccgtactactgtgccttctgtctaattcttggcctcaggccacggataaacgtaaggctcttgaagagacaaaggcgtacactacccagagtctggccagcgtggcttaccagattaacgccctggccaacaatgtgctccagctgctcgacattcaggctagccaacttagacgcatggaaagttctattaaccatatatctcaaacagttgacatccacaaagaaaaggttgccagacgggagattggaatacttacaaccaataagaacacatctaggactcataagatcatcgcaccggcaaacatggagcgcccggtcaggtacatccgtaaacccatcgattataccgtgctcgatgatgttgggcatggagtcaaatggctgaaggcaaagcacggtaacaatcagcccgctcggactggcactctgtctaggaccaatccgcccacccaaaagcccccaagtccaccaatgagcggccgtggcactctgggaaggaacactccttacaagaccctggagccagtgaagccccctactgttcccaacgactatatgacctcaccagctaggttgggcagccagcacagccccggtcggacagcctcgctcaatcagcgtcctaggacacatagtggatcctctggaggttcagggagcagagagaattccggctcaagttcaatcggaatcccaattgcagtcccgactccttccccccctaccatcggccctgagaacattagtgtgccgccacctagcggggccccaccagcaccacctctggccccactccttccagtctccactgttatcgccgctccgggatccgcacctggatctcagtatggcactatgaccagacagatcagcagacacaacagcaccactagctcaacatctagcggcggttatcgccgcaccccgagtgttacagctcagttcagtgcacaaccacatgttaacgggggtccgttgtattcccagaactccatcgcagacagccctactccaccacccccaccccctccggacgacatacctatgtttgatgattcccctccgccgccacccccccctcccgtggattacgaagacgaggaagcagcagtcgtgcagtacaacgacccctatgcggacggagacccagcatgggctcctaaaaactatatcgagaaagttgtcgcaatatacgattatactaaagataaagatgacgagttgtcctttatggaaggcgcaattatttatgtgatcaagaagaatgacgacgggtggtacgagggagtctgcaaccgggtgacaggactatttccaggcaactatgtggaatcaattatgcactacaccgactag

SEQ ID NO: 177559 - DNA, 1530 bp, Artificial Sequence
  Description of Artificial Sequence: Synthetic coding sequence
atggccgagctgcagatgctgctggaggaggagatccccagcggcaagcgggccttaatcgagtcttaccagaacctgactcgggtggccgactactgcgaaaataactacattcaggccacagacaaacgtaaggcattagaagagacaaaagcttacacaacacagtcattagcgtcagtcgcttaccagattaatgccttggctaacaacgttctgcagctgcttgatattcaggccagccagcttcgaagaatggaatctagcatcaatcacatatcacagacggtggatattcataaagagaaagttgcaaggcgtgaaattggcatcctgacaaccaacaaaaacacgagtcgcacccacaaaataatcgcccccgccaacatggagaggcccgtgagatatatacgtaaacccatcgactacaccgtcctggacgacgtggggcatggcgttaagaagtggcataagattatccacggcaacaatcagcctgcccggacgggtaccctgtctcgaactaatcctcccacacagaaacccccaagccctcctatgtctgggcgaggtactctggggcggaacaccccctacaagacactggagcctgtgaagcccccgaccgtgcccaacgattacatgaccagcccggccagacttggatctcagcatagtcccggacgcaccgccagtctcaatcagcggcccaggacccactcgggctccagcggaggttcaggcagtcgggagaattcggggtcatcctcaattgggattcctattgcagtcccaactccttctccgcctactatcggacctgaaaatatatccgtaccgccccccagcggggcccctcctgccccacctctggctcccctccttccagtgtctacagtgatcgccgcgccagggtctgcaccgggaagccagtacggcaccatgaccagacagatttcccgacacaacagcacgactagttcaaccagttcaggaggctatcgcagaaccccctcagtgactgcccagttctcagcccagccccatgtcaacggcggacctctgtactcccagaattccattagcatagctcctcccccacctcctatgccccagctaacacctcaaattcctttgaccggtttcgttgcaagagttcaggaaaacatcgctgactcacccacacctccccccccacctccgcctgacgatattcccatgtttgacgattcaccaccgccccccccccccccacccgtagactatgaggacgaagaagctgcagtcgtgcagtataacgatccttatgccgatggtgatcctgcctgggcaccaaaaaattacattgagaaggtagtggctatctatgactatactaaggataaagatgacgaactgtccttcatggaaggggccattatttacgtgataaagaagaacgatgacggctggtatgaaggagtgtgtaacagagtaacgggactgttcccaggcaactacgtcgagtcaattatgcattacactgattag

SEQ ID NO: 177560 - DNA, 1443 bp, Artificial Sequence
  Description of Artificial Sequence: Synthetic coding sequence
atggccgagctgcagatgctgctggaggaggagatccccagcggcaagagggctctgattgagtcatatcagaacctgactcgcgtggctgactactgcgaaaataactatattcaggctacagacaaaagaaaggccctggaggaaaccaaggcatacaccacacaatcacttgcatcagtggcatatcagataaatgctctcgccaataacgtcctccaactgctcgatatacaggcaagtcagcttcgccgcatggagtcttccatcaaccatatatcacagaccgtggatattcacaaagagaaagtcgctaggcgggaaatcgggattctgactactaacaaaaatacctcacgtacccacaagatcattgccccggctaacatggagcggccagtgaggtacatcagaaagcctatcgattataccgtcctggacgacgtcggtcacggcgtaaagtggcttaaagcaaagcatgggaataaccaacccgctcgcacaggcacgctgtctaggacgaacccccctactcagaaacccccgtccccccccatgagcggccggggcaccctgggccggaacacgccctataagacactcgagccagtgaaacctccaactgtgcctaacgattacatgactagccccgccagactgggcagccagcattcaccaggacgaactgctagtctgaaccaacgcccgcgcacacattctggcagctccgggggaagcggctccagggagaactccggtagtagctctatcggaatccccattgccgtgccaacccccagccctccaactattgggcccgctcctgggtcagctccaggaagtcaatacggaaccatgacacggcagatttcccggcacaattcaacgacatcatccacttcaagtggtggatatcggagaacgccatccgtcaccgcgcagttttccgcccagccccacgttaatggcggccccctgtactcccaaaattctatatccattgcgcctccgcccccccctatgcctcagctcactccccagattcctctgaccggatttgttgctagggtgcaggaaaatatcgcagattctccgacacctccaccccctcctccacccgatgacatccccatgtttgatgacagccccccaccacccccccctccacccgtggattacgaagacgaggaagccgccgtggtgcagtacaacgatccctatgcagatggcgaccctgcttgggccccaaaaaactacatagaaaaagtggtggctatctacgattatacaaaagataaggatgacgagttgagcttcatggaaggggccataatttacgtgatcaagaagaacgatgatggctggtacgagggggtctgcaatcgggttactgggctgttcccgggtaactacgtcgaatccattatgcactataccgactag

SEQ ID NO: 177561 - DNA, 1449 bp, Artificial Sequence
  Description of Artificial Sequence: Synthetic coding sequence
atggccgagctgcagatgctgctggaggaggagatccccagcggcaaaagagcactcatcgagagctaccaaaatttgacaagagtggctgactattgcgaaaacaactacattcaggctaccgataaacgaaaggctctggaagaaaccaaggcttacacaacccaatccttggcatctgttgcttaccagattaatgcgctcgccaacaacgttttacagttgttagatattcaggcaagtcagctgaggagaatggaaagctcaatcaaccatattagtcaaacagtggatattcacaaggaaaaggtggcccgccgagagattggcatcctcaccaccaataagaatacatcaagaacccacaaaatcattgctcccgcaaatatggagcgaccagttcgctatattagaaaacccatagactacaccgtgctcgacgatgtgggacacggcgtgaaaaaatggcataagattattcatggtaataatcagcccgcccgaaccgggacgctgtcccggactaaccctcccactcagaaaccaccatccccccccatgagtggcaggggcacactgggtcgtaacacgccatataagaccctggagccggtaaagcctcccaccgttcccaatgactacatgacttctcctgctcgattgggctcccagcatagtcccggcagaaccgcaagcttaaaccagcggccacgaacacattcaggcagcagcggcggtagcggcagccgtgaaaattcaggcagcagttccataggcataccaattgctgtgcccacaccctctccacccacaatcggaccagcggctccgggttcagcacctggatcccagtatggtactatgaccaggcagatttcacgtcacaactccactacctcatctacctcatccggaggctatcgaaggaccccctctgtcaccgcccaattttcggctcagcctcatgttaatgggggacctctttatagccagaattccatttctatcgcgccccccccgccgcccatgccacagctcacaccccagattccattaactgggttcgttgcaagggtgcaggaaaacattgccgatagccccactcctcctccccccccacctcccgacgacattcccatgttcgatgactcccccccaccccctccccccccacccgttgactatgaggacgaagaagctgccgtggtacaatacaatgacccctatgccgatggagaccctgcctgggctcccaagaactatatcgagaaagtcgtggccatttatgattacacaaaagacaaagacgacgagctgagctttatggagggcgccatcatctacgtgatcaagaaaaacgatgatggctggtatgagggtgtctgcaatagggtaacagggctatttcccggaaactacgtcgaaagcatcatgcactataccgactag

SEQ ID NO: 177562 - DNA, 1272 bp, Artificial Sequence
  Description of Artificial Sequence: Synthetic coding sequence
atggccgagctgcagatgctgctggaggaggagatccccagcggcaagcgcgctctgatagaatcttatcaaaacctcactcgtgtggccgactactgtgagaataattatatccaagctaccgacaagagaaaggctttagaggaaaccaaggcctacacgacccagtctttagcaagcgtggcataccagatcaacgctctcgccaataacgttttacagttgctcgatatccaggctagccagctcaggaggatggagagtagtatcaatcacatcagccagacagtagacatacacaaagaaaaagttgccaggcgcgaaattggcattctgaccaccaacaagaacacttctcggacacacaaaataattgcgcctgcaaatatggagaggcccgtgcgctatattaggaagcctatcgattacaccgttttggacgacgttggacacggcgtcaagaagtggcacaagatcatacacgggaataaccagccggcaagaacaggcaccctgtcaaggaccaatccccccacccagaagccacctagtccccctatgtccggccggggcactttaggacgcaataccccttataaaactctagagcctgtaaaaccgcctacagtgcccaatgattacatgacctctccagctagattaggaagccaacacagccccgggagaaccgcatctctgaatcagcggccaaggacccatagcgggtcctccggcggctcaggctcaagggagaactcgggctcctcctcaatcggaattccgatcgccgtccccacccccagtcctcccaccatcggcccagtgagtatcgcacctcctcccccacctatgccccagctcaccccgcagatcccactcacaggattcgtcgcaagggtacaggagaacattgcagacagccctacacctcctcctccccctccccctgacgacattccaatgtttgacgactccccaccaccacctcctcctccaccagttgactatgaggacgaagaagccgcagtcgttcagtataacgatccttatgccgacggggatcctgcatgggcaccaaaaaactacatcgagaaagtggtggccatttacgattatacaaaagataaggatgacgagctgtcttttatggagggcgctatcatctacgtcataaagaagaatgatgacgggtggtacgaaggagtctgtaatagagtgaccgggctgttcccaggcaactatgtggagagcattatgcactatactgattag

SEQ ID NO: 177563 - DNA, 1359 bp, Artificial Sequence
  Description of Artificial Sequence: Synthetic coding sequence
atggccgagctgcagatgctgctggaggaggagatccccagcggcaaacgtgccctgattgaatcctaccagaatttaacaagagtagccgactactgcgaaaataattacatccaggccacggacaaaagaaaggccctggaggaaaccaaggcctacacaacacagtctctggccagtgtggcttaccagatcaacgccctggctaacaacgtccttcaattattggacatccaggcttcccaattgcggaggatggagagctccataaaccacatctctcagaccgtggacatccacaaggagaaagtggccagacgtgagataggcatcctcacgaccaataagaataccagcagaacacacaagattattgcccccgccaatatggagcggcctgtgagatatatccggaagccgatcgattacacagttctagacgatgttggccacggcgtgaagtggctcaaggcgaagcacggaaataaccagcctgctcgaacgggaactttgtcccgaaccaacccccccacacagaagcctccctccccacccatgtctggtcggggaaccctgggccgcaataccccttataagacactagaacccgttaaaccgccaaccgtcccaaacgattatatgaccagtcccgctagactaggttcacagcattctccgggacggaccgcatctctcaaccagcgccccagaacccactctggatcctccggagggtccggatctcgggaaaattccggctcctcaagcatcggaatccccatagccgttccaactccgtctccaccgactatcgggcccgctgcgcccggcagtgcgcccggctctcagtatggcacaatgaccaggcagatttcacgacacaactctacgaccagttcgacaagctctggtggttaccgtagaacgccctccgtgaccgcccagttcagcgcccagcctcacgtgaatggcgggccactctatagccagaattccattgctgactcccccacccctcctcccccacctccacccgacgacatcccaatgtttgatgattccccgcccccacctcctcctcctcctgtggactacgaggacgaggaagccgccgtggtgcagtacaacgatccatacgctgatggggacccagcgtgggctccgaagaattacatcgagaaggtggtggctatctacgattataccaaggacaaggacgatgaactgtcctttatggagggagccataatttatgtgatcaaaaagaatgacgatggatggtatgaaggggtctgcaacagagtgactggtctattcccgggcaactacgtggagtctattatgcattacacggactag

SEQ ID NO: 177564 - DNA, 1431 bp, Artificial Sequence
  Description of Artificial Sequence: Synthetic coding sequence
atggccgagctgcagatgctgctggaggaggagatccccagcggcaaacgcgccctgatcgagagctaccagaatctaacccgcgttgccgactactgcgagaataattacatccaggcaacagacaagcgaaaggccctggaggagaccaaggcctacaccacccaatcactggcaagtgtggcttaccagattaatgctcttgctaacaatgtactccagctattggacatacaagcttcccagctgaggcgaatggagtcctccatcaaccacatctcccaaaccgttgacattcacaaggaaaaggtcgcacgccgtgaaatcgggatcttaaccaccaataaaaatacatcacggacccacaaaattatcgcacccgccaacatggagaggcctgtgagatacatcagaaagccaattgactataccgtgttggacgacgttggccacggcgttaagcacggcaataaccagcctgcacgtaccggcacactctctcggactaatccccctactcaaaaacctcccagtcctcctatgagcggccggggtactctgggcaggaacaccccatacaagacacttgagccggttaagccacccaccgtgcctaatgactatatgacctccccggctaggctgggctcacagcatagtcctggtcgtactgcatcactaaaccaacgccccagaacgcactccggctcgtccggaggctctgggtcaagagagaatagcggatcctcctctatcggtatccctattgcggtgcctaccccatcaccgcccacgatagggccggctgccccagggtctgctcctggatcacaatatgggacaatgaccaggcaaattagcaggcataactccaccacatcaagcacgtctagtggcggatacagaaggacccccagcgtcaccgcccagttctctgcccaaccgcacgtcaatgggggacctctttattcacagaattccatctccatcgctccacctccccctcccatgccacaactaacacctcaaattcccctgaccggttttgtggctagagtccaagagaacatcgctgattcaccaactcccccaccgcctccccctcctgacgatattcccatgttcgacgattcacctccacctccacctccgccccctgtggactacgaggacgaggaagctgcggtcgtgcagtacaatgacccatatgctgacggcgaccccgcctgggcacccaaaaattacatcgaaaaagtcgtggcaatctacgattacaccaaggacaaggatgacgagctgtcatttatggaaggagcaattatctacgttataaaaaagaatgacgacggttggtatgagggggtctgcaatagggtgacaggtctgttcccagggaactacgtggagtcaataatgcactatactgattag

SEQ ID NO: 177565 - DNA, 1446 bp, Artificial Sequence
  Description of Artificial Sequence: Synthetic coding sequence
atggccgagctgcagatgctgctggaggaggagatccccagcggcaagagggcactaatagaatcatatcagaatttgactcgcgtagccgactactgtgagaataactacattcaagcgacagacaagcggaaagctctggaggagaccaaagcatatactacacagtccctggcgtcagtcgcctaccaaattaacgcacttgccaataacgttctgcagctccttgacattcaggcaagtcaactgcgaaggatggaatcttcgattaaccatatctcccaaactgtcgacattcacaaggaaaaagtcgcccgaagagaaatcggcattctgactaccaataaaaacacctcaagaacacataaaatcattgcccctgctaatatggagcggccagtgcgatacatcaggaaacccatagactacaccgtcttggatgacgtgggacacggggttaagtggcttaaagccaagcacggcaacaatcaaccggcacggaccggcacacttagccgcaccaatccgccaacccagaagcctcctagtcctccaatgtctggccgcggtaccctcggtcgtaacactccctataagacgctggaaccagttaagccacctacggtgcccaacgattacatgaccagtcccgcacgattgggctcacagcattcacccggtcgaacagctagcctgaaccaaaggccacggacccatagtggctcatctggaggctctggaagtagagagaacagcgggtctagcagtatcggtattccaatcgccgtgcccacgccatctccaccaacaatagggcctgccgcccctggatcagcccccggcagccagtatggtacaatgacgcggcaaatttcccgacacaattctaccacttcctctacgagcagcgggggctatagacgcacaccctcagtgacagcccagttctctgcgcagccgcacgttaatggcggccctttgtattcacagaacagtatttcaattgctcctccgccccctccaatgcctcagttgacgccacagatccccctcaccggctttgtggcacgtgtacaggaaaatatcgcagacagccccactcctcctccacctccgccccccgatgatatccccatgttcgacgatagcccccctccacctcccccacctcctgttgactatgaagacgaggaagccgccgtggtgcagtacaatgatccctatgccgatggagacccggcttgggccccgaagaattatatcgagaaggtggttgctatttatgactatacaaaagacaaagatgatgaactcagctttatggagggggctatcatatacgttatcaagaaaaacgacgacgggtggtacgagggagtgtgcaaccgcgtgactggcctctttccaggcaattacgtcgagagtataatgcattatactgactag

SEQ ID NO: 177566 - DNA, 1527 bp, Artificial Sequence
  Description of Artificial Sequence: Synthetic coding sequence
atggccgagctgcagatgctgctggaggaggagatccccagcggcaagagggctcttattgaaagttaccaaaatcttacccgcgtggcggattattgcgaaaacaactacattcaggctacagacaaacggaaagctttggaggaaaccaaagcgtatactactcagtccctggcaagcgtggcctaccaaataaatgccctggccaataacgtgctccagttgctggatatccaggcctctcagcttcgcaggatggagtcctcaattaatcacatctcacagaccgtggacattcataaggaaaaggtcgctcggcgagaaatcggcattttgacaaccaataagaacacatcgaggactcataagatcattgcacccgcaaatatggaaaggcccgtgcggtatatcagaaagcccattgactacaccgtgctggatgacgtaggccacggcgtgaaatggctgaaagcgaagcacgggaacaatcagcctgctcgtactggtaccttgtctcggacaaacccacctacgcagaagcctccaagcccacccatgagtgggcgaggaaccttaggtcgcaatactccctataaaacactggagccggttaagccgcccactgtgccaaatgactacatgacgtcaccagcgcgtttgggctcccagcattcgcccggccgcactgcctcactgaaccagagaccaaggacccacagcggcagttcagggggatctggatctcgggagaactctggaagctcttctatcggaataccaatcgcagttccgactccgagtccaccaacaattggtccagagaatattagcgtgccacctccaagtggggcccctcctgctccgccactggctcccctgctacccgtcagtactgtcattgccgcacctggttctgcgccgggaagccagtatggcacaatgacacgtcagattagccgccataactccaccacctctagtacatcatctggaggctacagaaggaccccctccgtcaccgcccagttctctgcacagcctcacgtgaatggaggccctctgtattcgcaaaacagtatttccatcgcaccgcccccacccccgatgccccagctcacccctcaaatcccactcactggcttcgttgccagggtgcaagagaatatagccgattccccgacgcctcctccgccccccccaccagacgacatcccaatgtttgacgatagccccccacctccccctcccccacccgtcgattatgaagatgaggaagcagctgtggtgcaatacaacgacccatatgccgatggagaccccgcctgggcccctaaaaactacattgagaaggtggtggctatatatgactatacaaaggataaggatgacgagctgagctttatggaaggcgccatcatatatgtgattaaaaagaacgacgatgggtggtacgagggtgtgtgtaatcgggtgacaggactgtttccgggcaactatgtagagtcaatcatgcactacacagactag

SEQ ID NO: 177567 - DNA, 1428 bp, Artificial Sequence
  Description of Artificial Sequence: Synthetic coding sequence
atggccgagctgcagatgctgctggaggaggagatccccagcggcaagcgagcacttatcgaatcatatcaaaatttgacaagagtcgctgactattgtgaaaataattatatccaggccaccgataagaggaaagccctagaggaaaccaaggcctataccacccagagcctggcatccgttgcatatcagataaatgcgcttgcaaataatgtactccagctccttgatattcaggcttcacaactgcggcgaatggagtctagcatcaaccatatctcacagacggtggacatacacaaagagaaagtagcaaggcgggagatcggcattctgaccacaaataagaatactagccggactcacaagattatcgccccagccaacatggagaggcctgttcgttacattcggaagcccatcgattacaccgtgcttgacgacgttggccatggagtcaagcacggcaacaatcaacctgctcggacagggaccttgagcagaaccaatcctcctactcagaagccccccagccccccgatgtcaggccgtggcactctgggacgcaacactccatacaaaaccctggagcccgtcaagcccccgacagtgcctaacgattacatgacatccccggcaagactgggatcacagcattcgcctggacgcaccgcaagtctcaaccagagacctcgcacccatagtggcagcagcggcggctccggctctcgagaaaattctggctcaagcagtattggaatccccattgccgttccgactccatcccccccgaccattggcccagctcccgggagtgcccctggttcacagtatgggactatgactcgccagatctcgcggcacaacagcacgacaagctcaaccagctcagggggctatcgtaggactcccagcgtcacggcccagttctcggcgcagccgcatgtgaacggaggaccgctctattcccagaatagtatatctatcgctcccccccctccaccaatgccccagctgactcctcagatccccttaactggctttgtggccagggtccaagaaaacatcgccgacagtcctacaccaccccctccacccccgcccgatgatatcccaatgtttgatgacagtccccctccccctccccctccacccgtggactacgaagacgaagaagcggcagttgtgcagtacaatgacccctacgcagacggagatcccgcctgggcaccaaaaaattacatagagaaggtggttgccatatacgattataccaaagacaaggacgatgaactcagcttcatggaaggcgctattatatacgtgatcaagaagaacgatgacggatggtatgagggcgtttgcaaccgggtcaccggactttttcctggaaattacgttgaatctattatgcattacaccgactag

SEQ ID NO: 177568 - DNA, 1341 bp, Artificial Sequence
  Description of Artificial Sequence: Synthetic coding sequence
atggccgagctgcagatgctgctggaggaggagatccccagcggcaaacgggctctgattgagtcataccagaacttaacacgggtcgccgattattgcgaaaataattacatccaagccacggacaagaggaaagcacttgaagagactaaggcctatactacacagtcccttgctagcgtcgcttaccaaatcaacgcactagctaataatgtgctccagttactcgatatccaggccagccagctgaggagaatggaatcaagtattaatcatatttcgcagaccgtggatatccataaagagaaagtggcaaggcgagagatcgggatactgaccacgaataagaatacatccaggactcacaaaattattgcgccagccaacatggagagacccgtgaggtacattcgtaaacctatcgattacaccgttcttgatgacgtgggacacggagtgaaacacggtaacaatcaaccagccagaacgggaaccctgagccgtacaaatcccccgacacagaaacccccatccccccctatgagcgggaggggaaccttggggcgaaatacaccttataaaacgctagagcccgtgaaacccccaactgtgcccaatgactatatgacctcgcctgctcgcctggggagtcagcacagccccgggcggaccgcttcattaaaccagagaccgagaacacactctggttcttccggaggctctgggtctcgcgaaaatagtgggtccagctccataggcatacctatcgccgtaccaacacccagcccccccaccattggtcctgctcccggttctgctcccgggtcgcagtacggcactatgacccgccagatttcccgccacaattccactacttcatctacatcaagcggagggtatcgccggacccccagcgtcacagcacagttttcggcccagccacacgttaacggcggaccactctattcgcagaactcgatcgctgattccccgacacccccgcctccacctcctcctgacgacatccctatgttcgacgattccccccccccccccccgcctccgcctgtagattatgaggacgaggaggccgctgtagtccagtacaatgatccctacgctgacggggatcctgcatgggcccccaaaaactatatcgagaaagtggtcgccatctatgactacacaaaggacaaagatgatgagcttagctttatggagggagccatcatttacgtgattaaaaagaacgacgatggatggtacgagggtgtttgcaaccgcgtcactggactgttccccggcaattacgtggaatctattatgcactacacggactag

SEQ ID NO: 177569 - DNA, 1356 bp, Artificial Sequence
  Description of Artificial Sequence: Synthetic coding sequence
atggccgagctgcagatgctgctggaggaggagatccccagcggcaaaagagccctgatcgagagttaccagaacttaacacgggtggccgattactgcgaaaataattatatacaggctacagacaaacgaaaggccttagaagagacaaaggcctacaccacacagtccttggcctctgtggcctatcagataaacgcattggcaaataacgtgttacagcttctggatatccaggcttcgcagctgcggcgcatggaatcctccattaaccacatatcccagactgtcgacattcacaaagagaaggtggcccggagagaaattgggatactcacaacaaataaaaatacatcacggacgcataagatcattgcccctgcgaatatggagcgacctgtacgctacatacggaaacccatcgattatacagtcttggatgacgtgggacacggtgttaagtggctgaaagccaagcacgggaataatcagccagcacgtaccgggacactgagtaggacaaatccccctacacagaaacctccaagccccccaatgtcagggcgaggaaccctcggtcgcaataccccatacaaaaccctcgaaccagtgaagcccccaaccgtgccgaacgactatatgacctctcctgcgaggcttggcagtcagcattctcccggccggaccgcctccttgaaccagaggccaaggactcactcaggctcatccggaggcagcggaagtagagaaaattcgggctccagttcaattgggatcccaatcgcggtgcctacacccagtcccccaacgataggacccgcacccggaagtgcccccggctcgcaatacggcaccatgacccggcagatatcgagacataatagtacaacaagtagcacctcttcagggggctacagaagaactccctcagtgactgcacagtttagcgctcaacctcatgtcaacggaggcccattgtacagtcagaattccatcgctgacagtcctacccctccccccccgccaccgccagacgatatccccatgttcgatgatagtcctccccctccgcccccgcctcccgttgattatgaggacgaggaggcagccgtggtgcagtataacgatccctatgccgatggcgaccctgcttgggcccccaagaactacatagagaaggttgtggccatatacgactataccaaggataaggacgatgagctgagctttatggaaggcgccataatctacgtgatcaagaaaaatgatgacggatggtatgaaggcgtgtgcaaccgcgtgaccggtctgtttcccgggaattatgttgagtccattatgcattataccgattag

SEQ ID NO: 177570 - DNA, 990 bp, Artificial Sequence
  Description of Artificial Sequence: Synthetic coding sequence
atggccgagctgcagatgctgctggaggaggagatccccagcggcaaacgcgcactgatcgagtcgtatcagaatctgaccagagtggctgactactgtgaaaacaactatatccaggccacggacaaacgaaaagcactggaggagactaaggcttatacaacccagtcgctcgcttctgtcgcatatcagattaacgccctggctaataatgtcctgcagttacttgacattcaggcgtcccagcttagacggatggagtcctctattaatcacatctctcagcacggtaataaccagcccgcccgcaccgggaccctctctcggacaaacccccccacacagaaaccaccatctcctccgatgagtggcagagggactctggggcgcaataccccatataaaacactggagccagtgaagccccctacggtgcctaacgactatatgacatctcctgctcgtttgggctcgcaacactccccaggccgaacggccagtctgaatcagagaccaagaacgcattctggctcgagtggtggaagcggttctagagaaaattctggatcctcatcaatcggcatcccgatcgctgtgcccactccttcaccccccaccattgggcctgtggccgatagcccaacaccccctcccccccccccacccgatgatatacccatgtttgatgattcccctcccccccctcccccacctcccgtcgattatgaggatgaagaggcagcagtagtgcagtataacgacccatatgctgatggcgatcctgcctgggcccccaagaattatatagagaaagtggtcgccatctacgactacacaaaggataaggatgacgaactgtccttcatggaaggagctattatctacgttattaaaaagaatgatgatggttggtatgagggagtttgcaatcgggtgacggggctgtttcctgggaattacgttgaatcaattatgcattatacagattag

SEQ ID NO: 177571 - DNA, 1185 bp, Artificial Sequence
  Description of Artificial Sequence: Synthetic coding sequence
atggccgagctgcagatgctgctggaggaggagatccccagcggcaagcgggcgttgatcgaatcataccagaatttaaccagagtagctgattactgtgaaaataactatatccaggctaccgacaagaggaaagccctggaagaaacgaaagcatacacaacccagtctctggcctcagtggcgtaccaaattaacgccttggcgaataatgtactccagctgctggacattcaggcgtcccagctgcgcagaatggagtcttcaataaatcacatttcacagacagtggacatacacaaagaaaaggtggcaaggagagaaatcggcatcctgaccactaacaagaacacttcgagaacacacaagattatcgctcctgccaacatggaaaggccagtgaggtacatccgaaagccgattgactatacagtgctggatgacgtgggtcatggagtgaaaaagtggcacaagatcattcacggcaacaatcagccagcaaggaccgggacgctgagcagaaccaatcctccaactcagaaaccaccttctccccccatgagcggccgcggcaccctcgggcggaacaccccctacaagactctggaacccgtgaaaccccctacggtacccaacgattacatgacttccccagccaggttgggaagtcagcactcaccaggcaggacggccagtctgaaccagcggccccgcacccactctggttcctcagggggtagtgggtcccgggagaactctggcagcagttctataggaatccccatcgctgtaccaacccctagccctcctacgattgggcccgtggcagacagcccaacccccccacccccgccccctcccgacgatattcccatgtttgacgattccccaccgccccctccaccgcccccagtggattatgaggatgaggaggctgccgttgtgcagtacaacgacccatatgccgacggagacccagcctgggcccccaaaaattacatcgagaaagttgtggccatttatgattacactaaggacaaggacgacgagcttagcttcatggagggggctattatctacgtgatcaagaaaaacgacgacggatggtacgagggcgtgtgcaatagggtaacgggattatttccagggaattacgtcgaaagtattatgcactatactgattag

SEQ ID NO: 177572 - DNA, 3993 bp, Artificial Sequence
  Description of Artificial Sequence: Synthetic coding sequence
atgcccctgagcccccccgcccagggcgaccccggcgagcccagcccatgccgtcccccaaaaaagcatactacgtttcacctctggcgaagcaagaaaaagcagcagccagcccctcctgactgtggtgtgtttgtcccacatccacttcctgcccccgcaggcgaggctagggctctggatgttgtggacggtaaatatgtggttcgggactcacaggagttccccttacactgtggtgagagtcaattcttccatactacatccgaggcactagggtctctcctgttggaaagcgggatctttaaaaagtctcgggcccagcccccagaggataaccgacgcaaaccagtcctgggaaagctcggaacactgtttacagccggacggaggagaaatagccggaatggattggaatcacccacccgctctaacgctaagccgttgagtccaaaagatgtggtggcctctccaaaactgccggagagagaatcggagcggtcacggtcccagtcctctcaactgaagcagacagacactagtgaggaggggagcccacgtgaaaatcctcgggaggctgagggcgaactacctgagtcaggtggcccagccgccccaccagatgccgagctcagcccaaggtggtcatcctccgccgccgcagttgccgtccaacagtgccacgagaatgattccccccaactggaacctctggaagccgaaggagaaccttttcctgatgctacgactacagcaaagcagttgcattcctcaccagggaattcctcacgccaggagaatgcagaaacaccggctcgttccccaggggaagacgccagccccggagccgggcatgagcaggaggcgtttcttggagtgcggggagctccgggctctccgacccaggagcgtccggctggcggtctcggtgaggctcccaatggcgccccgtcagtttgcgctgaggaagggtctctcggaccgagaaacgccaggtctcaaccgccaaaaggagcctcagaccttcccggagaacctcccgccgagggggccgcccacacggcctcaagtgcacaggccgactgcacggcaagacctaagggtcatgctcacccggccaaggtgctaactctggacatctatctgagcaagaccgagggagcccaggtcgacgaacccgtggtgataaccccccgcgcagaagattgcggcgactgggacgacatggaaaagcggagctccggtaggaggagcggtagacggcgtgggagccaaaaatcgaccgattcgcccggtgccgatgctgagctgccggagagtgccgcacgcgacgatgccgtgttcgatgacgaggtggcccctaacgcagcctccgacaatgcttcagctgaaaaaaaagttaaaagtcctcgggcagccctcgacgggggtgttgccagtgccgcctccccagagtcaaaaccgagtccagggacaaagggccagctccgcggtgagagcgatcgcagcaaacagcctccacccgcctcgtctcccactaagagaaagggcaggagcagagcactagaagcagttcccgctccacctgcttccggccctcgcgcccctgcaaaagaatcgccacctaagcgtgtgccagatccttctcccgtaactaaagggacagccgccgagtctggcgaagaggccgcacgggcaattccccgtgaactgccggtgaagagttcgtcactactccccgaaattaagcccgaacataagcgcggccctttaccaaatcatttcaatgggcgcgcagaagggggaaggagtcgggaacttggccgagccgccggcgcaccgggagcatccgatgcggatggtctcaaaccacggaatcatttcggcgttggacgcagcactgtgaccactaaggtgaccttgcctgctaagcccaagcacgtggagctgaatctgaaaactccaaagaatttagatagccttggtaacgaacacaatcctttttcacagccggtgcacaagggcaacaccgccactaagattagcctattcgaaaacaaaagaaccaatagttcaccaagacataccgatatcagaggacagcggaacacaccagcctcaagcaaaacattcgtggggagagccaagctcaacctggcaaaaaaggctaaggaaatggagcagcccgaaaagaaggttatgcccaactctccgcagaacggagtcttagtcaaggagactgctatcgaaaccaaggtgactgtgagtgaggaagagattctcccagctacccgggggatgaatggagactcaagtgaaaatcaggccctgggaccgcaacccaatcaggacgacaaagccgatgtgcagactgatgctggatgtctaagtgagcctgtggcaagtgccttgattccagtcaaagatcacaaactgctggaaaaagaagattctgaagccgcagatagcaagtccctggtcctcgaaaatgtcactgacactgctcaagatattcccaccaccgtcgacacaaaagatctgcccccaaccgccatgccaaagccccagcatacattttcagactctcagagcccggccgagtcctcacccgggccatcactgtctctgagtgccccggcgccaggagacgtgcccaaggacacctgtgtccagtcaccaattagttcgttcccttgtaccgatctaaaggtaagcgagaaccataagggttgcgtgttgcccgtgagtagacagaataatgaaaaaatgccccttctcgagttgggtggcgagacaacccctcccctttccacagagcggtctccagaagctgtcggcagcgagtgtcctagccgagtgctcgtgcaggtgagaagttttgtgttgcctgtagaaagcacacaggacgtctcatcccaggtgatcccagagagttcggaagtgagggaagttcagcttcccacctgccactctaatgagcccgaggttgtctcagtcgccagctgcgcaccaccccaggaggaagtgctaggaaacgaacactctcactgcaccgccgagctggccgccaagagtggcccacaagtgattcctccggcgtccgagaagactctacccatccaggcacagtcccagggctccagaactccactaatggccgagagcagtcccacaaactcaccaagctctggaaaccaccttgccacacctcagcgaccagatcagacagtgaccaacggtcaggatagcccagcctcgttgctgaacatttcagcaggttcagatgattctgtgtttgattcatcttcggacatggagaaattcacggagatcatcaagcagatggattccgccgtctgtatgccaatgaagcgcaagaaggctcgaatgcccaattcccctgctccccattttgctatgcctccaatccatgaagatcatctggagaaagtgttcgacccaaaggtattcacgtttgggctgggcaaaaagaaggaaagccagccagaaatgtcccccgcactccacctcatgcagaacctggatacgaaatctaagctgcggcctaagcgagcctccgccgagcagtcagtactgttcaagagtcttcatacaaatacgaacggcaacagtgaacccttagtcatgccagagatcaatgacaaagagaaccgggacgtgaccaatggtggtatcaagcggtcacggttagagaagagtgccctgttcagttctctgctttcttcgctgccacaggataagatcttctccccttcagttacgtcagtgaatacgatgactactgccttttctacatcacagaatggaagcctctcccagagcagtgtttcacagcccaccactgaaggcgcccctccctgcggcttaaataaagagcagtccaacctcctgccagacaattccctgaaagtattcaactttaatagcagcagcacatcccatagctccctcaagtcacccagtcacatgtag

SEQ ID NO: 177573 - DNA, 5172 bp, Artificial Sequence
  Description of Artificial Sequence: Synthetic coding sequence
atggagaagcggagcagcggccggcggagcggccggcggcggggctcccaaaagagtactgatagccccggtgccgatgcagagctccccgaaagcgcggccagggatgacgcagtatttgatgatgaagtggcccccaacgctgcttctgataacgcgagcgctgaaaagaaagtgaaatcaccaagggctgccttggacggtggcgttgcatccgccgcatcaccagaatctaagccctcacctgggacaaagggccagctgaggggagaatcggataggagtaaacaacctccccctgcatcttcgcccaccaagcggaagggcagatcaagagcgctggaggctgttccagccccacctgcgagtggcccgagagcgcctgccaaggaaagcccacccaagcgggtgccagacccgtccccggtaaccaagggaacagctgcagaaagcggagaggaggccgcccgagccattccacgcgaactgcccgtaaaatcaagtagtctactcccggaaatcaagccagagcataaacgagggcccctcccaaatcactttaatgggagggctgaaggcggacgctccagggaattaggaagagcagccggcgccccaggcgccagcgacgctgacgggttaaaaccaagaaatcatttcggcgtaggtaggagtactgttactacaaaagttactttgccagcgaagccaaagcacgtagaactgaacctaaagacccctaaaaatctcgacagtctcgggaatgagcataatccgttctcacagcccgtgcacaagggaaatacagcgacaaaaatttctctctttgagaacaaacgcactaattcatccccccgccatacagatatccgcggccagagaaatacccccgcgagctcaaagacttttgtgggcagggccaaactcaatctcgcgaagaaagctaaggaaatggagcaacccgagaagaaggtgatgcccaattccccacaaaacggcgtgcttgtgaaagagaccgcaatcgaaactaaagttaccgtcagtgaggaggagatacttcctgctacccggggcatgaatggggatagcagtgagaaccaagcccttgggccacagccaaatcaagatgataaagccgacgtgcagactgatgcggggtgtcttagcgaacctgtcgccagtgcccttattcccgtgaaagatcacaagttgctggaaaaggaggattcagaggccgccgactcaaaatcgttggttctagaaaacgttacagatactgctcaggacatccctactacagttgacacaaaggatctgccacccaccgccatgccaaagccacagcataccttcagtgactcccaaagcccagccgagagttcacctgggcctagcctgtccctaagcgcaccagccccaggagacgtccccaaggacacctgcgttcagagcccaatatcctcattcccttgcactgatctgaaagtgtccgagaatcataaaggctgtgtacttccagtgtctcgccaaaacaacgaaaaaatgccactcttggagctggggggagaaaccacgccccccctctcaactgagcgttctcccgaggcggttggctctgagtgccctagcagagtgctcgtccaggtgcgctcattcgtcctcccagtggagtccacacaggacgtgagcagccaggtgatcccagaatcatctgaggtccgtgaggtccagctgcccacctgccacagcaatgaaccagaggtggtgtcagttgccagctgtgctcctcctcaggaggaggtactgggcaacgaacacagccactgcaccgcagaactggctgccaagagcgggccacaggtaatcccacccgcctccgaaaagactttgccaattcaggctcaatctcaaggaagtaggacccccctcatggccgaaagcagccctaccaattctccatcctccgggaatcacttggcgacccctcagcggcctgatcagaccgtcaccaatggtcaggattcgcccgcttccctcctcaatatttctgctggtagtgacgatagcgtgtttgacagttcttccgacatggagaaattcactgagattattaagcaaatggattctgcggtctgcatgccaatgaagagaaagaaagcccggatgccgaattcccccgcaccccacttcgcgatgccaccgatccacgaggatcacttggagaaggtgttcgatcctaaagttttcacattcggccttggaaagaaaaaagagagccagcccgaaatgtcacccgctctccatctgatgcaaaacttagacacaaagagtaagttgcgtccgaagcgtgcctcagccgaacagagcgtcctttttaaatccttacatacgaacaccaacggcaactccgaaccacttgtcatgcccgaaatcaacgataaggaaaatcgcgacgtaaccaacggcggaatcaaacgatcaagactggagaaatcagctctcttctcttcgctactgtcaagcctgccccaggataaaatattttccccatctgtgacctctgtcaatacaatgaccacggcctttagtacatctcagaatggttctctttctcaatcctctgtcagccagcctacaaccgagggggcgcctccatgcggactcaataaggaacagagtaacctcctgccggacaactctctgaaggtctttaactttaatagctcttcgacgagccattcctcactgaaatcgccatcccacatggagaaataccctcagaaggagaaaaccaaagaggacctggactctagatctaatctgcacctgccggagacaaagtttagtgagctttcgaagttgaaaaacgacgatatggagaaggccaatcacatcgagagcgtgatcaagtccaacctgccaaactgtgctaatagcgataccgatttcatggggctcttcaaaagctccagatatgatccctccatatctttttctgggatgagcctgtctgatacaatgacgctgcgtgggagcgtacagaacaagctgaaccctcggccaggcaaggtggtgatttacagcgagccagacgtctccgagaagtgtattgaggtgttcagcgacattcaagattgttcgagctggtctctatcccctgtgatactgatcaaggttgtaaggggatgctggattttgtatgagcagcctaacttcgaggggcattccatcccacttgaggagggtgagttggagttgagcggcctgtggggaattgaagatattttagagcgacatgaggaggcagagagcgataagccagttgtgatagggagcatccgtcatgttgttcaggactaccgcgtttcacatatagacttgtttactgaacctgagggcttgggcatactgagttcctacttcgatgacaccgaagagatgcagggctttggagttatgcaaaagacttgttctatgaaagtgcactggggcacctggctgatatatgaagagcccgggtttcagggcgtccctttcattttggaacctggggagtacccagacctctcattttgggacacagaggaggcatatatcggttccatgcggcctcttaagatggggggccgtaaagtggaattccctacagacccaaaagtcgttgtttatgagaaacctttcttcgaggggaaatgcgtggagcttgaaactgggatgtgctcatttgttatggaaggcggggaaactgaagaagccactggtgacgaccatctcccctttacttccgtaggtagcatgaaagtgctaaggggcatctgggttgcatatgagaagcccggattcacaggacatcaatacctgttggaggaaggggagtacagggactggaaagcatggggtggctacaatggagagctgcagtccttaagacccatcctcggcgacttcagtaacgcacatatgataatgtattccgagaagaattttggatctaaggggtcctctatcgatgtactggggatcgtggccaacctgaaggagacggggtacggcgtgaaaactcagtctattaacgtgctgagtggggtttgggtggcatacgaaaacccagacttcacgggagagcaatatattcttgataaggggttttacacgtcttttgaagattggggtggaaagaactgtaagatatcctccgtccaaccaatttgtctagatagtttcactggtcctcgaagaagaaatcagatccacctgtttagcgagccccagtttcagggccattcccagagctttgaagagacaacatcccaaattgacgactctttctccaccaaatcctgtagagtttccgggggttcatgggtagtttacgacggagagaacttcactggtaaccagtatgtgttagaagaagggcattacccctgcctgtccgccatgggatgtcctccaggggctacatttaagtctctacgattcatagatgtagaattcagcgagcctaccattatcctcttcgaaagggaagatttcaaaggcaagaaaatcgaactgaatgctgagaccgttaatttgcgttcgctgggcttcaacacacagatccggtcagttcaggtgataggtggcatttgggtgacctacgagtacggatcttacagaggcagacagtttttgctctctccggccgaggtccccaattggtacgaattttcaggatgtagacaaatcggatctctccgtccatttgtgcagaagaggatttactttcgactgcggaataaagccacggggttgtttatgtcaaccaatgggaatcttgaggatctgaagctcctccgaatacaggtcatggaggatgtgggggccgatgaccagatctggatttaccaggagggatgtataaagtgccgcatcgccgaagattgttgcctgactattgtgggatcattggtaacctccggaagcaagttgggcctggcattggaccaaaatgctgactcacagttctggagccttaaaagcgacggccgtatctattccaagctgaaacctaaccttgttcttgacattaaagggggaacacagtatgatcagaaccacatcatcttaaacacagtcagtaaagagaagtttacgcaggtttgggaggctatggtattatacacatag

SEQ ID NO: 177574 - DNA, 951 bp, Artificial Sequence
  Description of Artificial Sequence: Synthetic coding sequence
atgcagaagcccaagaccgtggcctgggagaacctgggccccgagatgtctgccctgggcaccgctttttcgcgcgaaggcggccggaaggtggaatttcctacagatcctaaggtggtggtgtacgagaagcctttcttcgagggaaagtgtgttgaacttgagacaggcatgtgctcctttgtgatggagggaggtgaaacggaagaggccacaggagacgaccacctgccttttacatcggtgggctccatgaaggtcctgcggggtatttgggtggcctatgagaagcctggcttcaccggacatcagtacctgctggaggagggcgagtatcgagattggaaagcttggggcggctataatggtgaactccagtcattacggccaatactaggcgacttctcaaatgcccacatgatcatgtatagtgaaaaaaattttggctccaaaggaagcagcattgacgtcttgggcatcgtagctaacctaaaggagacaggctacggcgtgaagacccaatccatcaatgtgttatccggcgtgtgggtggcttatgaaaaccccgactttactggagagcagtatatccttgacaagggcttttatacttctttcgaggactggggcggaaagaactgcaaaatctcatcggtacagccaatatgtctggactctttcactggtccaagaaggagaaaccagatacacttgttttccgaaccccagtttcaggggcacagccagagctttgaagagaccactagtcagatcgatgactccttctcgacaaagtcctgtagagtatcaggagggtcttgggtcgtttacgatggggagaatttcacaggaaatcagtatgttctggaagagggacactacccgtgtctttcagccatggggtgtccccccggagcaacattcaagtcacttagattcattgacgtctag

SEQ ID NO: 177575 - DNA, 1629 bp, Artificial Sequence
  Description of Artificial Sequence: Synthetic coding sequence
atgcagaagcccaagaccgtggcctgggagaacctgggccccgagatgtcagcactcggcactgcattttctagggaaggcgggcggaaggtggagtttccaacggacccaaaggttgtagtgtatgagaagcccttcttcgaaggcaaatgcgtcgaattagagacaggcatgtgtagttttgttatggagggcggcgagaccgaggaggctacaggcgatgaccacttgccctttacatctgttggcagcatgaaagttctacggggaatctgggttgcatatgagaaacctggctttacagggcaccagtacctgcttgaggagggggagtatagggactggaaagcatgggggggatacaacggggaactccagtctcttagacctattctcggggacttcagcaacgcgcatatgatcatgtattccgagaagaattttggttccaaagggtcctcaatcgacgtgctgggcattgtcgccaatttgaaagaaactggctatggcgtaaagacccaatcaattaacgtcctttccggggtgtgggtagcgtatgagaatccagactttaccggtgaacaatacatactggacaagggcttctacacctcatttgaggattggggaggaaagaattgcaagatctccagcgtgcagcctatttgtttagacagctttaccggacctcgacggcgaaaccagatccacctattttccgaaccccagtttcagggtcacagccagtcttttgaagagacaacctcacagatcgacgactcattttctacaaagtcctgtcgagtgtccggcggaagctgggtggtctacgatggtgaaaattttaccggtaaccagtatgtgctggaggaaggccattatccctgccttagcgccatgggctgtcccccaggcgccacctttaagtctttgagatttatcgacgtggagttctccgagcctaccattattctcttcgaacgggaagacttcaaaggcaagaagatcgagctgaatgctgagaccgtaaacctcaggtctttggggttcaatacgcaaatccggagtgttcaggtaattggaggaatttgggtaacatacgaatacggttcctacagaggacggcagttcctgctcagtcccgctgaggtacctaactggtacgaattctccggctgtagacagattgggagcctgcgccccttcgtccagaaacgcatctatttccgactgcgaaataaagccacaggattatttatgagcaccaacgggaaccttgaagacctgaagttgttacgcatccaagtgatggaggatgtaggcgccgacgaccagatctggatttatcaagagggatgcattaaatgtcggattgccgaggattgctgcctcacgatcgtaggaagtctggtgacatcaggcagcaagttggggctggccttggatcagaacgcggattctcagttttggtctctaaagagtgatggtagaatctattctaagcttaaaccaaacctcgtgcttgacattaagggtggtacacagtacgaccagaatcacatcatcctaaataccgtttcaaaggaaaagttcacacaagtgtgggaagcaatggtgttgtatacctag

SEQ ID NO: 177576 - DNA, 504 bp, Artificial Sequence
  Description of Artificial Sequence: Synthetic coding sequence
atggtggcccagcaggagagcatccgggagggcttccagaagcggtgtctgcccgtcatggtactaaaagcaaaaaagccctttaccttcgagacccaggaagggaagcaagaaatgtttcatgctaccgtagcaacggaaaaagagttcttttttgtgaaggtctttaatactctcctcaaggataaattcattcccaaaagaatcattatcatcgcgagatattatagacactctggctttctggaggtgaatagtgctagcagggttctggacgccgagagcgatcagaaggttaacgtccctctgaacatcataaggaaagccggagaaacacctaaaatcaacaccctgcagacacaacccctgggaacaattgtaaatgggcttttcgttgtccaaaaagtaacagagaaaaagaaaaacatcctgtttgacctcagcgataacactgggaaaatggaggtactgggggtgcgcaacgaggacacaatgaaatgttag

SEQ ID NO: 177577 - DNA, 1032 bp, Artificial Sequence
  Description of Artificial Sequence: Synthetic coding sequence
atggagagcaagtacaaggagatcctgctgctgaccggcctggacaatattaccgatgaggagctggatcggtttaagttttttctgtccgatgagtttaacattgcaacgggcaagctgcacaccgccaataggatccaggttgcgactttgatgatccagaacgccggagccgtgtctgcagtcatgaaaacgatacggattttccagaagttgaactacatgctgctggctaaaagacttcaggaggagaaagagaaagtggataagcagtacaagtcagttacaaaaccaaagcccttgagtcaggcggagatgtcacccgcagcctcagcagccattaggaacgatgtcgcgaagcagcgcgccgctccgaaggtgagcccacatgtgaaacctgagcagaaacaaatggtggctcaacaggaatccatccgggaaggattccagaagcgttgcctgcctgtgatggtgctgaaagccaaaaagccgtttacattcgagactcaagagggtaagcaggaaatgtttcatgctacagtcgctacagagaaagagttcttttttgtgaaagtgttcaatactctgttgaaggacaaattcattcccaagcgtattatcatcatcgcacggtactatcgacattccggttttctcgaagtgaactctgcaagtagagtgctggacgccgagtccgaccagaaggtaaacgtgccgcttaacatcatccggaaggcaggggaaacccctaaaataaatactctgcagacacaaccgctcggcaccatcgttaacggccttttcgtcgtgcagaaggtgactgagaagaagaagaatattctctttgacctgtcggataacacagggaagatggaagtccttggtgtgagaaatgaggacactatgaagtgcaaggaaggggataaagttagactcactttcttcacactctctaagaacggcgagaaacttcaattgacaagtggggtccatagtaccattaaagtcattaaggcaaagaagaagacctag

SEQ ID NO: 177578 - DNA, 411 bp, Artificial Sequence
  Description of Artificial Sequence: Synthetic coding sequence
atggagagcaagtacaaggagatcctgctgctgaccggcctggacaatataacagatgaggaacttgatcgtttcaagtttttcctatcagacgaattcaatatcgcgaccggcaaactgcacactgccaacaggatacaggtggctacattaatgatccagaacgcaggagcagtcagtgccgtgatgaagacaatccgcatctttcagaaacttaattacatgcttctggcgaaaaggttacaagaggagaaagagaaagtggataagcagtacaagtctgtgaccaaacctaagcccctgagccaagctgagatgtctccagcggctagcgccgccatcaggaacgacgttgcaaagcagagagccgcgcctaaagtcagtcctcacgtcaagccagagcagaaatag

SEQ ID NO: 177579 - DNA, 1800 bp, Artificial Sequence
  Description of Artificial Sequence: Synthetic coding sequence
atgagcaaggaggagcggcccggccgggaggagatcctggagtgccaggttatgtgggagcccgattcaaagaagaacacacagatggataggttccgagcagctgtaggcgcggcttgcgggttagccctggagtcttacgacgacctgtatcattggagcgttgagagctacagcgacttctgggccgaattttggaaattcagtgggatcgtcttcagtcgggtgtacgacgaagtcgttgataccagtaagggcatagcagatgtgcccgagtggttcaaaggtagtaggctgaactacgccgagaatctgctgcgccataaggagaatgatcgcgtcgcactatacattgcacgtgagggcaaggaggagatcgtgaaggttaccttcgaggagttaagacaggaagtggccctgttcgccgccgctatgagaaaaatgggtgttaaaaaaggcgaccgagtggtggggtacctcccaaactccgaacacgccgtcgaagctatgttggccgccgcctcgattggggcgatttggagcagcacttcacccgactttggggtgaacggcgtactggatcgcttttcccagatccagcccaagctaatctttagcgtggaggcagtggtgtacaatggcaaggagcataatcatatggaaaagttgcagcaagtggtgaaagggctgcctgacctgaaaaaagtggtcgtgataccatacgttagctctagagaaaacattgatttgtcaaagatccctaattcagtctttctggacgatttcctggccactggaaccagcgaacaggcgcctcagcttgaattcgaacagctgccattctcccaccccctcttcattatgttttcatctggaacaacaggtgcaccgaagtgcatggtgcacagcgcgggcggcaccctgattcagcacctgaaggagcatttgcttcacgggaacatgacctctagtgacattctgttatgctacacaactgtcggctggatgatgtggaattggatggtgtccttgctcgcaactggcgccgccatggtgctgtacgacggaagtcctctcgtgcctactcccaacgtgctatgggatctggtggaccggatcggtattaccgttctggtcaccggtgccaaatggctctccgtcctggaagaaaaggctatgaagcctgtggagacacattccctgcagatgctgcacaccattctatccacagggtcgccgctcaaggcacagagctacgaatacgtttacagatgtatcaagagctccatactgctcggctccattagtggaggtactgacattatctcatgttttatgggacataattttagcctgcccgtctataaaggtgagatccaagctcgtaatctgggaatggccgtcgaagcgtggaatgaggagggtaaagctgtgtggggtgagtcaggcgagctggtctgcacgaaacccatcccttgccaacccactcatttctggaacgacgagaatggaaataaatacaggaaggcatatttttccaaatttcctggcatttgggcgcacggtgactactgtcggattaaccctaaaacgggcggcatcgtgatgctgggacggtcggacggaactctgaacccaaatggggtgcgcttcggatcttctgagatatataatattgtatacgctcagcggcaggaatctggcagttgccgccagacggaccatagatggaaaagcagaggtgcacgcaggtgtttcctggaaccaagggacccaggctccgtccctgggcacccttag

SEQ ID NO: 177580 - DNA, 2019 bp, Artificial Sequence
  Description of Artificial Sequence: Synthetic coding sequence
atgagcaaggaggagcggcccggccgggaggagatcctggagtgccaggtgatgtgggaaccggacagcaagaaaaatacccagatggaccggtttagggctgccgtcggggcagcctgtggcctcgccctggagtcctacgacgatctctatcactggtcagtcgagagttacagtgatttctgggccgagttctggaagtttagtggtatagttttctcccgcgtttatgatgaagtggtagacacttcgaagggaatcgcggacgttccggagtggttcaagggctctagactgaattatgccgaaaatctgctgagacacaaggaaaatgacagagtggcactttatatcgcacgggaaggaaaggaggagattgtgaaggtcacttttgaagagcttcgccaggaggtggctctgtttgcagctgccatgcggaaaatgggagtcaaaaaaggtgatcgcgtggtggggtatctgcccaactctgagcacgccgtggaagcgatgctagcagcagccagcatcggagcgatatggagctcaacatcaccggactttggggtgaacggcgtgctggatagattcagtcaaatccagcccaagctcatcttctccgtggaggcagttgtctataatggaaaggagcacaaccacatggagaagctgcagcaggtagtaaaagggctacctgacctgaagaaagtggtggtcatcccatatgtttcaagtagggaaaacattgatttgtctaagatcccaaactcagtttttcttgacgattttctcgcaaccggaactagcgagcaggcaccccaactcgagttcgaacagctgccattcagccacccccttttcattatgttcagtagcgggaccactggcgctcccaaatgcatggtgcattcggccggcggcactttgatacagcatctgaaggaacacttgctgcatggcaacatgacaagcagcgacatccttttgtgctacaccacggtcgggtggatgatgtggaactggatggtgagtcttctcgccaccggcgcggctatggtcctctacgacggtagccctcttgttcccacgcctaatgtcttatgggacctggtggaccgaattggcattacagtcctggtgacaggtgcgaagtggttatcggtgttggaagaaaaggccatgaagcctgtcgaaacccactcccttcagatgctccacactattctgtcaactggaagtcccttaaaggcccagtcctacgagtatgtgtataggtgtataaagtcctctatcctccttggcagtatttccggcggtaccgatattatttcatgcttcatgggacacaacttttctcttcccgtatacaagggagagatacaagctagaaatctgggaatggctgttgaagcctggaacgaggaggggaaagcggtttggggggagtctggcgaacttgtgtgcacaaagccgatcccatgtcagccaacgcacttctggaatgacgaaaatggaaataaataccgcaaggcctatttcagtaagtttcccggaatctgggcccacggtgactattgccgtataaatcctaaaacgggaggtatcgtgatgttgggccgctccgatgggacccttaacccgaacggcgtgcggttcgggtcctccgagatatacaacatagtcgagagttttgaagaggtggaggactcactgtgcgtgcctcaatataacaaataccgcgaagagagggtcatcctcttcctcaaaatggcttcaggtcacgcttttcagcccgacctggtcaaacgcatacgcgacgcaattaggatgggactcagcgccaggcacgtaccttccctgattctggaaaccaagggtatcccatacactcttaacgggaagaaagttgaggttgctgtcaaacagataattgcaggaaaagccgtggagcagggaggggcattttccaatccagagaccctggacctatatcgagatatcccagaactgcaaggattttag

SEQ ID NO: 177581 - DNA, 762 bp, Artificial Sequence
  Description of Artificial Sequence: Synthetic coding sequence
atgcggaagatgggcgtgaagaagggcgaccgggtggtgggctacttgcctaacagcgagcatgctgtggaggcaatgctggccgccgcctcaatcggcgcaatctggtcctcaacctcccccgactttggtgtgaatggcgttttggaccggttttctcaaatccagcctaagctgattttttctgtggaggccgtggtttacaacggcaaagaacacaaccacatggagaaattgcagcaagtggtgaaagggctacctgatcttaagaaagttgtggtgattccatacgtgtcctctcgcgagaacatcgatctgtccaagatcccaaatagcgtctttctggacgactttcttgcaaccggtacatctgagcaggccccccagcttgaatttgagcagctgcccttcagccacccactgtttatcatgttttccagcggaacgactggtgcacctaagtgcatggtacacagcgccggggggacactcattcagcacctgaaagagcacttgttacatggtaatatgacttcctctgacattttgttgtgctacaccacagtgggctggatgatgtggaactggatggtctcgctgctggcaaccggcgcggctatggtgctgtacgacggttcgcctctggtgcctacgcccaacgtcctttgggacttagtggaccgcatcggctacctggggtcctggaggctcctgcagaaccagcctcaggatcgcgggcacagacacgcctggccggaatag

SEQ ID NO: 177582 - DNA, 1845 bp, Artificial Sequence
  Description of Artificial Sequence: Synthetic coding sequence
atgcggcccccccagtgcctgctgcacacccccagcctggccagccccctcctgctgctgctcctttggttactcggtggcggggtgggagctgagggcagggaggatgctgaactgttggtaactgtgcgcggcgggagattgaggggcatccggctgaagaccccgggtgggcccgtgtctgcctttctcggcattcctttcgctgagccgccaatgggtccccgcaggtttctgccacccgagccaaagcaaccatggagcggagtggtagacgccaccaccttccagtcagtttgctaccagtacgtggatactctttacccaggctttgagggtaccgaaatgtggaatcctaacagggagctgagcgaagactgcctttatctcaacgtctggacaccataccccagaccgacctcccccacgccagtccttgtttggatttacggcggcggattttacagcggggcctcatccctggacgtgtacgacggaaggtttttggtgcaagcagagagaaccgtgctcgtgagcatgaactaccgagtgggcgcctttggttttttggctctgcctggctcccgcgaggctcccgggaatgttggactcctggaccaaaggctcgcgctccagtgggttcaggaaaatgttgccgcgtttggtggagatccaacctctgtcaccttgtttggtgaatccgccggggctgcaagcgtgggaatgcatctgctgtcaccccctagccgcgggctttttcatcgtgctgtgctgcagtccggagcaccaaatgggccctgggctaccgtcgggatgggcgaagcacgccggagggcaacccagctggcccatttggtgggatgcccacccggaggaacaggtgggaatgataccgagctggtggcatgtctgcgcactcgaccggcccaagtgcttgtgaaccatgagtggcacgtcttgcctcaggagagcgtgtttaggttctcttttgtcccggtggtggacggggactttttatcagacaccccagaagcactgataaacgctggtgacttccacggactgcaggtgttggttggcgtggtgaaggatgaaggatcttacttcttggtgtatggagcccctgggttctctaaagataatgaaagcctgattagtagggccgaatttctcgcgggcgtacgcgtgggggtcccccaggtttctgatctcgctgcagaggcagtggtgttgcactatacggattggctccatccagaagaccccgctcgtctgagagaggctctctctgatgttgttggggaccacaatgtagtatgtcctgtggctcagctggccggccgactggccgcccagggtgctcgggtatacgcttacgtctttgaacaccgggcaagtaccttgtcctggcctctttggatgggcgttcctcatggctacgaaatcgagttcatctttggcattcctctggacccttccagaaactatacagccgaggagaagattttcgcacaaaggctgatgcgatactgggccaattttgctcgaacaggggatccgaacgagccccgcgaccctaaggccccccagtggcccccatacacagcgggggcacagcagtacgtctctctggacttacgtccattggaggtgagacgcggcctacgtgcacaggcctgcgctttctggaatcgattcctgcccaagctgctcagcgccacagatacactcgatgaagcagagagacaatggaaggctgaattccacaggtggtcatcttacatggtgcactggaagaatcagtttgaccactattccaagcaggatcggtgctctgacctctag

SEQ ID NO: 177583 - DNA, 1854 bp, Artificial Sequence
  Description of Artificial Sequence: Synthetic coding sequence
atgcggcccccccagtgcctgctgcacacccccagcctggccagccccctgctcctcttgttgctctggctgttgggcggaggggtgggcgctgagggtagagaggatgcagagctcttggtgaccgtgcgaggcggcaggctgagaggcatccggttgaagacacctggcggaccagtcagcgcattcctgggaattcccttcgctgagccacccatgggcccaaggcgcttcctgccccccgaacccaaacagccttggagcggagtggtggacgctactacattccaaagtgtgtgttatcaatacgttgataccctgtaccccggattcgaaggcacagaaatgtggaacccaaatagggaactgtctgaggattgtctttatctgaatgtgtggaccccgtacccgaggcctacatctcccacaccagttctcgtgtggatctacggcggaggcttctactctggcgccagtagcctggacgtatacgacggccgtttcctggtgcaagcagagaggacagtcctcgtttccatgaattatcgagtgggcgcctttggctttctggcacttcctggctctagggaggcccccggaaacgtcggactgcttgaccagaggcttgccctgcaatgggtgcaggagaacgtggcagcgttcggcggggatccaacatctgtaactttgtttggagagtctgctggtgccgcctctgtgggcatgcacttactcagccctccgagtcgcggcctctttcaccgagctgtgctgcagtcaggagcgcccaacggcccatgggctacagtgggcatgggggaagcccggaggagggccacgcagcttgcccacttagttggctgtcctcccggggggaccggcggaaacgatactgaactcgtggcttgcctgcgtacacgtcctgctcaggttcttgtgaaccatgaatggcacgtgttgccacaggaaagcgtgtttaggttctcctttgttcccgttgtggatggcgacttccttagcgatactccggaagcactcatcaatgctggcgattttcacggcctgcaggtgttggtgggagttgtaaaggatgaggggtcatattttttagtttacggggctcctgggtttagtaaggacaacgagagtctgatctctcgcgcggagtttctggcaggggtccgagtcggcgtgccccaggtgtccgacctcgctgccgaggcagttgttctgcattatacagattggctgcacccagaagacccagcccggctgcgggaggccttgtccgacgtggtgggcgaccacaacgtggtgtgtcctgtggcacaactggctgggaggctggctgcccaaggcgcacgcgtttacgcctatgtatttgagcatcgcgcgagcaccctttcgtggccactgtggatgggtgttccacacggctacgaaatcgagtttatttttggaattcccctcgacccatctagaaattacactgctgaagaaaaaatctttgcacaacgcctgatgaggtactgggctaattttgcgaggacgggtgatcctaatgagcctcgggacccaaaagcaccccaatggcccccttatacggctggcgcacagcagtacgtaagtctggacctgcgccctctagaggtgcggagggggctccgggcccaggcgtgtgcattctggaaccgattcctgcccaagctgctaagcgctacggcttcggaagctccaagtacttgccccgggttcacccatggagaggccgcccccaggccagggttacctctgccactgcttctcctgcaccagctgctcctgttatttttatcccatctaagacgcctgtag

SEQ ID NO: 177584 - DNA, 1854 bp, Artificial Sequence
  Description of Artificial Sequence: Synthetic coding sequence
atgcggcccccccagtgcctgctgcacacccccagcctggccagccccttgctcttactgctgctgtggttactaggagggggagtaggtgcagaaggccgcgaggacgccgaactgcttgttacagtaaggggcgggaggctgaggggtattagattgaaaacaccgggcggacctgtgtctgcgttcctgggcatcccctttgccgagccaccaatgggccctaggagatttctgcctccagagcccaagcagccctggagcggtgtggtggacgcaaccactttccagagcgtgtgttaccagtacgttgacactctatatcctggcttcgaggggactgaaatgtggaaccctaaccgggaattgtccgaggactgtctgtaccttaatgtgtggacaccatatccacgccctacctcgcccacacctgttttggtatggatctacggcggtgggttttatagtggcgctagctctctggatgtttacgacggcaggtttctggtgcaggctgaacgtaccgtgctcgtgtcaatgaactatagagtaggagcctttggcttcttagccctgcccgggtctagggaggcgccaggaaacgtgggactactggatcaacggcttgcattgcagtgggttcaggaaaatgtggcagcatttggcggagatcccacctcggtgacgctgttcggagaatctgctggagctgcctccgtgggcatgcatctgctgtcacctccctctaggggcctgttccacagggcggttctgcagtccggcgcccccaatggcccgtgggctactgtgggaatgggtgaggcccgccgcagagcaactcagctggcccatctggtaggatgcccccctggaggcaccggggggaatgataccgaattagttgcctgtttgcgaactcgaccagctcaggtcctggtgaatcatgaatggcatgttctgccccaggagtcagtttttaggttctcctttgtccctgtcgttgatggtgacttcctaagcgatacgcccgaggcactgattaacgccggggactttcatggccttcaggttctggtgggtgtggtgaaggacgaaggttcctatttcctcgtgtacggtgcacccggattctccaaagacaatgagagcttgatatcccgggcagaattcttggccggcgtgagagttggtgtccctcaagttagtgacctagccgctgaggctgtcgttctccactacactgactggctgcatccggaagatcctgcgcgcttaagagaagccctgtccgatgtcgtcggcgaccataacgtggtgtgtcctgtcgcccagttagccggcagattggccgctcagggcgcacgcgtgtatgcatacgtgttcgagcacagagctagtactctgagctggcccctttggatgggcgtgccccacgggtacgagattgagttcatctttgggattccattagatccttcccggaactataccgcagaagaaaagatctttgcacagcggctcatgagatattgggcaaattttgctcggacgggggaccccaatgagccgcgcgaccctaaggctccccagtggccaccatatactgctggggctcagcagtatgtgtctctggacttaagacctctggaagtcaggcgaggtcttagggcgcaagcttgcgccttctggaataggtttctgcccaaactcttatcggctacagcctccgaagcacccagtacttgcccaggatttacccacggggaggccgctcctcggccaggcctaccacttcccctcctcttactacaccagctgctgctgctttttctcagtcaccttcgacggctctag

SEQ ID NO: 177585 - DNA, 1845 bp, Artificial Sequence
  Description of Artificial Sequence: Synthetic coding sequence
atgcggcccccccagtgcctgctgcacacccccagcctggccagccctctgctcttgttgctgctgtggcttctggggggaggcgtgggggcggagggacgcgaggatgccgagctgctcgtgacggtgcgtggcgggcggttgcgcggcataaggttgaaaacccccggaggtcccgtgtcagcttttttgggcataccttttgccgaacctccgatgggcccacgtcgatttctccccccagaaccaaagcagccctggagcggcgtcgtcgacgccactacattccagtctgtgtgttaccagtacgtggacacactctaccccggctttgaaggaactgagatgtggaatcccaatcgggagctttccgaggactgtctgtacctcaacgtgtggaccccatatccccggccgacgtcaccaacccctgttctggtgtggatttatggcggggggttttattcaggagccagtagtcttgacgtgtacgacggccggtttctagtgcaggctgaaagaaccgttctcgtgtctatgaactatagagtgggagcctttggcttcctcgcgttaccggggagtcgagaggcccctggcaacgtgggtctgctcgatcagagactggccctccagtgggtccaggagaacgtggcagccttcggtggggatccgacttcagtcacactgttcggcgaatcggctggagctgcaagcgtcggcatgcatttactttctccaccgtcaaggggtctattccatcgtgcagtattacagtccggagctccaaacgggccctgggctaccgtgggcatgggtgaagcacgaaggcgcgctacacagttagcacacttggtggggtgtccaccaggaggtaccggaggcaacgacacagaactggtggcctgtttgcgcactcggcccgcccaagtactggtgaatcatgaatggcatgtcctccctcaggaatctgtctttcgcttcagctttgttcccgttgtggatggcgactttctctctgatacccctgaggctctgattaatgccggcgactttcatggactccaggtcctggtgggagtggtcaaggacgagggatcctatttcttagtatatggcgcccctgggttctccaaagataatgaatctctgatatccagagctgagtttctggcaggcgtaagggtgggtgtgccacaggtgagcgatctggccgctgaagccgtagtcttgcactacacagactggctgcatcctgaagaccccgcccgcttacgtgaggccctgagcgatgttgtgggcgatcacaatgtagtgtgccccgttgcgcagttggccggccgccttgctgcccagggcgctcgcgtctatgcatatgttttcgaacacagggcaagtacccttagttggcccttgtggatgggcgtgccccacgggtacgagattgaattcatattcgggatcccactcgacccttcccggaactatacagccgaggagaaaatattcgcccagcgtctgatgcggtattgggcaaatttcgcgcgaaccggagacccaaacgaacctcgcgaccccaaggctccccagtggccgccttataccgccggcgcccagcagtatgtctcacttgacctcagacccctcgaggtaagacggggactccgcgctcaagcatgcgccttctggaatcggtttttgccgaaactgctctctgccaccgataccctggatgaggcagagcgtcagtggaaagccgagttccacagatggtcttcctacatggtgcattggaaaaaccagtttgaccactatagcaaacaggaccgatgctctgatctgtag

SEQ ID NO: 177586 - DNA, 1581 bp, Artificial Sequence
  Description of Artificial Sequence: Synthetic coding sequence
atgcggcccccccagtgcctgctgcacacccccagcctggccagccccctacttctcctcctgttgtggctcctgggagggggtgtcggggctgaaggcagagaggatgctgaattgctggtgacggtccgaggtggccgtctgcgagggatccggcttaagacacccggcggccccgtaagtgcctttctcggcattccgttcgctgagccacctatggggccccggcgattcctgcctcctgaacccaaacagccttggagcggagttgtggatgctacaaccttccagtcggtctgctaccagtacgtcgatacactctatcctgggttcgaggggaccgaaatgtggaaccctaaccgagaactctccgaggattgcttgtaccttaacgtgtggactccctatccccgccccacctctccgacccctgtcctggtttggatctacggaggagggttttattcaggcgcaagctcgctggatgtttacgatggccgattcttggtccaggccgagagaactgttctagtgtccatgaactatagagttggagcattcgggttcctcgcccttcccggctctcgagaggcccccggaaatgtgggactcctggatcagaggctagcgttacagtgggtacaagaaaatgtcgcagccttcgggggggatccaacatcagtcaccctgttcggcgagtcagccggtgcagcatcagtcggcatgcatctgctttcccctccctcaagggggctttttcatcgagcagttcttcagtccggagcccctaatggcccatgggccaccgttggaatgggcgaggccaggcggagggccacccagctggctcacctggttggatgtccgcccggaggcaccgggggcaatgacactgagctcgtcgcatgtctccggactcggccggctcaggtgctcgtgaaccatgaatggcacgtgctgccacaggaaagcgtcttccgcttttcattcgtgcctgtggttgacggggattttctttccgatacccctgaagctctgatcaatgctggtgacttccatggactgcagctagcgggccgactggccgcccagggcgcgcgagtgtatgcctatgtcttcgagcatcgtgcctcgaccctgagttggcctctgtggatgggagtgccacatggctatgaaatagaattcatcttcggcatacctttagatccctctcgtaattacacagcagaagaaaagatttttgctcaacgactcatgcggtattgggcaaatttcgctcgaaccggtgatccaaacgagccccgcgaccctaaggctccacagtggcccccttataccgcaggagcccagcagtatgtatccttggatctgaggcctctggaggttcgtcgtgggctgcgcgcccaggcttgtgctttttggaaccgatttctccccaaacttctgtctgccaccgacacactggatgaggccgagcgtcaatggaaggcggagtttcaccgatggtcgagctacatggtccactggaaaaatcagtttgatcattattcaaagcaggaccggtgcagtgatctttag

SEQ ID NO: 177587 - DNA, 1806 bp, Artificial Sequence
  Description of Artificial Sequence: Synthetic coding sequence
atgcggcccccccagtgcctgctgcacacccccagcctggccagccccctgctgctgctcctgctgtggctgctggggggcggcgtgggagccgagggtagagaggatgccgaacttctggttactgtgagaggaggaaggctgaggggcatacggctgaagacccctggtgggccagtctcagcattccttgggatcccgtttgcagaacctccaatgggacctcgccggtttctgccccccgaaccaaagcagccatggtcaggcgttgtggacgcgaccacattccagtccgtgtgctaccagtatgtagataccctgtacccagggtttgagggaactgagatgtggaacccaaacagggagttgtcagaggactgcctgtatctaaatgtgtggaccccctacccacgcccaacatcgccgacaccggtgctggtatggatctatggcggggggttttattcaggtgcgagtagtttggacgtgtacgacggcaggttcctggtgcaggccgaaaggaccgttttggtgtccatgaactaccgtgttggggcttttggctttttggccctccctggaagcagagaagcacccgggaatgtcggactgctggatcagcgtctcgccttgcagtgggttcaggaaaatgttgctgcttttggtggggaccctacaagtgtgactctcttcggcgaatctgctggtgctgcatcggtgggcatgcatctgctgagcccaccgtcgagagggctgttccacagggccgtgcttcagagtggcgccccaaatgggccctgggccacagtgggcatgggcgaggccagacggcgagctacgcagctggcgcaccttgttggatgtccgcctggcgggacgggaggaaacgacaccgagctggtggcatgtttgcgcactcgtccggcccaagtgctggtgaaccacgagtggcatgtcctacctcaggaaagcgttttcagattctccttcgtccctgtcgtggatggcgatttcctatccgacaccccagaggccttaatcaatgccggcgattttcacgggctgcaagttctggtgggcgtcgtgaaggacgaggggagctattttctggtgtacggcgcacccggcttctctaaagacaatgaatcactcatttctcgggcagagttcttagcaggagtacgggtgggtgtgccacaggtgtctgacctagcagctgaggccgtggttttgcactataccgactggcttcacccagaggacccagcacgcctccgggaagccctgtcagacgtcgtcggcgaccacaatgtggtgtgccccgtggcgcaactcgctggtcgcttggcggctcaaggggctcgggtgtacgcttacgtttttgaacacagggcttccacactttcatggccactgtggatgggagtgccgcacggctacgagatcgagttcatcttcggcatccccctggacccatctaggaattatacagccgaggagaagattttcgctcagaggctgatgaggtactgggcaaactttgctcgcacaggggaccccaatgaacctcgcgatcccaaagcccctcagtggccaccatacaccgctggggcgcagcaatatgtctctcttgacctgaggcccttagaggtgcgccgcggcttgagggcccaggcttgtgctttttggaatcgatttctgcccaaactcctgtcagccactggtatgcaaggacctgctgggtctggcagacgcggcgttggcgcccggtgcaatccaagtcttctccccctggctagtgaatag

SEQ ID NO: 177588 - DNA, 1845 bp, Artificial Sequence
  Description of Artificial Sequence: Synthetic coding sequence
atgcggcccccccagtgcctgctgcacacccccagcctggccagcccacttttgctcctgctgctttggttgttgggtggtggtgtgggcgccgaggggcgcgaagatgccgagctgctggttaccgtccgtggaggccggctccgaggcatccggctgaagactcctgggggacccgtctccgcttttctcggcataccctttgccgagcccccaatgggacctcgacggtttctgcctcctgagccaaaacaaccttggagcggtgtggtagatgctacaaccttccagtccgtctgttaccaatacgtggataccctgtatcctggcttcgaggggacagagatgtggaatccaaacagagagctttctgaggactgcctgtacctgaacgtctggaccccttaccccagaccaacctctcctacccctgtgcttgtgtggatctatggaggcggattttattccggcgcttcctccttggatgtgtacgatggaaggtttttggtgcaagcggagagaacggtgcttgtgagcatgaattacagagtgggtgccttcggattcctggccctacccgggagtcgggaagccccagggaacgtggggttattggatcaacggctagcactccagtgggtgcaggaaaacgtggcagcatttggtggtgatcccactagcgtgacccttttcggcgaaagcgctggggctgctagtgttggcatgcacttgttgtcacctcccagtaggggtcttttccatagagctgtcctccagagcggtgcccccaatggtccctgggctaccgtgggcatgggcgaggccagaaggcgggcgacgcagttagcccacttggtcggctgccctcccggcgggactggggggaacgacactgagctggtggcgtgtctcagaactaggccagcccaggtgttggtgaaccatgagtggcacgtattgccccaagaatccgtattccgcttttcctttgtccccgtcgtcgatggtgatttcttaagtgacacaccagaagcactaattaatgctggtgattttcacggcctgcaggtgttggtcggtgtggtgaaggatgagggtagctattttctggtgtacggcgctcccgggttttccaaggataatgaatccttaataagtcgcgcggagttcctggccggcgtccgagttggggtcccgcaggtttcagatttagctgcagaagctgtagtgcttcactacaccgactggctgcaccctgaggatccagcacgcttacgggaggccttgagtgatgtggttggtgaccacaacgtggtctgccctgttgcgcaactcgccgggcggctcgccgcccagggggcacgggtttatgcctacgtgtttgagcaccgggccagcactctctcctggcccctttggatgggggtgcctcatggatatgagatagagtttatattcgggatacctctggatccaagcagaaattacaccgctgaggaaaaaatctttgcccaaaggctaatgcgctactgggctaattttgcacgaaccggggaccctaacgaacccagagaccctaaagccccccagtggcctccttacaccgcgggagctcaacaatatgtgtcacttgacttgcgaccgcttgaagtcagacggggtctcagagcacaggcttgtgcattttggaatcgctttctgcccaaacttctgagcgcaaccgacacattagatgaagccgagaggcaatggaaagccgagtttcacaggtggtcgagctacatggtccattggaagaatcagttcgatcactacagcaaacaggatagatgtagcgacctgtag

SEQ ID NO: 177589 - DNA, 480 bp, Artificial Sequence
  Description of Artificial Sequence: Synthetic coding sequence
atgcggcccccccagtgcctgctgcacacccccagcctggccagccctctgctgctcctcctgttatggttacttgggggcggagtcggtgccgagggccgtgaggatgcagaattgctcgtgacagtaaggggtggccggctgcgcggaatacggctgaagaccccaggagggcccgtgtcagcttttcttggcattcccttcgcagagcctcctatggggcccaggcgattcctgcccccagagcctaaacagccttggagcggagtggtggacgcaaccactttccagtctgtttgctaccagtatgtggacactctgtatcccggcttcgaaggtaccgagatgtggaatcctaatcgcgagctctctgaagactgtctgtatctcaacgtctggacgccctatcccaggcccacctcccccacccctgtgctagtgtggatttacggaggggggttttacagcggggcctcgtag

SEQ ID NO: 177590 - DNA, 87 bp, Artificial Sequence
  Description of Artificial Sequence: Synthetic coding sequence
atgcggcccccccagtgcctgctgcacacccccagcctggccagcccactgttactactacttctctggttactcgggggcggttag

SEQ ID NO: 177591 - DNA, 282 bp, Artificial Sequence
  Description of Artificial Sequence: Synthetic coding sequence
atgctgggcctggtgatgagctgccccgaccggaccctggtgaccaaagtgcggagccacccctccggtaatcagcaccggccgactagaggaggctctcgaagcttccactgtagacgaggggtgccacgcccagctgcactgcgtgtattgccccgatgtcccgccttctccgatgccgcttgccccgcggctatgcgacccccccaatgcctcctgcacacaccaagcctggcttcacccttgttactgctcctgctatggctcctcggtggcgggtag

SEQ ID NO: 177592 - DNA, 1284 bp, Artificial Sequence
  Description of Artificial Sequence: Synthetic coding sequence
atggccgtgctggccgccctgctgcggagcggcgcccggagccggagcccactgctccgcaggctggtccaggagatcagatacgtcgagaggtcttacgtgtcaaaaccgacacttaaggaggttgtcatcgtgtcggcaacccgaacgcctattggatccttcttgggatccctaagtctgcttccagcgactaaacttgggagcatcgctattcaaggcgccattgagaaggccggcatccctaaagaagaagtgaaggaagcttacatgggaaatgtgctacagggtggcgaaggccaggcccctaccaggcaggctgtgctgggcgcaggactccccattagcactccgtgtacgaccatcaataaggtgtgtgcgagcgggatgaaagccatcatgatggcatcccagtctctgatgtgcggacatcaagatgtgatggtcgcaggtggtatggagtccatgtctaacgtgccctatgtgatgaaccggggctccacgccgtatggcggagtaaaattggaggacctcattgtcaaagatggcctgaccgacgtctacaacaaaatacatatggggtcatgtgccgagaacaccgccaagaaactcaatatcgctaggaacgaacaggatgcctatgccattaatagctatacacgctccaaagcagcatgggaggccgggaagtttgggaatgaagtgatccctgtaaccgtgactgtgaaaggacagcctgatgtagtggtgaaagaggatgaagagtacaagagagtcgattttagtaaagttccgaaactgaagacagtctttcagaaggagaatggaaccgttactgcagcaaacgccagtacattaaatgacggagcagccgctctcgttctcatgactgccgacgccgccaagcggctaaacgtcacacccctggctcgcattgtcgcattcgcagatgctgcagttgagcccatcgactttcccatagcaccagtctatgctgcctccatggttttgaaggatgtcggcctgaaaaaggaagacattgctatgtgggaagttaatgaagcattcagcttagtggtgctcgcgaacataaaaatgttagagatagacccacagaaagtgaacatcaatggcggggccgtgtctctcgggcatccaattggtatgagcggggccagaattgtgggccatctgacccacgctctcaaacagggggaatatgggttggcctctatttgtaacggcggcggtggggccagcgcaatgcttatacaaaaactatag

SEQ ID NO: 177593 - DNA, 1194 bp, Artificial Sequence
  Description of Artificial Sequence: Synthetic coding sequence
atgaacgccggcagcgaccccgtggtgatcgtgagcgccgcccggaccataattggcagctttaacggcgccctggctgctgtgcccgtgcaagatcttggaagtacagtgatcaaggaagtgttaaaacgggctacagtcgcacctgaggatgtgagcgaagtcatattcggccacgtgcttgcggctggctgtgggcagaatcctgtgaggcaagcctcagttggcgcaggcatcccttattctgttcctgcctggagctgccaaatgatatgtggcagcggcctcaaggctgtgtgcttggctgtgcagagcataggcatcggggactcttcaattgtggtggcgggaggtatggagaacatgagcaaggccccccacctagcctacctgagaaccggcgtgaagatcggcgaaatgccacttacagattccatcctttgcgacggcctgactgacgccttccacaactgtcatatgggcatcaccgccgagaacgtagcaaagaaatggcaagtgagtcgcgaggaccaagataaggtggcagttctgtctcagaaccgaacagagaacgcccaaaaagccggtcatttcgataaggagatcgtgcccgtcctggtgtcaactagaaaaggcttaatcgaggtcaaaacggatgagtttcctcgccatggcagtaatatcgaggcaatgtcgaagttaaagccatattttctgacagacgggaccggcaccgtgacgcccgcgaacgctagcggcatcaacgatggcgcggccgcggtggtgctcatgaagaaatctgaggctgataagcgcggtctgacaccactggcgaggattgtgtcatggtcccaggtcggagtggaaccttcaatcatgggtataggccctataccggccattaagcaagccgtaaccaaggcaggctggtcccttgaggacgtggatatttttgaaatcaatgaagcattcgccgctgtgtcagccgcaattgttaaggaactggggctgaatcccgaaaaggtaaacattgaaggaggcgcgatcgcgcttggacaccctttgggcgccagcggatgccgaatcctcgtgacacttctgcacactctggaacgtatgggccggtctaggggagtggcggccctctgcatcggcggcggcatgggtatcgctatgtgcgtccagcgagagtag

SEQ ID NO: 177594 - DNA, 1281 bp, Artificial Sequence
  Description of Artificial Sequence: Synthetic coding sequence
atgggcagccaccccgtgctgcggatctggggcaaccggcgggccacggcggcctctctcggccggagtggcggtagactatcaagccctaggttgcttcgggtggtggcccccaccttgacattcgctcaaacgagcaggtgctcctttaacggtgcactggccgctgtccccgtgcaggatctcgggtctacagtgataaaggaggtgctaaagcgggcgaccgtggccccagaagatgtgtctgaggtgatctttggacacgtactggccgccgggtgcggacagaatccagtgaggcaagcgtcagttggggccggtattccatactccgtccccgcctggtcatgtcaaatgatttgcgggagcggcctcaaagctgtatgcctggcagtccagagtatcggcatcggcgactcttctatcgtagtcgcgggaggcatggagaacatgtcaaaggcaccacatctggcatatctgcggacaggggtcaagatcggggagatgccgttgactgactcgatcctctgtgatgggttgaccgatgcctttcataattgccacatgggaataacagccgagaacgtggccaagaagtggcaagtcagtcgggaagatcaagacaaagtcgcagtcctctctcagaatcgcacagagaatgcacaaaaagctgggcattttgataaggaaatagtgcccgtcctcgttagcacccgcaaagggttgattgaggttaagaccgacgaattcccacgccatgggtctaatatcgaggcgatgtccaaacttaagccctactttttaaccgacggcacaggaactgttacccccgcaaatgctagtggtattaacgacggagcagccgctgtagttctcatgaaaaaatcagaagctgacaagcgcgggctgactcctctggcgcgtatcgtgtcatggtctcaggtgggagtcgagccttcgattatgggtatcggaccaattccagctatcaaacaggcagttacgaaagctggatggtctctcgaggatgtggatatcttcgagatcaatgaggccttcgctgccgtgagtgcggccattgtgaaagagttggggctcaatcctgaaaaggtgaatatagaggggggtgcgatcgcgctgggccacccactgggtgcgtctgggtgccggattctcgtgacgctcctgcacacacttgagaggatgggcaggagcagaggggtcgccgccctctgcatcggaggcgggatgggcatcgctatgtgcgtgcaaagggagtag

SEQ ID NO: 177595 - DNA, 1275 bp, Artificial Sequence
  Description of Artificial Sequence: Synthetic coding sequence
atgcagcggctgcaggtggtgctgggccacctgcggggccccgccgactccgggtggatgccgcaggcggcgccgtgtctgagtggcgctccacaagccagcgcagctgacgtggtggtggtacatggccgccggacggccatatgcagagccgggagagggggatttaaggatacgacgcctgatgagctcctctctgccgtgatgacagccgtgctgaaggacgtaaatctccggcctgagcaactaggcgacatctgcgtcggcaacgtacttcagccaggagcaggagccattatggccagaatcgcccagtttttgagtgatattccggagacagttcccctgtctacagtaaatcggcagtgcagctcaggtctgcaagcggtagcctccatcgccggaggcatccgtaatggctcttacgatatagggatggcatgcggggttgagtccatgtcgctcgcagacagagggaacccaggaaacattaccagtcggttgatggagaaagaaaaagctcgtgactgcctcatcccgatgggaatcacaagcgaaaatgtggccgagcgattcggaatctcccgagaaaagcaggacacttttgccctggctagccagcaaaaagcggcccgggctcagtccaaggggtgctttcaagctgaaatcgtgcccgtaacgactactgtgcacgacgacaaaggcaccaagcgatcaatcactgtgacacaggacgagggtattaggccctctactacaatggaagggttggctaaactgaaacctgcgtttaagaaagacggaagtactaccgcaggcaactccagccaggtctccgacggggccgcagctatcctcctcgctaggcgctcaaaggccgaagagctggggctgcccatattaggggttctgcgttcctatgcggtggttggcgttccccccgacattatggggatcgggcctgcttacgcgatcccagttgctcttcagaaggcgggcctgacagtcagtgatgtggatatcttcgagattaacgaagccttcgcctcacaggcagcgtattgcgtggaaaaattgcgactgccaccggagaaggtgaaccctctgggaggagctgtcgccttgggtcatccattgggctgtacaggagccaggcaggtgattacacttctcaacgaacttaaaagacggggcaaacgggcctacggagtggtgtctatgtgtattggcaccggcatgggtgccgctgctgtgttcgagtacccaggtaactag

SEQ ID NO: 177596 - DNA, 1071 bp, Artificial Sequence
  Description of Artificial Sequence: Synthetic coding sequence
atgaccgccgtgctgaaggacgtgaacctgcggcccgagcagctgggcgacatatgtgtgggcaacgtgctgcagcccggcgccggtgctattatggcgagaatagctcagtttctaagtgacatccctgaaacggtccctttgtcaactgttaacaggcagtgctcaagcggattgcaggcggtggctagcatcgccggcggaattcgaaatgggtcttatgacatcggcatggcgtgcggagtagagtccatgtccttagctgatcgaggaaacccggggaacattacctcccggctgatggagaaagaaaaggcacgggattgtttgatacccatgggaattaccagtgagaatgtcgccgaaagatttggcatcagtagggagaagcaggacaccttcgcactggcatcacagcagaaagccgcaagggcccagtcaaaaggttgctttcaggcagagattgtgcccgtgaccacaaccgtgcacgatgacaagggcaccaagaggtcaattacggtgacccaggacgaaggaattagaccctccactacaatggagggcctcgcgaaattgaagcccgctttcaagaaggacgggtcgaccactgctgggaattccagccaggtgtcagacggagctgcagctattttactagctagaaggtccaaagcggaagaattggggttaccgatcctgggtgtgcttagatcctacgcggtggtgggggtgccaccagatatcatggggatagggcctgcatacgctatccccgttgctttgcaaaaagcaggattaactgtttcagacgttgacatctttgaaatcaatgaggcattcgcctcccaggctgcctactgtgttgagaaattgcgcctgcctcccgaaaaggtaaatccccttgggggagctgtggccctgggacatcctctcgggtgcacgggcgctagacaagtaataacactgcttaatgaactgaagagaaggggtaagcgagcctatggagtggtcagtatgtgtattggcactggaatgggcgccgcagcagtttttgaatatcccggtaactag

SEQ ID NO: 177597 - DNA, 462 bp, Artificial Sequence
  Description of Artificial Sequence: Synthetic coding sequence
atgcagcggctgcaggtggtgctgggccacctgcggggccccgccgacagcgggtggatgccgcaggccgccccatgtttatcaggtgccccgcaagctagcgctgccgacgtggtggtcgtccatggcagaaggactgcgatttgccgcgccggtaggggaggttttaaggataccacccccgacgagctcctgtccgccgtcatgacagcggttctcaaagatgtgaacctgcgcccagagcagctcggcgacatctgcgttggtaacgtgctacaaccaggagccggcgcaatcatggctagaatcgctcagtttctgtctgatatacctgagactgtccccctgagcactgttaataggcaatgtagctctggcctgcaggccgttgcctccatagcagggtggtccccttgtccctggctgaccgagggtacactcgaaatacttctaagggcctag

SEQ ID NO: 177598 - DNA, 381 bp, Artificial Sequence
  Description of Artificial Sequence: Synthetic coding sequence
atgagcctggccgaccggggcaaccccggcaacatcaccagccggctgatggaaaaggagaaagctagagactgcctaatacctatgggaattactagcgagaacgtagctgagaggttcggcatctctagggagaaacaggatacatttgccctggcctcgcagcagaaggctgccagggcacagtcaaaagggtgtttccaagccgaaatcgtgccggtgactacaaccgtgcatgatgacaagggtacgaagcgttctatcaccgtgactcaagacgaggggattaggcccagtactaccatggaaggactggctaaactgaagccagcatttaagaaagacggctcaaccactgctggtgaaaccgggcctggttag

SEQ ID NO: 177599 - DNA, 996 bp, Artificial Sequence
  Description of Artificial Sequence: Synthetic coding sequence
atgcagcggctgcaggtggtgctgggccacctgcggggccccgccgactcaggttggatgccccaggccgccccatgcctttcaggcgcgcctcaggcgagcgctgctgatgtcgtggtggttcacggaaggaggaccgccatttgccgcgcaggacgcggaggttttaaggatacaacaccagacgagctgctgtccgcagttatgacagcagtcctcaaggatgtgaacctgagacccgagcagctaggagacatatgcgtagggaatgtgctccagccaggcgcaggggctataatggcccgtattgcccagtttctttccgacatcccggagaccgtccccctgtccacagtgaaccgccagtgcagttctggactgcaggccgtggcttccatcgctggtggaataagaaacggttcctacgacatcggtatggcttgcggaatcaccagtgagaacgtggccgaacggtttggcataagcagagagaagcaggacacctttgcacttgcatctcagcaaaaagccgcacgtgcccagagtaagggctgcttccaggctgagatcgtccctgtcacgactactgtgcatgacgataaagggaccaaaagatccataacggttacacaggacgagggaatccggccgtctaccaccatggagggcctggccaagctgaagccggcgtttaaaaaagatggcagcactacagccggacttactgtcagtgatgtcgatatctttgagatcaacgaggcatttgcctcccaggccgcttattgcgtggagaagttaagactgcctccagaaaaggttaaccccctgggaggcgctgtcgcactgggccaccctctgggctgcaccggagcccgccaggtgataacactgttaaacgaactaaagcgccgtgggaagcgggcatacggagtggtcagcatgtgcataggcacgggaatgggcgccgccgccgtcttcgagtacccgggaaactag

SEQ ID NO: 177600 - DNA, 7377 bp, Artificial Sequence
  Description of Artificial Sequence: Synthetic coding sequence
atggtgctgctgctgtgcctgagctgcctgatcttcagctgcctgacttttagttggctgaagatctggggaaaaatgacagactccaagcccatcactaaatctaagtcagaagccaatctaataccctctcaagagccatttcccgcgtcagacaactccggagaaactccccagcggaacggagaagggcatacccttccaaagaccccatcccaagcagaaccagccagccacaaagggcccaaggacgctggaagacggcgaaactctctgccccctagccatcagaagccccctcgaaatccccttagcagttccgatgcagctccatcccctgaacttcaggctaacggcacaggaactcagggtttagaggcaactgatactaacgggctgtcttccagtgctcgcccgcaggggcagcaggccgggagtccttcaaaggaagacaagaaacaggcgaacatcaaacgtcaactaatgacaaactttatcctgggctcctttgacgattactctagtgatgaggattcggttgcgggcagctcgagggaatccactaggaagggctcccgtgcaagccttggagctttatccctcgaagcgtacctgaccacgggggaggctgagacacgggtaccgacaatgcgaccctccatgtctggactgcacctcgttaagcggggacgggaacacaagaagctggacttacatagagacttcaccgtagcctccccagccgaattcgtgactcgttttgggggggatcgcgtaatcgagaaggttctgattgctaacaatgggatcgctgccgttaaatgcatgaggtcaattaggcgctgggcatacgagatgtttcgaaatgaaagagccatcagatttgtcgttatggtcacacccgaagatttaaaggccaacgcagagtacatcaaaatggccgaccactacgtacctgtgccgggtggacctaacaacaacaattatgccaacgtggagctcattgtcgacatcgctaaacgaattccggtgcaggccgtttgggccgggtggggacatgcctctgagaatcctaagctgcctgaactgctgtgcaaaaacggtgtcgcatttcttggtcccccctcagaagccatgtgggctctgggcgacaagatcgcgagtacagtagtagcccagacgctgcaagtgcctactcttccatggtcaggctccggactgacagttgaatggaccgaagatgacctgcaacagggaaagcggatctccgtgccagaggacgtgtacgacaagggatgcgtcaaagatgtcgatgagggtttggaagctgccgagcgaatcggctttccattgatgatcaaggcgtccgagggcgggggaggcaaagggattagaaaggctgaatcagcagaggacttccccatcttgttcaggcaagtccagagcgagatcccgggtagccccatcttcctcatgaaacttgcccagcacgcccgtcacttggaggtgcaaattttggctgatcagtacggtaatgcagtgtccctcttcggtagagactgtagtatccagagacgtcatcagaaaatcgtggaggaggcccctgccacaattgccccactcgctatcttcgaatttatggagcaatgcgctatacgactggccaaaactgtcgggtacgtgtcagccggaacagtggagtatctgtacagccaagacggcagtttccatttccttgagcttaaccctaggctgcaggtggaacacccatgcaccgagatgatcgcggacgtgaatctaccagccgctcaacttcagattgcaatgggggtaccactgcacagacttaaagacatcagacttttgtacggagaatcaccgtggggcgtgactccaatcagtttcgagaccccctccaaccctcccctggccaggggtcatgttatcgccgctaggatcacctcagagaatcccgatgagggtttcaagccctcctccggtaccgtccaagagctgaatttccgctcttctaaaaatgtctggggatattttagcgtagccgcaaccggtggcctgcacgagtttgccgattctcaattcggtcattgcttttcgtggggggagaatcgcgaggaggctatctccaacatggtggtggccctgaaagagcttagcatccgcggcgactttcgcacaactgtggagtatctgattaatctgctggagaccgaatcctttcagaacaatgacatcgataccggctggctggattatctaattgctgaaaaggtgcaagccgagaagccagacattatgctgggtgtggtgtgtggcgccctgaacgttgctgacgcgatgttcagaacatgcatgaccgatttcttacactcgttagagcggggacaagtattgcctgcggacagcctattaaatctcgtggacgtcgagctgatctatgggggagtaaagtatatactaaaagtggcgcgccaaagtctcacaatgtttgttctcatcatgaatggctgtcacatagagatcgacgcacatagactgaatgatgggggacttcttctgagctacaacggaaactcatacacaacttacatgaaggaagaagttgacagttatcgaattaccattggcaataagacctgcgtatttgaaaaggaaaacgaccccacagtccttagatctccgtccgccggcaaacttacgcagtatactgtggaagacggcggacacgtggaggcagggagcagctacgccgagatggaagtgatgaagatgattatgaccctcaacgtccaggagagaggtagagttaaatacatcaaacgcccaggtgccgtgttggaggctgggtgcgttgtagcaaggctcgaattggacgacccaagcaaagtgcatccagccgaaccatttaccggagagctgcctgcgcagcagacacttcccatcctgggggaaaagctccaccaggtgtttcacagtgtcctggaaaacctgaccaatgtgatgtcaggcttctgcctccctgagccggtattctcgattaaactcaaagaatgggtgcagaagttgatgatgaccctccgacatccttcgttgcccttgctagagctgcaggaaatcatgaccagtgtggccggacgaattcctgctcctgtcgagaagtcagtgagacgggtgatggctcagtatgcgagcaatattacaagcgtcttgtgccagttccctagccaacaaatcgccactatactggattgccatgctgctacgcttcaacggaaggctgaccgcgaggtctttttcataaacacccaaagcattgtccagttagtgcagagatacaggagtggcattcgggggtacatgaagacagtagtgttggacctcctgaggcgctacttacgagtggagcaccactttcaacaagcccactatgacaaatgtgtgatcaatctgcgggaacagttcaagcccgacatgtctcaggtactggattgcattttcagccacgcgcaagtcgctaaaaagaatcagttggttatcatgctgatcgatgaactttgcggacccgacccctcactctccgatgaattgatttccattctcaatgagctgacccagctcagcaaatccgagcactgtaaggtagcattgagggctaggcagattctgattgcaagccacctcccctcttacgaactgagacacaatcaggtcgagtcaatcttcctcagcgccattgacatgtatggacaccagttctgcccggagaacctgaagaaactgattctgtccgagacgacaatcttcgatgtactgcccaccttcttttatcatgccaacaaggtagtgtgcatggcatcactggaagtgtacgtacggcgcggctatattgcttatgagctgaatagtttgcagcaccgacagctccctgacgggacgtgcgtagtggaatttcagttcatgctgccttcatctcaccctaataggatgaccgtccccatcagcatcactaaccctgacctgctcagacatagcacagaactctttatggacagtggcttctctccactgtgccagaggatgggagctatggtagccttcagacggttcgaagacttcacacggaactttgacgaggtgatttcgtgctttgctaacgtgccgaaggacacccccttattttcagaggcaaggacctccctttacagcgaggatgattgcaaatcactccgcgaagagccgatccatatattgaatgtgtccattcagtgtgcagaccacctggaagacgaggcgctcgtgccaatcctgcgtacttttgtgcaatcaaaaaaaaatattctggtcgattacggactccggaggatcacgtttttgatcgcccaggaaaaggagttcccaaaattttttacctttagggcccgcgatgagtttgccgaagacagaatctataggcacctggaacccgcgcttgcatttcagctcgaacttaacagaatgagaaatttcgacctgaccgcggtgccgtgtgcaaatcacaagatgcacctgtacttgggagcagcaaaagtgaaagagggcgtggaagtaaccgaccatcggttcttcattcgggccatcattcgccatagtgacctcatcacgaaagaggcaagcttcgagtaccttcaaaatgagggagaaagactgttactggaggcaatggacgaactggaagttgcattcaacaacacttcagttcggacggattgtaaccacattttcctcaatttcgtgccaacagtgatcatggaccctttcaagatcgaggagagtgtacgctacatggtgatgcggtatggtagccggttgtggaagctgagagttctccaggccgaggtgaaaatcaatatcagacaaactacaactggctcagcggtccccataagactctttataactaatgagtctggatactacctggatatcagcttgtacaaagaggtgacagatagtagatccggaaatattatgtttcactcttttggaaataagcagggaccacagcatggtatgcttattaatactccctacgtaacaaaagatttgttacaagccaagcgcttccaggctcagactttaggaacaacatacatctacgattttcctgagatgttcagacaggcattgttcaaattgtggggctcccctgacaagtatcctaaagacatactgacatacaccgaactggtgctagactctcagggccagttggtcgagatgaatcgcctgccagggggtaacgaggtgggcatggtggcctttaaaatgaggtttaagactcaggagtacccagaaggccgtgatgtaattgtcataggtaacgatatcacatttaggataggatcatttgggcccggggaggatctgttgtacctgagggcttcagagatggcgcgggctgagggaatcccgaagatttatgtcgccgctaattcgggcgcaaggatcggaatggcggaggagatcaaacacatgttccacgtcgcctgggtcgacccagaagacccgcacaagggttttaaatacctatatctgacgccacaggactatacaaggatctcgtctctgaattcggtgcattgcaagcatatcgaggagggaggtgagtcacgctacatgatcactgatatcattggcaaggatgatgggttaggggtggagaacctgagaggcagcgggatgattgcaggagagtcgtcactggcttatgaggaaatagtgacaatctctttagtcacctgccgcgccatcggcataggtgcttatcttgtaaggctgggccagcgcgtaattcaggtagaaaatagtcatatcattttgactggtgcctctgcgctgaacaaggtgctggggagggaggtctacacgtcaaacaatcagcttgggggagttcagatcatgcattataatggggtgtctcacattacagtgccggacgattttgagggagtatacaccatcctggaatggttatcctatatgcccaaagacaaccattctccagtgcctattattacccctactgatcctattgacagagaaattgagtttctcccaagtagagccccctacgaccctaggtggatgctggccggcaggccacatcccacactgaagggaacttggcagtccggttttttcgaccacggcagttttaaagaaatcatggccccgtgggcacaaacagtcgttactggccgggcccgcctgggcggcattcctgtcggggttattgctgtagaaacaagaacagtggaggtggcggtccctgcagatccagctaacttggattcggaggcaaagatcattcagcaggccggacaggtctggtttcctgactcagcatacaagacggcccaggctgttaaggacttcaaccgggagaagcttccactgatgatattcgcgaattggagagggttctccggaggcatgaaggatatgtatgaccaggtcctgaagttcggcgcttacattgtggacggcctgaggcagtacaaacagcctatcttaatttacatacccccctacgctgagcttcgggggggtagctgggtggtgatagatgctaccatcaaccccctatgtatcgagatgtacgcagataaagagagtcgaggtggtgtgttagaaccagagggtaccgtggaaattaagttcagaaagaaagacctgatcaaatccatgcgcaggattgatccagcatataagaaactcatggaacagctcggtgaaccggacctctcggataaagaccggaaggatctggaagggcggctgaaagcacgtgaggatctgttgttgccaatctatcaccaagtggccgttcagttcgccgacttccacgatacgcctggcaggatgcttgagaaaggcgttattagtgacattctcgaatggaagacagcacgcacattcctgtactggcgactgcgcagactcctgttggaagatcaggtgaagcaagagatcctgcaggcctccggagaactttcacacgtccacattcagtcaatgcttaggcgatggtttgtggagacagaaggagcggttaaagcctacctctgggataataaccaagtcgtcgtacagtggctcgaacaacactggcaggccggtgacgggccgcgcagtacaatccgcgagaatattacatatctgaagcatgattccgtactgaaaacaatccgcggcttggtggaagagaatcccgaggtagctgtagattgcgtgatttatctctcacagcatatttccccggccgagcgcgctcaggtggtgcacctgttgtccaccatggattctcccgccagcacatag

SEQ ID NO: 177601 - DNA, 7377 bp, Artificial Sequence
  Description of Artificial Sequence: Synthetic coding sequence
atggtgctgctgctgtgcctgagctgcctgatcttcagctgcctgactttctcctggctgaaaatctggggaaagatgaccgactccaaaccaatcacaaagtcaaagagtgaagcgaacctgatcccaagccaggagccctttccagcatccgataattccggagagaccccccagcgtaatggcgagggtcacactctgcccaagaccccaagccaggctgaacccgcttcacataagggacccaaagacgccggccgcagacgcaactccctgcccccgtcccaccagaaacccccccggaaccccctgtcatcttcagatgccgccccctcccccgaactgcaggcgaatggcaccggaacccagggcttggaggcaactgataccaacggactgtcctcatcggctcgcccccagggccaacaggcaggatctccgagcaaggaggataaaaaacaggcaaatattaaacgccagctgatgactaattttatcctgggtagctttgacgattattcgtccgatgaggatagcgtggccggatctagcagggagtcaacaaggaaaggctctagagctagcctgggagctctcagtctggaggcatacttgactacaggagaggctgagacccgcgtgcccaccatgcgaccatcgatgtcgggattgcacctcgtgaagagaggaagggagcataagaagcttgatctgcaccgagatttcacagtcgcatcgcctgccgagtttgtgactcggttcggcggcgaccgcgtcatcgaaaaagtgttaatagcgaacaacggcattgcggccgtcaagtgcatgcggtccatccgccgctgggcatacgagatgttccgcaacgaaagggcaatcagattcgtagtcatggtgacccccgaagacctgaaggccaacgcagaatatattaagatggcagatcactatgtacccgtgcccggtggccccaacaacaacaattacgcaaacgtggaactcatcgtggacatagccaagaggatccctgtacaggctgtttgggccggatgggggcacgcgtctgaaaaccctaagttgcccgagcttttatgcaagaatggtgttgcctttttggggcctccaagtgaggctatgtgggctctcggggacaagattgccagcaccgtggtggcacagacactgcaagttcccactttaccgtggtccggtagcggcctgaccgtggaatggacagaagatgaccttcagcaggggaaacggatatccgtccctgaggatgtttacgacaaaggctgcgtgaaagacgtggacgaagggttagaggccgccgagagaatcggctttccacttatgatcaaggccagtgagggcggaggtgggaagggcattcgaaaggccgaatctgccgaagatttcccaatactttttcgacaagtccaatcagaaatcccaggcagcccaattttcctcatgaaactcgcgcagcacgctaggcatctagaggttcagatcctggctgaccagtatggaaacgcagttagtctgttcggtagggattgtagtatacaaagacgtcaccagaagattgttgaggaggcccctgcgaccatcgccccactggcaattttcgagttcatggagcagtgtgcgataaggctggcgaagactgtgggctacgtgtctgccggtactgtggaatatctctattcacaggatggaagttttcattttctcgaattgaatccaaggctccaggtggagcatccctgtactgagatgattgccgatgtcaatctacccgcagcccaactgcagatcgctatgggggtgccactgcacagactcaaggacatccgcctcctttacggagaatctccgtggggagtcacacctatttcgtttgagactccatcaaacccccctctggctcgcgggcacgtcattgccgcacgaattacctcggaaaaccctgacgaggggttcaagccatccagtggaaccgttcaggaactgaattttagaagctccaaaaacgtgtggggatatttcagcgtggcagccaccggcggcttacacgagtttgccgatagccagtttggtcattgtttcagctggggcgagaacagggaggaggcaatcagtaatatggtcgttgcactgaaggagttgtccatcaggggtgactttcgcacaaccgtcgaatacctgattaacttgcttgagacagagagcttccagaacaatgatattgacactggctggctcgattaccttattgccgagaaagttcaggctgaaaaacctgacattatgttgggtgtcgtttgtggcgcattgaacgtggcagatgccatgtttcgaacatgcatgaccgactttcttcatagtttggagcggggtcaggtcctaccagcggactccctgctcaatttggtcgatgtggaactgatttacggcggagttaagtacatcttgaaggtggctagacagtcccttaccatgttcgtcttgataatgaacggttgccacatagagattgatgcccatagactgaatgacggagggctcttacttagttacaatggaaactcctacacgacttacatgaaagaggaggtcgatagctatagaatcacaattggtaacaaaacatgtgttttcgaaaaggaaaatgatcctactgtactccggagccccagtgctggaaaacttacacagtatactgtcgaggacggaggacacgtagaagcaggcagttcctacgccgaaatggaggttatgaagatgatcatgacccttaatgtccaggaacgcggacgagttaagtatattaaacgtcctggggcagtgttggaagctggatgcgtcgtcgcgaggcttgaattggacgacccgtcaaaggtgcatcctgccgagccttttacgggggaactgcctgcgcagcagacccttcccattcttggcgaaaagctccaccaagtttttcactccgtgctggagaatctgactaatgtgatgtcagggttctgtctgcccgaacccgtcttttccatcaagctgaaagagtgggtgcaaaagcttatgatgaccctgagacacccaagtcttccactgctggaactgcaggaaatcatgactagtgtggcaggaagaatacccgcgcctgtcgagaagagcgtgaggcgcgtgatggcccagtacgcctcaaacatcactagtgtgctgtgtcaatttccttcccaacagatcgccactatcctggactgccacgccgctaccttgcaaagaaaggccgatcgggaggtattcttcatcaatacacagtcaattgtgcagctggttcaaaggtatcgatccggcattcgagggtatatgaagacagttgtgctcgatctgctgcgccgctacctgcgagtcgagcatcacttccaacaggcgcattatgataagtgcgtgatcaatctccgggagcagttcaaaccggatatgtcccaggtcttagactgcatcttttcccacgctcaggtggccaagaagaatcaacttgtgattatgctcattgacgaactctgtggccccgatccttctctgtcagatgagctgattagcattctcaacgagctcacccagctgtctaaaagcgagcactgcaaagtggccttgagggcaagacaaatcctgatcgcatctcacctcccaagctatgaactgcggcacaaccaggtcgagagcatattcctctcagcaattgacatgtacggtcatcagttttgccctgagaacttgaaaaaactcattctgtcagaaaccacaattttcgatgtgctgcctacattcttttaccatgcaaacaaggtggtttgtatggcctcactggaagtttacgtccggaggggatatattgcttacgagctcaactcgctccaacaccggcagttgccggacggtacctgtgtcgtggaatttcagttcatgcttccaagcagtcatccaaaccggatgactgtgcctatatcaattaccaatcccgacctccttagacactccaccgagctgttcatggacagtggcttctccccactgtgtcaaaggatgggagctatggtcgcctttcggaggttcgaggacttcacccgcaatttcgacgaagtcatctcttgcttcgcaaacgtgccgaaagatactccgttgttcagtgaggcccgcacaagcctgtattccgaggatgattgtaaatccttgcgcgaggagccaattcacatcttaaacgtctccatccaatgcgctgaccatttggaggacgaggcgctggtgcctattctccggactttcgtgcaatccaaaaagaatatactggtcgattacggactgaggaggataactttcctgatagctcaggagaaagaattccctaagttctttacgttccgcgcaagggacgaattcgctgaagaccggatatataggcacctggaacctgccttagcttttcagctggagctgaaccgcatgagaaatttcgatttaaccgccgtcccctgtgcgaaccacaagatgcacctttacctcggcgcggcaaaggttaaggagggcgtggaagtcactgaccacaggttttttatcagagctatcatccggcattcggacctcatcaccaaggaggccagctttgagtacctacagaatgaaggagaacggcttctactggaggcaatggatgagctggaggtcgccttcaacaacacatcggtgagaacagactgcaatcacattttcctgaacttcgtgccaacagttatcatggaccccttcaagatcgaagaatctgtgcgatacatggtcatgaggtacggttctcggctctggaaactgagagtgctgcaggcagaggttaaaatcaatattcggcaaaccacaaccggaagtgctgtgccaatacggctctttattactaatgagagcggctactacctagacatctcactgtacaaagaagttactgattcaaggagtggaaatatcatgttccattccttcggtaataagcagggcccccagcacgggatgttaatcaataccccttacgtgactaaggaccttcttcaagctaaaagattccaggcacaaacactcggtaccacctatatctacgacttccccgaaatgttccgccaggccttgtttaagctatgggggtcacctgataaatatcccaaagatattcttacatacactgaacttgtactggactctcaagggcagttagtcgaaatgaacaggcttcccggaggtaatgaggtggggatggtagcattcaagatgcggttcaagacacaagaatacccagaaggccgcgatgtgatcgtgattggaaacgatatcaccttccgcataggttccttcggtccaggagaggatttgctttacttgagagcctccgagatggcccgtgctgagggtatcccaaaaatatatgtcgccgccaattcgggggctcggatcggtatggcagaggaaatcaagcatatgttccacgtcgcttgggtggatcctgaggacccacacaagggcttcaagtacttgtacctcaccccacaagactatactaggatttcctctctgaactctgtgcactgtaagcatattgaagaggggggcgaaagtaggtatatgattacagatatcataggaaaagacgacggcctcggagtggaaaacctacggggcagtggcatgatagctggggagagcagccttgcttatgaggaaatcgtgactattagtttggtcacgtgtcgcgcaatcggtataggagcgtacctagtgagactgggccaacgggtcatccaggtcgaaaactcccacatcatactgactggagctagcgctctcaacaaagtcctcgggagagaggtgtacaccagtaacaaccagttgggtggagttcagattatgcattacaacggagtcagccatattactgtaccggatgacttcgaaggagtatatactatcctcgagtggctctcctatatgcctaaagataatcactcccctgttcctatcattacccctactgatcccatcgaccgcgagatcgagttcctcccgtcaagagccccttatgatccgcgatggatgttggcaggccgcccccatcccactctgaagggcacatggcagagtggcttcttcgaccacggttcgtttaaagagattatggctccatgggcccagacagtagtgacaggccgggcgcgcctgggagggatccctgtcggtgtgattgctgtcgaaacacggaccgttgaggttgctgtgccagcggaccctgctaacctggatagcgaggcgaaaattattcagcaggcagggcaagtgtggttcccagacagtgcctacaagacagcccaggcagtaaaggatttcaaccgggagaagttgcctctcatgatctttgccaactggagggggttctctggaggtatgaaggatatgtacgatcaggtgttaaaatttggagcctacattgtagacgggttacgccaatataaacagcccattctgatctacatcccaccatatgctgaactgcgcggtggctcctgggtcgtgatcgatgccaccatcaatcccttgtgcattgaaatgtatgccgataaagagtccagaggaggtgttctcgaaccagaaggcaccgtggagattaaattccggaagaaagacctgattaaatctatgcgccgaatagaccctgcttacaagaaactcatggagcaactgggtgaaccagacttatctgacaaagatagaaaggatttggagggccgcctgaaagctagagaggatctgttgttgcccatttaccaccaagtggccgttcagtttgccgactttcacgatacacccggccgtatgctggagaagggtgtgattagtgatatactggagtggaagacagcaagaacgtttctgtattggcggctcagaaggcttctgcttgaagatcaggtcaagcaggagatccttcaagcatcaggagagctctcgcacgttcacatacaaagcatgttacgtcgatggtttgtcgagaccgagggagcagtcaaggcttacttatgggataacaaccaagtggtggtgcagtggctggagcaacactggcaagcaggcgatggaccgcgctctacaattcgggagaacatcacatatctgaagcacgacagcgtgctaaagactatacgcggattggtggaagagaatcctgaagtggcagtggattgtgtaatatacctgtcgcagcatattagcccggccgaaagagcacaagtagtacacttgctgagcaccatggattcacctgctagcacatag

SEQ ID NO: 177602 - DNA, 7167 bp, Artificial Sequence
  Description of Artificial Sequence: Synthetic coding sequence
atggtgctgctgctgtgcctgagctgcctgatcttcagctgcctgacattctcttggttgaagatttggggcaaaatgactgactcaaagcctattacaaagagcaagtcagaggccaatttaattccctctcaggaacccttcccagcatcagacaatagcggcgaaacccctcagcgaaacggtgagggccatacactcccaaagacgccatctcaagcagaacccgcatctcacaaaggtccaaaagacgctggccgacggagaaattctttacccccctctcatcagaagcccccgcggaatcctctctcaagtagcgacgctgccccatctccagagctccaagctaacggcacaggaacccagggtctagaagccaccgataccaacgggttgtcctctagtgcaagacctcagggtcagcaagctggctctcccagcaaggaagacaagaaacaggctaatataaaaagacagcttatgacaaacttcatccttggtagttttgacgactacagcagcgatgaggatagcgttgccgggagctctcgggagagcacgcggaaaggttcccgggctagtctgggagccctgagcctagaagcctatctgaccaccggagaagctgaaacacgagtgccaaccatgcgtccttccatgtctggccttcatctcgtgaaacggggtagggagcataaaaagctggatctacacagagattttaccgttgcaagtccagccgaatttgtgacacgcttcggaggggaccgagttatcgagaaagttctaatcgccaataacggtatcgccgccgtgaaatgcatgagaagcattcgcagatgggcttatgagatgttccgtaacgagagagcgatcaggtttgttgtgatggtgactcccgaagacctgaaagcaaacgcagagtacataaaaatggcagaccattacgtccccgttcccgggggccccaacaacaacaactatgcaaacgtcgaattgatcgtcgacatcgcaaagagaatccctgtccaggcggtgtgggcagggtggggacacgcctccgaaaaccctaaactgccagagctgctgtgcaagaatggagttgcctttctgggtccaccaagtgaagcaatgtgggcacttggagacaagattgcgagtaccgtcgtcgcacagaccctccaagtcccgaccctgccttggagtggaagcggcctgaccgtggagtggaccgaggacgacctccagcagggcaaacggatcagtgtacccgaagatgtctacgataaaggttgcgtgaaagatgtggacgagggcctggaggctgccgaacgaatcggatttccattaatgatcaaagccagcgagggtggcggcggaaagggcatccggaaagctgagtccgccgaggacttcccaattctgttcagacaggtgcagtcggagattcccggtagcccaatttttctgatgaagctggctcagcatgcccgtcatcttgaggtccagatcttggccgaccagtatggcaacgcggtctccctgtttggtagggactgctccatccagcggagacaccagaaaatcgtcgaggaggcgccagctacaatcgcccccttagccattttcgagtttatggaacagtgtgctataaggctggccaagactgtcggatacgtcagtgcgggcacggttgaatacttgtactcacaggatgggtcttttcacttccttgaactgaacccacgcctgcaggtcgagcatccatgcactgagatgatagccgatgtgaatctgcccgcagcccagctgcaaattgcaatgggcgtgcctcttcatcgccttaaggacattagacttctatacggggaatctccttggggcgtaacccctattagctttgagaccccatccaatcccccactcgcccgaggacacgtgatcgccgcccgtattacctcagagaaccccgacgagggatttaagccctcctccggcaccgtgcaggaactgaacttccgcagctctaagaacgtatggggatactttagtgtggccgcgactggaggtcttcacgaatttgcagactcacagttcgggcactgctttagctggggtgagaaccgtgaggaggccatttccaatatggtcgtggctttaaaagaactgtccatccgaggggacttccggaccacagtcgaatatctcatcaaccttttggaaaccgagagctttcaaaacaatgacatagacacagggtggctggactacttgatcgctgaaaaagtgcaggctgagaagcctgatatcatgctcggagttgtttgcggcgccctgaatgtcgcggacgccatgttccgaacatgtatgacggattttctccactcactggagcgcggacaggtgcttcccgccgatagcctgctgaacctcgtggacgtggagctgatttacgggggggttaagtacatcctgaaagtggcaagacaaagtctgacaatgttcgttctgataatgaacggatgccatatcgaaattgacgcccatagactgaacgacggcggccttctgctgagctataacggtaatagctacaccacttacatgaaggaggaagtcgattcttaccgtattaccatcggtaataaaacctgtgtctttgagaaggagaacgatcccaccgtgttacgtagccctagtgccggaaagctaactcagtatacagtcgaggatgggggccacgttgaggccggcagttcctacgcggaaatggaggtgatgaaaatgatcatgacactcaatgttcaggaaaggggcagggttaaatatattaaacgacccggtgccgtgttagaggccggctgcgtagtggcccgtctggagctcgatgaccccagtaaagttcatcccgcagagccttttacgggtgagctgcccgcccagcagaccctgcctattctgggcgagaagctgcatcaagtgtttcacagcgtgctcgagaacctgaccaacgtcatgagtggattttgtcttcctgagcctgtgttctccatcaagctgaaggagtgggtgcagaagctgatgatgactctcagacatcctagtctgcctctgttggaacttcaagaaatcatgacttcggtcgccggccggatcccagcccccgttgaaaaaagcgttcgacgggtcatggcccagtacgccagcaacattaccagcgttctgtgccagtttccctctcagcaaatcgctacaatccttgactgtcatgcggcgacactacaacgtaaggccgatcgcgaggtgttctttatcaacacccagagcatcgtgcaactggtgcagtccaaggatgaactctgtggcccagacccttcactgtcagatgaattgatatctatcttgaacgaactaacccagctgagtaaatctgaacattgcaaggtggccctgagggccaggcaaatactgattgcaagtcatctgccctcctatgaactcaggcataatcaggtggagtctatcttcttgtccgcgatcgatatgtatggacaccagttctgccccgaaaatctgaagaagctcatactgagtgagacaacaatttttgacgtactgcccaccttcttctaccacgccaacaaagtagtttgcatggcatcattagaagtgtacgtgcggcgcggctacatagcatacgaactcaactctctgcagcaccgacagttacctgacggaacttgcgtcgtggaattccagtttatgttaccttcttcacatcccaataggatgacggtccccattagcataacaaatcctgatttattaagacactctaccgaactgttcatggactccgggttctcgccattgtgccagcggatgggcgcaatggtcgccttccgtcggttcgaggactttacccggaattttgacgaagtgatttcctgcttcgctaacgtgccaaaggatactccactgttttccgaggccagaacaagcctgtactcagaagatgactgcaagtctttacgggaagaacctatacatatcctgaacgtgagcattcaatgcgccgatcatctggaagacgaggcactcgtgccgatcctaagaacgtttgtccagtcaaagaagaacattctggtggactacggtcttagacgaattaccttcctcatagcacaggagaaggagttccccaaattttttacttttcgagcccgggatgaattcgctgaggatcgaatctataggcatctagaacctgcgttggcgtttcagctcgagttaaacagaatgcggaactttgatctcacggccgtgccttgcgctaaccacaagatgcacctgtatcttggcgctgccaaagtaaaggagggcgtagaggtcaccgaccaccgcttctttattcgtgccatcattcgccattccgatctgatcaccaaggaagcatcttttgaatacttgcaaaacgagggcgagcgactgctccttgaagctatggatgaactggaagttgcctttaacaacactagcgtccgtaccgactgcaaccacatattcctgaactttgtgcccaccgttatcatggatcccttcaaaatcgaagagtccgtaagatacatggttatgagatacggcagcaggctctggaagctcagggtgctgcaggcggaggtgaagatcaatatccgacagaccaccacaggttccgccgtgccaatccgcctttttatcacaaatgaatcgggatattatcttgatatctccctctataaagaagtcaccgatagcaggtccgggaatataatgtttcacagttttggcaacaaacaggggccccagcacggaatgctcattaataccccatatgtgacaaaggacttgctccaggccaaacgctttcaggcccagacgcttggcactacatatatctacgattttcctgagatgttccgtcaagctctgttcaagctctgggggagcccagataagtatccaaaagacatcctaacatacaccgaattggtccttgattctcagggtcaactggtggagatgaatcggctccctggcggaaacgaggtggggatggttgctttcaaaatgagattcaagactcaggaatacccagaagggagggacgtaatcgttatcggaaacgacattacttttagaatagggtcttttgggccgggagaggacttactatacttacgcgcttcggagatggccagggccgagggcattccaaagatttacgtggcagctaactcaggagcgcgtatcgggatggctgaagaaattaaacatatgttccacgtggcctgggttgacccggaggacccccacaagggattcaaatacctgtacctcactcctcaggactatactaggatctcctctctgaactctgtgcactgcaagcatatagaggagggcggagagagtcgttatatgatcaccgacataatcgggaaagatgatggcttgggtgttgaaaacctgcggggaagcggaatgatcgccggggagtcctccctggcctatgaggagattgtcactatttccctcgtaacgtgtagggcaatcggcatcggggcttacttggttagactcggccagcgcgtgattcaagtcgagaacagccacattattctgactggagcatccgctctgaacaaagttctgggccgggaggtgtatacttcgaataaccagttgggaggcgtccaaatcatgcactacaatggtgtgtcccacattaccgtgccagatgattttgagggggtatatacaatattagaatggttaagctacatgcccaaggacaaccactcacctgtgcccataataacaccaactgaccccattgacagggagatcgaatttctgcccagccgcgcaccttatgaccccagatggatgctagccggccgcccccacccaaccctgaaggggacatggcaaagcggctttttcgatcacggctctttcaaagagatcatggccccttgggcacagaccgtcgttacagggcgcgcgcgcctggggggcatccctgtgggtgttattgccgtcgagaccaggacagttgaggtggccgtccccgccgacccagccaacctggactcggaggcaaaaatcatccaacaggctggccaggtctggtttccagattctgcctacaagactgcgcaggctgtgaaagacttcaacagagagaagctacccctcatgatctttgcaaactggagaggtttttctggagggatgaaggatatgtacgaccaggtcctgaaattcggtgcctatatcgtggatggattacggcaatacaagcagcctatcctaatctacatccctccatacgccgaactgaggggaggtagttgggtagtaatcgatgccaccatcaaccctctgtgtatagaaatgtacgctgacaaggaatctcgaggtggagtcctggagcccgaggggactgtggaaatcaaattccggaaaaaggacctgatcaaatcgatgcggagaatcgaccccgcttacaagaaactgatggagcagctgggagagccagatctctccgacaaggacagaaaagatttagagggccggctgaaagctcgagaggacctgctcctgccgatttatcaccaggttgccgttcagttcgctgactttcatgatacacctggaagaatgcttgagaagggggttatctctgatatcctagagtggaagacggcccgaactttcctgtactggaggctgcggcgactcctattggaggaccaagtgaagcaagagatcctgcaagccagtggcgagctgtcccatgtacatattcaatcaatgctacgccggtggtttgtggagactgaaggagccgttaaggcctatttatgggataataatcaagtggttgtccaatggctcgagcagcactggcaagcaggtgacggccctcgcagcaccatccgcgagaatatcacctacctgaagcacgatagcgttcttaaaaccattaggggcttagttgaggagaatcccgaggtagctgttgattgtgtgatttacctgtcccagcatattagtcccgccgagcgtgcccaggtggtgcatctgcttagcacaatggactcaccagcatccacctag

SEQ ID NO: 177603 - DNA, 5070 bp, Artificial Sequence
  Description of Artificial Sequence: Synthetic coding sequence
ctgcccttcctgctgaagcccccccagaccctgcccagccccgacgcaatgttccgtacctgcatgaccgactttctgcattccctcgaaaggggccaggtgcttcctgcagacagcctcttgaacctggtggatgttgagctcatctacggcggagtgaagtatatcctgaaggtggcgagacagtcactgactatgtttgtacttattatgaatgggtgccacatcgagatagatgctcataggttgaatgacggtggccttctgctgtcttacaatgggaattcttacaccacatatatgaaggaggaagtcgatagctacaggataaccatagggaataaaacctgcgtgtttgagaaggagaacgatccaacagtgctgagaagcccatctgccggaaagcttacacagtatacagtcgaagacggcggccacgtcgaggctggctcctcatacgcagaaatggaagtaatgaaaatgatcatgacattgaatgttcaagaacgaggccgcgtgaagtatattaagagacccggagcggtgttagaggctggttgcgtagtcgccaggctcgaattggacgaccccagcaaggtccaccctgccgagcccttcacaggagaattaccggcccagcaaactctccctattttaggcgagaaactccatcaggtgttccatagtgtgctggagaatctcacaaacgtaatgtcaggcttctgtttacctgagccggtattttcaatcaagctcaaagagtgggttcagaaattgatgatgactttacgccacccttccttaccactgttggaactccaggaaatcatgacatccgtggcaggacgcatcccagcccccgtcgagaaatccgtccggagggtcatggcccagtacgcctccaatatcacttcagtgctttgtcaattcccctcccagcagattgcaacaatccttgactgccacgcagcaacattacagagaaaggccgatagagaggtctttttcataaatacccaatcaatcgtacagttggttcaaagatacagatccgggattaggggctacatgaaaacagtcgtcctggacctcctgagaaggtatttgcgtgttgaacaccatttccagcaagcccactatgacaagtgcgtcattaacctccgagagcaattcaaacctgacatgtcacaggtcctggattgcatcttcagtcatgctcaagtggccaagaagaatcagctcgtcattatgttgattgacgaactgtgcggcccggacccctcgctgagcgatgaattgatcagcattcttaatgaactgactcagttgtcaaagtctgagcactgcaaggtggctcttagagcacggcagatcctgatagcttcacacctccccagctacgagcttcggcacaatcaggttgaaagcatcttcttaagcgcaatcgatatgtatgggcatcagttttgcccagagaacctgaaaaagttgatccttagcgaaaccactatcttcgatgtgctgccaacattcttctaccatgccaataaagttgtgtgcatggcttcgctggaggtctatgtgagacgggggtatattgcgtacgagctgaattcgctgcagcaccgccagttacctgacgggacctgcgtagtagagtttcagttcatgctgccttctagtcatcctaatcgtatgaccgtgcccatttcgataactaacccagacctgttacggcattcaacagaactgtttatggatagcggtttcagcccactgtgccagaggatgggcgcaatggttgcatttcggcggtttgaggattttacccgcaacttcgacgaggtgatctcctgttttgcaaatgtacccaaagatacgccgctgttctctgaagcacgcacctccctgtatagtgaggatgactgtaagtctctgcgcgaggagccaatccatatactaaacgtaagtattcagtgtgcagaccacctcgaagatgaggcgctcgtccccattctgcggaccttcgttcagagcaagaagaacattctcgtcgattacggtctgaggcgcatcaccttcctgatagctcaagaaaaagagtttcccaaattttttacctttagagcaagggacgagttcgcagaagaccggatatacaggcaccttgagcctgccctcgctttccagttggagctgaacagaatgcgcaactttgatcttacagcagtgccctgcgctaatcacaagatgcatctgtatctcggtgccgccaaagtcaaggaaggggtcgaggttacggaccaccgtttttttatacgggctattatccgtcattccgacttaattacaaaggaggcctctttcgagtatcttcagaatgaaggcgaaagactcctcttggaggcaatggatgaactcgaggtagccttcaacaacacatccgttcgaactgattgtaaccacatcttcctcaactttgtcccaaccgtgatcatggacccatttaagattgaagaatctgtgcgttatatggtgatgaggtacgggtcacggctctggaagctccgcgtgctgcaggctgaagtaaaaatcaatattcggcaaaccaccactgggtcggctgttccaatacggctcttcattactaatgagagcggatactacctagacatcagcctgtataaagaggttacagacagccgcagcggcaacatcatgttccactcgttcggaaataaacaagggcctcagcatggcatgctaattaatacgccctatgtgacgaaagacctgcttcaggctaaacgattccaggcacagacactcgggacgacctatatctatgactttcccgagatgttccgccaggccctcttcaaactgtggggctctcctgacaagtatcccaaagacatcctgacttacaccgagctggttctagactcacaggggcagttggtggagatgaatcggctgcccggcggtaatgaagtgggtatggtggcattcaaaatgagatttaaaacacaggaatatccagagggcagagacgtcatagtgatcggcaatgacatcactttcaggattgggtcttttgggcctggagaggacctactgtatctgcgagcaagtgagatggcccgggcggagggcatacccaaaatttacgtagcagctaacagtggagccagaatcgggatggcagaagagatcaagcacatgtttcacgtagcttgggtggaccccgaagacccacacaagggttttaagtacctgtacttaacaccccaggactacactcggatttcttctctcaatagtgtccattgtaagcacatagaagaaggcggagaatcaaggtacatgattactgacattataggcaaggatgatggcctgggcgtggagaatctaaggggaagcggcatgatcgctggcgaatcctccctcgcttacgaggaaattgtaacaatttcactagttacatgtagagcgatcggcatcggggcctacctagtcagactgggacagcgtgtcattcaagtggagaattcccatatcatcttaaccggagcgtccgccttgaataaggtgctcggtagagaggtttatacctcaaataaccagctaggcggcgtccagatcatgcattataatggagtgtcccatatcacggtgcccgacgacttcgaaggcgtctataccatactggaatggctgtcctacatgcctaaggacaatcacagtcccgtgccaattattacccccaccgaccccattgatagggagatcgagttcctgccctctagggcaccttatgacccgcggtggatgctcgccggacgcccccatccaactttaaaagggacctggcagagcggatttttcgaccacggatctttcaaggaaatcatggccccctgggctcagactgtagttactggcagagctagactcggaggcattcccgtgggggtaatcgctgtggagacaagaaccgtcgaggttgctgtaccggctgaccccgcaaacctggattcagaagctaaaatcattcagcaagcgggacaggtctggttcccggattctgcttacaaaacggcccaggcggttaaggatttcaacagggaaaagttaccacttatgatatttgcaaattggcgggggttttctggggggatgaaagatatgtacgaccaggtgttgaagtttggagcctatatcgttgatgggctcaggcagtataaacaacccattctgatctatatcccaccctacgccgaactcagaggcggatcatgggtagtgatcgacgcaacaatcaaccctctctgcatcgaaatgtatgcagacaaggagtcacgggggggagtcttggaacctgaggggaccgttgagatcaagtttcggaaaaaggatcttatcaaatcgatgcgccgcatagacccagcctacaagaagctgatggagcagcttggcgaaccagatctgtcggacaaggaccgcaaggacctggagggacgcctcaaagctcgggaggatctcttgctgccaatctatcaccaagtggcagtccaatttgccgactttcatgatacaccgggccggatgctggaaaagggtgtgatctcagacatcctcgagtggaagacagcacgcacttttctttattggcgattacgccgcctcctcctggaagaccaagtgaaacaggagatcttgcaggccagtggcgaactgtctcatgtgcatatccagtcgatgctgcgcagatggtttgttgagactgagggggctgtgaaggcctatctctgggacaacaaccaagtggtggtgcagtggcttgaacagcattggcaggctggcgacggacccaggtctaccattcgtgagaacatcacctacttgaaacacgacagcgtgctcaagaccatcaggggcctcgtggaggagaatccagaagttgcagtcgattgcgtaatctacctttctcagcatataagtcccgccgaaagggcccaggtcgttcatctgttgagcaccatggacagtcccgcttcaacctag

SEQ ID NO: 177604 - DNA, 432 bp, Artificial Sequence
  Description of Artificial Sequence: Synthetic coding sequence
atgaccgacagcaagcccatcaccaagagcaagagcgaggccaacttaatcccaagccaggaaccatttcccgcttctgacaattcaggagaaaccccccagaggaacggcgagggccacacactaccaaaaacccctagtcaagctgaaccagcctctcacaagggccccaaagatgccgggcgccgaagaaactcattacctccctcacaccagaaaccacctcggaaccccttgtctagcagcgacgccgcaccctctccagagcttcaggccaatggaacaggaactcaaggcctggaggctaccgacacgaacggactcagttctagtgcccgtccccagggtcaacaggctggatctcccagcaaagaagataagaaacaggccaacataaaacgacagctcatgaccaacttcatcttggggtag

SEQ ID NO: 177605 - DNA, 2577 bp, Artificial Sequence
  Description of Artificial Sequence: Synthetic coding sequence
atgaccgtgcccatcagcatcaccaaccccgacctgctgcggcacagtacggagctattcatggatagcggctttagcccattgtgccaacggatgggagctatggttgcatttcgccgcttcgaagattttactaggaacttcgacgaggttattagctgctttgccaatgttccaaaagacacacccctgtttagcgaggctcggacaagcctgtatagcgaggacgattgcaagtcgttgagggaggagcccattcacatcctgaatgtctctattcagtgcgccgatcacctggaggatgaggctcttgtgcccattctgcgaacattcgtccagtctaaaaagaatattttagtagactacgggctgaggcgaattacttttctcattgcacaggagaaggaattcccaaagtttttcacgtttcgagcacgcgatgagttcgccgaggatcgcatctatcggcatttggagcccgcactcgcattccagctggaactgaaccggatgcggaatttcgaccttactgcagtgccatgcgccaaccataaaatgcatctctatctgggtgctgccaaggtgaaagaaggagtggaggtgacagaccatcggttcttcatacgcgctatcataaggcactctgacctgatcactaaggaggctagctttgagtatctacaaaacgagggggagcggctcctcttagaggctatggatgagctggaagtggctttcaacaataccagcgtcaggacagactgtaaccatatattcctgaatttcgtccctacagttattatggatccctttaagatcgaggaatctgtacgatacatggttatgaggtacgggtcccggctctggaagctacgagtgttacaagcggaagttaagatcaacattcggcaaactacaaccggtagtgcagttcccatcagactctttatcaccaatgaatctgggtactaccttgacatttcactatacaaggaggtgaccgactctcgcagtggaaatataatgtttcacagcttcggtaacaagcagggccctcagcacggcatgctcatcaataccccctatgtgaccaaggatcttttgcaagccaaacgttttcaggcccagacactggggacaacctacatctacgattttcctgaaatgttcaggcaagctctgttcaagctgtgggggtctcctgacaagtaccccaaggacatccttacatacacagaactcgtgctggactctcagggtcagcttgtggagatgaatcggctgcccggaggaaacgaggtcggtatggtggccttcaaaatgcgattcaaaacccaggaatatccagagggacgcgacgtcatagtaattggcaatgatataaccttcaggatcggatccttcggacccggcgaggacctgctgtacctccgcgccagcgagatggccagagctgaagggatccccaaaatatacgttgctgccaactcaggcgctcgcatcgggatggcggaagaaatcaaacacatgtttcacgtggcctgggttgatccggaagatccacacaaaggatttaaatatctttatctcacccctcaagattatacccgcatctctagcctgaacagcgtgcactgtaagcacatcgaggaagggggcgagagtaggtatatgattactgatattataggcaaggatgacggcctaggcgtggagaaccttagggggagtggcatgatcgctggtgaatcttctctagcatatgaggaaatagtaaccatctccttggtgacctgccgagcgattgggattggcgcctacctggttaggctgggtcagagagtgatccaggtggaaaattcacacattatcctaaccggagcctctgctctcaataaggttctcggccgagaggtatacacctctaataaccagctggggggggtccagattatgcattataacggggtgagtcatataactgtccccgacgactttgaaggcgtctatacaatccttgaatggctttcttatatgccaaaagataaccactcccctgttcctatcatcacccctacggatccaattgacagagaaattgagttcctgccctccagagctccatacgatcctagatggatgctcgccgggcggccccacccaactctcaagggcacatggcagagcgggttctttgaccacggatctttcaaggagattatggccccctgggcccagacagtagttacaggtagggccagactgggcggcatcccggttggcgtgatcgccgttgaaacccgtacagtcgaggtggccgtgccagccgatcctgccaatctcgacagtgaagctaaaatcatccagcaggccggccaagtttggttcccggactctgcttataaaaccgcgcaagccgttaaggatttcaatcgagaaaagctgccattaatgatttttgcaaactggcgtggtttttccggtggtatgaagggctgcttggggacatggagggacgtgagttggtggaagattagggccatgctgcctatgcacattggagaggggtccgtctag

SEQ ID NO: 177606 - DNA, 1038 bp, Artificial Sequence
  Description of Artificial Sequence: Synthetic coding sequence
atgggcagcagcgaggaccaggcctaccggctgctgaacgactacgccaacgggtttatggtatcacaagtcctcttcgccgcatgtgagctcggagtgttcgacctactcgctgaagctccaggccctctcgatgtcgcagccgtggccgcaggtgtacgggcgagtgcgcacggcacagaattgctgttggatatctgcgtgagccttaagttactgaaagtcgaaactcggggggggaaggccttctacagaaatactgagttaagttccgattacctcacgaccgtctcacctacctctcaatgctcaatgctgaagtacatgggacgtacctcctaccggtgttggggacatctggcagatgccgtgagggaaggccgtaatcaatacctcgagactttcggcgttcccgctgaggagctgttcaccgctatctataggagcgaaggtgagcggcttcagttcatgcaggcactgcaggaggtctggagtgtcaatggacgttctgtgctgaccgctttcgacctcagtgtgtttcctttgatgtgcgatctcggtgggggggctggtgcgctagccaaggagtgtatgtctctttaccccgggtgtaaaattacagtttttgacattcctgaggtggtgtggaccgcgaagcagcatttctccttccaggaggaggaacagatcgacttccaagaaggagatttcttcaaggatcccctgccggaggccgacctctacatcctggctcgggttctgcacgattgggctgacggcaagtgttctcacctgctggagagaatttaccacacttgcaagccaggtggaggaatcttggtaattgagtcactactggatgaggacagacgcggaccactgctcacccagttatatagtttaaatatgctggtgcagacagagggccaggagcgtacaccgacccactatcacatgcttctgtcgtctgcgggcttcagagatttccagttcaagaaaactggtgccatctacgatgctatcttggcccgcaaatag

SEQ ID NO: 177607 - DNA, 897 bp, Artificial Sequence
  Description of Artificial Sequence: Synthetic coding sequence
atgggcagcagcgaggaccaggcctaccggctgctgaacgactacgcaaacggatttatggtgagccaggtgttattcgctgcctgcgaacttggtgtgtttgatctgcttgcagaagctccaggccccttggacgtagcagcggttgcggctggagtgcgggctagcgcccacggcacagagctgctcctcgatatctgcgtgagcctgaagctcctgaaggtagaaacccgaggcggtaaagctttttaccgcaatactgaactgtctagtgattatttaacaacagtgtcgcccacatcccagtgctcaatgttgaagtatatgggacggacttcttaccgctgctggggtcatctggccgatgcggtgagggaaggaagaaaccaatacctcgaaacttttggcgtgcccgctgaagagctgtttacagctatataccgaagcgaaggtgaacgcctgcaattcatgcaagccttacaggaggtctggtccgtcaacggtagatccgttttaactgcctttgatctgtccgtattccctcttatgtgtgatttagggggtgatttcttcaaagatccgctccctgaggcggacttgtacatcctggcacgggtacttcatgactgggccgacggcaagtgttcacatttgttggagcgcatctaccacacgtgcaagcccggagggggaatcctcgtgatagaaagccttctggatgaggataggcgcgggccccttctgacccagctctacagcctgaacatgctggttcagacagagggacaagagcgcacccccacacactatcacatgctcctgagcagtgccgggttccgagactttcagttcaagaagactggggcaatctacgacgcaattcttgcacgcaagtag

SEQ ID NO: 177608 - DNA, 1122 bp, Artificial Sequence
  Description of Artificial Sequence: Synthetic coding sequence
atgggcagcagcgaggaccaggcctaccggctgctgaacgactacgcaaacgggttcatggtgtctcaagtactctttgccgcatgtgagctgggtgttttcgacctgcttgccgaggctcctggcccgttggacgtggctgctgtggccgcgggagtgcgagcctccgcacatggcactgagcttctactcgatatctgtgtttctcttaaattgctgaaggtcgagactcgaggcggcaaagctttttaccgaaacacggagctatcatctgactacctgacaaccgtgtcccctacctctcagtgttccatgctgaagtacatgggaagaacatcgtataggtgttggggtcacctggccgacgccgtgcgggaggggaggaatcaatacctggaaaccttcggagtgcccgcggaagagttgttcactgctatctaccggtctgagggtgaacggctacagttcatgcaagcactgcaggaagtttggtcagtaaatggaagatccgttctcacggcattcgatctgtccgttttcccacttatgtgcgatctgggggggacctggattaagcttgagacgattattctctcaaagctgagtcaggggcagaaaaccaagcaccgcgtgttttcactgatcggaggtgctggagccttagctaaggagtgcatgtccctttatccaggctgcaagataacggtttttgacattcccgaagtggtgtggactgcaaagcaacatttctcatttcaggaggaagaacagattgatttccaggaaggagatttcttcaaagatccactgcccgaagctgatctctacatcctggctagggtgcttcatgactgggcggatggcaagtgttctcacttgctggagcgcatctaccatacatgcaaacctgggggtggcatcctcgtgatcgaatctctgctcgacgaggaccggaggggtccactgctgacgcaactatactccctgaatatgctggttcagaccgaaggacaggaacgcacacccacgcattaccacatgcttctgagctctgccgggttcagggattttcaattcaaaaagacaggagccatttacgacgcaatactggctaggaagtag

SEQ ID NO: 177609 - DNA, 375 bp, Artificial Sequence
  Description of Artificial Sequence: Synthetic coding sequence
gactgccggctgaccagcgtgtgcctgccctgcgtgcccggcgacttctttaaagatcctctgcctgaagctgatttatatatccttgcacgtgtgctgcacgactgggcagacgggaagtgcagccacctgctggagcgcatttatcatacctgcaagccagggggtggaatcctggtgatcgagtccctccttgatgaagaccgacgtggcccactcctgacgcaactatacagtctgaacatgcttgtgcagacagagggtcaggagcggacccctacacattatcacatgctcctgtcctccgccgggtttcgcgacttccagttcaagaaaaccggtgctatctatgacgctattctggcacgcaagtag

SEQ ID NO: 177610 - DNA, 711 bp, Artificial Sequence
  Description of Artificial Sequence: Synthetic coding sequence
atggagagcagcgccaagatggagagcggcggcgccggccagcagccccagcctcagccccagcaacccttcttgccaccagctgcatgttttttcgcaactgctgctgcagcggccgctgctgctgcagccgcagctgcacagtccgcccaacagcaacaacagcagcaacaacagcagcagcaggcccctcagttgagaccagccgcagatggacagccaagtggaggcggccacaagtctgcaccgaagcaagtcaagagacagcggtccagctccccagaactgatgcggtgtaagcgcagattgaacttctccggttttggctattcactgccccagcagcagccagcagcggtggcaaggcgcaacgagcgcgagcggaatcgcgtcaaactggttaacctcggcttcgccacactgagggagcacgtgccaaatggggctgccaacaaaaaaatgagcaaggttgagacacttaggagcgccgttgagtatatcagagcgctccagcagttattagatgaacacgatgccgtatccgctgccttccaagcaggcgttctgtccccaactatctcccccaactattctaacgacctgaactcaatggccggttcgcccgtcagctcctattccagcgatgaaggaagttacgatccacttagcccagaagagcaggagttgttagacttcacaaactggttctag

SEQ ID NO: 177611 - DNA, 582 bp, Artificial Sequence
  Description of Artificial Sequence: Synthetic coding sequence
atggacggcggcaccctgccccggagcgccccccccgccccccccgttcctgtgggatgcgccgcccgcagacgacctgcatcgcccgagctgctcagatgctccaggcgacggcgaccggcaaccgccgaaaccggaggtggcgccgccgccgttgctcgcagaaacgagcgcgagagaaacagggtcaaactggtaaatctgggctttcaggccttgcggcaacacgttccccacggcggcgcctcaaaaaagctgtcaaaagtcgagacccttcgtagcgccgtggagtacatcagagctctccaacggttactggctgaacacgatgccgtgagaaacgccctcgccggaggcctgaggccacaggcagtaagaccctctgctcctagggggcccccaggcacaaccccagtggcggccagtccaagccgcgcgagcagctcgcccgggcgcggtgggagtagcgagcctgggagcccgaggtcagcatacagctcagacgactcgggatgcgagggcgcgttgtctcccgcggaacgagaactactcgatttcagctcgtggctgggcgggtactag

SEQ ID NO: 177612 - DNA, 1542 bp, Artificial Sequence
  Description of Artificial Sequence: Synthetic coding sequence
atgtgcagcctgggcctgttcccccccccccccccccggggccaggtgactctatatgaacacaataatgaactggtcacaggatcatcatacgagagccccccgccggactttaggggccagtggataaatctccctgtcttgcaattgacaaaggatccactcaagacacccggcagactagaccatgggacccgaaccgctttcatccaccatcgagaacaggtttggaagcggtgtattaatatttggagggacgttgggctttttggtgtgttgaacgagatcgctaactccgaagaggaggtttttgaatgggtcaagacagcaagtggttgggccctagctctttgtcgctgggcctcgtcactccatggtagtctgtttccacacctgtctttacgatccgaagatctgatagcagaatttgcacaagtaaccaattgtaccatagtacctagtttgaagcatcgcctacaaagaaacgtcgcttctctggcctggaaaccactttccgcatccgtgcttgccgtcgcctgccagagttgtatcctcatttggaccctagaccctacatccctgtcaaccaggccttctagtggctgtgcacaagtgctttctcaccctggtcacacaccggtcactagtctggcatgggccccaagcgggggcagactgttgagcgcatcccccgtcgatgccgccattcgtgtgtgggacgttagcactgagacatgtgtgcccttgccctggtttagaggcggaggggtgacaaacctcctgtggtcgcccgacgggagtaagatcctcgcgaccactccctctgccgtttttagggtgtgggaagcccagatgtggacatgtgaacgctggcccacgctgtcagggcggtgccagacaggctgctggtctcctgacggtagcaggctgctgttcacggttttgggagaacctttaatctacagccttagcttcccagaacggtgcggagaggggaagggttgcgtgggaggcgccaaatctgcaacgattgtggcagatttatcggaaacgactatccagactcctgacggcgaggagcgcctgggtggagaggcgcactctatggtctgggacccctccggagaaagattagctgttttgatgaaaggtaaaccaagagtgcaagacgggaaaccggttatccttttgttccggactcgcaacagtccagtattcgagctcctgccctgcggaatcattcaaggggagccgggagcacagcctcagctaattactttccaccccagcttcaataagggcgcactgctgtccgtggggtggagcacgggaaggatcgcgcatatccccctctatttcgtgaatgcgcagtttccacggttctccccagtgctgggaagagctcaggagcccccagccggcggcggcggaagcattcacgacctaccgctatttactgagaccagccccacctctgcaccgtgggaccccctccccgggccccctcccgttctcccacattccccccattcccacctgtag

SEQ ID NO: 177613 - DNA, 1683 bp, Artificial Sequence
  Description of Artificial Sequence: Synthetic coding sequence
atgccccagacccggagccaggcccaggccaccatcagcttccccaagagaaagctgtcgagggccctgaataaagcaaaaaactctagtgacgcgaagctggaacccacgaacgtacaaactgtgacttgtagcccccgtgtgaaagccttaccgcttagtccccggaagcgacttggtgacgacaacttgtgcaatacacctcatctgccaccttgttctcctccgaagcagggcaagaaggaaaacggtccccctcattcccacaccctgaaggggcggagactcgtgttcgacaatcagctgaccattaagagtcctagtaagcgagaactcgcaaaggtccaccagaataagatcctgagcagtgtgcgaaaaagccaggaaatcactacaaactctgaacagaggtgccccctaaagaaggagagcgcctgcgtccggctgttcaagcaggagggtacttgttatcaacaggccaaactcgtgcttaacaccgcggtccctgaccgcctgccagcgagagaaagagagatggacgtgatcaggaacttcctgcgagaacacatctgcgggaaaaaagctgggagcctgtatctcagcggcgcccctggaactggcaagactgcgtgtctatcccggatcctccaggacctgaagaaggaactgaaagggttcaagacaattatgttgaattgtatgagtctccggacagcacaggcagtctttccggcgattgctcaggaaatttgccaagaagaggtttcacgacccgctggcaaagatatgatgaggaagctagagaaacacatgacagctgagaaggggcccatgatcgtgctagtgttagatgaaatggatcagttggattccaaaggtcaagacgttctgtacactctctttgagtggccatggctcagcaacagtcacttagtacttattggcatcgccaataccctggacctgacagacaggatcctgccacggctacaggctagagaaaagtgcaaaccccagttgctgaacttccctccttatacacgaaaccaaatcgttacgatcctccaagaccgcctcaaccaggtgagtagggatcaagttcttgataacgcggctgtgcagttttgcgcccgcaaggtgtcagctgttagtggcgatgtacgcaaggccctcgatgtgtgccgtagggctatagagatcgtggaatccgacgtgaaaagccaaacaatacttaaaccccttagcgaatgcaaatcccccagcgagcctctcatcccaaaaagggtcggactgatacacatctcacaagtcatttcagaagtagacggcaaccgtatgactctctcacaggagggagcccaagactctttcccacttcagcagaagattttagtctgctctcttatgctcctgattagacagttaaagatcaaggaagttaccttggggaaactgtacgaagcatactccaaggtgtgccgcaagcagcaagttgcagccgtcgaccagtcggagtgtctgtcgctatctggacttctggaagcccgaggcattcttggcttgaaacgcaataaagagacacgcctgactaaagttttcttcaagatcgaggagaaagagattgagcacgcactgaaggacaaagccctaatcgggaatatcctggcaacgggcttaccctag

SEQ ID NO: 177614 - DNA, 339 bp, Artificial Sequence
  Description of Artificial Sequence: Synthetic coding sequence
atggccgagcaggccaccaagagcgtgctgttcgtgtgcctgggcaacatctgtcggtcgcctatagccgaggcggtgtttcgcaagcttgtgactgaccaaaacatctctgaaaactggagagtagattcagctgccacttcgggttatgaaataggtaaccctccagactatagggggcagagctgcatgaaacgccacggtatcccgatgagccatgtcgcccgccaggtaccctccctcgatctgaagctatgcgtcctgtgcttctctggtagcctgactgctgttctttttctaacaggcacatgggcaggcccccagacacaggaactgtag

SEQ ID NO: 177615 - DNA, 477 bp, Artificial Sequence
  Description of Artificial Sequence: Synthetic coding sequence
atggccgagcaggccaccaagagcgtgctgttcgtgtgcctgggcaatatctgtcgtagtcctattgccgaggccgtcttcagaaagctggtcaccgatcaaaatatatctgagaactggcgggttgattcggctgccacaagcgggtacgagattggaaatcctcccgactatcgtggtcaatcctgtatgaagcgccatgggattccaatgagtcacgttgccagacagatcacaaaggaagacttcgccacttttgactatatcctctgtatggatgagtccaacttacgcgacctaaatcggaagtctaatcaggtgaagacctgcaaagcgaagattgagctgttagggtcctatgatccccaaaagcagttgattatcgaggatccctactacgggaatgactccgactttgaaaccgtgtaccaacagtgtgtgcgctgttgccgggcgttcctggagaaggctcactag

SEQ ID NO: 177616 - DNA, 477 bp, Artificial Sequence
  Description of Artificial Sequence: Synthetic coding sequence
atggccgagcaggccaccaagagcgtgctgttcgtgtgcctgggcaacatctgtaggtcaccaattgcggaagccgtgttcaggaagctggtgactgaccagaacattagtgagaactgggtgattgactcaggcgcagtttcagattggaacgttgggaggagccctgacccgcgcgctgtctcctgtctgcgcaatcacggcattcataccgcccataaggccagacaaatcacgaaggaagattttgccacctttgattacatactctgtatggacgagagcaatctccgagatctgaaccggaagtcaaatcaggtgaaaacgtgtaaggcaaaaatcgaactgcttgggtcctatgacccacaaaagcaattaattatagaggatccgtactacggtaatgattctgatttcgagacagtgtaccagcagtgcgtgagatgctgcagggctttcttagagaaagctcattag

SEQ ID NO: 177617 - DNA, 219 bp, Artificial Sequence
  Description of Artificial Sequence: Synthetic coding sequence
atggccgagcaggccaccaagagcgtgctgttcgtgtgcctgggcaatatctgccggtcccccattgccgaagccgtgttcaggaaacttgtgacggaccaaaacatttcagaaaactggcgcgtagactcagctgctacttcagggggatccctgacagctgttctcttcctgactggaacctgggcaggcccacagactaagagctgcgcagcctag

SEQ ID NO: 177618 - DNA, 483 bp, Artificial Sequence
  Description of Artificial Sequence: Synthetic coding sequence
atggccggcaagcggagcggctggagccgggccgccctgctgcagctcctactgggcgtcaacctggtggtgatgcctccaactagagcccggagcctcagatttgtgacactgctgtacaggcatggagatcggtcccctgtaaaaacatatccaaaggacccgtaccaagaagaagagtggcctcaagggtttggacaacttacaaaagaaggcatgctgcagcattgggagttagggcaagccctgcgccagagataccacggcttccttaatacttcttaccaccggcaggaggtgtacgtccgaagtacggattttgaccggacgctcatgagcgctgaagctaacctggctggtctatttccaccaaacggaatgcagcggttcaaccccaatattagctggcagcctattccagttcacacagtgccgattaccgaggatcgagtacgggtcgcgagtccctcattgggatggtag

SEQ ID NO: 177619 - DNA, 1272 bp, Artificial Sequence
  Description of Artificial Sequence: Synthetic coding sequence
atggccggcaagcggagcggctggagccgggccgccctgctgcagctcctgctcggagtgaaccttgtcgtaatgccgcccaccagagcaagatctctgaggttcgtcacactgttgtataggcacggggacaggtctcctgtgaaaacctaccccaaggatccttaccaggaggaggaatggccccaagggtttggccaactcaccaaggaaggaatgctccagcattgggagcttggacaggcactgcgccagcgttaccatggctttctaaacacgtcatatcacagacaagaagtgtatgttagaagcacggactttgacaggactctgatgtcagcagaggctaatctcgccggccttttccccccaaatggtatgcaaagattcaaccctaatatttcatggcagcctattccagtgcacacagtgcccatcacagaggacagactgttaaaattcccactgggaccctgtccccggtacgaacagctacagaatgagacccgacagacccctgagtaccagaatgaatccagtcgaaatgcccagttcttagatatggtggctaacgaaactgggcttactgacttgacactggagaccgtgtggaatgtgtacgatacgctgttctgtgagcaaacgcatggattgaggctgcctccatgggcctctccccaaacaatgcagaggctgtccaggttgaaggatttctccttccggtttctcttcggtatataccagcaggctgagaaggcacggctgcaaggtggggtattgctggcacagatcagaaagaatttaacattaatggccacgacgtcacaactccccaaactgctggtttactccgcccatgacaccactctagtggcgctgcaaatggccctggatgtgtacaacggagagcaggctccatacgccagctgtcatatattcgagttgtatcaagaggactcaggcaacttttccgtggagatgtacttccgcaatgaaagtgacaaagcgccatggcctctctccctgcccggatgcccccatcgatgtcctctgcaggacttcctcagactgacagaacctgtggtgcctaaggactggcaacaggagtgccagctggcaagcggcccagccgatacggaagtgattgtggccttagccgtatgcggatctatactctttctgcttatcgttctcttgctgactgtgctcttcaggatgcaggcgcaacctccaggttatagacatgtggccgatggcgaggaccacgcgtag

SEQ ID NO: 177620 - DNA, 1176 bp, Artificial Sequence
  Description of Artificial Sequence: Synthetic coding sequence
atggccggcaagcggagcggctggagccgggccgccctgctgcagttgctgctcggcgtgaatttggtcgtgatgccacccacgcgcgctcgctccctcagattcgttacgctggaaggcatgctgcaacactgggagctcggccaggcactgagacagaggtaccacggttttttaaacactagctatcacaggcaagaagtttatgtgcggtccacggattttgatagaacccttatgagtgcagaggccaacctcgccggcctgtttcctcccaatggtatgcaaagattcaatccgaatatctcctggcagccaattccagtgcacacagttcccattaccgaggacagattattaaaattcccactggggccatgtccgcgttatgaacagctccagaacgagaccaggcaaacacccgaatatcagaacgagtcatctcgaaacgcccagttccttgacatggtagccaacgagactggcctcactgacctgaccttagagactgtgtggaatgtgtacgacacattattttgcgagcagacgcacggattgcggcttccaccgtgggcgtccccacagacaatgcagcggctcagtaggcttaaagattttagtttccgcttcctgtttggcatttaccagcaagcggaaaaagctcggctccaggggggagtgctcctggcgcagatcagaaagaacctgacacttatggccactacaagccaactccccaagcttctggtctacagcgcacacgatacaactcttgtagcactccagatggccctggacgtctataatggcgaacaggccccctacgcgtcttgccacatttttgagctgtaccaggaggattctggaaacttctctgtcgagatgtattttagaaacgagagtgacaaggcaccttggccactgagtctccccggttgcccccaccggtgtcctcttcaggacttcctgaggctcaccgaacccgttgtccctaaggactggcagcaggagtgccaactggcctcagggcctgcagacaccgaggtcatcgttgctttggccgtgtgtgggagcatattgttcctgttaattgtcctcctgttaaccgtcttgttccgtatgcaagcacagccccccggataccgccacgtggcagatggagaggatcatgcttag

SEQ ID NO: 177621 - DNA, 711 bp, Artificial Sequence
  Description of Artificial Sequence: Synthetic coding sequence
atggtggccaacgagaccggcctgaccgacctgaccctggagaccgtttggaacgtctatgatactctgttctgcgagcaaacccacgggttgcggctgccgccatgggcttcaccgcagactatgcagaggctgagtagattgaaggattttagctttaggtttctgttcggtatctatcagcaggcagagaaggcgcgcctacagggtggtgtgcttttggcacagattcgcaaaaatttgacactgatggctacaacaagccagttaccaaaactgcttgtttactccgcccacgacactaccctcgttgctctgcaaatggcgttagatgtgtacaacggggagcaggctccctacgcctcttgccacatatttgaactctatcaagaggactcaggcaattttagcgtcgaaatgtacttcaggaacgaaagcgataaagcgccttggccactgtcattgcccgggtgtccccatcggtgccctctgcaggacttcctgcgccttaccgagccagtggtccctaaagattggcaacaggaatgccagctcgctagcggccccgctgacacagaggtcatagtagcactagcagtatgtggcagtattctctttttattgattgtactgctgttaactgttctctttcggatgcaggctcagcctcccggctacagacacgtagcggacggggaagaccacgcatag

SEQ ID NO: 177622 - DNA, 1242 bp, Artificial Sequence
  Description of Artificial Sequence: Synthetic coding sequence
atggccggcaagcggagcggctggagccgggccgccctgctgcagctcttgctcggagtcaatctggtcgtgatgcccccgactagagctaggtccctgcggttcgtgaccctgctgtatcgtcacggtgacagatcccctgtgaaaacgtaccctaaggacccttaccaggaagaggaatggcctcagggatttggccagctgacaaaagagggaatgttgcagagatatcacggctttcttaatacatcttatcatcgccaagaagtttatgtgcgctctaccgactttgacagaaccctcatgtcagccgaagccaacctggccggactcttcccaccgaatggaatgcaacggtttaatccaaacatttcctggcaacctataccagtccacaccgttcccattaccgaagacagactgcttaaattcccattgggcccttgcccccggtacgaacagctgcagaacgaaactaggcaaacccctgaatatcagaacgagagtagtcgaaatgcccaattcctggacatggtcgccaatgagacgggcctgaccgacttaaccctggaaacagtgtggaacgtctatgacacacttttctgtgaacagactcatggactgaggctgccaccttgggctagcccacagacaatgcagaggctgagtcgcctgaaggacttttctttcaggtttctgttcgggatttaccagcaagcggagaaggcaaggctgcagggtggagtcttactggcccagatccggaaaaacttgaccttaatggctacgaccagccagctgccgaagttattggtctattcggctcacgacacgaccctcgttgccctccagatggcgctcgacgtttacaacggagaacaggccccctatgcatcctgtcatatattcgaactgtatcaggaggattcaggtaacttctccgtggagatgtacttccggaatgaatctgacaaggcaccctggccactgtctttgcccggttgcccacaccggtgcccccttcaggattttttgcggctgaccgagcctgtagttcccaaggattggcaacaggagtgtcagcttgcctccggacctgcagacaccgaggttatcgttgccttagccgtctgtggatccatcttgttcctgctgattgtcctccttttgactgttctttttcgaatgcaagcgcagccaccgggctaccggcatgtggcagacggagaggatcacgcctag

SEQ ID NO: 177623 - DNA, 978 bp, Artificial Sequence
  Description of Artificial Sequence: Synthetic coding sequence
atggacatgtggaccgccctgctgatcctgcaggccctgctgctgccatctctggctgatggagccacacccgctctacgctttgtggcagtgggagactggggaggcgtgcccaacgcgcctttccatacagccagggaaatggccaacgcaaaggaaatcgcaagaacagtccagatcctcggagccgatttcatcctaagcttgggagataacttctattttaccggtgtacaggacattaatgacaaaagattccaggagacctttgaagacgttttcagtgaccggtcattgaggaaggtgccatggtatgttctagcaggcaaccacgaccatcttggaaatgtctccgcccagatagcttattctaaaattagtaagcggtggaattttccctcacccttctatcggctgcacttcaaaatcccacaaactaatgtctcagttgccatcttcatgctggacactgtgaccctgtgtggaaactctgatgactttttatcccaacagccagagcgtccccgggacgtcaaactggcccggacacagttgagctggctgaagaaacaactcgccgcagccagggaggactatgtgctggtggctggccactaccccgtgtggagcattgccgaacacggacctacccattgtctcgtaaaacagctcagacccttacttgcgacatacggcgttaccgcctacctatgtggtcatgaccacaacttacagtacctgcaggacgagaatggtgtggggtacgtgctgtcgggcgcagggaatttcatggacccaagtaagcggcaccagaggaaagttcccaacggctatctgcgatttcactacggcacagaggattccctgggggggtttgcctacgtggagattagtagtaaagaaatgaccgtcacgtatattgaggctagtggcaaatcactctttaagacacgattgccccgccgagcacgcccctag

SEQ ID NO: 177624 - DNA, 1239 bp, Artificial Sequence
  Description of Artificial Sequence: Synthetic coding sequence
atgggcagcccctggaacggcagcgacggccccgagggcgcccgggagcctccatggcctgccttgcctccgtgtgatgagcggaggtgtagtccctttccactgggcgcgctcgtcccagtgactgccgtgtgcttgtgtctttttgtggtgggcgtgtcagggaacgttgttacagtgatgcttatcggccggtatagagatatgcgcaccacaaccaacctctacttggggtctatggcggtcagcgacctgctgatcttgctcggcctcccctttgacttgtaccggctgtggcgatcaagaccatgggttttcggccccctgctgtgtcggctgtctctgtacgtgggcgagggttgcacctacgccacccttttgcatatgaccgctctgagtgtggaaagatacttagccatttgccgacctctgagggcacgcgtgctggtgaccaggcgaagagtgagagcacttatcgcagtcctgtgggccgtggccttactgtccgccggtccctttttatttcttgtgggggtcgagcaagaccccggaatctctgtggtgcccggcctcaatggaacggcccgcatagcttcatctccactggccagtagtcctcccctgtggctgtcccgagccccaccacccagcccaccctctggccccgagaccgccgaggcagcagctctcttcagcagggaatgcaggccttcaccggcccagctgggcgctttaagggtgatgctatgggtcaccacagcttattttttcctgccttttctgtgcctgtctatactttatggccttatcgggcgagaactgtggtctagcaggcgccctttgcgcggccccgccgcaagtgggcgagagcgaggtcacagacagaccgttagggttttgctggtcgtggtgcttgcatttatcatttgttggttgccatttcacgtcgggcgcatcatatacatcaatacagaagattcaagaatgatgtatttctctcagtatttcaacattgtggcgcttcagctcttttatctgtctgcatccattaacccaatcctgtataatctgatttccaaaaagtatcgcgccgcagcatttaagttattgctggcaagaaagtcacgtcctcgcggctttcaccgaagccgtgacaccgccggtgaagtggctggtgacacggggggggatactgtgggatatacagagacgagcgccaatgttaaaacaatgggatag

SEQ ID NO: 177625 - DNA, 978 bp, Artificial Sequence
  Description of Artificial Sequence: Synthetic coding sequence
atggacatgtggaccgccctgctgatcctgcaggccctgctgctgccttccctggcagacggagccacgcccgctctgcgattcgtcgcggtgggcgactgggggggcgtgccaaacgccccctttcacaccgcgagggagatggccaatgcaaaggaaattgctaggactgtgcagatcctgggagcggacttcattttgtcccttggcgacaacttttacttcaccggggtgcaggacattaatgataaacgctttcaagagacttttgaagatgtcttttctgaccgatcgctgcggaaggtcccttggtacgttctggctggcaaccacgaccaccttggaaacgtttccgctcagattgcttactctaagatctccaaacgatggaatttcccctctcctttttaccggctgcattttaaaatccctcagacaaacgtgtccgtggctatttttatgttagacacagtcaccttgtgcgggaactcggatgattttctgtctcagcagcctgagcgaccccgcgatgtgaaattggcaaggacccagctgtcatggctgaagaagcagctcgctgccgcacgtgaggactacgtcctcgtcgcaggacactacccagtgtggtccatcgccgagcatggtccgacacactgcctggtgaaacagcttaggcccctcctggcaacttacggggtcaccgcatacctctgtggccatgaccacaatttgcaatatttacaagacgagaatggggtgggatatgtcctctcaggggccggaaacttcatggacccatcgaaaaggcaccaaagaaaagtacccaacgggtacctaagattccattacggaactgaggatagcctgggaggcttcgcatacgtggaaatttcctccaaagagatgacggttacttacatagaagcttctgggaagagcctctttaaaacacggctgccccgcagggcacggccctag

SEQ ID NO: 177626 - DNA, 978 bp, Artificial Sequence
  Description of Artificial Sequence: Synthetic coding sequence
atggacatgtggaccgccctgctgatcctgcaggccctgctgctgccttcactggccgacggtgctaccccagctttaaggttcgtggctgtaggcgattggggaggcgtaccgaacgccccattccacaccgctcgcgagatggcaaacgcaaaagaaatcgccagaacggtgcagattctaggagcagattttattctgagtttaggcgacaatttctatttcaccggggtccaggacataaacgacaagcgcttccaggagacttttgaggacgtgttttctgatcgttcccttcgaaaggttccatggtacgtactggctggaaatcacgatcaccttggaaatgtgagtgcccaaatcgcttactccaagatcagtaagaggtggaacttcccaagccccttctacagattgcactttaaaatcccccagacgaacgtgagcgttgctattttcatgctggatactgtgacgctttgtggtaacagtgacgacttcctgtcacagcagccggagcggcccagggatgtcaaactcgcaagaacccagttgtcgtggcttaagaaacagctggcagcggcacgcgaggattacgtcttggtggcggggcattaccctgtttggtccatcgctgagcatggccctacccattgcctggtcaaacagcttaggccactgcttgccacttacggggttacagcttatctgtgcggacacgaccataatctgcagtacctccaggacgagaacggcgtgggctacgtgcttagcggcgccggaaattttatggacccctcaaagagacaccaacgcaaggtaccaaatgggtacctgagattccactatgggaccgaagattctctgggtggttttgcatatgtcgagatttcctccaaggaaatgacagtcacctacatcgaagcatcgggtaaatcactgtttaagacccgcctgccacgacgcgcacgcccttag

SEQ ID NO: 177627 - DNA, 1161 bp, Artificial Sequence
  Description of Artificial Sequence: Synthetic coding sequence
atgcgggccgcccccctgctgctggcccgggccgccagcctgagccttggattcctttttctgttatttttctggttggatcgctccgtactggctaaagaattaaagttcgtgaccctagtgttcaggcacggtgaccgatctcccattgacacatttcctactgatcccattaaggaatccagctggccacagggttttggccagctcactcagctgggaatggagcaacactacgaactgggggagtatatccggaagagataccgcaagttccttaacgagagctacaagcatgaacaggtctatataaggtcgaccgacgtcgaccgaactctcatgtccgccatgacgaacctggccgctcttttcccaccagaaggagttagcatctggaatcccatcttactctggcagcctatcccggtgcacaccgtgcccctgagtgaagaccagttgctgtacctcccattccgcaattgtcctcgcttccaagagctcgagtcggagactctcaaaagcgaggaatttcagaaacgcctgcatccgtacaaggatttcattgcaaccctgggaaagctgtctggcctgcacggacaggacctgtttgggatttggtcgaaagtatatgatcctctctattgcgagagtgtacacaactttactcttccgtcgtgggccaccgaggacaccatgacaaaactccgggaactttcagaactttccctgttgtcgctgtatggaatccataagcagaaggagaaaagcaggctccaaggcggcgtactggtgaacgagattttaaaccacatgaaacgggcaacacagataccctcatataagaagctaatcatgtattcggcccacgacactacagtgagcggtctgcagatggcccttgacgtgtacaacgggcttctaccaccttacgctagttgccatctgactgaactgtattttgagaagggcgagtacttcgtcgaaatgtattacagaaacgaaacacagcacgagccttatcctttaatgcttccaggatgctccccctcatgcccgctcgagaggtttgcagagctggtcggaccagtgattcctcaagactggtccactgagtgcatgacaactaattctcaccaggggacagaggactctaccgactag

SEQ ID NO: 177628 - DNA, 1257 bp, Artificial Sequence
  Description of Artificial Sequence: Synthetic coding sequence
atgcgggccgcccccctgctgctggcccgggccgccagcctgagcctgggcttcctctttttactcttcttctggcttgacaggagtgtacttgctaaggagctgaagttcgtcaccctcgtcttccgacacggggatcgcagccctatcgataccttcccaacagaccccatcaaggaatctagttggcctcagggttttgggcagctgacccagcttgggatggagcagcattatgagctgggagaatacatccgcaagaggtaccgcaagtttcttaacgaatcttacaagcacgagcaggtctacataaggagcaccgacgtagaccggacgcttatgtccgccatgacgaatctggcagcactttttccccccgaaggagttagtatttggaacccaatcttactgtggcaaccaataccagttcatacagtgcctctatctgaagaccagcttctctacttgccgttcaggaactgtccaagattccaagagctggaaagtgaaaccctgaagtccgaggagttccagaaacggctccacccatataaggacttcattgcaacgctcggcaagctgagtggtctgcacggacaagatttgttcgggatctggtcaaaagtttatgatcccctttattgcgaatctgttcacaatttcaccctgccttcctgggctactgaggacactatgacaaaactccgagaactgtccgagctttctttgctctcattgtacgggatccacaagcagaaggagaaatctaggctgcaggggggagtgctggttaacgagatcctaaaccacatgaagcgagccacacagatccccagttataagaaactgatcatgtatagtgcgcacgatacgacagtgagcggtttacaaatggctttggatgtgtataacggcttgctccctccatatgcgtcatgtcacctgactgagctgtacttcgagaagggggaatatttcgtggagatgtactaccgaaacgagacccagcacgaaccctaccctttaatgttaccagggtgctccccatcgtgtcctctggaaagatttgcggaacttgtgggcccagtcatcccccaggattggtcgacagagtgtatgacaactaactctcaccaggttctcaaggtcatatttgctgtggcattttgtctcatcagtgccgtactgatggtcctgctgttcattcatatcagaagagggttatgttggcagcgggaaagctatgggaatatttag

SEQ ID NO: 177629 - DNA, 1281 bp, Artificial Sequence
  Description of Artificial Sequence: Synthetic coding sequence
atggccggcctgggcttctggggccaccccgccggccccctgctgctgctgctgctccttgtgctcccgccccgtgccctccctgaggggcctctggtttttgtggccctggtctttcgtcacggcgatagagctccattggcctcctaccccatggacccccacaaagaggtggcttccactctgtggccaagaggccttggccagctcaccaccgagggagtcaggcagcaactggagttaggccggttcttgcggtcaaggtatgaagctttcctgtctcctgaataccgccgagaggaggtctacattcgtagcaccgacttcgatcgtactctcgagtcagcccaagctaatctcgccggcttatttcccgaggcagccccagggagccccgaggcacgctggcgacccattcctgtgcacacagtgcccgtggccgaggacaagcttttgagattcccaatgcgcagctgtcctagataccacgaattactgcgggaggccaccgaggctgccgaatatcaggaggccctggaggggtggactgggtttctcagccgcctagaaaatttcacaggactgtctttggtcggagagcctctccgccgcgcatggaaggtcctcgacacacttatgtgccagcaggcacatggcctgccactccccgcatgggcctcgcccgacgtgctgaggacattagcccaaatttccgctttggatataggagcacatgtcggaccccccagggcggcagagaaggcacagcttaccggcggcattctgttgaacgcaattctggccaacttcagtcgggtgcagcgactgggcctgccgttgaagatggtgatgtactcagcccatgactctactctgttggctctgcaaggcgctctgggtttatatgatggccatactccaccatatgctgcatgtcttgggttcgagttccgcaaacacctcggcaaccccgcgaaagacgggggaaacgtgactgtgagcctgttttatcgtaacgattcagcccatctaccacttcctttatccctgccaggatgccctgcaccctgccctctcggaaggttttatcaactgaccgcgcccgcgcgccctccagcacatggagtatcctgccatgggccctacgaagccgccattcctcccgccccagtcgtccctctgctggcaggtgcggtcgccgttctggtggcactgagcttgggattgggactattggcttggcggccaggctgtcttagggcgctgggcgggcctgtctag

SEQ ID NO: 177630 - DNA, 1002 bp, Artificial Sequence
  Description of Artificial Sequence: Synthetic coding sequence
atggccggcctgggcttctggggccaccccgccggccccctgctgctgctgctcctgctggtcttgccacctcgtgccctgcccgagggaccactcgtattcgttgcactcgtgttccgccatggcgatcgagctcccctggcgtcctacccgatggatcctcataaggaagtcgcctcgacgctttggccccgggggctgggtcagctgacaaccgagggagtgcgacagcagctggagctgggccgtttccttagatccagatatgagggtttcctgtcacggctggagaatttcaccggactgtccctggtgggggagcccctgcggcgcgcatggaaagtcctggatacattaatgtgccagcaagcgcacggtctgcctttaccagcctgggcatcccccgacgtgttgagaacactggcccaaatctctgcacttgacatcggagctcatgttggcccgcccagagcagccgaaaaagcccaactgaccggaggcattctcctcaacgccatcttggctaactttagccgggtgcagaggctcggcttgcccctgaagatggtcatgtatagtgcccacgattccaccctgttggctctgcagggggccctcggcctctacgacgggcatactccaccttacgcagcctgcctggggttcgaatttcgtaagcacctcggcaaccccgccaaggatggcggaaacgtaacagtgagcttgttctaccggaatgactccgcccatctgccactgcctctcagcctgcctggctgccccgcaccttgtcccctcgggcgcttctaccagctgactgcacctgcccgaccgcccgcccacggtgtctcctgccacggaccttatgaggccgcgataccacccgcacccgtggtgccgcttctggcgggggccgttgcggtgctggtcgcgttgtcgttaggccttggtctgcttgcttggaggcccgggtgtttgagagctctgggaggaccggtgtag

SEQ ID NO: 177631 - DNA, 633 bp, Artificial Sequence
  Description of Artificial Sequence: Synthetic coding sequence
atggagatgggccggcggatccacctggagctgcggaaccggaccccgtcggacgtaaaggagctcgtactagataactctagatccaacgaggggaaactagaaggtctgactgatgaattcgaagagctggaatttctgtccactatcaatgtggggttgacatccattgcgaacctccccaaactgaataaactgaaaaagctggaactgtcagacaatcgggtgtcaggtggcctggaagtgctggccgagaaatgtcctaatctcacacaccttaatttaagtggaaacaaaatcaaggatcttagtactatcgaaccgcttaaaaagctggagaatctgaagtctctcgacctgttcaattgtgaggttaccaatctcaatgattaccgagaaaacgtgtttaaactgctccctcagcttacttacttggacggctacgaccgggacgacaaagaggcccccgacagcgatgctgaggggtatgtggagggactcgatgatgaggaagaggatgaggacgaagaggagtatgatgacgaggagggctacaacgatggtgaagtcgacgacgaagaggacaagaaaaagaagaaaaaaaagaaaaagaaaaagaagaagaaaaagtag

SEQ ID NO: 177632 - DNA, 750 bp, Artificial Sequence
  Description of Artificial Sequence: Synthetic coding sequence
atggagatgggccggcggatccacctggagctgcggaaccggaccccttcggatgttaaagagttggttctcgataacagcagatctaacgagggcaagctcgaaggtctgactgatgagttcgaggagctggagttcctgagcacaatcaatgtgggactcacgtcaatagccaacttgcctaaactgaataaattgaagaagctggagttatccgataaccgggttagtggaggtcttgaggtgctggcagagaagtgcccgaatttgactcatctcaacctgagcggcaacaaaatcaaggatctttctacaattgagcccctcaagaaactggaaaatctcaaatcattagatctcttcaactgcgaagtgactaatctgaacgattatagagagaatgttttcaaactgctgccccagcttacttacttagacggttacgaccgagacgacaaggaggcaccagatagcgatgcggagggctacgtggaggggttagacgatgaggaagaagacgaagatgaagaagagtatgacgaggatgctcaggtggtggaggacgaagaagatgaggatgaggaagaggagggggaggaggaggacgtttctggagaggaagaagaagatgaggaggggtacaacgatggcgaggttgatgacgaggaagatgaagaggagctgggcgaggaagagcgcggacagaagcggaagagggaaccagaggacgagggcgaggacgacgattag

SEQ ID NO: 177633 - DNA, 396 bp, Artificial Sequence
  Description of Artificial Sequence: Synthetic coding sequence
atggagatgggcaagtggatccacctggagctgcggaaccggaccccatcagatgtgaaagagctttttcttgacaacagtcagagtaatgagggcaaactcgagggactgacggacgagttcgaagagctggaactgctcaatacgattaacatcggactcaccagtatagccaacctgcctaaattgaacaaacttaagaaattagagttatcgagtaatcgggcttcagtggggctggaagtgctggccgagaaatgccccaatctgattcatcttaacctgtctggtaataagattaaggacctatccaccatcgagcctcttaagaagctagagaatctggagtctctggacttgtttacctgcgaagtgacaaatcttaataattattag

SEQ ID NO: 177634 - DNA, 807 bp, Artificial Sequence
  Description of Artificial Sequence: Synthetic coding sequence
atggagatgaagaagaagatcaacctggagctgcggaaccggagccctgaagaagtcacagaactcgttcttgacaattgcctttgcgtcaacggggaaattgagggcctgaatgacacattcaaagaactggagttcctgtcaatggcaaacgtcgaactttcctctttggctagattgcctagcctgaacaaactgcgcaaattagagctgtctgataacatcatctctggtggcctggaagtcctcgctgagaagtgtccgaatcttacatacctaaacttatcaggaaacaagatcaaagatctctcaaccgtagaggccctgcagaacttgaaaaatctgaagtcattggacctattcaactgcgagataacaaacctcgaggactatagagagtcaatctttgagctgctccaacagatcacctacctcgacggctttgaccaggaggacaatgaggccccggactcagaagaggaagacgacgaagacggcgacgaagacgatgaagaggaggaggagaatgaggccggtcccccagaagggtacgaggaggaagaggaggaagaggaagaagaggacgaggacgaggacgaggatgaggacgaagctggatcagagctgggtgagggggaagaagaggttgggctgagttatctgatgaaagaagagatccaggatgaagaggacgatgacgactatgttgaggaaggggaagaggaagaggaggaagaggagggagggcttagaggagaaaaaaggaaacgagacgcagaagacgatggcgaagaagaggatgattag

SEQ ID NO: 177635 - DNA, 411 bp, Artificial Sequence
  Description of Artificial Sequence: Synthetic coding sequence
atggagatgaagaagaagatcaacctggagctgcggaaccggagcccagaggaagaggacaacgaggcccccgactcagaggaggaagatgatgaggatggagacgaagacgacgaggaagaggaagaaaacgaggcagggccacccgaggggtatgaggaagaagaggaggaggaggaggaagaagatgaggacgaagacgaagacgaagatgaagccggttcagaactgggcgaaggggaggaggaggtcggtttgtcatacctcatgaaagaggagatccaagacgaagaagacgatgacgactacgtggaggagggagaggaggaggaggaagaggaggagggcggtctgagaggcgagaagagaaagagggacgcggaagatgacggagaagaggaggacgactag

SEQ ID NO: 177636 - DNA, 663 bp, Artificial Sequence
  Description of Artificial Sequence: Synthetic coding sequence
atggccaacgtggagctgagcagcctggcccggctgcccagcctgaataagctcaggaagttggaactcagcgataacattatttcgggaggcttggaagtgctcgccgagaagtgcccaaacctcacgtatttgaatcttagtggtaacaagattaaagatctgtccaccgtggaagccctccagaatctcaaaaatctcaaaagcttagatctgttcaactgcgaaatcacaaatctggaggactaccgggaatctatctttgagttattacaacaaataacctatctagatggcttcgaccaggaggacaacgaagctccggattcggaggaggaggatgatgaagacggagacgaggacgacgaggaagaggaagagaatgaggccgggcccccagagggttatgaggaagaggaggaggaagaggaagaagaggacgaggacgaagacgaagacgaagacgaggcgggttctgagctcggggaaggtgaagaagaggtgggcctttcttacctgatgaaggaagaaattcaggatgaggaagacgatgatgactacgttgaggagggtgaggaggaggaggaagaagaggagggtggactccggggcgaaaaacggaagcgagatgcggaagacgacggggaggaagaagatgattag

SEQ ID NO: 177637 - DNA, 684 bp, Artificial Sequence
  Description of Artificial Sequence: Synthetic coding sequence
atggagatgaagaagaagatcaacctggagctgcggaaccggagccccgaggaagtcaccgagcttgtcctggacaattgcctgtgtgtgaatggtgagattgagggtcttaatgacaccttcaaagaactggaatttctctcaatggcaaacgttgaattgtcttcgctagcccgtctgcccagtctgaataaacttcgcaagcagaatttaaaaaacctcaagtcccttgacctgttcaattgtgaaatcacaaatttggaggactatcgcgagagtatttttgagttgctccagcaaattacctatctggacgggttcgatcaagaggacaacgaggcccctgactcggaagaagaagacgatgaagatggtgatgaggatgacgaggaggaagaagagaacgaggctgggcccccggagggatatgaagaggaggaagaagaggaagaagaagaggatgaagatgaagacgaagatgaggacgaagccgggtcagagctcggcgagggggaggaggaggtgggcctgtcatatctgatgaaagaggagatacaggatgaggaggacgacgatgattacgtcgaagagggcgaggaggaagaagaggaagaagagggtggcctgcggggagaaaagcggaagcgggacgctgaggatgacggagaagaggaagatgattag

SEQ ID NO: 177638 - DNA, 2076 bp, Artificial Sequence
  Description of Artificial Sequence: Synthetic coding sequence
atggacggctgcaagaaggagctgccccggctgcaggagcccgaggaggacgaggattgctacatcctgaatgttcaaagctccagcgacgatacgtcgggtagctcagttgccagacgggcccccaaaaggcaggcctcttgcatcctgaacgtacagtctcgcagcggggatacatcaggatccagcgttgctcgtcgcgcacctaagcgtcaagccagcagtgtggtggtcatagactcagactctgacgaggagtgccacacacacgaagaaaaaaaggcaaagctgttggagatcaacagcgatgacgaaagccccgaatgctgtcatgtgaagcctgcaatccaggagccacctattgtcatttcggatgacgacaatgacgatgacaatgggaacgatcttgaggttcctgacgataacagcgacgactcagaagcgcccgacgataattcagacgattccgaagcacctgacgacaactccgacgactccgaagcccccgatgacaactccgacgattctgaggcacccgatgacaatagtgacgactcagatgtgcccgatgataactctgacgattcttcagatgataacagcgacgacagctctgacgacaattccgatgactcggacgtgcctgatgataagtccgatgatagtgacgtcccagatgacagcagtgacgatagcgatgtgcccgacgactccagtgacgactcggaggctcctgatgacagctccgacgacagtgaggccccggacgattcctctgatgattccgaagcgcccgatgacagcagtgatgacagcgaagcgccagatgattcctccgatgatagtgaagcaagtgatgattctagtgatgacagcgaggccagtgacgactcttcagatgactctgaagccccagacgataaatcggacgactctgatgtccccgaagataaatccgatgacagcgacgtcccagatgacaactctgatgacctcgaggtgccagtgcccgcagaagacctgtgtaacgagggacagattgccagcgatgaagaagagctagtggaggcggccgctgcagtctctcagcacgattcaagcgacgatgcgggagagcaggacctgggcgaaaacctatctaaacccccaagcgatcccgaggctaaccccgaagtgagcgaaaggaagctgcctacagaggaagagcctgctccagtggtcgaacagtcaggcaaaagaaagagcaagactaaaaccatcgtcgaaccaccccggaaacgtcaaacaaaaaccaaaaacattgtggagccgccacgtaaacggcaaacaaaaaccaagaacatcgtagagccactgagaaaacggaaagccaaaactaagaacgtgtcggtaacccctggccataagaaacgtggcccatctaaaaagaaacctggggctgctaaagtggagaagagaaagaccaggacccctaaatgtaaagttcctggttgttttctgcaagaccttgaaaagtctaagaaatattcaggaaaaaatctcaagagaaacaaagacgagcttgtgcagcggatttatgacctgttcaatcggtctgtttgcgacaaaaaactgccagaaaagctacggatcggttggaacaacaagatggttaaaactgctggcctatgttccacgggtgagatgtggtatcccaagtggcgcaggtttgcaaagattcagatcggcctcaaggtatgtgattccgcggaccgcatccgcgacactctgattcacgaaatgtgccatgcagcctcttggctcatcgatggtatacacgactcccacggagacgcgtggaagtattatgcccgcaaatccaaccgaatccaccccgagttaccaagagtgactcgctgtcataattataaaattaactacaaagttcactacgaatgcactggatgcaaaacccgaattgggtgctatacaaagtctctcgatactagtagattcatctgtgccaagtgcaaaggaagtctggtcatggttcctctgacacagaaggacgggactcgtattgtgccccacgtctag

SEQ ID NO: 177639 - DNA, 2076 bp, Artificial Sequence
  Description of Artificial Sequence: Synthetic coding sequence
atggacggctgcaagaaggagctgccccggctgcaggagcccgaggaggacgaagattgctacatactcaatgttcagtctagctccgacgacacatctggctctagcgtcgcacggagagccccgaagaggcaagccagctgcattctgaacgtccagagcagatccggggacacatctggtagctccgtggctagaagggccccaaagcggcaagcctcgtctgtggtagtgatagactccgattcagatgaggagtgccacacacatgaagagaagaaagcaaaacttttggaaattaactcagacgacgaaagtcctgagtgttgtcacgtgaagccagccattcaggagcctcccatagtgatcagcgatgatgacaatgatgacgacaatggaaatgatctggaagtccctgatgacaattcggatgacagcgaggcacccgacgacaactcagatgacagcgaagcccctgacgataactctgatgacagtgaggccccagatgacaatagcgacgactccgaagcacctgacgacaacagtgatgattctgacgttcccgatgataatagtgatgacagttctgacgacaattcggatgactctagcgatgacaactctgacgactctgatgtgccagacgataaaagtgatgatagcgatgtacctgacgactctagcgacgacagcgatgtccccgatgactcgtctgacgatagtgaagcaccagacgattccagcgatgattccgaggccccagacgattcgagcgacgattccgaggccccagatgattcttctgatgacagcgaggcgccagacgacagctcagacgattcagaagccagcgatgattcatctgacgattctgaagcatccgacgacagtagcgatgactctgaggccccagacgataagagtgacgactcagatgtgccagaggacaagtcggacgactccgatgtgccagatgataattctgatgatttagaagttcccgtccctgccgaggacctgtgcaacgagggccagatcgcgtccgatgaagaagagctggttgaggcagctgctgcagtgtcgcagcacgattccagtgatgatgctggagagcaggatctgggggagaacctgtccaagccaccctcagatcccgaagccaaccctgaggtgtccgagcgcaagttgccaaccgaagaggagccagcgcccgtagtggaacagtcgggaaaacgaaagagcaagacaaaaactatagtagagcctccgagaaaacggcagaccaagaccaagaacattgtagagccccctaggaaacggcaaacgaaaaccaaaaacattgtcgagcccctgcggaagcgaaaagccaaaacgaagaatgtgtccgtgactccgggacataaaaagcgtggtccctccaagaaaaaacccggggccgccaaggtggagaaaagaaagacacggacaccaaaatgcaaggtgccaggctgcttcctgcaggacctggaaaagagcaaaaaatactctgggaagaatttgaaaagaaataaggacgaactggttcaacggatctacgacctgtttaatagaagtgtgtgcgataaaaaactgccagaaaagctgagaattggctggaataataagatggttaagacggcaggcctgtgtagcaccggggagatgtggtatcccaaatggcgccggttcgctaaaatacagattggactcaaagtgtgcgacagtgccgaccgtatccgcgataccttgattcacgagatgtgtcatgccgcctcatggcttatcgatgggatacacgattctcacggggatgcctggaaatattatgcccggaagtccaaccggatccatcccgaacttccccgcgtcactcgatgccataactacaaaatcaactataaggtgcattatgaatgcacgggatgcaaaactcgtataggatgctacaccaaaagtctggatacttcacggtttatctgcgcaaagtgcaaggggagcctggttatggtccccctgactcagaaggacggtacaaggatagtgcctcacgtatag

SEQ ID NO: 177640 - DNA, 540 bp, Artificial Sequence
  Description of Artificial Sequence: Synthetic coding sequence
atggtgcaggcctggtacatggacgacgcccccggcgacccccggcagccccacaggcccgaccccgggcgaccagttggtctggaacagctgcggcggctgggtgtgctttattggaagctggatgctgacaaatacgaaaacgatcccgaactggagaagattagacgcgagcgcaactattcgtggatggacattatcacaatctgcaaagacaaattgccaaattatgaggaaaaaatcaagatgttttatgaagagcacctacatctcgatgatgaaatacgctatatcttggatggcagtggatacttcgatgtgagggacaaggaagatcagtggatcaggattttcatggaaaaaggcgatatggtcaccttgccggccggcatctatcatcggttcacagtggacgagaaaaattacaccaaggctatgcgattgttcgtcggagaaccggtgtggacagcttacaaccggccagcggatcacttcgaagcccggggtcagtacgttaaatttctggcacagactgcttag

SEQ ID NO: 177641 - DNA, 2670 bp, Artificial Sequence
  Description of Artificial Sequence: Synthetic coding sequence
atgagcaaccccttcgcccacctggccgagcccctggaccccgtgcagccgggcaaaaaattttttaatctgaataagttagaggactcccgctacggcaggctcccattcagcatacgagtgctgctggaggccgccatacggaactgtgatgagtttctggttaaaaaacaggatattgagaacatccttcactggaatgtcacgcaacacaaaaatatagaggtgcctttcaaacctgctcgggtcattctgcaggacttcacaggggtgcccgcggttgtggattttgcagccatgagggacgctgtgaagaagttagggggcgaccccgagaaaattaacccggtgtgtcctgctgatctcgtgatcgaccactccatccaggtggatttcaatcggcgggccgactccctgcagaagaaccaagacctggaatttgaaaggaatagagagaggttcgagttcctgaagtgggggagtcaggcattccataacatgcgtatcattcctccaggctctggcattatacaccaagtaaacctcgaatacttggcacgggtcgtcttcgaccaggatggatattactatcctgattctctcgtcggcaccgacagccataccacaatgattgacgggctcgggatcctgggctggggcgtgggaggtattgaggctgaggctgtgatgttggggcagcctatctcaatggtgctgccacaggtgatcggttatcggcttatggggaagcctcaccctctggtgacatccaccgacattgtcctcacgataaccaagcatctccggcaagtgggcgtagttggtaagtttgtggagttttttgggccgggcgtggctcagctcagcatcgccgacagagctaccatagcaaatatgtgtcctgagtatggcgccactgcagcctttttccctgtggacgaggtgagcatcacctatctggtacagacaggccgagacgaggaaaagcttaaatacattaagaagtacctccaagctgttggaatgtttcgcgatttcaatgaccctagtcaagatcccgatttcacgcaggtcgtggagctggacctgaagaccgttgtgccttgttgtagcggacccaagcggccacaggacaaagtagcagtctccgatatgaaaaaggactttgagagctgtctgggggcaaaacaaggctttaagggatttcaggtcgccccggaacaccataacgatcacaaaacttttatatacgataatacggaattcaccctcgcccacggaagcgtggtgatcgctgcaatcacaagctgcacaaatacgtctaacccgagcgtgatgctgggcgcaggcctgctcgcgaaaaaggccgtggacgccggactcaacgtgatgccctacatcaagacatccctgtcaccggggtctggtgtggtgacatattatctccaagagtctggcgtgatgccttacctatcccaattgggcttcgacgtcgttggctacggatgtatgacttgcatcggcaactccggccctctgcccgaaccagtagtagaggctatcacccaaggagacttggtggctgtgggcgttctctccgggaatcgcaactttgaagggagagtccaccccaacacacgggcaaactatctcgccagcccaccactcgtgatcgcttacgccatagccgggaccattaggatcgattttgaaaaggagccgctcggggtcaacgccaaggggcagcaggtgttcctgaaggacatttggccaactcgagacgagattcaggctgtcgaacggcaatacgtcattcccgggatgttcaaggaggtttatcagaagattgaaactgtgaacgagtcctggaatgccctcgctaccccctcagataaactctttttctggaattcaaagtcaacctatatcaagagtccgccctttttcgagaatctaactctggatctgcagccaccaaaatccattgttgatgcctacgtactgctgaacctgggtgactccgttacaaccgaccacatatccccagcaggcaacatcgctaggaactccccggctgctaggtatttgacaaatcggggcttgacacccagggagttcaatagctacggttccagaaggggcaatgacgctgtgatggcccgtgggacatttgccaacatcaggcttctgaacagatttttgaacaaacaggcccctcagactatccacctcccttcgggtgaaattttagacgtgttcgacgctgccgaaaggtaccaacaggccggcttgccactgatcgtccttgccggaaaggagtatggggccgggtcgtccagagactgggccgccaagggaccattcttgcttgggatcaaagcagtactggccgagtcatacgaacgcattcacagaagcaacttggtcggtatgggtgtgattccactggagtacttacctggggaaaatgccgatgcactcgggctaaccgggcaggagagatatacaattattatacccgagaacctgaagccacagatgaaagtccaggttaaactcgatactggaaagacctttcaagctgttatgagatttgacacagatgtggaacttacatactttctgaacggtgggattttgaactatatgattcgcaagatggccaaatag

SEQ ID NO: 177642 - DNA, 1305 bp, Artificial Sequence
  Description of Artificial Sequence: Synthetic coding sequence
atgagcaaccccttcgcccacctggccgagcccctggaccccgtgcagccggggaagaagttcttcaacctcaataaactagaggattccagatacggacgcctccccttctctattcgtgtgctgctagaggccgcaattcgcaactgcgacgagtttctggtaaagaagcaagacatcgagaatatcctgcattggaatgtgacacaacacaagaatattgaggtccccttcaagcccgccagggtcatcctgcaggattttacaggagtccccgcggtcgtggattttgctgctatgcgcgacgccgttaaaaagctggggggggaccctgaaaagattaatcctgtgtgtccggccgacctcgttattgatcactccattcaggttgacttcaataggagggcagattccctccagaagaaccaagatttagagtttgaacggaaccgggaaagattcgagtttctaaagtggggcagccaagcattccataacatgaggatcatacccccaggctctgggataatccaccaggtgaacctggagtacctggcaagggttgtcttcgatcaagatggctactactaccctgattctcttgtgggtaccgattctcataccacaatgatagacggcctaggaatcctgggatggggcgtgggaggaatcgaggccgaggcggtgatgctgggccagcccatcagcatggtgctgccacaggtgatcggctacaggctgatgggcaagccccaccctctcgtgacctcaacagacattgtgctgacaataaccaagcacctgaggcaggtgggagtagtgggcaaatttgtggagtttttcggccccggggtggcccagcttagtattgctgaccgggctaccatcgccaacatgtgtcccgagtacggcgccacagccgcctttttccctgtcgacgaagtatcaataacttatctcgtgcaaactgggagggatgaagagaagctgaaatacatcaagaaatatctgcaagccgtggggatgttcagggactttaatgaccccagtcaggacccagatttcacccaggttgtcgagctggacctgaagaccgtcgtgccatgctgcagtggcccaaagcggccccaggataaggttgccgtctccgacatgaaaaaggacttcgaaagctgcctcggcgcgaagcagggctttaagggcttccaagtggcacccgagcatcataatgatcacaagacttttatttatgacaataccgaattcacactagcacatggcagcgttgtgattgccgccctctag

SEQ ID NO: 177643 - DNA, 2670 bp, Artificial Sequence
  Description of Artificial Sequence: Synthetic coding sequence
atgagcaaccccttcgcccacctggccgagcccctggaccccgtgcagcctggaaagaaatttttcaacctaaataagcttgaagactctcgctatggcagattgcctttttcaatcagggtgctgctggaggcagccataaggaactgcgatgaattcttggttaagaaacaggacatcgaaaatatcctccactggaatgtgacacagcataagaacattgaagtgccatttaaacctgctcgggttattctccaagacttcacaggagtccctgccgtcgtggacttcgccgccatgcgtgacgcagttaaaaaacttggaggtgacccagagaagattaaccccgtttgcccagcggatctggtgattgatcattcaatccaagtcgactttaaccgacgggccgattcacttcagaagaatcaggacctcgaattcgagcggaatcgtgaacgatttgagttcttaaagtggggctcccaggcttttcacaatatgcgcattattcctccagggtccgggataatccaccaggtgaatttagaatacctggcacgggttgtgtttgaccaagatgggtactactacccagactctttggtggggacagacagccacactactatgatcgatggattaggcatactgggatggggcgttggcgggatcgaggctgaagcggtgatgctcggacaacctattagcatggtacttcctcaggttatcggttaccggcttatgggcaagccccatcctcttgttacttccactgacatcgttctaactattactaagcacctgcggcaggtgggagtggtcggaaagttcgtggaattttttgggcccggggtggcccagctgagcatagcagatagagcaacaatcgccaatatgtgtcctgagtatggcgctacggccgcgttcttcccagtagatgaggtgtctattacctatctggtgcagacagggagggacgaagaaaagttgaagtatataaagaagtacttgcaagccgtggggatgtttcgtgattttaatgatccaagccaggatcctgatttcacgcaagtggttgaactcgaccttaaaactgtggttccttgctgtagcggcccaaaaaggccacaggataaggtcgccgtctctgatatgaagaaagacttcgagtcctgcttgggggcaaagcaggggtttaaaggctttcaagtggcacccgagcaccacaacgatcacaagacatttatatacgataatacagaattcaccctcgcgcatggaagcgtggtgatagccgcaatcacgagctgcaccaacacttccaaccctagcgtgatgctcggtgctggcttgctggccaaaaaagccgtcgatgccggcctgaacgtcatgccctacattaagacctctctaagtcccggctctggggttgtgacctattatttgcaagaatctggcgttatgccgtacctatcacagctaggctttgacgtggtcggatacggctgcatgacttgtataggcaattccggaccacttccggaaccggtggttgaggccattacacagggtgatctcgtggccgtgggtgttctttcaggcaatcgcaacttcgaaggaagggtgcaccctaatacacgggcaaattacctcgcctcccctcctctcgtaatcgcctatgcaatcgcaggtacaatacgcattgactttgaaaaggagcctcttggtgttaacgcaaaaggacagcaagttttcttgaaagatatctggcctacacgagacgagatacaagctgtggagagacaatatgtcatccctggcatgttcaaggaggtatatcaaaagatcgagaccgtcaatgaaagctggaacgcactggctaccccttcagataaattatttttctggaattcaaaatctacctacataaagtcacccccattttttgaaaatttaactctcgatcttcagcctcccaagagcatcgtggatgcttacgttctgttgaatctgggagactctgtcacgacggaccatatctcgcccgccggaaacatcgcacgaaactcacctgccgcccgctatctgaccaaccgtgggttgacgcctagagaatttaactcctatggaagccgccgcggtaatgatgcagtcatggctcgggggacatttgccaatattaggctgctgaatagatttctgaacaaacaggctccccagaccatccacttgccctcaggcgaaatcctggatgtatttgacgccgcggaaaggtatcagcaggcaggattacctctcatcgtgctggcgggcaaggagtacggcgctgggtccagcagagactgggccgccaaagggccattcctcttggggattaaggccgtcttagccgagagctacgagcgcattcataggtctaatcttgtcggaatgggtgtaatcccgctggaatatctgccaggcgagaacgcagacgcactcgggctaacgggacaggagagatacactatcatcatccccgagaacctgaaacctcaaatgaaggtacaagttaagctcgacacgggcaaaacattccaagctgtcatgcggtttgatactgacgtggaactgacctattttctgaatggcgggatcctcaattatatgatcaggaagatggctaagtag

SEQ ID NO: 177644 - DNA, 2346 bp, Artificial Sequence
  Description of Artificial Sequence: Synthetic coding sequence
cagctggagccccggagcgcccgggagcgggtgcccctgctgggcagcggttctccagtggcgggcgcgcccccctgctccaggaggaatacttggccgtccgtgataatgtcaaacccgttcgcccatctggccgagcccctggatcccgtgcagccaggaaagaaattcttcaatctgaataaactggaggattcaagatatggaagactgcccttttcaatccgagtcttgctggaagctgcaatcagaaactgcgacgagttcctcgtgaagaagcaggatattgagaatatcctccactggaacgttactcagcacaaaaacattgaggttccttttaagcctgcccgggtaattctacaggactttaccggcgtcccagcagtcgtagattttgccgcgatgagggacgccgtgaagaaactgggaggggaccccgaaaaaatcaacccagtgtgccctgccgacttagtcatcgatcactctatccaggtcgactttaacaggcgagccgacagcctgcaaaaaaaccaagatctagagtttgagcgcaacagggaacggttcgagtttctcaagtgggggtcacaggcctttcataacatgaggattatcccccccgggtcaggcataatacaccaggtaaacctggagtacctggcccgtgtcgtatttgaccaggatggatactattatcccgattcactcgttggcactgactctcacaccacgatgatcgacgggctcggtattttaggctggggagtggggggcattgaggcagaagccgttatgctgggacagccaatttccatggtgctcccacaggtcattggttaccgccttatgggcaaaccccatccactggttacaagcacagatatagtgctcacaattaccaaacatttacgccaagtcggggtagtcgggaaatttgtggaattctttggacctggcgtggctcaactgtctattgccgatcgtgccacaatagcaaatatgtgtcctgagtacggcgccactgctgcttttttccccgtggacgaggtctccattacatacctggtgcaaactggccgggatgaggagaagctgaaatatattaaaaagtacctgcaggccgttggcatgttccgggacttcaacgatccttcacaggatcccgacttcacacaggtggtagaacttgatctgaaaacggtggtgccttgctgttccgggcctaagagaccccaggacaaggtcgccgtgagtgacatgaaaaaagactttgagtcatgcctcggagcaaaacaggggtttaagggcttccaggtggcacctgagcatcacaatgatcacaaaactttcatttacgacaacaccgagtttactctggcacacggcagtgtagtgattgctgcaattacatcatgcacaaacactagtaacccctccgtcatgttgggggccgggctcctcgccaagaaggctgtagatgccggtctcaatgtcatgccttacatcaagacatcattgtctcctgggagcggggtggtcacctattatctgcaggagagcggagtgatgccctatctgagccagctcggcttcgatgttgtcggctatggttgcatgacatgtatcggcaattcaggccctcttcctgagcctgtcgttgaggccattactcaaggcgacctggtcgctgtgggagtgctgagcggcaaccgcaattttgaggggcgagtgcatccaaataccagagccaattacctcgcatcgcctcccctggttatcgcttacgcgattgccggaaccattcgtatagactttgaaaaggaaccactcggcgtcaacgctaaaggacaacaggtattcctgaaagacatttggcctactcgcgacgaaatccaggccgttgagagacagtatgtgatcccagggatgttcaaagaagtgtatcaaaagatagaaacggttaacgagagttggaacgcccttgctactccatccgataagcttttcttctggaattccaagagcacctacattaagtccccccctttcttcgagaacctgacgctggacctgcagccccccaagtccatcgtagatgcttacgtgctactcaatctcggagactcagttaccactgaccacatctcacccgctggaaatatcgcccggaattcccctgccgctcgttacctgaccaataggggtttcgagcggcaattaacccaggaaaacaccgatctatgcctgagcccacccctcctgacgagcctttctagcccactgaaactgtgggggcagttgttctgtcacggcgagcagtgtctcggcgatctggagaaatag

SEQ ID NO: 177645 - DNA, 2373 bp, Artificial Sequence
  Description of Artificial Sequence: Synthetic coding sequence
atgcgggacgccgtgaagaagctgggcggcgaccccgagaagatcaaccctgtgtgccccgcagatctagtgattgatcactccattcaagtagatttcaataggcgcgcggatagccttcagaaaaaccaagacctcgagtttgagaggaacagagagcgatttgagtttctgaagtggggatcacaggctttccataacatgcggattatccccccaggctccggaataatacaccaggtgaatctggagtatctcgcgagggtggtgttcgatcaggacggctactactatccagattccctcgtgggcaccgactctcacacaacaatgatagatggtctaggtattctcggctggggcgtgggtggcattgaggccgaagccgtgatgctcggacagccaatcagtatggttctaccccaggttatcggctatagactgatgggcaagccgcacccgcttgtaacctccaccgatattgttctgacaatcacgaagcacttgaggcaagtaggggtggtcggcaaattcgttgagttctttggaccgggcgtcgcccagttgagcatcgctgaccgggctacaattgctaacatgtgtcctgaatatggagctaccgctgcattttttccagtggatgaagtctccattacttatctagtgcagacgggccgagatgaggagaaactaaagtacatcaaaaaatacttgcaggcggtgggcatgtttagggattttaacgacccaagccaggatcccgatttcacacaggtggttgaactggacctgaagaccgtggtcccctgctgctccggacccaaaaggccccaggataaagtcgctgtaagcgacatgaaaaaagatttcgaaagctgtctcggtgccaaacagggattcaaaggatttcaggttgctcccgaacatcataacgaccacaagacttttatctacgataacacagaattcactctggcccacggcagcgtggtgatcgcagccataacatcatgcactaacacaagcaatcccagcgttatgttgggggctgggctgttggccaagaaagctgtggatgcaggactgaacgtcatgccttacatcaaaaccagcctgtccccaggtagcggtgtcgtgacgtattatctacaggagtctggcgtcatgccgtatttgagccagctgggtttcgatgtcgtggggtacggctgtatgacctgtattgggaactctggacctctcccggaaccggtggtggaagccatcacccagggcgacttggtcgcagtgggagtcttgtctggcaacagaaactttgaagggcgggtgcaccccaataccagagcgaattatctggccagtccccctctggtgatcgcctacgccatagccggaacgatccggatcgacttcgagaaggagcctttgggtgtgaacgccaaggggcagcaggttttcctaaaagatatctggccgacccgcgatgaaatacaggccgtcgagagacagtacgtaatccccggcatgttcaaggaagtgtatcagaaaatcgaaacagttaacgaatcctggaacgccctcgccacaccctccgacaagctgttcttctggaacagcaagtcaacttacattaagtcccctcccttcttcgaaaacttgaccttggacctccagcccccgaaaagtattgtcgatgcatacgtgctacttaaccttggagactccgtcactacggatcacatctcccctgccggaaacatcgccagaaacagccccgcggcccgctatctaactaatcgcggactgactccacgcgaattcaattcttatgggagtcgccgcgggaacgatgccgtgatggcaagaggaacttttgcaaacatccgcttgctcaaccgctttctgaacaagcaggccccacagaccatccatttgcccagtggagagatactcgatgtattcgatgctgccgagaggtatcagcaagccggacttcccttgatcgtgctggcaggtaaagaatacggcgctggtagctccagggactgggcagcaaaagggccctttctgctcggcatcaaggccgtgctggccgagtcctacgagcgtatccacagaagcaatcttgtcggcatgggagtgattccactggaatatctgcctggtgagaatgccgacgctctgggcctgactggccaggagaggtataccatcatcatcccggagaacctgaagcctcaaatgaaagttcaggtgaaactggatacaggcaagacctttcaagccgtgatgagatttgatacagatgtggagctaacctacttcctcaatggagggattctgaattatatgattaggaagatggcgaaatag

SEQ ID NO: 177646 - DNA, 333 bp, Artificial Sequence
  Description of Artificial Sequence: Synthetic coding sequence
atggccaagcaccaccccgacctgatcttctgccggaagcaggccggtgttgccatcggccggttgtgcgaaaagtgcgacgggaagtgtgttatttgcgattcctacgtgcggccctgtactttggtgcgtatttgcgatgaatgcaactacggtagctaccaggggagatgcgtaatatgcggcgggcccggcgtgtcggacgcatactactgtaaggagtgtaccattcaggaaaaggatcgcgacgggtgtcccaagattgtgaatttgggctcttccaagacagatctgttctacgagcgcaagaaatacggcttcaagaaacgatag

SEQ ID NO: 177647 - DNA, 2418 bp, Artificial Sequence
  Description of Artificial Sequence: Synthetic coding sequence
atggccccctacagcctgctggtgacccggctgcagaaggccctgggagtaaggcagtatcatgtcgccagcgtgttatgtcaaagggcaaaagtcgccatgtcccattttgaacctaacgagtatattcattacgatctgctggagaagaacatcaatattgtgaggaaaaggctcaaccggccgctgaccttgtctgagaaaatcgtgtatggtcacctggatgaccctgcctctcaagaaattgaaaggggtaagtcatacctgaggctgcgccccgacagggtcgcaatgcaagacgccaccgcacaaatggcaatgctgcagttcataagctcaggcttaagcaaagtggccgtgccatcaacaatccactgtgaccacctcattgaggctcaagtcggaggtgagaaggatttgcggagagccaaggatattaatcaagaggtgtataactttcttgctacagccggagcgaagtacggagtcggattttggaagccaggatccggaattatccaccagatcattctcgagaattacgcctacccaggcgtacttctaatcggcacggactcgcatactcctaacggaggcggcctcggagggatctgcatcggagtagggggggccgacgccgtggacgtgatggccggcatcccgtgggagctgaagtgtcctaaagtgattggcgtaaaactgactggcagcctctcaggttggtccagccctaaagacgtaatcctgaaggtcgccgggatcctaactgtgaaggggggaactggggccatcgtcgagtatcacggccccggcgtagattctattagctgcacaggtgaggagggagggcaggctacctggcctttgccctgcgccgggccggacgggagcccagtgggctcgaggtctgggatggccaccatctgtaacatgggcgctgagatcggggccaccacgtccgtcttcccctacaatcacaggatgaaaaaatacctgagtaagacgggacgtgaagacattgcaaatttggctgacgaatttaaagaccacctggtccccgaccctggctgccactatgatcagctcattgaaatcaatctctcggagctgaaaccacacatcaacgggccattcacccctgacctggcacaccccgtcgctgaggtcggaaaggttgctgagaaagagggctggccccttgacattagagtcggcttaattgggagctgcaccaatagcagttacgaagacatgggaaggagcgccgccgtcgctaaacaagctctggcccacggactcaagtgtaagtctcagttcacaattaccccgggatctgaacaaatccgcgccacaatagagcgggatggttatgcgcagattctgagggacttgggcgggattgtcctcgccaatgcctgtggcccttgtattggacaatgggaccggaaagacattaagaagggggagaaaaacaccatcgttacatcttacaaccggaacttcacagggaggaatgatgctaatcccgagacgcatgcctttgtgaccagcccggaaatcgttactgccctcgctatcgcagggactctgaaattcaacccggaaacggattacttgacaggtaccgacgggaagaagtttagactggaagcaccggatgccgatgagctgcctaagggtgagttcgacccagggcaggacacttaccagcaccctcccaaagattcatctggacagcacgtagatgtcagccccacctctcagcggctgcagctgctggagccattcgacaaatgggatgggaaggacctggaggaccttcagatactgatcaaagtcaagggaaaatgtactacagaccacatctccgctgccggaccctggcttaaatttcgcggtcatttggataacatcagcaacaacctcctgattggggccattaatatagaaaacgggaaagcgaactctgttcggaatgctgtaactcaggagtttggacctgtgccggataccgcacggtactataagaagcatgggattcggtgggtggtgataggcgatgagaactatggagagggttcgtcacgggagcatgcagctctcgagccacgacacctcggtggtcgcgccatcattaccaaaagttttgccagaatccatgagaccaatcttaaaaaacaggggttgctccctcttaccttcgccgacccggcagattataacaagatccacccagtggacaagctgaccattcaggggttaaaggactttactcctggcaaacccctgaaatgtattatcaagcaccccaacggaactcaggaaacaatattgctcaatcacacgttcaatgaaacacagattgagtggttccgcgcagggagtgctctcaacagaatgaaggaactccagcaatag

SEQ ID NO: 177648 - DNA, 1506 bp, Artificial Sequence
  Description of Artificial Sequence: Synthetic coding sequence
atggccaccatctgcaacatgggcgccgagatcggcgccaccacctcagtcttcccttataatcatagaatgaaaaaatatctgtctaaaacagggcgggaggacatcgccaacttagccgacgaattcaaggatcatctcgtccccgatcctgggtgccattacgaccagctgatcgaaatcaatcttagcgagctcaaaccgcatataaatggccctttcacccccgacttagcccatccagtggctgaggtggggaaggttgccgaaaaggaagggtggccactggacatccgggtaggcctgatcggttcgtgtactaacagcagttatgaagatatgggccggtcggccgcagtcgctaagcaagcccttgcacacggactgaagtgtaagtcccagtttactattacccccggcagcgagcagatccgtgccaccattgaacgcgacggctacgcacaaatactgagggacctggggggtatcgtgctggcaaacgcgtgcggtccttgcatcgggcagtgggacaggaaagacatcaaaaagggagaaaaaaatacaatagtgacatcctataaccggaacttcacgggtaggaatgacgcaaatccggagacgcatgctttcgtgacaagccccgaaattgtcacagcattagccatcgcggggacccttaaattcaaccctgaaaccgattatttaacgggaaccgatggcaagaaatttagactcgaggctcccgacgccgatgagttgccaaaaggcgagttcgatcccggacaagacacataccagcatcctcctaaggactctagcggccaacatgtggacgtcagcccaacttctcagcggctgcagctgctggaaccctttgacaagtgggatggcaaggatctggaagacttgcagatcttaatcaaagtaaagggcaaatgtacgacggaccacatctcggcagccggcccatggctgaagtttcgaggtcacctggacaacatcagcaacaacttactcattggagcaattaatattgagaacggcaaagctaactccgtgcgtaacgccgtaacccaggaatttggccctgtcccagataccgctcgttattataaaaaacacggcatccgctgggtggtgattggagacgaaaattacggagaaggctctagcagggagcacgccgctctggaaccgagacacctgggaggtagagctattatcacaaagtcctttgcccgcatccacgagaccaatttgaagaagcaggggctgcttccgctgacgttcgctgaccctgccgactataacaaaatacaccctgtagacaagttaaccattcagggcctaaaggattttacaccaggtaagcctctgaagtgcattataaaacatccgaacggtacccaggagactatcttgttgaatcatactttcaacgagacccaaatcgaatggtttcgtgccggcagcgcgctgaaccggatgaaggagctccagcagtag

SEQ ID NO: 177649 - DNA, 2286 bp, Artificial Sequence
  Description of Artificial Sequence: Synthetic coding sequence
atggccccctacagcctgctggtgacccggctgcagaaggccctgggcgtccgtcagtatcacgtggccagcgttctttgtcagagagccaaggttgctatgagccactttgagcctaatgagtacatccattatgatctattagaaaagaacatcaacattgttcgaaagagactgaatcggcccctgactctgagtgaaaagattgtctacggtcatctggatgaccctgccagccaggaaatagagcgaggcaaatcttatctgagactccgccccgacagagtggctatggtcgccgtcccaagtaccattcactgtgaccatcttattgaagcccaggtgggcggcgagaaggatctgaggcgcgcaaaggacataaatcaagaggtgtacaactttttggcaactgcaggggctaaatatggtgtggggttctggaaaccaggctctggcatcattcatcaaataattctcgaaaactatgcttatccaggtgtgctcttgattggtaccgactcgcacactccgaatgggggaggtttgggcggaatctgcatcggcgtggggggcgctgatgcagttgatgtgatggctgggataccttgggagctcaaatgccccaaggtgatcggagtgaagctgaccgggagcctctcaggttggagctcccctaaggatgtgatcctgaaagttgctggcattctcacagtgaaaggtgggactggcgcgattgtggagtaccacggcccaggtgttgacagcatttcatgtactggcatggctactatttgcaacatgggcgccgaaattggggctactacatcagtcttcccttataaccatagaatgaaaaagtatctgtcgaaaacggggagggaggacattgcaaatcttgcagatgaatttaaggatcacctggtacctgaccccggctgtcactacgaccagctcatcgagatcaatctcagtgagctgaagcctcatattaacggacccttcacccccgatctggcacatccagttgcagaggtgggaaaagtcgccgagaaggagggttggccgctggatatcagagtcggcttgattggaagctgcacaaattcatcctacgaggatatgggacgctctgctgctgttgccaaacaggcgttggctcacggattgaagtgcaaatcccagttcacaatcaccccggggtccgaacagattcgggctaccatcgagagggatggctacgcacagattctgcgggatttggggggcattgtactggctaatgcatgcgggccatgtattggacagtgggatagaaaggatattaagaaaggggagaaaaacactatcgtaacgtcttataataggaactttacagggaggaatgatgccaaccccgagacccacgcattcgttaccagccctgaaatcgtcactgccctggcgatcgctggcacccttaagtttaatcctgaaacggactacctgacggggactgacgggaagaagtttcgactggaagccccagatgccgacgagcttcctaagggggaatttgaccccggccaggacacttaccagcaccctccaaaggactcatctggtcagcatgtcgacgtgtccccgacaagccaaagattgcagctgctagagccctttgacaaatgggacgggaaagatctagaagatttgcagatcttaattaaagtcaaagggaagtgtacaactgaccatatttcagcagccggaccttggttgaaattccggggccacctggacaatatcagtaataacctgttgataggggctatcaatatcgagaacgggaaggccaattccgttcggaacgccgttacgcaggagtttggacctgtaccagataccgctaggtattacaagaaacacgggataagatgggtcgtgatcggtgacgagaattacggcgagggatcttctcgcgagcacgcagcgctagagccgagacacttaggggggcgggcgattattaccaagagctttgccagaatccatgagaccaatctaaagaagcagggcctgttgccattgacattcgctgacccagccgattacaacaagatccacccagtggataagctgaccatccaggggctgaaggacttcactcccggcaagcccctgaagtgtatcatcaagcatcccaatgggactcaggagacgattctgctgaaccacacctttaacgagactcaaatagagtggtttcgggccggtagtgccctcaatagaatgaaagaattgcagcagtag

SEQ ID NO: 177650 - DNA, 756 bp, Artificial Sequence
  Description of Artificial Sequence: Synthetic coding sequence
atggagctgagcgccatcggcgagcaggtgttcgccgtggagagcataagaaagaagcgggttagaaagggcaaggttgaatacctggtaaagtggaagggctggcccccaaagtatagcacctgggagcccgaggaacatatcctggacccacgccttgtaatggcgtacgaagaaaaagaggagcgtgatcgggcgtccggttacaggaagcggggacccaaaccaaagcgacttttgctgcaaaggctgtacagcatggatctgcgctcctctcacaaagctaaagggaaagaaaagctgtgcttctccttgacttgcccactcggatctggctccccagaaggggtcgtgaaggccggcgctccggagcttgtagacaaaggacctctggtacctactctgccatttcccctcagaaaaccaagaaaagctcataagtatttaagattgtccagaaaaaaattcccccccaggggccccaacctagagtcccatagccatcggagggagttattccttcaagagccgccagcccccgacgtcctccaggcagccggcgaatgggagcccgccgcacagcctcctgaagaggaggccgatgccgacctggcagaagggccaccaccatggactcccgcccttccgagcagtgaagtcactgttacggacatcactgccaattcaataacagttacttttagggaagcccaggcagccgagggtttctttagggataggagtggaaagttttag

SEQ ID NO: 177651 - DNA, 633 bp, Artificial Sequence
  Description of Artificial Sequence: Synthetic coding sequence
atgaaccggttcctgctgctgatgagcctgtacctgctgggcagcgctaggggaactagttcacagcccaacgagctcagtgggtctatcgaccaccagacaagcgtccagcagcttcctggggaaccagctgcaacagaacatgccgagggcgagcacacagtcggagagcaaccatcaggagagcagccgagtggcgaacatttgagtggagagcagccactgtctgaactggaatctggagagcagccctccgacgaacagccatctggggaacacggttcaggcgagcagccatcaggcgagcaggcttccggcgaacagccctctggggagcatgcctccggcgagcaggcctcgggcgcaccaatctcgagcactagtaccggtactattctgaactgttacacttgtgcatatatgaatgaccaggggaaatgtcttcgaggggaggggacctgtatcactcagaactctcagcagtgcatgctgaagaagatattcgagggagggaaactgcagttcatggtgcaaggatgcgaaaacatgtgtcctagcatgaatctattttcccatgggaccaggatgcagataatctgctgtaggaaccagtccttctgtaataagatttag

SEQ ID NO: 177652 - DNA, 741 bp, Artificial Sequence
  Description of Artificial Sequence: Synthetic coding sequence
atgaaccggttcctgctgctgatgagcctgtacctgctgggcagcgcgagaggcacgagttctcaacccaacgaactgagcggatcaatcgatcatcagaccagcgtccaacagctgcctggggagttttttagtctagagaatccctctgacgccgaggccctttatgaaacaagcagtggcctcaatacgctgagcgagcacggatcgtccgagcacgggtcctcaaaacacaccgtggccgagcacaccagcggggagcacgctgaatcagagcatgctagcggggagccagccgctaccgagcacgctgagggagaacacaccgtgggggagcaacctagcggtgaacaaccaagcggagaacacctctccggggagcaaccactcagcgaacttgagtctggcgaacagccttccgatgagcagcctagcggcgagcacggctctggggaacagccgagtggggagcaggcatcgggtgaacagccttccggcacgattctcaattgctatacttgtgcttatatgaatgaccaagggaaatgccttcggggggagggcacatgtattactcagaacagtcagcaatgtatgctgaagaaaatttttgaaggtggtaagcttcagttcatggttcaaggctgtgaaaacatgtgtcccagcatgaacctctttagccacggaacacggatgcagatcatttgctgccgcaaccagagcttctgcaacaagatctag

SEQ ID NO: 177653 - DNA, 468 bp, Artificial Sequence
  Description of Artificial Sequence: Synthetic coding sequence
atgaaccggttcctgctgctgatgagcctgtacctgctgggcagcgccaggggtactagctcccagcccaatgaactaagcggatcaatcgatcaccaaacatccgtgcagcagctcccaggggaacagccctccggcgagcaaccaagcggcgagcatctcagcggggagcagcctctgagtgagcttgaatcgggggaacagccttcagatgaacagcctagtggcgagcatggcagcggtgaacaaccatcaggcgaacaggccagcggggagcagcccagtggggagcacgctagcggagaacaggccagtggagcccctatttccagcacatctacgggaggtaagttacaatttatggtccagggctgcgagaatatgtgtccgtccatgaatctatttagccacggcacacggatgcagattatctgttgccgcaatcagagtttctgcaacaagatttag

SEQ ID NO: 177654 - DNA, 498 bp, Artificial Sequence
  Description of Artificial Sequence: Synthetic coding sequence
atgaaccggttcctgctgctgatgagcctgtacctgctgggcagcgcacgcggcactagttcacagcctaacgagctctctggtagcatcgatcatcagacttccgtgcagcagttgccaggagagccagcagcgaccgagcacgccgaaggggagcatacagtgggggaacagccttctggtgagcagccttctggcgagcacgcctccggggaacaggcgagtggggctcctatcagctcgactagtactggaacaatattgaactgctatacttgtgcctacatgaacgaccaaggtaaatgtcttcgcggagaaggaacgtgcattactcaaaattctcagcagtgtatgctgaagaagatcttcgagggtggcaaactccagttcatggtccaggggtgtgagaacatgtgcccatccatgaatctgttcagccatggaacaaggatgcagattatctgttgccggaaccagagcttctgcaataagatttag

SEQ ID NO: 177655 - DNA, 246 bp, Artificial Sequence
  Description of Artificial Sequence: Synthetic coding sequence
atgaaccggttcctgctgctgatgagcctgtacctgctgggcagcgccagagggacgtcaagtcagccaaatgagctgagcggcagcattgatcaccaaaccagcgtgcaacagctcccggggggcaaactccaatttatggtgcagggctgtgaaaacatgtgtcccagtatgaacctcttctcccacggcacacggatgcaaattatctgttgcagaaatcagtccttctgcaacaaaatttag

SEQ ID NO: 177656 - DNA, 366 bp, Artificial Sequence
  Description of Artificial Sequence: Synthetic coding sequence
atgaaccggttcctgctgctgatgagcctgtacctgctgggcagcgctcggggcacatcctcacagcccaacgagctgtctgggtccatcgaccaccagacctcagtccaacaactcccagggaccatcctgaactgttacacgtgtgcttacatgaatgaccagggcaagtgcttacgcggagagggtacttgtattacccaaaatagtcagcaatgcatgcttaaaaagatcttcgagggaggaaaactccagtttatggtccagggatgtgaaaacatgtgcccatctatgaatctcttttcccatggaacacgaatgcagattatctgctgtcgcaatcaatctttctgcaacaagatctag

SEQ ID NO: 177657 - DNA, 588 bp, Artificial Sequence
  Description of Artificial Sequence: Synthetic coding sequence
atgaaccggttcctgctgctgatgagcctgtacctgctgggcagcgcacgaggaacctcatcgcagcccaacgagcttagcggatctattgatcatcagacatctgttcagcaactacccggagagcagcctagtggcgaacaacctagtggagaacacctgagtggcgagcagccactcagcgagctagaaagcggcgagcaaccatccgatgaacagccaagcggagaacacggcagcggtgagcagccttccggagagcaggcttcgggcgaacagccctcaggcgagcacgcttcaggtgagcaggcatccggcgcgcccatttcttccacctcaacgggtactatactgaattgttatacatgcgcttacatgaatgaccagggtaagtgcctcagaggagaggggacatgcatcacacagaactcgcagcagtgtatgctgaagaaaattttcgaaggcggtaagctgcaatttatggtgcaaggttgcgaaaacatgtgtccatccatgaacctgttctcacatgggacgcggatgcaaatcatatgctgtaggaaccaatctttctgtaacaagatctag

SEQ ID NO: 177658 - DNA, 741 bp, Artificial Sequence
  Description of Artificial Sequence: Synthetic coding sequence
atgaaccggttcctgctgctgatgagcctgtacctgctgggcagcgcgagagggacctctagtcagccgaatgaactttcaggctcaatagaccaccagacatcagttcagcaactaccaggagagttcttctcactggaaaacccgtccgacgcagaggccttatatgagacttcaagcggcctgaataccctgtcagagcacggcagctccgagcatggctcctccaagcatacagtggcggaacacacatctggtgaacacgctgaaagcgagcacgcaagcggagagcccgccgctacagagcacgccgaaggcgagcataccgtgggggagcagccaagcggggaacagcctagcggcgagcacctgagcggcgagcaacctcttagcgaactggagtcaggagaacagccaagtgatgaacagccctctggggagcacggctctggggagcagccctcgggtgaacaggcttccggagagcagcccagtggaacgatactgaactgttacacctgtgcctatatgaatgaccagggcaagtgtttacggggggaaggaacctgcataacacagaattctcagcaatgtatgctcaaaaaaatttttgaaggcggcaagcttcagttcatggtgcagggatgtgaaaacatgtgtccttccatgaatctgtttagccatggcacaaggatgcaaattatctgctgccgaaatcagagtttttgtaacaaaatttag

SEQ ID NO: 177659 - DNA, 513 bp, Artificial Sequence
  Description of Artificial Sequence: Synthetic coding sequence
atgaaccggttcctgctgctgatgagcctgtacctgctgggcagcgcacgcggaacgagtagtcagcctaacgaactgtcggggtctattgaccaccagacatccgtgcagcagttacccggcgaacagccaagcgacgagcaaccatctggggaacacggatccggagaacagccttcgggagagcaagcatccggcgagcagcctagcggcgagcacgcctctggagagcaggcgagtggagcgcccatttccagcacctcgacgggcacaattttaaattgctatacttgcgcttatatgaatgatcaaggaaaatgtctgagaggcgaagggacttgtatcactcaaaattcccagcaatgtatgttgaagaagatctttgagggaggcaagctgcagtttatggtgcagggttgcgaaaatatgtgcccctcaatgaatctgttttcccatggaacaagaatgcaaatcatctgctgccggaatcagagcttctgtaataagatatag

SEQ ID NO: 177660 - DNA, 531 bp, Artificial Sequence
  Description of Artificial Sequence: Synthetic coding sequence
atgaaccggttcctgctgctgatgagcctgtacctgctgggcagcgcacgaggcaccagctcccagcccaatgagctcagcgggtctatagatcaccaaaccagcgttcagcaactccccggtgagcagccctctggggagcagccatcgggtgagcacctttcgggagagcagcctctctcagagctcgaaagtggcgagcagccgtccgatgagcagccttctggggagcacggaagcggcgagcagccgtccggggagcaggccagcggcgagcagccctctggcactatcctgaactgttacacctgtgcctatatgaatgaccagggaaaatgtttgaggggcgagggcacatgcattactcaaaattcccagcagtgcatgctgaagaagatcttcgagggcggcaaattacagttcatggtccaaggctgcgagaacatgtgtcccagtatgaacttgttctctcatggcacacgcatgcagattatctgctgtcgcaatcagagcttttgcaataagatctag

SEQ ID NO: 177661 - DNA, 588 bp, Artificial Sequence
  Description of Artificial Sequence: Synthetic coding sequence
atgaaccggttcctgctgctgatgagcctgtacctgctgggcagcgctagagggacgagctctcagcccaacgaactgtcaggttccatagatcatcagacaagcgtgcaacaattgccaggtgaacaacctagtggagagcaacctagtggagagcatttgagcggcgaacaacctctctccgaactcgaaagcggagagcaaccctctgacgagcagccttccggcgaacacggcagtggtgagcagcctagcggtgagcaggcaagcggtgaacagccatccggggaacatgcatcaggagagcaagcatcaggagccccgatttctagcacatcaacagggactattcttaattgctacacctgcgcctatatgaatgaccagggaaaatgcctccgcggcgagggaacctgcataacccagaacagtcagcagtgcatgctaaaaaagatcttcgagggaggcaagcttcagttcatggtgcaaggatgcgaaaacatgtgccccagcatgaacttgttcagccacggaacaagaatgcagataatatgttgccgcaatcagagcttttgtaataagatttag

SEQ ID NO: 177662 - DNA, 633 bp, Artificial Sequence
  Description of Artificial Sequence: Synthetic coding sequence
atgaaccggttcctgctgctgatgagcctgtacctgctgggcagcgcacgcggcacctcttctcagccaaatgaattaagcggctctatagatcatcaaacatccgtgcaacagttgcctggggagcccgcggccacagagcacgccgaaggagagcatactgtaggtgaacagcccagtggcgaacagccttccggagagcacttaagcggtgagcagcccctgagtgagcttgagagtggcgagcagccgtccgatgagcaacctagcggtgaacatggatctggcgagcagccctccggtgagcaggcgagcggggaacagccaagtggagagcacgcctcaggggagcaggcatcaggagctccaatctcttccacctcaaccgggacgattctgaattgctatacctgcgcttatatgaatgatcagggcaaatgccttcggggcgaggggacttgtattacacaaaactcacagcagtgcatgcttaagaagattttcgaaggggggaagctccagttcatggtacagggatgtgagaatatgtgcccaagtatgaatctgttctctcatggcacgcgcatgcaaatcatctgttgcagaaaccagtcattctgtaacaaaatctag

SEQ ID NO: 177663 - DNA, 798 bp, Artificial Sequence
  Description of Artificial Sequence: Synthetic coding sequence
atgaaccggttcctgctgctgatgagcctgtacctgctgggcagcgcccggggaacctccagccaaccaaatgagctttctggctccattgaccaccaaaccagcgttcagcagctgcctggcgagtttttttcattggaaaaccccagcgacgccgaggccctgtatgagacgtctagtggactcaatactctgtctgagcatggttcctcggagcacggatcatcaaaacacaccgtggctgagcacacttcaggagaacacgccgaatcagagcacgcttccggggagccagctgccacagagcacgctgagggagaacataccgtgggcgaacagcccagtggagagcagccttccggagagcacctgtccggcgaacagcccctctccgagttggaaagtggggaacaaccgtccgatgagcaaccaagcggcgaacatggatccggcgagcagcccagcggggaacaagcttccggagaacagccgtcaggagagcatgccagtggagagcaggctagcggcgcccccatctcatctacatcaacaggcactatcctgaattgctacacttgcgcgtatatgaatgaccagggaaaatgtctcagaggagagggcacgtgtatcacccagaactcccagcagtgtatgctcaagaagattttcgaaggcgggaagctacagtttatggtgcagggatgtgagaacatgtgtccatctatgaatcttttttcacacggcacacggatgcagattatttgctgtcgaaatcaatccttttgtaataagatttag

SEQ ID NO: 177664 - DNA, 1722 bp, Artificial Sequence
  Description of Artificial Sequence: Synthetic coding sequence
atgagcgccgtgagccagccccaggccgcccccagccccctggagaaatcacctagtacagcaattctgtgcaatacgtgcggaaatgtctgcaagggggaggttctccgagtgcaggacaaatatttccatatcaagtgcttcgtgtgcaaggcctgtggttgtgatctcgctgaaggcggcttctttgtgcgacaaggagagtacatttgcacgctggattaccagcggctgtacggtacacgttgcttcagctgtgatcagttcatagagggggaagtggttagtgccttgggcaagacatatcacccagactgtttcgtctgtgcagtctgtagacttccatttccacccggcgatagagtaacttttaatggaaaggagtgcatgtgtcagaagtgttccctgcctgtgagcgtcggttcctccgcacaccttagccagggcctccgcagctgtgggggctgtggcactgagatcaaaaacggtcaagctctggtggccctggataagcattggcacctgggctgcttcaaatgtaaatcttgtggtaagctgcttaacgcagaatacatatccaaagacggcctaccgtactgcgaggctgattaccacgccaaatttggtatcagatgtgattcctgtgagaaatatattacgggtagggtattagaggcaggcgaaaaacattaccatcccagctgtgccctttgcgtgcgctgtgggcagatgttcgcggaaggagaagagatgtaccttcaggggtcctccatttggcatcctgcctgtagacaggcagcaagaacagaggataggaacaaagagacacgcactagctcagagtcgattatttctgtgccagcgtccagcacctcgggaagcccatctcgggtgatctatgctaagcttggcggtgagatcctagactatcgcgacctggccgccctgcctaaatctaaagctatatacgacattgacagacctgatatgataagttactcaccttacatctcgcactctgcaggggaccggcaatcttatggggaaggcgaccaggacgataggagttacaagcagtgccgaacctctagcccttcctcaacaggtagtgtctcactgggtagatatacccctacatcacgctccccacaacactatagccggcccgggagcgaatcaggcaggagcactcccagcctgtcggtgctgtcagattctaaacctcccccctcaacctatcagcaagcacctaggcatttccatgtcccagatactggcgtcaaggacaatatttacaggaaacccccaatttaccgccaacatgccgcacgtcggtcagatggggaagacggtagcctcgatcaggacaaccggaagcagaagtcatcatggttgatgttaaaaggagatgccgacactcggacaaactcacctgatcttgacacacagtctctgtctcattcttccggaactgaccgggatcctcttcaaaggatggcaggagattcatttcactcacgcgagaaaatttacccttacgattctctgattgtgactaaccgcattagagttaagctgcctaaggatgtagatcggacccgactggagcggcacctgagtcctgaggagtttcaagaagtgttcggaatgtcaatcgaggagttcgatagactcgctctctggaaacgcaatgatttgaagaagaaagcacttctattttag

SEQ ID NO: 177665 - DNA, 1041 bp, Artificial Sequence
  Description of Artificial Sequence: Synthetic coding sequence
atgttcgccgagggcgaggagatgtacctgcagggcagcagcatctggcatcccgcctgccgtcaggcggcgcgcacagaggaccgaaacaaagaaacaaggacaagtagcgagagcatcatctctgtgcccgcgtcctcaaccagcggcagtcctagtagagtgatctacgcaaaactgggcggcgagatcctggactaccgggatctcgctgctctcccgaaaagcaaagctatctacgacattgacagaccagacatgatttcatactcgccctacatcagccactcagcaggagatagacagtcctacggcgagtcaccccaactcctaagcccgacgccaactgagggggatcaggatgacaggtcatataaacaatgtaggacatcaagcccgtctagcacggggagtgtaagtctggggaggtatacacctaccagcagatcaccacagcactacagtcgccccgacaccggagtcaaggataatatctaccgcaaacctcccatttaccggcaacacgccgcgaggagatccgacggcgaggacggcagtctggatcaggacaaccgtaagcagaagagttcttggctgatgctgaaaggcgatgctgacacccggacgaacagccctgacctggacactcaatctctgtcccacagcagtggcactgaccgagaccctttacaacgcatggccggagattctttccattcaaggttcccgtactctaaatcagatcccttgccgggccatgggaagaacggcctcgatcagcgcaacgccaatctcgcaccttgcggggctgaccctgacgccagctggggaatgcgggagtataagatctatccctatgatagcctaattgtcaccaaccgcatcagagtaaaattacctaaggacgtggatcgcacaaggctggagagacacctgtcccctgaggaattccaggaggtctttgggatgagcatcgaggagttcgacagactcgctctgtggaagcgcaatgatctaaagaagaaagccctgcttttctag

SEQ ID NO: 177666 - DNA, 1836 bp, Artificial Sequence
  Description of Artificial Sequence: Synthetic coding sequence
atgagcgccgtgagccagccccaggccgcccccagccccctggagaagtccccttccaccgcaatactatgtaacacatgcgggaacgtatgtaaaggcgaggtcttacgcgtacaggacaagtattttcacattaaatgttttgtgtgcaaagcttgtggctgcgatctggctgagggaggattcttcgtgcggcagggagagtatatttgcacccttgattaccagcggttatatgggactcgttgtttttcctgcgaccaattcatcgagggcgaagttgtctcagctcttggaaagacataccaccctgactgcttcgtctgcgctgtgtgtcggctgcccttcccaccaggagaccgagtgaccttcaatggcaaggagtgcatgtgtcagaaatgttcgctgcccgtgtcagtgggctcgtctgcccacctatcacaaggccttagaagctgtggaggctgcggaacggagatcaagaacggacaagcactggtcgccctcgacaagcactggcacctgggatgcttcaaatgtaagtcctgcgggaaacttcttaatgccgaatatatctccaaagacgggctcccttactgtgaggccgattaccacgccaaattcggcatcagatgcgatagttgtgagaagtacatcaccggcagagtcctggaggccggtgagaaacattaccaccccagctgcgccttatgcgtgcgctgtggccagatgttcgccgagggtgaagaaatgtacctccaggggagttccatttggcaccctgcctgtagacaagccgccaggaccgaggacaggaacaaagaaacgagaacctccagcgagagcatcatatccgtcccagcaagctctacgagtggttcaccatccagggtcatttacgctaaactgggaggggagattctggattacagagacctcgccgcactcccaaagagcaaagcgatctatgatatcgacagacctgacatgatctcttattctccatatatcagccatagcgcaggagatcggcagtcgtacggcgagggagatcaggatgatagaagctacaagcagtgcagaactagttcacctagctcaaccggtagtgtgagtctgggcaggtacacccctactagcaggtctcctcaacactattcaagaccagggagtgagtccggcaggtcaactccaagcctttcagtgttgagcgatagcaagccccctccgtctacctatcagcaggctccccggcatttccacgtacccgacacaggagtcaaagataatatttatcggaaaccccctatttaccgtcaacatgctgctcggcgcagtgatggtgaggatggatcgcttgaccaagacaaccgcaagaaatcgtcgtggctgatgctaaagggggacgccgacacccggaccaactctcctgatcttgacacccagagcttaagccattcttctggcacagaccgcgaccctttgcagaggatggcgggagactcattccactcacggtttccatatagcaaatctgatccactccctggacatggaaaaaatgggctcgaccaacgtaatgccaacctagcaccatgcggagcagacccggatgcctcatggggtatgagggaatacaaaatctatccctacgattctctaatagtgaccaaccggatcagggttaaactgccaaaggacgtcgaccgcacccgcctcgagcggcatctcagccccgaggagttccaagaggtgttcggcatgtccattgaagaattcgatcggctggccctgtggaaacggaacgatctcaaaaaaaaagccctcttgttttag

SEQ ID NO: 177667 - DNA, 1719 bp, Artificial Sequence
  Description of Artificial Sequence: Synthetic coding sequence
atgagcgccgtgagccagccccaggccgcccccagccccctggagaagtccccctctacggccatcctgtgcaatacctgcggtaatgtgtgtaagggcgaggtccttagggtccaggataagtacttccatatcaagtgttttgtctgtaaggcttgcggttgcgacttggccgaaggtggatttttcgtgagacaaggtgagtatatctgcacactggattatcagaggttgtacggtacccggtgtttttcctgtgaccagttcatcgaaggggaggtggtatccgcgcttggcaaaacctatcatccagattgttttgtttgcgccgtttgtcgtctgccttttcccccgggggatcgagtgacctttaatggcaaggagtgtatgtgccagaagtgttctctgccagtgtcagtggggagttccgcccatctctcacagggactgcgcagctgtgggggctgcggcacagaaataaagaatggacaggctctggttgctctcgataagcattggcacttaggatgctttaaatgcaaatcatgcgggaagcttctcaacgccgaatatatctccaaggacggcttgccctactgcgaggcggactatcacgccaaatttggcatcaggtgcgatagctgtgagaagtatatcactggcagggtactagaagccggtgagaagcactaccatccctcctgcgccttgtgtgtccgctgtggacagatgttcgcagagggggaagaaatgtatctgcaggggtcaagcatatggcaccccgcatgcaggcaggcagctcgtacagaggacagaaacaaagaaacccgcacgagtagtgaatctattataagtgtgccagcctcatccacgtccgggtccccaagccgagtgatctacgccaaactaggtggcgaaatactggactatcgggacctggcagcactccctaaatctaaagccatctatgacatagatcgcccggacatgatcagttactcaccctatatctcccacagtgccggcgacaggcaaagctacggtgagggcgaccaggacgaccgcagctataagcagtgccgtacttcttctccatcatccacgggctccgtgagtctcggaagatatacacccacgtcccggagcccgcagcactacagccggcccggcagcgaatctggccggtctaccccttccctcagcgtgctttcggattcaaagcccccaccctctacataccagcaggcacccaggcatttccacgtgcccgacaccggcgtgaaagataacatttaccgaaagcctccgatataccgccaacacgccgcaagaagatcagacggtgaggatggctccctggatcaggacaaccggaagaaaagttcctggctgatgcttaaaggcgacgccgacacccgcactaactctcccgatttagacactcagtccctcagccactcatccggcacagatcgagatcctttgcagagaatggcaggggattccttccacagtcagtacaaaatctacccatacgattccttaattgtgacgaaccgaatccgggtcaaactgcctaaggacgtggaccgcacccgtttagagaggcacttatctccagaagaattccaagaggtcttcggtatgtcgatcgaagaatttgaccggctggcgctgtggaagcgcaacgatctcaaaaagaaagcactgctgttctag

SEQ ID NO: 177668 - DNA, 1596 bp, Artificial Sequence
  Description of Artificial Sequence: Synthetic coding sequence
atgagcgccgtgagccagccccaggccgcccccagccccctggagaagagccccagcactgctatactgtgtaatacctgtgggaacgtgtgtaaaggtgaggttctgagggtacaggataagtacttccatattaaatgtttcgtatgcaaagcttgtgggtgtgatttggcggaggggggcttttttgtgcgtcagggcgagtatatttgcacattagactaccagagactgtatggcacccgctgttttagctgtgatcagtttatagagggagaggtggtatcagccctggggaagacgtatcacccagattgtttcgtgtgcgccgtctgtagacttccctttcctcctggggacagggtcacattcaacggaaaggagtgcatgtgccagaaatgtagcctgcccgtttccgtcgggagctctgcccacctgagccaaggcctgcgctcgtgtggaggatgcggcactgagattaagaatggccaagcactggtggctctcgacaagcattggcaccttggatgtttcaagtgcaaatcctgtggaaaactgttgaacgcagaatatatctcaaaagacggcctgccttattgcgaggctgactaccatgcaaaatttggcatcagatgtgattcctgcgagaaatacatcacgggcagggtcctggaagccggagagaagcactatcacccttcttgtgctctctgtgtaaggtgcgggcaaatgttcgctgaaggtgaggagatgtatctccagggatcttcgatatggcatcccgcatgtagacaggctgcccggaccgaggacagaaataaggagacccggacatcgagcgagagcatcatttccgtgcctgcttctagcacttctggttccccctctcgcgttatttacgcgaaactgggtggggaaatcctggattatcgcgatctcgctgcgttacccaaatctaaggccatctatgacatcgataggccagacatgatttcctattctccgtatattagccatagcgcaggagacaggcaatcatatggtgagagtcctcaactcctttcgcccactcctacagagggcgaccaggacgaccgttcttacaaacagtgcaggacaagcagtccatcttctaccgggagcgtaagcctaggtaggtataccccaacttcacggtctccacagcactattcccggccagctgccaggcgatctgacggggaagatggcagcctggatcaggataataggaaaaagtcatcctggttgatgctcaagggcgacgccgataccaggaccaactctcctgacctcgatacgcagtcactgtcgcattcgagtggaactgatcgcgaccccctgcagaggatggccggcgactcattccactctcaatacaaaatctatccatacgacagcctgatcgtgaccaatcgcatcagggtgaaacttcctaaggacgtggaccggacacgcctagaacggcatctctccccagaagaatttcaggaagtgttcggtatgtcaattgaggagttcgatagattggccctgtggaagcggaatgaccttaaaaagaaggccctccttttttag

SEQ ID NO: 177669 - DNA, 1935 bp, Artificial Sequence
  Description of Artificial Sequence: Synthetic coding sequence
atgagcgccgtgagccagccccaggccgcccccagccccctggagaaaagtccttccacggctatcctctgcaatacatgcggcaacgtttgcaaaggggaggttttgcgggtgcaggacaagtatttccatattaaatgtttcgtgtgcaaagcgtgtggatgcgatttagccgagggagggttctttgtcagacaaggggaatatatatgtaccctggattatcagcgcctgtatggaactagatgtttcagctgcgaccagtttattgaaggggaggttgtcagcgctctggggaaaacatatcaccccgactgtttcgtatgcgccgtgtgtagactgccttttccaccaggcgaccgcgtgacctttaatggcaaggaatgtatgtgccagaaatgctccctgcccgtatctgttggctcatccgcacatctctctcaggggttacggtcttgtggcggatgcggtaccgaaattaagaatggccaggcacttgttgctctggacaaacattggcaccttggatgcttcaaatgcaagtcatgcggtaaacttctcaacgccgagtatattagtaaggatggcctcccatattgcgaagctgactaccacgctaaattcggcataaggtgcgacagctgtgaaaaatacataactggcagggttctggaggctggggagaagcactaccatcccagctgcgccctgtgtgtgaggtgcggacagatgttcgcagaaggcgaagagatgtacctgcaagggagctccatctggcaccctgcgtgccgccaggccgcgcggactgaggaccgaaacaaggagacaaggaccagttctgagtccataatttccgtgcccgcaagtagcacgagcggaagtccatcaagggtgatctacgcgaagttaggaggtgaaatcctggactatagggacctcgccgcgctccctaagtccaaagcgatatatgacatcgacagaccggacatgatctcttatagtccatacattagccattcagcaggcgacaggcagtcttacggagaaggggaccaggacgataggagttacaagcagtgtcggacgagtagtccaagttccaccggttccgtgagcttggggcggtatacccctacaagtagatccccccagcattacagcaggccagccggaaccgtctccgtcgggacctctagctgcctctctttgtcgcagcaccccagccccacttcagtctttcgtcaccactacattccatattttcgggggagtgagtctgggcgcagtaccccttccctgtcagtcctctctgactctaaacccccacctcctcccaccagtcgccatctcgcaactcatgttcccgacactggagtaaaggacaacatctatcgaaaacctccaatttatcgtcagcacgcagccaggaggtctgatggggaagatggatcccttgaccaggataacaggaaacagaaaagcagctggctcatgcttaaaggcgacgccgacacccgcaccaatagcccagatctggacactcagtccttgagtcattcctcagggacagacagagatcccttgcaacgcatggctggagacagcttccactcgagatttccttattcaaagtccgacccgctaccgggccatggcaaaaatggactggatcagaggaatgcaaatctcgcgccttgtggagccgacccagacgcaagttgggggatgcgcgaatacaagatatatccctatgactcactgattgtgaccaaccgcatcagagtgaaacttcctaaggatgttgaccggacccgtctagaacggcacttgagcccggaggagttccaggaggtattcggtatgtccatcgaagagttcgatagactggcactgtggaaacgcaatgacctaaagaagaaagcactgctcttttag

SEQ ID NO: 177670 - DNA, 1566 bp, Artificial Sequence
  Description of Artificial Sequence: Synthetic coding sequence
atgagcgccgtgagccagccccaggccgcccccagccccctggagaaatcacccagcacggcaatactttgtaacacctgcgggaatgtatgtaagggcgaggtgctgagagttcaggacaagtatttccacattaagtgcttcgtttgcaaagcatgcggctgtgacctggccgaggggggcttcttcgttagacaaggggagtatatatgtacccttgactaccaaaggctgtacggaactcgctgtttttcttgcgatcagtttatagagggggaagtggtatcggctctcggcaagacctatcaccccgattgcttcgtgtgtgccgtttgtcgactcccattcccacccggcgatcgagtgaccttcaacggaaaggagtgtatgtgccagaagtgttctcttccagtaagcgttggctcttcagcacacctctcccagggcctacgcagctgcggtggctgcggtacagaaataaaaaatggacaggccttggtagctctggataagcactggcacctgggctgcttcaagtgtaaatcctgtggtaaactactaaatgccgagtacatcagcaaagatggactgccttactgcgaagccgattaccacgccaaatttggaatccgctgcgactcctgtgaaaaatatattaccggcagagttctggaggctggcgaaaagcactatcacccaagctgtgccctttgtgtgcggtgcggccagatgtttgccgagggtgaggagatgtacctccaggggagttctatatggcatcctgcctgtagacaagccgctaggacagaagacaggaacaaagaaaccaggacctcctcagagagtattatcagtgtccctgcttcttccacatccgggtcccctagtcgggttatatatgccaagctcggcggagagatcttggattatcgagatctggctgcgctgcctaagtccaaagctatttacgacatcgatagaccggacatgatcagctattcaccctatatcagtcattccgctggagatcgccagtcctatggcgagggtgatcaggacgaccgatcttataaacaatgtagaacaagtagcccctcctccacagggagtgttagtctcggcagatacacaccaacatctagatccccacagcactacagcagacccgctgcacgacgatcagacggagaggacgggtctctcgatcaggataaccgcaagcagaagtcttcctggttaatgctcaaaggcgacgccgatacgcggacgaatagcccagatctggacacgcagtccctatctcactcatcgggaaccgatcgcgatcctcttcagagaatggctggggactcttttcatagccaatacaagatctatccatatgactccctgatcgtgacaaatcggattcgtgtcaagctcccgaaggatgtcgaccggactcggcttgagcggcatctgtcgccagaggagtttcaggaggtttttggaatgtccatagaggaatttgaccgcttagccctgtggaagaggaatgatctcaagaagaaggctctcctgttttag

SEQ ID NO: 177671 - DNA, 1413 bp, Artificial Sequence
  Description of Artificial Sequence: Synthetic coding sequence
atgagcgccgtgagccagccccaggccgcccccagccccctggagaagagtccgtccactgcaattctgtgtaacacatgcggaaacgtgtgtaagggggaagtgctccgggtacaagacaagtacttccatattaagtgcttcgtttgcaaggcgtgcgggtgtgatttggcggaaggaggattttttgtccgccaaggggagtatatctgtaccttagattaccagcgtttgtatggcacacgctgttttagctgcgatcagttcatagagggggaagtggtatctgctctcggaaagacctatcatcctgactgcttcgtgtgtgctgtgtgccgcctcccctttccccctggcgatagggtaactttcaacggcaaggaatgtatgtgccagaagtgctccctccctgtttccgtggggagcagtgcccatctcagtcagggtctacggtcttgcggaggatgcggcacggagataaagaacggccaagctctggtcgccctggataagcattggcacttgggatgctttaaatgcaaatcatgcggaaagttgttgaacgccgagtacattagcaaggatggactgccatactgcgaggcagactatcatgcaaaatttggaatcaggtgcgatagctgtgagaagtacataactggccgggtgctcgaagcaggagagaagcactaccacccatcttgtgcactgtgtgtcagatgcgggcaaatgtttgctgagggtgaagaaatgtacttacaggggtcatctatctggcatccagcctgccggcaggcagcacgcactgaagaccgtaataaggaaacgcggacgtccagcgaatctattatatcagtccccgctagctccacttccggaagtccttctcgcgtcatctacgctaaactgggcggagaaatactggattacagggacctggccgccctacctaagtccaaagcgatctacgacatagacaggcctgacatgatcagttacagcccatatattagtcatagcgcgggcgatcggcagtcgtacggagagagtccacagttgctctctcctacaccaacagaaggtgaccaagatgaccgctcatataagcagtgccgtacctcgtcacctagcagcacaggttcagtgagcctgggacggtatacccctacatccagaagcccacagcattacagtcggcccgccgcacgtagaagcgatggtgaggatggaagcctggaccaagacaatcggaagcagaaatcaagctggctgatgctgaagggagacgccgatactcgaactaacagtcccgacttggacacccagagcttgtctcacagcagcgggactgacagggaccctctccagagaatggctggtgactcttttcattcccgagaatggttcttttag

SEQ ID NO: 177672 - DNA, 1938 bp, Artificial Sequence
  Description of Artificial Sequence: Synthetic coding sequence
atgagcgccgtgagccagccccaggccgcccccagccccctggagaagtcccccagtactgccattctgtgcaacacctgtggtaatgtctgcaaaggtgaggtgctgcgtgtacaggacaagtactttcacatcaaatgtttcgtgtgtaaggcctgcggttgcgatctggccgaaggcggcttttttgttagacagggagagtacatttgcactctcgattatcagcgcctgtacgggacacggtgcttctcttgtgaccagtttatcgaaggcgaggtcgtctctgccctcggaaagacctaccaccctgactgctttgtgtgcgctgtgtgtagattgccttttccgcctggagaccgggtgacttttaatggaaaagagtgcatgtgtcaaaaatgctctctgcctgtgagcgtgggaagctccgcgcatctgagccagggacttaggtcttgtggcggctgtgggaccgaaatcaagaatgggcaggcactggtggccctggacaagcactggcacctcggctgcttcaagtgtaaaagctgcggcaagttgttaaacgctgagtatatctcaaaagatggcctcccctactgcgaagccgactatcatgccaaatttggcatcaggtgcgactcttgtgagaaatacattaccggcagagtgttagaggccggcgagaagcattaccatccaagctgtgctctgtgcgtgcggtgcgggcagatgtttgccgagggagaagagatgtatctgcaggggagtagtatttggcatcccgcttgtcgccaagccgcacgtaccgaggacaggaacaaggagactaggacgtctagtgaatcgattatcagcgtccctgcttccagcacatctgggagcccgagccgagttatctatgcaaaactcggcggcgagatcctggattaccgggatctagctgcactgcccaaatcgaaagctatctacgatatcgacaggcctgacatgatttcttattcaccgtacatctcccacagtgcaggcgaccgccaaagctatggagagggcgaccaggatgatcggtcttacaagcagtgccgcacttcaagtccatcaagcacaggttccgttagtctggggcgatacactcctactagtaggtcgcctcagcactattccagacccgccggcaccgtgtccgtcgggacaagctcttgtctgtccctgagccaacacccaagccctaccagcgtttttcgtcaccactatatcccttatttccggggatccgagagtggaaggtctactccctctctttccgtcttatctgacagcaaacctcccccatcaacatatcagcaggcccctagacattttcatgttcctgatacgggcgtgaaggacaatatataccggaagcctcctatttatagacaacatgcggcccgtagaagtgacggtgaagatgggtccctcgaccaagataaccggaagcagaagtcttcgtggctaatgttgaagggcgacgccgacactcgcactaattcccccgacctggacacccaaagcctgtcacactcaagtggcacagacagagaccctttgcaacgaatggctggggatagcttccattcacgctttccttattcgaaaagtgatcccctgcccgggcacggaaaaaacggtcttgatcagaggaacgccaaccttgcaccctgtggagctgatcctgatgcgtcgtggggcatgagggaatacaaaatctatccatacgactccttaatcgtcaccaacaggatcagagtaaagctccctaaagacgttgacagaactcggctggagcggcacctctcacctgaggaattccaggaggtgtttggcatgagtatcgaggaatttgaccggcttgccctttggaagcggaatgacttgaagaagaaggcacttttattctag

SEQ ID NO: 177673 - DNA, 1680 bp, Artificial Sequence
  Description of Artificial Sequence: Synthetic coding sequence
atgagcgccgtgagccagccccaggccgcccccagccccctggagaagtccccctctactgcaatactctgcaatacttgcggcaacgtctgcaagggggaagtactccgcgtgcaagacaagtactttcacatcaagtgcttcgtgtgcaaagcttgcggatgtgacctggccgagggaggcttcttcgtgcgtcagggagaatatatatgtacactggactaccagcgactgtacggtactaggtgcttcagctgtgatcagtttatcgaaggggaggtggtgtccgcgctcggaaagacttaccaccccgattgttttgtgtgcgcagtgtgccgcttgcccttcccacccggcgatcgcgtgacctttaacggaaaagagtgcatgtgtcagaaatgttccctccctgtgtcagttgggtccagtgcccacctgtcacagggcctccgctcgtgtggcgggtgtggtacagagattaaaaacgggcaggccctggttgccctcgataagcattggcatcttggttgtttcaagtgtaaaagttgcggtaaactcctgaacgcggagtacatatcaaaggatggactgccttactgcgaagcagactaccatgcgaaatttgggatcagatgcgattcctgtgagaaatacatcaccggccgtgtgctcgaagctggagagaagcattatcacccttcgtgcgcactctgtgttcgttgcgggcagatgtttgcagagggagaggagatgtacctgcaaggcagctccatatggcaccctgcttgtagacaggctgctcgaacggaggatagaaataaggagacaaggacctcaagtgaatcgattatctctgttccggcttcgagcacttctgggtctccttctcgggtgatatatgctaagctgggtggggaaattctggactatcgggacctcgccgcgctccccaaatctaaagccatctatgatattgatcggcccgacatgattagttattccccgtacataagtcactcagccggggataggcaatcctatggagaaggagaccaggatgaccgatcatacaagcaatgccggacatctagcccctcctctactggtagcgtgtccctgggacggtacacaccaacttctcgatccccccagcattattcgagacccgccgctagaagatctgacggggaggacggatctctcgatcaagacaacaggaagaagtcatcatggctcatgttaaagggagatgccgacactcggaccaactctccagatctagatacccagagtctttcgcattcgagtggaacagaccgagacccactgcagaggatggccggggactcttttcacagccggttcccgtacagcaagagtgacccgctgcccggacatgggaaaaacggacttgatcagcggaacgcgaatctagccccttgtggggcagacccggacgccagctgggggatgagagagtacaagatctacccatatgatagtctgatcgtgaccaatagaattcgagtcaagctgcccaaagacgtggacaggaccaggttagaacgacatctgagtcctgaagaattccaggaggtttttgggatgtccattgaggagtttgatagattggctctttggaagcgtaacgatctaaaaaaaaaggctttactgttctag

SEQ ID NO: 177674 - DNA, 1041 bp, Artificial Sequence
  Description of Artificial Sequence: Synthetic coding sequence
atgttcgccgagggcgaggagatgtacctgcagggcagcagcatctggcaccccgcctgtcgacaagccgcccggaccgaggatagaaacaaagaaactcgaacttcttcagaatctataatcagtgtgccagccagttccacgagcggttcccctagccgggttatatatgcaaaactcggaggggaaatactggactaccgtgatctcgcagccttgccgaagagcaaggccatctacgatatcgaccgccccgatatgatttcatactcaccatacatatcacactctgctggtgatcgccaatcttacggggaatcaccgcagctcctaagccccacacccacagagggagatcaggacgaccggtcatacaagcaatgccgaacttcctcaccgtctagcaccggctcagtttccctgggacgctatacccccacatcccgaagccctcaacactattcgaggcccgataccggagtgaaagataacatttatagaaaacccccaatttacaggcagcatgcagccagaagatctgacggagaagatggtagcctcgaccaggataaccgcaagcagaagtcaagctggctgatgctcaagggggatgctgacacaaggacaaactctccagaccttgacactcagtctctctctcattcatcaggcaccgatagggatccactgcaacgaatggcaggtgattcattccattctagatttccttattccaagtcagatccactacctggccacggtaagaatggattggaccagagaaatgccaaccttgccccttgtggcgcagatcccgacgcaagctggggtatgcgggaatacaaaatttatccttacgactccctcatcgtgactaaccgaatcagggtcaagctgcctaaggatgtggatcgaactcggctcgagcgacacctcagccccgaagagttccaggaggttttcgggatgtctattgaggaatttgaccggctggcactgtggaagagaaacgacctcaagaagaaagcgcttctgttctag

SEQ ID NO: 177675 - DNA, 1716 bp, Artificial Sequence
  Description of Artificial Sequence: Synthetic coding sequence
atgagcgccgtgagccagccccaggccgcccccagccccctggagaagtcacccagtaccgctatcttgtgtaatacatgcggaaacgtttgcaagggcgaggtcctccgcgtgcaagacaaatacttccatatcaaatgtttcgtgtgtaaagcctgcgggtgcgacttggctgagggggggttttttgtcaggcaaggggaatatatatgcaccttggactatcagcgtctgtatggcacaaggtgtttctcatgtgatcagtttattgagggagaagtggtgagcgccctgggcaagacgtatcatcctgattgttttgtgtgtgcagtatgtcgacttcccttccccccaggagatcgagtgacttttaacggcaaggagtgtatgtgtcagaaatgctcgctgccggtctctgtcggttcatctgcacacctgtctcagggactgagaagttgcgggggatgcggcaccgaaattaaaaatggacaggctctggtcgccctggacaagcattggcacctcggatgttttaagtgcaaatcctgtgggaagctgttgaacgccgagtacatcagcaaggatgggctgccatattgtgaggccgactaccacgccaaattcggaatcagatgtgactcatgcgagaagtatattacaggccgcgtgctggaagccggagagaaacattatcatcccagctgcgctctgtgcgtgaggtgcggccagatgttcgccgagggcgaagagatgtacctgcaggggtcttcgatatggcatcctgcttgccgtcaggcagcacgaacagaggacaggaataaagagacaagaactagctccgaatctattatctctgtgccggcatcttctacaagtgggagcccctctagagtgatttacgccaaacttggaggagaaatccttgattaccgcgacctggccgcactccccaagagcaaggccatctacgacattgacaggccggacatgatctcgtattctccttacataagccacagcgctggcgatcgccagtcctacggggagggagaccaggatgaccgctcttacaaacaatgcaggacttcttcccctagcagtactggctcggttagcctggggcgatacacacctacctctcgatccccccaacattactcacggccaggctccgaatccggacgctccaccccatccctgagtgtcctgtctgactctaaacctccacccagtacatatcagcaggctcccaggcacttccacgtgcccgacacaggcgttaaggataacatttatcgtaagcctccaatctacaggcagcacgccgcgagaagaagcgacggcgaagatggcagccttgaccaggataataggaagaagtcatcctggctgatgctgaagggggacgctgacactcgcacaaattcacctgatttggatacccagtctctgtctcacagcagtgggaccgaccgggacccacttcagcgaatggcaggggactcattccattcacagcaaatttacccttatgatagccttatcgtcacgaacagaataagagttaaactgcctaaggatgtcgacagaactaggctggagagacacctcagccccgaagaattccaggaagtattcggcatgtccatagaagagttcgaccgcttggccctctggaaaaggaatgatctgaagaaaaaagcactgttattctag

SEQ ID NO: 177676 - DNA, 1596 bp, Artificial Sequence
  Description of Artificial Sequence: Synthetic coding sequence
atgagcgccgtgagccagccccaggccgcccccagccccctggagaaatcgcctagtacagcaattttatgcaatacctgtggtaatgtgtgcaagggggaggtactgagagtgcaggataagtactttcacattaagtgttttgtctgtaaagcctgcggctgcgatctcgcagagggcggtttcttcgtcagacagggtgaatatatctgtactctggattatcagagactttacgggacacgctgcttctcatgcgatcagtttatcgaaggcgaggtggtgtcagctctgggcaagacgtatcaccccgactgcttcgtgtgcgcggtctgccggcttccattcccaccaggcgatagagtgactttcaacgggaaagagtgcatgtgccaaaaatgtagtctgcccgtgagcgtcggatcatccgcgcatctgagtcaaggcctccggtcttgtggcggttgcggaaccgagatcaagaatggccaggctctggtggcactggataaacactggcacctaggctgttttaagtgcaaatcctgcggcaaactcttgaacgccgagtacatcagtaaagacggtctgccatattgcgaagcagactaccacgccaagtttggcatccgatgtgacagctgtgaaaaatacatcaccggtcgggtactcgaagcaggtgagaagcattatcacccctcgtgtgccctgtgcgtccggtgtgggcagatgtttgcagagggagaggaaatgtatttgcaggggtctagtatctggcatcctgcatgccgccaggccgcccgcacagaagaccggaataaagagacccggacatcctctgaatcaatcatttcagtgcctgcgtcatcgacctcaggtagtccgagtagggtcatctatgccaaactgggtggcgagatcctggattacagggaccttgccgctttaccaaaatctaaagccatctacgatatagataggccagatatgatttcgtattccccatatattagtcactccgcaggagataggcagtcatacggggaaagccctcagctgttgagccccaccccgactgagggagaccaggatgacagatcctacaagcaatgtcggacatcctccccatccagcacgggctctgtctcactgggacgatacactcctacaagtaggagtcctcagcactattcgcgccctgccgcacggagatccgatggcgaggacggcagcctggatcaggataaccggaagaagagcagctggctcatgctcaaaggggatgcggatacccgtaccaatagtcctgacctggacacccagtcactgagccattcctctggcaccgatagagatcccctgcagcgcatggccggggactcgttccactctcgggagcagatctacccttacgatagtttgatcgtgaccaaccggattcgagtgaagctgccgaaggacgttgatcgcacaagacttgagagacatttgagccctgaggagtttcaagaggtgttcgggatgagcattgaagaattcgacaggctggcactgtggaagagaaacgaccttaagaagaaagccctgttgttttag

SEQ ID NO: 177677 - DNA, 2193 bp, Artificial Sequence
  Description of Artificial Sequence: Synthetic coding sequence
atggaggagctgatcgtggagctgcggctgttcctggagctgctggaccatgagtatctaaccagtactgtgagagaaaaaaaggccgtaattaccaatatcctcttacgaatccaaagcagcaagggattcgacgtcaaagaccacgcacagaaacaggaaactgcaaactctctgccagcgcctccccaaatgcctctacctgagattccacagccatggctgccacccgattccggccctcccccattgccgacatcctcgctgcccgaaggctattacgaggaggcagtgccgctctcacctgggaaagctccagagtatattacctcaaactacgatagcgatgcgatgtccagcagctacgagtcctacgacgaagaagaggaagacgggaaaggaaaaaaaacccggcaccagtggccaagcgaagaggccagtatggatctcgtgaaagatgcaaagatttgcgccttcctcctacggaaaaagcggttcggccagtggaccaaactgctgtgcgtcatcaaagacaccaagctgctttgctacaaatctagtaaagatcagcagccacaaatggagctgccactccaaggatgtaatataacttacatccctaaagactctaaaaaaaaaaagcatgaactcaagataacccagcagggcactgatcccctcgtcctggcagtgcagtcaaaagagcaagctgagcagtggctgaaggtaattaaggaggcctattcaggatgcagtggacccgttgattctgagtgccccccacccccatcatctccagtgcacaaggccgagcttgaaaagaagctgtcctcagaaaggccatcaagcgatggggagggtgtagttgaaaacggaatcacgacttgtaacggcaaggaacaggtaaagcgaaagaaatcatcaaaatccgaagctaagggaacagtttctaaagtgacgggaaaaaagattacgaagataatttccctcggcaaaaagaagccatccacagatgaacagactagctcagccgaggaggatgttcctacctgtgggtatttaaacgtgctgagtaattcacggtggcgagagcggtggtgtcgagtaaaagataacaagctcatattccacaaagaccgaactgatctgaagacacacatcgtctccattccactgagaggctgcgaagtcatcccgggactagatagcaagcatccgcttacttttaggctcctccgtaatggccaagaggttgccgttcttgaagcatccagctctgaggatatgggtagatggattggcattttgctggcggaaacgggatcttcgactgatcccgaggcattgcattacgactatatagacgtagaaatgtctgctagcgttattcaaacagccaagcagactttttgcttcatgaaccggagagtgatctccgcaaatccttacctgggggggacaagcaacggctacgcacatccaagtggcacagcactacattacgatgatgtgccttgtattaatggctctctgaagggcaagaagcctcccgtcgcaagcaacggtgtcacggggaagggaaaaacattgtctagccagccgaagaaagcagaccccgcagccgttgttaagcggactggctcaaacgccgcccagtataagtatggaaaaaatagagtcgaggcggacgccaagcggctccagaccaaagaagaggaacttctgaagaggaaggaagcactgcgaaatcgtctggcccagctcaggaaggaaagaaaggatcttcgcgccgctattgaggttaacgccggaagaaaaccccaagctatcctcgaggagaagctgaagcagctggaagaggaatgtcgccagaaggaggccgaaagggtctctctggagcttgagcttacagaggtcaaggaatccctcaaaaaggccttagccggcggtgtgacgctgggcctggcaattgagcctaagtccgggacttcttcgccccagagccctgtgtttcgtcaccggaccctcgaaaacagtcccatcagttcgtgcgatacaagtgataccgaaggacctgtgcccgtaaacagcgcggccgtgttgaaaaaaagccaagccgcacccggatcatctccctgtcgcgggcacgtccttcgaaaagcgaaagagtgggaactaaagaatggaacgtag

SEQ ID NO: 177678 - DNA, 2193 bp, Artificial Sequence
  Description of Artificial Sequence: Synthetic coding sequence
atggaggagctgatcgtggagctgcggctgttcctggagctgctggaccatgagtatctgactagcactgttcgcgaaaaaaaagccgtgatcacaaatatcctgctcagaatccagtcaagtaagggttttgacgtcaaagatcatgcccagaagcaggaaaccgccaattctctgcctgcgcctcctcagatgcccctgcccgagatcccccagccatggttaccacccgattccggccctcctccactgccaacctcttcactgccagaaggctactacgaggaagccgtgcccctctcgcctggaaaagcccctgaatacataacaagcaattacgattcagacgccatgtccagctcatatgagtcctacgacgaggaagaggaagatgggaagggtaaaaagacccgtcatcagtggccttctgaggaagcaagcatggatctggtaaaagacgctaaaatctgtgcatttttactgcgcaagaaaagattcgggcagtggactaaactcttatgcgtgatcaaagacacaaagctgctttgctacaagagtagcaaggatcagcagccacagatggaattgcctcttcagggatgcaacatcacatacattcccaaggattctaagaaaaagaagcacgaattaaaaatcacacagcagggaacagaccctctggttcttgctgtgcagtctaaggagcaggcagagcagtggctgaaagtgattaaagaagcctattccgggtgttccggacctgtggactccgagtgtccaccccctccgtcatcacctgttcacaaagccgaacttgagaagaaactctctagcgagagaccatcctcagacggagagggagtggtagagaatgggatcacaacttgtaacgggaaggagcaggtcaaaagaaaaaagagttccaaatcagaagcaaaagggacagtgtctaaggtgactggcaagaagattactaagattatctctctggggaaaaagaaaccgagcacggatgaacagactagtagtgctgaggaagacgtcccaacctgcgggtacctgaatgtgctatctaattctcgctggagggagcgctggtgtagagtcaaggataataaactgatcttccataaggaccgcactgacctcaagacacatatagtctctattcccctccggggatgtgaggttatccccggtttagacagcaagcaccctctgaccttccgcctgctgcggaacggacaggaagtggccgtgctggaggcgagcagtagtgaagacatggggagatggattgggattcttctggccgagacaggttcaagcacagatcctgaagcgctccactacgattatatcgatgttgagatgagtgcaagcgtgattcagaccgcgaaacaaaccttttgcttcatgaacagacgagtaatcagcgctaacccttaccttggagggacctcaaacggctatgctcatccctcagggaccgccctgcattacgatgatgtcccatgcataaatggctcacttaaggggaaaaagccaccggttgcgtcaaacggtgtcacaggaaaaggcaaaaccctctcatcccagccgaaaaaagctgaccctgcagcagtggtcaaacgtactgggtcgaatgctgcacaatataagtacggcaagaaccgtgtcgaagctgacgcgaaacgtctgcagactaaggaggaggagttactcaagcggaaggaggccctgagaaacaggctggcccaactgcggaaggagcgtaaagatctgcgagctgctatagaggtaaatgcgggccggaagccccaggccatcctggaggaaaaactgaaacagctggaagaggagtgtaggcagaaggaggccgagagagtcagcctagaactggagcttacagaagtgaaagaatccctcaaaaaggccctagctggaggggtaacgctcggattggcaattgaacctaagtctggtacttctagtccccagtcccccgtatttcggcaccgaacgctggaaaacagccccatctcatcttgcgatacttctgatactgagggcccggtcccggtgaatagtgccgcagtgcttaagaaaagtcaagctgcacccggcagttctccctgtcggggacatgttctgcggaaggcaaaagagtgggagctgaagaatgggacctag

SEQ ID NO: 177679 - DNA, 2445 bp, Artificial Sequence
  Description of Artificial Sequence: Synthetic coding sequence
atggaggagctgatcgtggagctgcggctgttcctggagctgctggatcacgaatacctcacctctacggtgcgagagaagaaggctgtcatcacaaacatcctgctgaggatccagagctccaaaggctttgacgtcaaggaccacgcccagaagcaagagactgccaacagcttacctgccccaccgcagatgcccctgcctgagatcccccagccttggttgccgcctgacagtggtccgccaccattaccaacctcaagtcttcccgaaggctactacgaggaggcagtgcccctgagcccaggcaaagcgccagagtacatcactagtaattacgattcggacgctatgtcttcgtcgtacgagagttacgacgaagaagaggaagatgggaaagggaagaaaaccaggcaccaatggcccagcgaggaggcatccatggatttagtaaaggatgctaagatttgtgccttcctcctgcgcaaaaagagatttggtcagtggactaaacttctgtgtgtgatcaaggataccaaactcctgtgctacaaaagcagcaaagatcagcaaccgcagatggagcttcccttgcagggctgtaatattacctacattcccaaagactccaagaagaaaaagcatgagctgaaaatcacacaacaagggacggatcctctggtgctagctgttcagagcaaagagcaggccgaacaatggctaaaagtgataaaagaggcttacagcgggtgtagcggtcccgtggattcagaatgtcctccccctccgtcctcccctgtgcacaaggcagaacttgaaaaaaagctgtcttctgagcgtcctagtagcgatggcgaaggcgtagtggaaaacggcatcaccacatgcaacggcaaggagcaggtgaaaaggaagaagagctccaagagtgaagccaaaggcactgttagcaaggttacagggaaaaaaataacaaagattatcagtctcggaaagaaaaagccttcgacggatgaacaaactagtagcgccgaggaagacgtgccaacttgcgggtaccttaatgttcttagcaacagcagatggagagagagatggtgtcgtgtgaaggataataagctcatttttcacaaagaccggacagatcttaagacacacatcgtttcaatccccctcagggggtgcgaggttattccaggactggactctaaacatcccctcactttccgcctgttgcgcaatggacaggaagtagccgtgttagaggcaagcagttctgaagacatggggcgctggatcggcatcctattggctgagactgggtcttcaaccgaccctgaagccctacattacgattacatcgacgtcgaaatgtccgccagcgttattcagaccgcaaagcagaccttttgctttatgaataggagagtaatatccgccaacccatatctggggggaacatcaaatgggtatgcccatccaagcggaaccgcacttcactacgacgacgtgccctgcattaatggtagctgggaacctgaagacggtttcccagcctcttgcagtaggggcctcggagaggaagtgctctacgataacgccggtctttatgacaatcttcctcccccacacatttttgcacgttatagcccagcagaccggaaggcatcccgcttgagtgcagacaaattgtctagcaaccattataaataccctgcaagcgcccagtccgttaccaatacttcttccgttggcagggcgtcacttgggctgaactcacagcttaaaggaaaaaagccaccagtagcatcaaatggagttaccgggaagggtaagacgctctcaagtcagcccaaaaaggctgatcctgccgctgtagtcaaacgtaccgggtcaaacgccgcccaatacaagtatggtaaaaatagagttgaagctgatgcaaagcggctgcagaccaaggaagaggagctacttaaacgtaaagaagctctgagaaaccgactagctcaactgcgtaaagagaggaaggaccttcgggccgcaatcgaggtgaacgctggccgtaaaccccaagccattcttgaagagaagctcaagcagttggaagaggagtgtagacagaaggaagccgagagagtttcgttggaactggaactgactgaggtgaaagaatctcttaagaaggctcttgctggtggtgtgaccctgggcctcgccattgaacccaaatcaggtacaagctcccctcaatctcccgtgttcaggcatcgcactctggaaaattctccaatcagtagctgtgataccagcgataccgaggggcccgtgcctgtaaacagcgctgctgtgctaaagaagagccaggcagctcctgggagttccccctgtcgcggacacgtgttgaggaaagcaaaagagtgggagctgaagaacggaacctag

SEQ ID NO: 177680 - DNA, 2307 bp, Artificial Sequence
  Description of Artificial Sequence: Synthetic coding sequence
atggaccggggccaggtgctggagcagctgctgcccgagctgaccgggttgctgtcgttactcgaccacgaatatctttctgacaccacactagagaaaaagatggctgtagccagcatccttcaaagccttcagcctctgccagctaaagaagtgagttatctctacgtgaacaccgccgatcttcattctggcccgagctttgtcgagagtttattcgaggagtttgactgcgatcttagcgatctgagagacatgcctgaggacgatggcgagccctccaagggcgcgtcccccgagcttgctaagagcccccggctcagaaacgccgctgacttaccgccaccactgccaaacaagcctccccccgaagattactacgaggaggccctacccttaggccccggaaagtcccccgaatacatcagcagtcacaatggctgtagccccagtcatagcattgtggacggatattacgaggacgcggactcctcatatcctgctactagagtgaacggagaactaaagagctcctacaacgattccgatgccatgtcctccagctacgagtcatatgatgaagaagaggaggaaggtaagtccccccagccaaggcaccagtggccaagcgaggaggcatctatgcacctggtccgagagtgtaggatctgcgcgtttctgctgagaaaaaagcgcttcggacagtgggccaagcagctcacggtgattcgcgaggatcaacttttatgctacaagagttctaaggatcgccagccccatttgcggctggccctcgacacatgctctataatctatgtccccaaggattctaggcataagagacacgagctgcgctttacacagggcgccactgaagttcttgtacttgcattgcagtccagagagcaagctgaggaatggttgaaggtgattcgcgaggtcagcaaacctgtcgggggtgccgagggtgtggaggtgccacgcagcccggtgctcctgtgtaagctggacttagacaaacggcttagtcaggaaaaacagacctccgacagcgactccgtcggagtgggcgacaactgcagcacactggggcgaagagagacctgcgaccatggcaagggcaagaaatcttcactggctgaactgaaggggtccatgagtcgcgccgcaggtcgcaaaataacgagaataatcgggttttcaaagaagaagactttggctgacgatctgcagacttcctccaccgaagaggaagtgccatgctgtggctaccttaatgtgctagtgaaccagggttggaaagaacggtggtgtagattaaagtgcaataccctgtacttccataaggaccacatggacctccggactcatgtcaacgccattgccttgcaggggtgcgaggtggctccaggttttggaccacgtcatccttttgcattccgaattcttaggaaccggcaggaggtggccatactcgaggcatcttgttccgaagatatgggacggtggttgggtcttctacttgtggagatgggatcccgcgttaccccggaggctctgcactacgactatgtcgacgtcgagaccttaacgtcgatcgtttccgccggtcgcaacagttttttgtatgcacggtcctgccagaatcaatggcctgaacctcgcgtttatgatgacgtgccttacgaaaagatgcaggacgaggagcccgagaggcccacgggcgcacaggtgaagcggcacgccagttcatgttcagaaaagagccaccgtgtggatccccaggtcaaagtcaagcggcatgccagcagtgcaaaccagtataagtatggaaaaaaccgagccgaggaggacgcccgtaggtacctcgtggagaaagagaaattagagaaggagaaagagacgattcggacagagttgatcgcgctgcgccaggagaaacgggagctcaaggaggctattcgctccagtcctggggccaaacttaaagccctggaagaggccgttgcaacactcgaggctcagtgccgtgcaaaagaagagcggcgtattgacctggagctcaaactggtggccgtgaaggagcgattacagcagagtctggccggtggccctgcgctcggactgtccgtctcttccaaacctaagtccggggagactgcgaataagccacagaacagcgtcccagaacaacccttgcccgtgaactgcgtcagtgaactgaggaagcgtagtcctagcatagtcgcatccaaccaggggcgggtgcttcagaaagccaaagaatgggaaatgaaaaagacatag

SEQ ID NO: 177681 - DNA, 2178 bp, Artificial Sequence
  Description of Artificial Sequence: Synthetic coding sequence
atggaccggggccaggtgctggagcagctgctgcccgagctgaccggactcttgagtctgctggaccacgagtatttatcagacacaacgttagagaagaagatggccgtggccagcatcctccagtcactccagcccttaccagcaaaggaagttagctacctgtacgtcaatactgcagatcttcacagcggcccctcgtttgtcgaatctttatttgaggaatttgattgcgatctgtccgatctgcgtgatatgcccgaggacgacggcgaaccttccaaaggggcatctccagagctggcaaaaagtcctcggctgcgaaatgcagcagacctgcctcccccattgcccaataagccgcctcccgaggattattacgaagaagcgctacccctggggccaggcaagtcccccgagtatatttcctcacacaacggatgcagccccagtcatagcatcgtagacggttactatgaggacgcggactcctcttacccagccacgagggtgaacggggaattaaagtcatcctataatgattccgatgccatgtcctcctcttatgagtcttacgacgaagaggaggaggaagggaagtctccacagcccagacatcaatggccatccgaggaagcatccatgcacttagtgcgtgagtgtcgcatctgcgcctttctccttaggaaaaaaaggttcgggcaatgggcgaaacagctcacagtcatccgcgaggatcagctcctttgctataagtcgtccaaggatagacagcctcatttgagactggcgctggacacttgctctattatttatgttcccaaggacagccggcataaacgccacgaacttcggttcacgcagggtgctactgaggtccttgttctggctctccaaagtcgcgagcaagcagaagaatggctaaaggtgatcagggaggtgagcaaaccggttggtggtgcagagggtgtggaggttcccagaagccccgtgttgttgtgtaaactggatctggacaaaagactctcccaggaaaaacagaccagcgattctgacagcgtgggggtgggggacaattgctctacgctgggcagaagagaaacttgcgaccacggaaaggggaaaaagtcctccctggccgagctgaaaggctccatgtcgcgggcagctggaaggaagatcactaggatcatagggtttagcaagaagaaaaccctcgccgatgatctgcagaccagctccaccgaagaggaggttccgtgttgtgggtacttgaacgttctagtgaaccaaggttggaaagagcggtggtgcagattgaagtgcaatactctttacttccataaggaccacatggatctgcgcactcatgtgaatgctatcgccctgcagggatgtgaagttgccccaggcttcgggccccgccacccgtttgccttcagaatcctgcggaataggcaggaggttgccattcttgaagccagctgctccgaagatatgggacggtggctcgggttgctcctagtggaaatggggtctcgcgtgactccggaagccctacattatgactacgtggacgtggagaccctgactagcatcgtcagtgcaggtaggaactccttcctgtatgcacgctcgtgtcaaaaccagtggcccgagcctcgggtttatgacgatgttccctacgagaagatgcaggatgaggaacccgagaggcccactggcgctcaggtgaagcgtcatgcttccagctgtagtgagaaatcacatagggtcgatcctcaggtgaaggtgaagcgccacgcaagcagcgctaaccagtacaagtacggtaaaaacagggcagaggaggacgcccgccgatatctcgtggagaaagagaagctggagaaagagaaggaaacaatccgtaccgagttaatcgccctacgccaggagaagagagagctgaaggaggctatccggagttcccctggagccaagttgaaagcactggaagaagctgtggcaacactagaagcacaatgccgagcaaaagaagaacgcaggatcgacctggaactgaagctggtcgccgtgaaggagcggctgcagcagagtttagctggggggcctgctctgggattgagcgtgtcaagcaagccaaagtccggagagtgggaaatgaaaaaaacctag

SEQ ID NO: 177682 - DNA, 2457 bp, Artificial Sequence
  Description of Artificial Sequence: Synthetic coding sequence
atggagcggtacaaggccctggagcagctgctgaccgagctggacgattttttgaagatcttagaccaggagaatctgagctcaactgccctagttaaaaagagttgcctggctgaactgctgcgcctttacaccaagtcaagctcatctgacgaagaatacatatacatgaacaaggtgacaataaacaaacagcagaacgccgagtcacagggcaaggctccagaggagcagggattgctgccaaatggcgagcctagtcaacattccagtgctccccagaagtccctgccggatcttcctccacctaaaatgattcccgagagaaagcagttggcaatccctaagactgaatcacctgaaggatactacgaggaggctgagccttatgacacgagtctcaacgaagacggagaagcagtctcatcctcatacgagagttacgatgaagaagatggttccaaagggaagtctgctccgtatcaatggccctcaccagaggccgggatcgagctaatgagggacgcacgaatctgcgccttcctgtggagaaagaaatggttgggacagtgggcaaagcaactgtgcgtgatcaaagataaccggttgttatgctacaagagttctaaggatcattccccccagcttgacgtaaatctcctgggttccagcgtcatccacaaggagaaacaagtgaggaagaaggagcacaagttgaaaattacccctatgaatgcggacgtgatcgtgctcggtctgcagtctaaagaccaggcagaacagtggctgcgggtgatccaggaagtcagtggactgccgtccgagggcgcgtctgaagggaatcagtacaccccagacgcgcaacggtttaattgccaaaaaccagacattgcggaaaaatacctaagtgcttctgaatatgggtcttcagtcgacggacacccagaggtgcccgaaactaaggatgtcaagaagaaatgttccgcaggcctgaagctgtctaatttaatgaacctgggacggaagaagagtaccagtctcgagcctgtcgagcgaagtttggaaaccagcagctacttgaatgttctcgtgaactcacagtggaagagtcgctggtgctccgttcgcgataaccacctgcatttctaccaggaccggaatagatctaaggtagctcagcaaccactgagcctggtcggttgcgaggttgtgcctgacccaagccctgatcatttatacagcttcagaattttacataagggagaggagttggccaaacttgaggccaagagttctgaggaaatggggcattggctgggactgctgctaagcgaatcagggagtaagactgatccagaagaattcacctacgactacgttgacgctgaccgggttagctgcattgtatccgccgccaagaactccttactgcttatgcaacgcaaattcagcgagcctaacacatacatcgacggactgccgtcccaagacaggcaagaagaactctatgacgacgtcgacctctctgagctgacagccgccgtcgagcccactgaagaagccacacctgtggccgatgacccgaacgagagggagtccgacagggtctatctcgacctgacacctgttaagagcttcttacatggcccctcttccgcccaagctcaggcatcatctcctacactttcttgtctagataacgctacagaggcactccccgctgactccggccctggaccgacccccgacgagccctgtatcaaatgccctgaaaacttgggagagcaacagctggaatccttagaacccgaggatccaagcctccgtatcactactgtgaagatccagacagagcagcagcggattagcttccccccttcgtgtcccgacgcagttgtcgctacacctccaggggccagcccccctgtgaaagaccgcctgagagtgacttctgcagaaattaagttgggaaagaatcgaacggaggccgaggtgaaaagatacaccgaagagaaggaacgcctggaaaagaagaaagaggaaattaggggtcatttagcccagctccgtaaggagaaacgtgagttgaaagagacattgctgaagtgcaccgacaaagaggtcctggcctcgctagagcaaaaactaaaggaaatcgacgaggagtgtaggggcgaggagtcccgccgcgtggatctcgagttgtctattatggaagtgaaagacaacctgaagaaagcggaggccggccctgttacattaggtacaactgtagacactacccacctcgaaaatgtaagcccgcgacctaaggccgtaacgccagcatctgcacccgattgcacccctgtaaactcagccaccaccctgaagaatcgaccactatccgtggtcgtcacaggtaaaggcactgttcttcagaaggctaaggaatgggaaaagaagggcgctagctag

SEQ ID NO: 177683 - DNA, 2445 bp, Artificial Sequence
  Description of Artificial Sequence: Synthetic coding sequence
atggagcggtacaaggccctggagcagctgctgaccgagctggacgattttttaaagatcctggatcaggaaaatcttagtagtaccgctctagttaagaagtcatgcctcgcagagctcctgcggctctataccaaaagctcttcctccgatgaagagtacatttacatgaataaggtgacaattaacaagcaacagaacgctgaatcccaaggaaaggcacccgaagagcagggtttactgcccaacggagagcctagccagcattcgtcggcccctcaaaaaagtctccctgacttacccccgcccaagatgatccctgagagaaaacagctggcaatcccaaagaccgagtctccggaaggttactatgaagaggctgaaccctacgacactagtcttaatgaggacggcgaggccgtgtcttccagctacgaaagctatgatgaggaggatgggagcaaaggaaaaagtgccccttatcagtggccatcccccgaggccggcattgagctgatgagggacgcgaggatctgcgcttttctctggcgcaagaaatggctcgggcagtgggctaagcaactgtgcgtgatcaaggacaatagactgctttgctacaaaagctctaaggatcatagtccccagctggacgtgaaccttctgggatccagcgtgatccataaagaaaagcaggtgcggaagaaagaacataaattgaagatcacccccatgaatgctgatgtcattgtccttggcctacagtctaaagaccaggcggagcaatggctcagggtcattcaggaggtgtccgggctgcccagcgaaggagcctctgagggaaatcaatacactccagacgcccagcggtttaattgccagaagcctgacattgccgagaagtatctgagtgccagcgaatatggcagctctgtcgacggtcatcctgaagttcctgagactaaagatgtcaaaaagaagtgtagcgccgggctgaaactcagtaaccttatgaacctcggaaggaaaaagtctacctcgttggagcccgtagagcgcagtctcgaaacgtcctcctacctgaatgttctggtgaactctcagtggaagagtcgctggtgttctgtaagagacaaccatttgcatttctaccaggataggaataggtctaaagtggcacagcaacctttgtcccttgtgggctgtgaagtggtcccggacccttcaccggaccatctgtactctttccgtatcctgcataagggggaggaactggcaaaacttgaggctaaatcttcagaggagatgggacattggttgggcctgctgctgagcgaaagcgggtcaaaaactgatcccgaggaattcacctatgactacgttgatgctgaccgagtgtcctgcattgttagcgcggcaaagaattcattgctcctgatgcagcggaagtttagcgagcctaacacttacattgatgggcttccttctcaagaccgccaggaggagctctatgacgatgtagatctgtccgagctgactgccgcagtcgagcccaccgaggaagcaacccccgtggctgatgaccctaacgaacgggagtctgatagagtgtaccttgacctcacacctgtgaagtcctttctgcacgggcctagttccgcacaggctcaggcctcctctccgaccctctcgtgtttggacaatgccacggaagcactccccgcagattccggaccaggccctacccctgacgaaccctgcattaagtgtcccgaaaatctgggggaacagcagttggaaagtttggagcctgaggatccttcgctccggataactactgtgaaaatccagacagaacaacagagaattagttttcccccttcttgtccagatgctgttgtcgccacacctcctggcgcttctccgcctgtgaaggaccgtcttagggtcacttctgccgaaataaaattaggcaaaaaccgtacagaagccgaggtaaaacgctatacggaagagaaggagcggctggagaaaaagaaggaagaaatcagaggtcacctggcacagctgcgcaaagagaagagggaattgaaagaaacactcctgaagtgcacggacaaagaggtgctggccagtctcgaacagaaattaaaagaaattgacgaagagtgcaggggcgaggaatccaggcgggttgatctggagctttcaattatggaggtgaaggataaccttaagaaggcggaggccggtccagtcacgctggggaccaccgtagacactacccatctggagaacccaaaagctgtaactcccgccagcgctccagactgcactccagtgaacagtgcaacgactctaaaaaacagacccctttctgtggtggtgacaggcaagggtactgtcttgcagaaggctaaggagtgggagaagaagggtgcatcttag

SEQ ID NO: 177684 - DNA, 2526 bp, Artificial Sequence
  Description of Artificial Sequence: Synthetic coding sequence
cagcgggtgcgggccctggagcagctgctgaccgagctggacgactttctcaaaatactcgatcaggaaaatctcagcagcacagccttggttaagaaaagctgtcttgccgaactcttgaggctttacaccaagagttcctccagtgacgaggaatacatctacatgaataaggtaacaatcaacaaacaacagaacgctgagagccagggaaaggctccagaagagcaagggctgctgcccaacggagagccctcacaacactcctcagcaccacagaagtccctgcccgatctgcctcctcctaaaatgattcccgagaggaagcagctggcaattccaaagacagagtccccggaggggtactatgaagaggcagaaccctatgatacatcactgaacgggcacagcggaggcttcctgcccaccggggtgcctagatgggtccaagtgcctgagggagtgatctacgcgacaatcacactagaggatggtgaagccgtctcaagcagttacgaatcttacgatgaggaagatggttctaagggaaagtccgctccctatcagtggccaagcccagaggccggtattgaacttatgagggacgccaggatatgtgccttcctctggcgtaaaaagtggttgggccagtgggcgaaacagctctgcgtgatcaaggacaaccgtctgctctgttataaatcaagtaaggatcatagtcctcagctggacgtaaacctccttggcagctcggtgatccacaaagaaaagcaggtccggaaaaaggaacacaagttgaaaattacccctatgaacgccgacgtgattgtgcttggactgcagtccaaagaccaagccgagcagtggctacgggtgattcaagaagtatctggcctcccttctgaaggggcctcggaggggaaccagtacaccccagatgcgcagcggtttaattgccagaaacctgacatcgccgaaaagtatctgagtgctagcgagtacgggagctccgttgatggacaccccgaggtgcccgagactaaggacgtcaagaagaaatgcagtgctggcctcaaactgtctaatctgatgaacctgggaagaaaaaagtccacttcactagagcccgtggagcgttctttggagacctcttcgtatctcaatgttctggttaacagccaatggaagtctaggtggtgcagcgtgcgtgataaccacctgcatttttaccaggacagaaaccggagtaaggtcgcacagcagcccttgagtcttgtgggctgtgaggtggtccccgatccctcaccagaccacctatattcctttcgcatcctacacaaaggagaggaacttgctaagctcgaggccaagtcctcagaagaaatggggcactggctcgggctcctgctgagcgagagcgggtcaaagaccgatcccgaagagttcacctacgattatgtggacgctgatcgggtgtcttgtatcgtttcggccgctaagaactccctcttacttatgcagcgcaagttctccgagcctaacacttatattgacggactgcctagtcaagaccggcaggaagaactctacgacgatgtggacctcagcgagttgactgcagcagtagagccaactgaggaagcaacccccgtcgccgatgatcccaacgaaagagagagcgaccgcgtgtacctggacttgactcctgtcaaaagctttttgcatgggccctcatccgcccaggcccaggcatcctccccaactttgtcatgcctcgataatgcgactgaggctctacccgcggattcaggccccggaccaactcctgatgagccatgtatcaaatgccctgagaatttgggagagcagcagctggaaagtctggaacctgaggacccctctctgagaattaccacggtgaagattcagaccgaacagcagagaatatctttccccccctcttgtcccgacgctgtggttgccaccccccctggcgcctccccccccgttaaggaccggctgagggtgacctctgccgagattaagctggggaaaaacaggaccgaggctgaggtcaaaaggtatactgaggaaaaagaaaggctggagaaaaagaaggaagaaatcagaggacatctcgctcagctgaggaaagagaagagagagctcaaggaaactttactcaagtgcacggataaggaagtcctggcctccctggagcaaaagctgaaagagattgacgaagaatgcaggggcgaagagtcccgcagagtcgacttagagctctccatcatggaagtcaaagacaatctgaaaaaagcagaggcaggccctgtaactctcggaacgaccgtagacacaacacatctcgagaatcctaaggcggtgacgccggcttccgcaccagactgcactccagtgaactcagccactaccctcaagaaccgtccattgtccgtcgtcgttacggggaaaggaacagtacttcagaaagcaaaagagtgggagaaaaagggtgcatcatag

SEQ ID NO: 177685 - DNA, 939 bp, Artificial Sequence
  Description of Artificial Sequence: Synthetic coding sequence
atggagcggtacaaggcccagggctgctgctgcctggtggtgcagcggaggatcagacaagtgtctgcctctttggaacagctactcaccgagctggatgatttcttaaagatcctggaccaggagaacctgagcagtactgccctcgtcaagaaaagctgtctggccgaacttttgcgcctttatacaaagagctcctcttctgacgaggagtatatctacatgaacaaggtgaccattaacaaacagcagaacgccgagtcccaggggaaggcccctgaagagcaggggctgctcccaaacggcgagccttcccaacatagcagtgcacctcagaagtccctgcccgacctcccccccccgaaaatgattcccgagcggaaacaacttgcaattcctaagaccgagtcgcctgaagggtattatgaggaagccgaaccgtatgacacatctctgaatgaagacggtgaggccgtttcttctagctacgagtcttatgatgaggaagacggatctaaagggaagagcgccccctaccagtggccttcaccggaggctgggattgagctgatgcgggatgcgaggatctgcgcctttctgtggcgaaagaaatggctcggacagtgggccaagcagctgtgcgttattaaagacaaccgcctactgtgctacaagtcctctaaggatcacagccctcaactggacgtaaacctactgggatccagcgtcattcataaggaaaagcaggtccggaagaaagaacacaagctgaaaatcacacccatgaacgctgacgtcatcgtgttaggcctccaatccaaggatcaggcggagcagtggctgagagtgattcaggaagtctccggactaccaagtgaaggcgcttcagaaggaaaccaatacaccccagacgctcagcggttcaattgtcagaaatag

SEQ ID NO: 177686 - DNA, 939 bp, Artificial Sequence
  Description of Artificial Sequence: Synthetic coding sequence
atggagcggtacaaggcccagggctgctgctgcctggtggtgcagcgacgaataaggcaggtgagtgcttctttagagcagctcttgacagagctagatgatttcctgaaaattcttgaccaggaaaacctctcaagcacagccctggtcaaaaagagctgcctggcagagttgctgcgcttgtacacaaaatcaagctcttcagacgaggaatacatttatatgaacaaggtgaccattaacaagcagcagaacgctgagagtcaaggcaaagcgccagaggaacaaggactgctgcccaatggcgaaccttcccagcattcctcagccccccagaaaagtttacctgacttaccaccgccaaaaatgattcctgaaagaaagcagctggccattccaaagaccgaaagtccagaaggctactacgaggaggcggagccatatgacacctcactaaacgaggacggtgaagccgtgtccagcagctacgaatcctatgatgaagaagacggctccaagggaaagtctgccccgtaccaatggccctctcctgaagccggtatagaattaatgcgcgatgctagaatctgtgctttcctgtggcgcaagaagtggctgggacagtgggcaaagcaactgtgcgtgatcaaagacaatcggttactgtgttataagagcagcaaagatcattctccccagctggatgtgaaccttctggggtccagcgtgattcacaaagaaaagcaggttcgcaagaaggagcacaagctgaaaatcacccctatgaatgctgacgttattgtcctcggacttcagagcaaggaccaggcagagcagtggctcagggtcatccaagaggtgtctggactgcctagcgaaggagcctctgagggtaatcagtacacgccggacgcacaacggtttaactgccagaagtag

SEQ ID NO: 177687 - DNA, 2616 bp, Artificial Sequence
  Description of Artificial Sequence: Synthetic coding sequence
atggagcggtacaaggccctggagcagctgctgaccgagctggacgacttccttaagattctggatcaggaaaacctgtcctccaccgctctagtgaaaaagagctgcctagcagagctattacgcctgtataccaagtcttcctcatcggatgaggagtatatctacatgaacaaggttactatcaacaaacagcagaatgccgaatcacaagggaaagcccccgaagagcagggtctgttgcctaatggtgagccttcccaacactcctcagccccccaaaaatcgttgccagatctcccccccccaaaaatgaggattttaactttgggccagatctcaggagctcagtcttttagtcccgatgggacccatctcaccggcacagaattccttggcggctggagttggcgaccctctcagatccggcttatgagccctgggacacactggggagacctgacagccactgagatccctgagagaaagcagctcgcaatccctaagacagaaagtcctgagggctattacgaggaggcagaaccttacgatacttcactgaatgaagacggcgaggccgtctcctcatcctacgagtcctacgacgaggaggacgggagtaagggtaaatctgcaccctatcagtggccatcaccagaggcggggatcgagctgatgcgggatgcccgcatatgtgcctttctgtggaggaagaaatggttggggcagtgggcaaaacagctgtgcgtgatcaaggataacagacttctgtgctataagtccagtaaagatcatagcccccaactcgacgtgaacctactagggtcatcggtgatccataaggaaaaacaggtgaggaagaaggagcacaaattgaagattaccccaatgaatgcagatgtgatagtattagggctccagagtaaggaccaggccgaacagtggctgcgggtaattcaggaggtgagtgggctaccttccgagggagctagcgagggaaaccagtatacccctgacgcccaaagattcaactgccagaagccagacatagctgagaaatatctgagcgctagtgaatatgggtctagcgtggacggacaccccgaggtgcctgaaactaaggatgtgaaaaagaaatgcagtgccggcctcaagctgagtaatctcatgaatttgggaagaaaaaaatctacttcactagaaccagtcgaacggtcgctggaaacatcctcctatctgaacgttctggttaactcccagtggaaaagccggtggtgtagcgtgcgcgataatcacctccacttctaccaggaccgaaatcgaagtaaagtggcccagcagccactgtctctggtgggctgcgaggtagttcctgacccctcacctgaccatttgtactccttccgcatactccataagggagaggagctggccaagctcgaggccaaatctagcgaagagatgggtcactggctcggcctcctgctgtccgaatctggtagcaaaaccgatcccgaagagtttacttacgattatgttgacgccgaccgggtttcctgcatcgtgtctgcggccaagaactcactgctgcttatgcagcgaaagtttagcgaacccaacacctacatcgatggactgccctcccaggatagacaagaagagctgtatgatgatgtggacctgtctgaattaaccgccgcggttgaaccaaccgaagaggctacacctgtcgccgacgacccgaatgagagggagtccgatcgagtgtatttggaccttacacccgtcaagtcatttctgcatggtccttcttcggcccaggcccaggcttcctcccctaccctgagctgtctggataatgccacagaagccctacctgccgatagtgggcctggcccaacaccggatgaaccctgcatcaaatgtcctgagaacctgggagaacagcagctggaatccctggagccggaagatcctagcctgagaattacgaccgtgaaaatacaaaccgaacaacagcggattagctttcccccctcctgccccgatgcagttgtggcgactccccccggcgcgagtcccccagtcaaagatagattgagggtaacctctgccgaaatcaaactggggaagaatcgcacagaagcagaggttaagcgttacacagaagagaaagaacggctggaaaaaaagaaggaagagattcgggggcaccttgcacagttgaggaaggaaaagcgagagctgaaagaaacgttgctgaaatgtaccgataaggaagtgctggcttctctggagcagaaactgaaagagatagatgaagaatgtcgaggcgaggaatcccgcagggtggatctggagctgagcattatggaagtcaaggacaacctgaagaaggccgaggctgggccagttaccttaggaacaacagtggatactacgcaccttgaaaatgtctctccaaggcccaaggcggtgacacccgcatctgcccctgactgcaccccagtgaactctgccacgacactgaaaaacaggccgctgagcgtggtcgtcactgggaagggaacagtgctacagaaagctaaagaatgggagaaaaagggggcctcttag

SEQ ID NO: 177688 - DNA, 1002 bp, Artificial Sequence
  Description of Artificial Sequence: Synthetic coding sequence
atgtgcgaggaggagaccaccgccctggtgtgcgacaacggcagcgggctgtgcaaggctggtttcgctggggatgacgcccctcgtgccgtttttcctagcattgtcgggagaccccggcatcagatctggcaccactcattctacaacgagctacgcgtggcccccgaagagcaccctacacttcttaccgaagctcctttgaaccctaaggcaaatcgcgagaagatgacacagatcatgttcgagacgtttaatgtgccagctatgtacgtggcaatacaggcagttctctccctttatgcctcaggtcgtacaacaggtatcgtgctggattctggggacggggtgactcacaatgtgcctatctacgaaggatacgccttgccgcacgctataatgcgccttgacctcgctggaagggatctgactgattatctcatgaagatcctcacggaacgtgggtactcctttgtgacgactgctgaacgggaaattgtccgtgatatcaaagagaagctgtgctatgtggccctggacttcgaaaacgaaatggcaacagccgcttctagcagctctcttgagaagagctatgaactccctgatggtcaggtgatcactattgggaacgagaggttcaggtgtcccgagaccctgttccagcccagcttcattggcatggaatcggccggaatccacgagacaacttacaacagcatcatgaaatgtgacatcgatatcagaaaggatctatatgccaacaacgtactgtctggcgggactaccatgtatccaggaattgccgatcggatgcagaaagagatcacggcgcttgcgccaagcactatgaagattaagatcattgcaccacccgaacggaagtacagtgtttggatcgggggatctattctggcgtctttaagcacttttcagcagatgtggatttctaaaccagaatatgacgaggccggcccctccatcgtccatcgcaagtgtttttag

SEQ ID NO: 177689 - DNA, 1113 bp, Artificial Sequence
  Description of Artificial Sequence: Synthetic coding sequence
atgagcctgcaccagttcctgctggagcccatcacctgccacgcctggaaccgggaccggacacagatagccttatcccccaataaccatgaggtccacatttataagaaaaatggtagccagtgggtaaaggctcatgaattgaaggaacataatggccacatcaccggcatagattgggctccaaaatctgataggattgtaacatgtggcgctgatagaaacgcatatgtctggtctcagaaggacggggtgtggaagcccaccctggtgattctccgaatcaaccgtgcggctacctttgttaaatggtcaccactggaaaataaatttgccgtgggaagtggtgcgaggctgattagcgtttgttatttcgagagcgagaatgactggtgggtaagtaagcatatcaagaagcccattagaagtacagtgctgtctttagactggcatcccaataatgtcttattggccgcgggatcttgcgacttcaaatgtcgtgtcttttctgcctacatcaaagaagtggacgaaaaacccgcgtcaaccccctgggggagtaaaatgccttttggacaactcatgagcgaatttggagggagcggcactgggggttgggtccacggcgtttcattttccgcctctggaagccggctggcatgggtatctcatgatagtaccgtgtccgtcgctgacgcgagcaagtctgtacaggtgtccacgctcaagaccgagtttctcccactgctgtcagtgagcttcgtctccgaaaactcagtagtggctgcaggacacgattgttgtcctatgttgtttaattatgatgaccgagggtgcctcactttcgtatcaaaactagatatccccaaacagtcaatccaaaggaacatgagtgccatggagagatttaggaacatggacaaaagggccaccacagaagataggaatacagctctggagaccctgcaccagaactctattacccaggttagcatctacgaagtcgacaaacaagattgtagaaagttttgtactaccggcatcgacggagcaatgaccatctgggacttcaaaacactggagagttcgattcaggggctacggatcatgtag

SEQ ID NO: 177690 - DNA, 1038 bp, Artificial Sequence
  Description of Artificial Sequence: Synthetic coding sequence
atgcacgagcggttcatccactgcttctgcatcgactgggcccccaagtctgacagaattgttacctgtggtgccgatcggaatgcctatgtgtggagtcagaaagatggcgtgtggaagcctacactcgtgattctcagaataaatcgtgccgccacttttgtgaagtggtctccacttgagaacaagttcgcggtcggtagcggcgccagactgattagcgtctgctattttgagtctgaaaatgactggtgggtgtctaaacacattaagaagcctattaggtcaaccgtactaagcctagactggcaccctaataacgtgctcttggcagccggatcttgcgacttcaaatgtagggtctttagcgcttacatcaaggaggtggatgagaaaccggcctcaacaccctgggggtccaaaatgcctttcggtcagctcatgtccgagttcggcgggagcggcaccggaggatgggtgcacggtgtgtccttctccgcctccggatcccggcttgcatgggtgtcccacgattctacagtcagcgttgccgacgctagtaagagcgttcaggtcagcacgctcaagaccgagtttctgcctctcctcagtgtgtctttcgtgagcgaaaacagcgtagtggccgctggacatgattgctgccccatgctgtttaactacgacgatcgcggatgcctgactttcgtgtccaaacttgatatcccaaagcagtctatccagcgtaatatgtccgccatggaaaggttccggaatatggacaagcgggctaccaccgaagacaggaacactgcattggaaacactccaccaaaacagtataactcaggtgagtatatatgaggtcgacaaacaggactgtcgcaagttctgcacaaccggcattgacggggcgatgacgatatgggactttaaggaaccctcccggcacgggctcccgcagctgccggggggggcacaccagctcccgcggctggagcaggggcctcaccccgactgtcacctgccacagcagccttag

SEQ ID NO: 177691 - DNA, 1119 bp, Artificial Sequence
  Description of Artificial Sequence: Synthetic coding sequence
atggcctaccacagcttcctggtggagcccatcagctgccacgcctggaacaaggacaggacacagatcgccatttgccctaacaaccacgaggtccatatctacgaaaaatccggggcgaagtggacaaaagtgcacgagctgaaggaacataatgggcaagtgacgggaattgattgggcacctgagagcaaccgcatcgttacttgtggtacagacagaaatgcttacgtgtggactctgaagggtaggacatggaaacctacactggtcattctgcgcatcaacagggctgctaggtgtgtgcgatgggctccaaacgagaacaagtttgcggtaggtagcggaagtagagtcatttcaatctgttattttgaacaggagaacgactggtgggtatgcaagcacattaagaagcctatacggtctacagtgctgtctctagactggcaccccaataatgtgctcctagcagctggcagctgcgatttcaagtgcaggatcttctcggcctacattaaggaggtggaagagcgcccagcccccaccccctggggatccaagatgccattcggcgagcttatgtttgagtctagctccagttgtggatgggttcacggagtgtgctttagcgcatccggctccagagtggcttgggtctctcacgactcaactgtgtgcctcgccgatgctgataagaagatggcagtggccacgttagcctctgagacactcccactgctagctctgaccttcattacagacaattcgctcgtcgcagcgggacatgactgcttcccagtgttgtttacttacgacgccgccgccggaatgctgagctttggtgggcgtttagatgtgcccaaacagtccagccaaagaggccttaccgcacgggaaagattccagaatctggataagaaagcaagcagtgaagggggcaccgctgctggcgctggtttagactcactgcacaagaactccgtatcacagattagcgttctttctggcggaaaggccaaatgtagccagttctgcacaacggggatggacggcgggatgagcatctgggatgtaaaaagcctcgaaagcgcactgaaggatctgaagatcaagtag

SEQ ID NO: 177692 - DNA, 309 bp, Artificial Sequence
  Description of Artificial Sequence: Synthetic coding sequence
atggcctaccacagcttcctggtggagcccatcagctgccacgcctggaacaaagacagaacccagatagctatctgccccaataaccacgaagtgcacatctacgagaagtctggcgccaaatggacaaaagtgcacgagcttaaggaacataatgggcaggtcaccgggattgactgggccccagaatcaaaccggatcgttacttgtggcacagatcgcaatgcttatgtctggacactgaaaggaaggacatggaagccaaccctggtgattctgcgaattaacagagccgctcggtgcgtttag

SEQ ID NO: 177693 - DNA, 393 bp, Artificial Sequence
  Description of Artificial Sequence: Synthetic coding sequence
atggcctaccacagcttcctggtggagcccatcagctgccacgcctggaacaaagatcgcacccaaattgccatttgccccaacaatcacgaggttcacatctacgaaaaaagcggcgcaaagtggacaaaggtgcatgaattgaaggagcacaacggacaggttacgggaattgattgggcaccagaatctaaccgcattgtaacatgcggcacagacaggaacgcgtacgtgtggactctcaaggggaggacatggaagccaactcttgtgatcctgaggataaatagggccgcacggtgtgtgagatgggcgcctaatgagaacaaattcgccgtcggttcaggatcccgcgtaatttcaatatgctatttcgaacaggaaaacgactag

SEQ ID NO: 177694 - DNA, 252 bp, Artificial Sequence
  Description of Artificial Sequence: Synthetic coding sequence
atggcctaccacagcttcctggtggagcccatcagctgccacgcctggaacaaagaccgcacgcagattgcaatttgtcccaataaccatgaagtccatatttacgagaaaagtggagctaaatggacaaaggtgcatgagttaaaagaacacaacggccaggtcacggggatcgactgggcacccgagagcaaccggatcgtgacatgcgggaccgaccggaatgcttacgtctggaccctaaaggggtag

SEQ ID NO: 177695 - DNA, 402 bp, Artificial Sequence
  Description of Artificial Sequence: Synthetic coding sequence
atggcctaccacagcttcctggtggagcccatcagctgccacgcctggaacaaagataggactcaaatcgctatctgtcccaataaccacgaagtgcacatctatgaaaagtcaggagctaagtggacaaaagtccatgaactgaaagagcacaacgggcaggtcaccggaattgactgggcaccggagagcaaccgcatagtgacttgcggcacggaccggaatgcttatgtctggacactgaagggccggacatggaagcctacactggtcatccttcggataaacagggcagcccgttgcgttagatgggcacctaacgagaacaaatttgccgtgggctccggaagtcgggtcatctctatctgttactttgaacaggagaacgactggtgggtgtag

SEQ ID NO: 177696 - DNA, 66 bp, Artificial Sequence
  Description of Artificial Sequence: Synthetic coding sequence
atggcctaccacagcttcctggtggagcccatcagctgccacgcctggaacaaggacaggacctag

SEQ ID NO: 177697 - DNA, 402 bp, Artificial Sequence
  Description of Artificial Sequence: Synthetic coding sequence
atggcctaccacagcttcctggtggagcccatcagctgccacgcctggaataaggaccgcacgcaaatcgccatttgtcccaacaaccatgaggtccatatctacgagaagagcggggcgaaatggacgaaagtccacgagctgaaggagcacaatgggcaggttaccgggatcgattgggcccccgagtccaatagaattgtgacttgtggtacagatcgcaatgcctacgtttggacactgaaggggcgtacgtggaagcctaccctggtgatactgagaattaatcgggctgctcggtgcgtgagatgggcccctaacgaaaacaagttcgccgtcggtagtggctctagagtcatctccatttgctatttcgagcaggagaacgattggtgggtctag

SEQ ID NO: 177698 - DNA, 327 bp, Artificial Sequence
  Description of Artificial Sequence: Synthetic coding sequence
atggcctaccacagcttcctggtggagcccatcagctgccacgcctggaataaggatcgcacccagatcgcaatttgcccaaataatcatgaagtgcacatctatgaaaagagcggtgccaaatggaccaaagtccacgagttgaaggagcacaacggccaagtcaccggaattgactgggcaccagaaagcaatagaatcgtgacttgtggcactgaccgcaatgcatacgtttggacgctgaaaggcaggacttggaaacctacgttagtcattttgcgaattaatagagcggccagatgcgtcaggtgggcacccaacgagtag

SEQ ID NO: 177699 - DNA, 1119 bp, Artificial Sequence
  Description of Artificial Sequence: Synthetic coding sequence
atggcctaccacagcttcctggtggagcccatcagctgccacgcctggaacaaagatagaacgcagattgccatttgcccaaacaaccacgaggtgcatatctatgagaagagtggggccaaatggacaaaagtgcacgaattgaaggaacacaacggacaggtcacaggaatcgactgggctcccgaatccaataggattgtgacctgtggaactgatcggaatgcttacgtttggacactaaaggggcgcacttggaaacccaccttagtgatactgcggatcaatagggcagcccggtgcgtaagatgggcccctaacgagaataaatttgctgtagggagcggatcccgcgtcatcagcatttgttacttcgagcaggaaaacgattggtgggtatgtaagcatatcaagaagccaattcgatcaactgtgctgtcacttgactggcaccccaacaacgtgttgctggctgcaggatcatgtgatttcaaatgccggattttcagtgcctatatcaaggaggtcgaagagcggcctgcccctaccccgtgggggtccaagatgccttttggcgagctgatgttcgaaagctctagttcatgtgggtgggtccatggcgtgtgcttctccgctagtggttcacgggtagcctgggtgtctcacgacagcaccgtgtgtctggccgacgctgataagaagatggctgttgctactttggcctctgagacgctcccacttcttgccctcactttcattacggataactcgttggtggcagctggccatgactgcttccctgtgctgtttacctatgacgctgctgctggaatgctctcttttggcggccggttggatgtgcctaaacaatcgtcgcaacgaggattgactgcgcgggagaggtttcaaaacctagacaaaaaagcatccagtgaaggcggaacagccgccggtgccggcctcgatagcttacacaagaacagtgtttcacagatttcagtgctgagtggggggaaagcaaaatgctcccagttctgcacaactggcatggacggcgggatgtctatttgggatgtgaagtctctagaatcggccttgaaagaccttaagatcaagtag

SEQ ID NO: 177700 - DNA, 387 bp, Artificial Sequence
  Description of Artificial Sequence: Synthetic coding sequence
atggcctaccacagcttcctggtggagcccatcagctgccacgcctggaacaaagacagaactcagattgcaatctgccccaacaaccacgaagtacatatctacgaaaaatcaggggccaagtggactaaggtgcatgagctgaaagagcacaatggccaggtgacaggcatcgactgggccccagaatcaaacagaatcgtcacttgtgggacagatcgcaatgcgtatgtctggacgctaaagggtagaacctggaaacctaccttagttatcctgaggataaaccgagccgctagatgcgttcgttgggcccccaatgagaacaaatttgccgtaggcagtgggagccgcgtgattagcatctgttatttcgaacaggaatag

SEQ ID NO: 177701 - DNA, 402 bp, Artificial Sequence
  Description of Artificial Sequence: Synthetic coding sequence
atggcctaccacagcttcctggtggagcccatcagctgccacgcctggaacaaggatagaacacagatcgctatatgtccaaataaccatgaggtccatatttacgagaaaagtggcgcgaaatggactaaggtgcatgagttaaaggagcataatggacaggtgacaggcatcgattgggcgcccgaatcgaatcgtatcgttacctgcgggactgataggaacgcctacgtgtggactctgaagggccggacatggaagcccaccctggtgattcttcgcattaaccgggctgcgagatgtgtgcggtgggctcccaatgagaataaattcgctgttggtagtggaagcagagtaatttcaatctgctacttcgaacaagagaacgactggtgggtttag

SEQ ID NO: 177702 - DNA, 903 bp, Artificial Sequence
  Description of Artificial Sequence: Synthetic coding sequence
atgatcctgctggaggtgaacaaccggatcatcgaggagaccctggctttgaagtttgaaaacgccgccgctggtaataagccagaagccgttgaagtcacattcgctgactttgacggagtgctttaccacataagcaacccgaacggggataaaacgaaagtaatggtgtctatctctctcaagttttacaaggagctgcaggctcatggagctgatgagcttttaaaacgagtgtacggatcatttctggtaaaccctgagagtggatacaatgtatcacttctgtacgacctcgagaatttacccgcttctaaggattccattgttcatcaggccggaatgctgaagcgtaattgttttgcatctgtctttgagaaatattttcaatttcaggaggagggaaaggaaggagaaaatcgtgccgtaattcactaccgagacgacgaaacaatgtatgtggagagcaagaaagaccgtgtaactgtggtcttttccacagtcttcaaggatgatgatgacgtggtcatcggcaaggtgttcatgcaggagttcaaggagggcagaagggctagccacacggccccacaggtcttattcagtcaccgagaaccccctctggagctgaaggacacagacgcagcagtgggcgataacatcggctatattactttcgttctatttccacgacacacgaacgcatccgcccgagacaatacaataaatctaatacacactttccgggactacttgcactatcatatcaagtgttccaaggcttatattcacactcgaatgagggcaaaaacatcagattttttaaaagtattaaacagggctcgaccagacgccgaaaagaaggagatgaagacaatcaccggaaagaccttttcttccagatag

SEQ ID NO: 177703 - DNA, 903 bp, Artificial Sequence
  Description of Artificial Sequence: Synthetic coding sequence
atgatcctgctggaggtgaacaaccggatcatcgaggagaccctggcactcaagttcgaaaatgccgcggcggggaacaagccagaggccgtggaggttacattcgctgactttgacggggtgttgtaccatatttctaaccccaatggagataagactaaggtgatggtgagtatttccctcaagttttataaagagctacaggcacatggagccgatgagctcctgaaaagggtgtacggctctttcctggtgaatcccgaatcagggtacaacgtgagcctgctgtatgatctcgagaacctgcccgcctccaaagattccatagtacaccaggcaggtatgctaaagcgcaactgttttgcctccgtgtttgaaaaatattttcagtttcaggaggagggtaaagagggggagaacagggccgtgattcactatagggacgacgagaccatgtatgtggagagcaagaaggacagggtaacagtggttttctcgacagtgttcaaagatgatgacgacgtcgttataggcaaggtgtttatgcaggagtttaaagaagggagacgggcatcccacaccgcaccccaagttcttttttcacatcgggagcccccacttgagctaaaggatacagatgctgctgtgggcgacaacataggatacatcactttcgtcctcttccctaggcatacaaatgcctctgcccgtgataacaccattaatttgatccatacattccgggactacttacactatcatattaagtgttccaaagcatacattcacactcgtatgcgggccaaaactagtgatttcctgaaggttttgaatagagctcggccagacgctgagaaaaaggagatgaagacaattactggcaaaacattctcctcaaggtag

SEQ ID NO: 177704 - DNA, 273 bp, Artificial Sequence
  Description of Artificial Sequence: Synthetic coding sequence
atgatcctgctggaggtgaacaaccggatcatcgaggagaccctggctttgaaatttgaaaacgctgctgctgggaataaacctgaagccgtcgaggtaacctttgctgactttgacggtgtgctctaccacatctccaatcccaacggagacaaaactaaagtgatggttagtatctccctcaagttctacaaggagctccaggcacatggagcagatgaactcctgaagagggtctatggctcctttctcgtgaaccctgagtccggctag

SEQ ID NO: 177705 - DNA, 864 bp, Artificial Sequence
  Description of Artificial Sequence: Synthetic coding sequence
atgtgcgacgaggacgagaccaccgccctggtgtgcgacaacggcagcggccttgtgaaggccggtttcgcgggcgatgatgctcctcgcgctgtgtttcccagcatcgtgggacgcccgaggcaccagggcgtcatggtcggcatgggccagaaggattcttacgtgggggacgaagctcagtcaaagcgggggatcctgacacttaaatatcctatcgagcacggtatcataaccaattgggatgacatggaaaaaatttggcaccacacgttttataacgagctacgagttgctcctgaggagcaccctacactcttgactgaagccccgctgaacccaaaggctaatcgtgaaattgtccgagacatcaaggagaaattatgttacgtagccttggatttcgaaaatgaaatggctaccgcagcaagctcttcgtcactggagaagtcatacgagctccctgacgggcaagtgattactatcgggaatgaaaggttccgctgcccagaaaccctttttcagccgtcgttcatcggtatggaatctgccggaattcatgagaccacatataatagcattatgaagtgcgacatagacatacggaaggacctgtacgcaaacaatgtcatgtccggaggaaccacaatgtatcccggcattgccgataggatgcagaaggagataactgccctcgctccttcgaccatgaaaataaaaataatagctccccccgaaagaaagtattctgtctggattgggggctcgattctggctagcctcagcacatttcagcaaatgtggataacaaaacaggaatatgacgaggctggcccgtcgatagtccacagaaagtgtttttag

SEQ ID NO: 177706 - DNA, 765 bp, Artificial Sequence
  Description of Artificial Sequence: Synthetic coding sequence
atgtgcgacgaggacgagaccaccgccctggtgtgcgacaacggctctgggctcgttaaggccgggtttgctggtgacgacgcccctagggccgtgtttccaagcattgtggggcggccaagacatcagggagtgatggtgggcatggggcagaaagactcctacgttggggacgaagctcagtcgaagcgtggtatactcactctcaagtacccaatcgagcacgggattataacaaattgggacgacatggagaaaatatggcatcataccttctacaatgaattgcgcgtggcacccgaggagcacccaacactgctgacagaggcgccccttaacccgaaagccaatcgcgaaaagatgacccagataatgttcgaaacgtttaacgtccctgcaatgtacgtggccatacaagcagtgctcagcctctacgcctctggtagaaccactggaatcgtgctcgacagcggagatgggatcatgaaatgcgacattgacattcgtaaggatctctacgccaataacgttatgtccgggggaaccacaatgtatcccggaatcgccgaccggatgcagaaagaaatcactgccttggctccatctacgatgaaaataaagattatcgcgccaccagaaagaaagtattcagtgtggataggaggcagtatattggcatcactatccacttttcaacagatgtggataacgaaacaggaatacgacgaggccggaccatctatcgtacaccgcaagtgtttctag

SEQ ID NO: 177707 - DNA, 1029 bp, Artificial Sequence
  Description of Artificial Sequence: Synthetic coding sequence
atgtgcgacgaggacgagaccaccgccctggtgtgcgacaacggcagcgggctggtgaaggcaggctttgcgggagacgacgccccgagggcagtcttcccgagcatcgtcggaaggccacggcaccaaggcgtgatggtgggcatgggccagaaggactcttacgtgggcgatgaggcgcagagcaagagggggattcttaccttaaagtacccaatagagcacggcattattacgaaagccaaccgagagaaaatgacccagataatgtttgagacgttcaatgtgccagcaatgtacgtcgctattcaggcagtcctaagcctgtacgcttctggaagaaccactggcatagtccttgactccggggatggcgtgacacacaacgtccctatttacgagggttatgcactgcctcatgcgattatgcggctcgatctggccgggagagaccttacagattacctcatgaagatcctcacagaacgtgggtattctttcgttactaccgcagaacgtgagatcgtcagggatattaaggagaagctgtgctacgtggcgctcgacttcgaaaacgagatggctaccgctgcctcttcctcatctttagaaaaatcttatgagctgccggatggccaggttatcacaatcgggaatgagcggtttagatgcccagaaaccctgttccagccatccttcattggcatggaatcagccggtatccatgagacaacctacaattctattatgaaatgtgacatcgacattcgcaaggacctgtacgccaacaacgtgatgtcaggcgggaccactatgtatcctggtatcgcagaccggatgcagaaagaaatcacagctctggccccatccaccatgaagattaaaattatcgcaccaccagagcgcaaatattcagtgtggataggcggaagcatattggcttcgctttctacattccagcagatgtggatcaccaagcaggaatatgacgaggctggaccatctattgtacacaggaagtgcttctag

SEQ ID NO: 177708 - DNA, 870 bp, Artificial Sequence
  Description of Artificial Sequence: Synthetic coding sequence
atgtgcgacgaggacgagaccaccgccctggtgtgcgacaacggctcaggtttggtgaaagctggatttgctggcgatgatgctcccagggctgtatttccaagcatcgtgggaaggccacgccaccagggagtgatggtaggaatgggacagaaagactcatatgttggggacgaggctcagtcaaaacggggcatcctaacactgaaataccctatagagcatggtattatcacaaattgggatgacatggaaaagatctggcatcataccttctataatgaactgcgggtagcccctgaggaacatccaactctgctgaccgaggccccgctgaacccaaaggcgaaccccgaacgtgaaatcgttagagatataaaggagaaattgtgttacgtggcactggacttcgaaaacgagatggcaactgcggcaagctcttcatccttagaaaaatcttatgaacttcccgatggccaggtgataactattggaaacgaacgattcagatgcccggagaccctttttcaacctagctttataggtatggagagcgctgggatccacgagactacctacaactccatcatgaagtgcgacatcgatatacgaaaagacctatatgccaataatgtgatgtccggagggacaaccatgtatccgggtatcgccgaccgcatgcaaaaagaaataactgccctggcaccctccaccatgaagatcaagataatcgcaccccccgagaggaagtactctgtatggatcgggggcagcatcctcgcttctctgagcacatttcagcaaatgtggattactaagcaggagtatgatgaggccggcccttccattgtgcataggaagtgtttctag

SEQ ID NO: 177709 - DNA, 1134 bp, Artificial Sequence
  Description of Artificial Sequence: Synthetic coding sequence
atgtgcgacgaggacgagaccaccgccctggtgtgcgacaacggcagcggtctcgttaaggccggctttgccggggatgacgctcctcgagcagtgttcccaagcatagtgggaaggccaaggcaccagggcgtcatggttggaatgggacagaaagatagctacgtgggcgatgaggcacaaagcaagagaggaattctcacacttaaataccctatcgagcacggtatcatcacaaactgggacgacatggaaaaaatttggcaccacaccttctataacgagcttcgcgttgcaccagaggagcatccgacattactgaccgaagcacccctgaaccctaaggccaatcgggagaaaatgacacagatcatgtttgagacctttaatgttccagccatgtacgtggctatccaggcggtgctgtcactgtacgccagtgggaggacaacaggaatagtgctggacagcggcgacggggtcactcacaatgtgcccatttatgaagggtatgctttgccacatgccattatgcggcttgatctcgctggcagagatttgactgactatctcatgaaaattctgactgagcgaggctattctttcgtgacgacagccgagagggaaattgtgcgggacattaaggagaagttgtgctatgtggcactcgactttgagaacgagatggccacagcagcttcatctagctctctggagaagtcgtatgaactgcccgatgggcaggtgattaccattggaaatgaacgattccgttgtcccgagacactctttcagccgagcttcataggcatggagtcagccggaattcatgagacaacttacaactccattatgaagtgcgatatagatataaggaaggatctttacgcaaataacgtcatgtctgggggtaccacaatgtaccccggaatcgcagatcgcatgcagaaggagatcacagctctggcaccctcaaccatgaaaataaagatcatagccccccctgaaaggaagtactccgtgtggattggaggaagtattctggcctccttgtccacctttcagcaaatgtggatcaccaagcaggaatacgacgaggctggaccctctatcgtgcatcggaagtgtttctag

SEQ ID NO: 177710 - DNA, 1146 bp, Artificial Sequence
  Description of Artificial Sequence: Synthetic coding sequence
atggcccccggcgagaaggagagcggcgagggccccgccaagagcgcactgcgcaagattcgcactgccacactggtgatcagtcttgctcggggctggcagcagtgggctaacgaaaattccattcgccaggctcaggagccaactggctggcttccgggaggtacccaagactccccccaagcacctaagcccatcacaccaccgacctcccaccagaaggcccaatctgcaccaaagtctcccccccggctgcctgagggtcacggagacggccaatcaagcgaaaaggccccagaggtgtcccacataaagaaaaaagaggtctcaaaaactgtggtgtcgaagacctacgagcggggcggagacgtatcccatctgtctcatcggtacgagcgagatgctggcgtgttagaacccggccagcccgagaatgacatcgaccggatcctgcactctcacggctctccaactcgaaggaggaagtgcgcaaacctggtatctgagctgacaaaaggttggcgagtaatggagcaggaggaaccgacttggcgttcagatagtgtggataccgaggactccggctacggtggtgaggccgaggagcggcccgagcaggatggtgttcaggtcgccgtggtgcgcattaaacgacctttacccagccaagtcaatagatttacagagaaactgaactgtaaggcccagcaaaagtatagtcctgtcggcaacctcaaaggccggtggcaacagtgggccgacgaacatattcagtcgcagaaactcaacccattcagtgaagagtttgattacgagctcgctatgagcactaggttgcacaaaggtgacgaaggctacggtcgacctaaagaagggacaaagaccgctgaacgcgctaagagggccgaagagcacatttatagggagatgatggacatgtgctttatcatctgtaccatggccaggcaccgccgggacgggaagatacaagtgacattcggtgaccttttcgataggtacgtgagaataagtgataaagttgttggcatccttatgcgtgcaaggaagcacgggttggtcgacttcgagggagagatgctgtggcaaggtcgcgacgatcatgtggtaattacgctcctaaagtag

SEQ ID NO: 177711 - DNA, 2685 bp, Artificial Sequence
  Description of Artificial Sequence: Synthetic coding sequence
atgaaccagatcgagcccggcgtgcagtacaactacgtgtacgacgaagatgaatatatgattcaggaggaggagtgggatagggacttgctgcttgaccccgcctgggagaaacagcagcggaagacttttactgcttggtgcaactcacatttacggaaggccggcacccagatcgagaatatcgaagaggactttcgtaacggtttgaaactgatgctgttgttggaagttatctccggcgaacgacttcctaagccagaccgtggaaagatgaggttccacaaaatcgctaatgtaaacaaggctctggattatatagccagcaagggggtaaaattagtgagcataggagctgaagaaatcgttgacggaaatgttaagatgaccctgggcatgatatggactataattcttcggttcgcaatccaagatatctctgttgaggagacctctgccaaagagggccttctcctctggtgtcagaggaagaccgccccataccgcaatgtaaacatacagaactttcacactagttggaaagacggcctgggattgtgcgctctgatacacagacaccggccggatctaattgattacagcaagctcaacaaggacgaccctataggcaatattaacttagcaatggagatcgccgaaaagcatcttgacattcctaagatgctcgacgccgaggacatagtcaatacacccaagccagacgaaagagctattatgacctatgtaagttgcttttatcacgcctttgccggggctgaacaagctgaaactgccgccaataggatctgtaaggtacttgccgtgaaccaagagaatgaaagattaatggaggagtacgaacgtctggcttcagagctcctggagtggataagaaggaccataccttggttggaaaaccggactcccgaaaagacaatgcaagcgatgcaaaagaaactggaagacttcagagactaccgccggaaacacaaacctcctaaggttcaagaaaagtgtcaactagagatcaattttaatactttacagactaagctgcgtatctccaaccgccccgcctttatgccttcagagggcaagatggtaagcgacatcgctggcgcctggcaacggttagaacaggctgagaagggctacgaggaatggctcctcaatgaaattaggcgactggaacgactggagcacttagccgagaaattccggcagaaggcctctacgcatgagacttgggcatacgggaaagagcagatcctgcttcagaaagattacgagagtgcgtccctgaccgaagtcagggcactgctacggaagcatgaggctttcgagagcgacctcgccgcccatcaggatagagttgagcagatagcggccattgctcaggagttgaacgagctggattatcacgacgcggtgaatgttaacgataggtgccagaagatatgcgatcaatgggacagacttggaactttgactcagaaaaggcgcgaagccctagaaagaatggagaaattgctggagacaattgaccagcttcatctcgagttcgctaagagggccgccccctttaacaattggatggaaggagctatggaggacctccaagatatgtttatcgtccactcaattgaggagattcagtccttgatcaccgcacacgagcagttcaaggcaaccctccctgaggcagatggagaacgccagtctatcatggcaattcagaatgaagtcgaaaaggtcattcagtcttacaatatccggatttcctctagtaacccttattcaacagtcaccatggacgaattaagaacaaagtgggataaggtaaagcaacttgtacccattcgcgaccaatcccttcaggaagaactcgctcgccagcacgcgaatgagcgcctgagaaggcagtttgcagctcaggcaaatgccatcggcccatggatccagaataaaatggaggagattgccaggagtagcatacagataaccggcgctctggaggaccagatgaatcagctcaagcagtatgaacacaacataattaattacaagaacaacatcgacaaactggaaggcgaccatcaactgatccaggaggctttggtgttcgataacaaacatactaattataccatggagcatattcgggtaggatgggaactgctgttgacaaccatcgcaagaacgattaatgaagtggagacacagatactgacccgtgatgccaagggaataacccaagaacaaatgaacgaattccgggcatcttttaaccatttcgatagaaggaagaacggcctgatggatcacgaggactttagggcctgcctcatctccatgggatatgacctgggcgaggccgaatttgcccgcattatgacgctggtggatcccaacggccagggcacagtgacctttcaaagcttcattgacttcatgacacgggaaaccgcagatacagacactgctgaacaggttattgcttctttccgaatcctcgcatcggataaaccgtacatcctcgccgaggaattgagacgggagctaccccccgaccaagcccaatactgtataaagcgaatgcctgcctattcagggcccggcagcgtccctggtgcactagactacgcggcgttctccagtgctctgtatggcgaatcggatctgtag

SEQ ID NO: 177712 - DNA, 2685 bp, Artificial Sequence
  Description of Artificial Sequence: Synthetic coding sequence
atgaaccagatcgagcccggcgtgcagtacaactacgtgtacgacgaggatgagtatatgatacaggaagaggaatgggatagggatctactcctggacccagcttgggaaaaacagcagcggaaaacattcaccgcctggtgcaactcccacctgagaaaagccggaacccaaatcgagaacatcgaggaggacttcagaaacggtctcaaacttatgctcctccttgaagttatcagtggggaacggctacccaagcccgaccgtggcaaaatgaggttccataagattgccaacgtgaacaaagcattggattatatagctagcaaaggtgtcaagttggtgtctataggggccgaggaaatcgtggacggcaatgtgaagatgacgcttggtatgatctggaccatcatcttacgcttcgctatccaggatatcagcgtggaggagacctcagctaaggaagggctgctgttgtggtgtcagaggaagacagctccttaccgaaatgtgaacatccaaaatttccatactagctggaaggatggattgggcctatgcgctttgatacaccggcatagaccagacttgattgactactcgaaactgaacaaagatgatccgattggcaacatcaacctggccatggaaattgccgagaagcatctagacatacctaagatgctcgacgccgaagatttagtgtacactgcacgccctgacgaacgggccatcatgacatacgtgtcctgctactaccatgctttcgctggggctcagaaagctgaaacagcggctaatagaatctgtaaggtgctggcagtgaatcaagagaacgagaggctgatggaggaatacgaaagactggcctctgagcttttagagtggatcaggagaacaattccgtggctcgaaaatagaacacctgagaaaaccatgcaggccatgcagaaaaagctcgaggattttagagactaccggcgcaagcacaagcccccaaaagtgcaggaaaagtgccagctggaaatcaatttcaacaccctgcaaacaaagctgagaatttccaacagacccgcgtttatgccaagcgaggggaagatggtaagtgacatagctggggcatggcagcggctggaacaggctgagaagggatacgaggaatggttgctgaatgaaatacggcggctggaaagattggagcatctcgctgagaagtttaggcagaaggcatcaactcatgaaacgtgggcctatggtaaggagcagattctgcttcagaaagactacgagtccgcaagtttgacagaagtgcgggcattgcttcgcaagcacgaggcctttgagtcagatctcgccgcccatcaggacagagtcgagcagattgcggcaattgcgcaagagttgaacgagttggattaccacgacgctgtgaacgtcaatgaccggtgccagaagatctgcgatcaatgggatcgactgggcacccttacacaaaaacgccgcgaagctcttgaacgaatggaaaagctcctcgaaactatagaccagctccacctggagttcgccaagcgggctgctcctttcaataactggatggagggggcaatggaagatttgcaggacatgttcattgttcacagcatcgaggagatacaatcactcataactgctcatgaacaatttaaagccactctaccggaggccgacggtgagcgccaaagcataatggccattcagaacgaggtcgaaaaggtaattcaatcctataacatccggatttctagttctaacccctacagtactgtcaccatggatgagctccggaccaaatgggacaaggtgaagcaactcgtgccaatacgagatcagagtctccaggaagaattggcacggcagcacgcaaacgaacggttgagaagacaatttgccgcacaggccaacgctattgggccctggattcagaacaagatggaagaaatcgcccgctcctctatccagattaccggagccctggaggaccagatgaaccaactgaagcagtacgagcataatattattaattataagaacaacatagacaagcttgagggagaccaccagctcattcaggaggctctggtgttcgataacaagcacaccaattacaccatggagcacatccgcgtcggatgggagcttctactcacgacaatcgcacggactattaatgaagtcgaaacccagattctcacccgggatgccaagggaataacccaggaacaaatgaatgagttccgggcctctttcaatcattttgatcgcagaaagaatgggctgatggaccacgaggactttagagcctgtctgatttctatggggtacgacctgggagaggcagaatttgctcgaatcatgacactggtcgaccctaacggacaagggacagttaccttccagagctttatcgatttcatgacaagagaaaccgccgatacagacactgccgaacaggtgatagcaagtttccgcattcttgcctccgataagccctatattttggctgaagagcttcgtagagaacttccacccgaccaggcccagtactgtatcaaacggatgcctgcttacagcggcccaggttcggtccccggcgccttggactacgccgctttctcttcagcactgtacggtgagtcagatctgtag

SEQ ID NO: 177713 - DNA, 1992 bp, Artificial Sequence
  Description of Artificial Sequence: Synthetic coding sequence
agcaccctgagcagcgtggagggcccccccgagagcagcacctgctcttatcaggaaatgcggcggtcatcagtcaatagctccgctatggcggaaaccgctgccaatagaatctgcaaggtactcgccgtgaatcaggagaacgaacgactgatggaagagtatgagaggctggcctccgagctacttgaatggatacgtagaaccataccctggctggagaatcgcacgccggaaaaaactatgcaggctatgcagaaaaaattagaggatttcagggactatagacgcaagcataaaccccccaaggtgcaggaaaagtgtcagctggaaatcaatttcaatacactacagactaagttgcgtatctcaaatcgacctgccttcatgccaagcgaagggaagatggtgtccgacattgccggagcttggcagcgcctggaacaggcggagaaggggtatgaggaatggctgttaaacgagatccgccgtctggagcggctggagcatctcgcggagaagtttagacagaaagcctctactcacgaaacctgggcatacggtaaggaacaaatactgttgcaaaaggactatgagagcgcgtcactcactgaggtgcgtgcactcttgcggaaacacgaggcattcgagtctgatctggccgctcaccaggaccgggtggagcaaattgctgctatagcccaggaactcaatgaactagactaccatgacgctgtgaacgtgaatgaccggtgccaaaagatctgcgaccagtgggataggctgggcacccttacccaaaaacggcgcgaggctctggagcgcatggaaaagctcttagaaaccatcgaccagctacacctggaattcgccaaacgcgccgcaccctttaataactggatggagggcgctatggaagatctgcaggacatgtttatcgtgcattccatcgaggagatccagagccttatcacagctcacgagcagtttaaagcgactctaccggaagctgacggcgaacggcagtccattatggccatacagaatgaagtggagaaagtcatccagtcatataacatccgtatcagctcctccaacccatactcaacagtcactatggacgagctgcgaacgaagtgggacaaagtgaagcagcttgtccccatccgggatcagtctctccaagaagagcttgcccgacagcacgctaacgagcgcctgaggcgccagttcgcagcacaggcgaatgccataggcccctggatccagaacaagatggaggagatcgcaagatcctctattcagattacaggagctcttgaggatcagatgaaccaactcaagcagtacgaacacaatattattaactacaagaacaacattgataagctggaaggcgaccaccagctgatccaggaagctctggtgttcgataacaagcatacaaattataccatggagcatatccgagttggttgggaactgttgcttactaccattgctcgcaccatcaatgaggtagaaactcagattttaacacgcgacgctaagggcatcacccaagagcagatgaatgagttcagagcttcgttcaatcacttcgacaggcgcaagaacgggctgatggatcatgaagacttcagagcatgtctgattagtatgggatacgacctgggggaagctgagttcgcccggattatgaccctggttgatccaaatggccaggggacagtcactttccagtccttcattgatttcatgacccgggaaaccgcagataccgacacggccgagcaggtcattgccagctttcggattctcgcgagtgacaaaccatacatcctggcagaagagctcaggagggagctgcctccagaccaagcccaatactgcattaaacgaatgcctgcctatagcggaccaggatccgtgccaggagctcttgattacgccgcctttagtagtgcactctatggcgaaagtgatctgtag

SEQ ID NO: 177714 - DNA, 1167 bp, Artificial Sequence
  Description of Artificial Sequence: Synthetic coding sequence
atggagaagctgctggagaccatcgaccagctgcacctggagttcgctaagcgggcagcgccgttcaataattggatggaaggcgctatggaagacctccaggatatgtttatcgtccattccatagaggagatccagtccctcattacagctcatgagcagttcaaagcaaccttgcccgaggcagatggggagcggcagagcataatggctatacagaacgaggtggagaaggttatccaatcttacaacatccggatcagtagtagcaatccatatagcaccgtgaccatggacgagctaagaacaaagtgggataaggtcaagcaactggtccctattagggatcagtccctgcaagaggagctcgcccggcaacacgccaatgaaaggttgcgccgtcagttcgcagcacaggccaatgcgataggaccttggattcaaaataagatggaggagatagccaggtcttccatacagattacaggcgcacttgaggaccagatgaatcagttgaagcagtatgagcacaacatcattaattataagaacaatattgacaagctggagggggatcaccagctgattcaagaagccctggtcttcgataacaaacacacaaactacaccatggagcatattagagtggggtgggagctgttgttaaccaccatcgcccggacgattaacgaagttgaaacacagatcctgacccgcgacgcaaagggaattactcaggagcaaatgaatgagtttcgggcctctttcaaccactttgataggcgaaagaatggtctcatggaccatgaagattttcgcgcttgtttaataagcatgggatacgacctgggcgaggccgagtttgcccgtattatgacactagtggatcccaatggccagggtactgtgacctttcaatctttcatcgacttcatgactcgagagacagccgatactgacaccgcagaacaggtgattgctagctttaggatcctggctagcgacaagccatacatcttggctgaagagttgagaagagagttacctcctgaccaagctcagtactgtatcaaaaggatgcccgcctactcaggtccaggaagcgtccctggggctttggattacgcagctttctctagcgcgctttacggggagagcgacctctag

SEQ ID NO: 177715 - DNA, 1131 bp, Artificial Sequence
  Description of Artificial Sequence: Synthetic coding sequence
atgttcaacccccacgccctggacgtgcccgccgtgatcttcgacaacggctcaggcctttgcaaagcagggctctccggagaaattggtccccggcatgtaataagctctgttttgggtcattgcaaattcaacgtccctctcgcccggctaaatcaaaaatatttcgtgggccaggaagctctctataagtatgaagctttgcatctgcactatcccatcgaaagaggcctggttacaggttgggacgacatggaaaaattgtggaagcacctgttcgaaagagagttgggcgtaaagccgtcgcagcagcccgtccttatgaccgaacctagtctcaatccacgggagatccgcgaaaagctcgctgagatgatgttcgagaccttctctgtaccaggcttctacctaagcaatcacgccgtagcagccttatacgcatcggcttgcgtgacagggctggtagtagacagtggggacggagtcacttgcacagtccccatctttgaaggatactcactgccccacgccgtgacaaaattgtgtatggctggaagagacataaccgagcatcttacaaggctgctgtttgccagcggcttcaacttcccatgcattctcaataaggctgtagttaataatattaaggagaaactgtgctatatagccctggagcccgagaaggagctccgcaaatcacgaggtgaggtgctgggcgcctacagacttcccgacggccatgtcatccacttcggcgatgaactgtaccaggtgccggaggtgctgtttgcaccagaccagctgggaatccacagccctggtctctcgaagatggtatccagttcaatcatgaagtgcgacaccgacattcagaacaagctatacgctgacattgtgctgtcgggcggcacaaccctgctcccggggttggaagaaagactgatgaaggaggtggagcaactggctagcaagggaactccaataaagattaccgcttctcccgatcgatgctttagcgcctggattggcgcatctattatgacgtccatgtcgtctttcaagcagatgtgggtgacaagcgccgattttaaggagtatgggacgtctgtggtgcagaggagatgcttttag

SEQ ID NO: 177716 - DNA, 1134 bp, Artificial Sequence
  Description of Artificial Sequence: Synthetic coding sequence
atgttcaacccccacgccctggacagccccgccgtgatcttcgacaatggcagtggtttctgcaaggctggcttgtccggggagtttggcccccggcatatggtttcctcaattgtcggacatctgaagttccaggcccccagcgcggaggcaaaccagaaaaagtacttcgtgggtgaggaagccctgtataaacaagaagccttacagctgcacagcccatttgaaagggggcttatcactggatgggatgacgtcgaacggttgtggaaacacctctttgagtgggagctgggcgtgaagcctagcgatcagcccttgcttgcaactgagccctcgttaaaccctcgggagaatcgggagaaaatggctgaagtgatgtttgagaattttggtgtccccgcattctacctgtccgatcaagctgtactcgcactctacgcctccgcgtgcgtgactgggctggttgtggattcaggtgacgcagtaacatgtacagttcccatttttgaagggtacagcctgccacacgccgtgactaaactacacgttgcaggcagggacatcacggagcttcttatgcagctattgctagcgtcaggtcatacctttccctgccagttggataaaggactcgtcgatgatattaaaaagaagctctgttatgtggcactggagcccgaaaaggagctatcccggaggccagaggaggtcctgagggaatataagcttcccgacggtaacatcatttctctgggggatcccttacatcaggcgccagaagcattattcgtgccccaacagcttgggagtcagtcgcctgggttaagcaacatggtgagtagcagtatcacgaagtgtgatacggacatccagaaaatccttttcggcgaaatcgtgctgtccggggggactaccctgtttcacgggctcgatgatagattactgaaagagctggagcagttggcgagtaaggacacccccatcaagatcacggctccccccgaccgatggttctcaacctggatcggcgcctcaatcgtaaccagtttgagctccttcaagcaaatgtgggttaccgctgctgacttcaaggagtttggtacgtccgttgtgcaacgcaggtgcttttag

SEQ ID NO: 177717 - DNA, 987 bp, Artificial Sequence
  Description of Artificial Sequence: Synthetic coding sequence
atgttcaacccccacgccctggacagccccgccgtgatcttcgacaacggctctggattctgcaaggctggcctgtccggagaatttgggcctagacatatggtgagctccattgtaggtcacctgaagttccaggcaccttccgccgaggctaatcagaagaagtatttcgtgggcgaagaggccctgtacaagcaggaagcccttcagttgcatagtccttttgagcgggggttgattacagggtgggacgacgtggaaagactgtggaagcacctctttgagtgggagcttggggtcaagcccagcgatcagccactcctggcgactgaaccgtctttgaatccacgtgagaatcgggaaaagatggccgaggtgatgttcgaaaattttggcgttccggctttttacttgtctgatcaagccgttctcgcgctatatgcctcagcctgtgttactgggctagtggtggactcgggtgatgccgtgacgtgcaccgtgcctatcttcgaggggtactccctgcctcacgccgtcaccaagctccatgtggctggacgcgatatcaccgagctcttgatgcaactcctcctggctagtgggcatacatttccttgtcagttagacaaaggattagtcgacgatattaaaaagaaactctgttacgtggccttggaaccagaaaaagagctgtccaggcgaccagaggaggtcctcagggaatacaagctgccagacggaaacattatctctttaggggatcctttacaccaggcccccgaagcccttttcgtcccacagcagctgggatcacagtctcccggtctctcgaacatggtatcctccagcatcaccaaatgcgataccgatatacagaagatcctcttcggagaaatcgtgttaagtgggggtactaccctgttccacggactcgacgaccggctgctgcatctggactggagcctccatagacatctcagcgagtag

SEQ ID NO: 177718 - DNA, 1752 bp, Artificial Sequence
  Description of Artificial Sequence: Synthetic coding sequence
atggagagcaagggcgccagcagctgccggctgctgttctgcctgttgatttctgctactgtgttcaggccgggactcgggtggtatactgtcaactctgcctatggggatacaataatcatcccatgtaggctggacgtaccacaaaatttgatgtttggcaagtggaaatacgagaaacccgacggttcacctgtcttcatcgcgttcaggagctctaccaaaaaaagcgtgcaatacgacgatgtccccgagtataaagataggctgaacctgtcagaaaattatactctctctatcagcaacgctagaatctctgacgagaagaggtttgtatgtatgcttgtcacagaagataacgtcttcgaggctcccaccatcgttaaggtgttcaaacagcccagcaagccagaaatcgtatcgaaggccttgttcctggagacggagcagctcaaaaagctgggggactgcatttcagaggatagctatcccgacggtaacattacctggtatcgtaacggcaaggtgctgcatcccttggaaggagccgtcgtaatcatctttaaaaaagaaatggacccagtgacacaactttatacgatgacctccactctcgaatacaaaacaactaaggcagacatacagatgccattcacttgctcagtcacgtactacgggccgtcgggtcagaaaaccatccattccgagcaggctgttttcgatatatactaccctactgaacaggtcactatccaagttttgcctcccaaaaatgctatcaaggagggagacaacattaccttgaagtgtctgggaaacggaaacccaccacccgaggagttcctcttctatctacccggtcagccggaaggtataagaagtagtaatacgtatacgcttacagatgttcggcgcaacgcaacgggggactacaagtgctcccttattgacaagaagtccatgatagctagcactgccataaccgttcactatctggacctttctttaaacccttcgggggaggtcacaaggcagatcggagatgcattgcctgtttcttgcaccattagcgcttcccgcaatgccactgtggtgtggatgaaagataatatcaggttaagatcttctccaagtttttcctccctgcattaccaggatgccggaaattacgtgtgcgagactgcactgcaagaagtggagggcctgaagaagcgggaaagcctgaccctgatagtcgaggggaagcctcagatcaagatgacaaagaagacagatccctctggcctctccaagactataatctgtcacgtggagggctttcccaaacctgctatccagtggacaatcaccggatcgggatctgtaattaaccagaccgaggagtccccctacatcaacggcaggtactacagtaaaataattatctcgccggaggaaaatgtcacgctgacttgtaccgctgaaaaccagcttgagaggaccgtgaactcgctgaatgtgtcagcaatttccattcccgagcatgacgaagctgatgagatctcagatgagaatcgcgaaaaagtaaacgatcaggcaaagctgattgttggaatcgtggtggggctgctgcttgctgccctggtggctggtgttgtttactggctgtatatgaagaaaagcaagaccgcatcgaagcacgtgaataaagacctgggcaatatggaggaaaataagaaacttgaagaaaacaaccacaaaaccgaagcttag

SEQ ID NO: 177719 - DNA, 918 bp, Artificial Sequence
  Description of Artificial Sequence: Synthetic coding sequence
atggaccccgtgacccagctgtacaccatgaccagcaccctggagtacaagaccactaaagcagatattcagatgccatttacttgttcagtgacctactatggtccctccggtcaaaaaacaatccactccgaacaagctgtatttgacatctattaccttgacctttctctgaaccccagcggcgaagtaactcgccagatcggcgatgccctgcctgtgagttgcactatctctgcttctcgcaatgccactgtggtgtggatgaaggacaacatccggcttcggtcatcaccaagcttttctagcctccactaccaggatgcgggaaattacgtttgtgaaaccgctcttcaagaggtggagggtctcaagaaacgcgagagcctaacattgatcgtagaggggaagccacaaatcaaaatgacgaagaaaactgaccccagtgggctaagcaaaactataatctgccacgtcgagggttttcccaaaccagctattcagtggactatcacgggatcaggatctgtgattaatcaaacggaggagtccccatatattaacggacggtactactctaaaattataatcagccccgaagaaaatgtcaccttaacttgtaccgcggagaatcagctcgagaggaccgtcaatagtctgaatgtgagcgccattagcattccggaacacgatgaggctgacgagatttctgacgagaacagggagaaagtcaacgaccaggccaagctcatcgtgggcatcgtggtcggtttgctactggccgccctggttgccggagtcgtgtattggctttacatgaagaaaagtaagaccgcatctaagcacgttaataaggaccttggcaatatggaagagaacaagaaactggaagagaataaccacaagactgaggcctag

SEQ ID NO: 177720 - DNA, 1035 bp, Artificial Sequence
  Description of Artificial Sequence: Synthetic coding sequence
tgactgggcgactgcatcagcgaggacagctaccccgacggcaacataacatggtatcgtaacggaaaggttctgcatccactagaaggcgcagtggtgattatctttaagaaagagatggacccagtgacccaattgtatacaatgacctccaccctggagtataaaactaccaaagctgatatccagatgccttttacctgctctgtgacatattatggaccctctgggcaaaagacgatccattcagagcaggcggtgttcgacatttactatctggatctgtctcttaaccctagcggtgaggtcacaaggcagattggcgatgccttgccggtgagctgcaccatatccgctagccggaatgcaaccgtcgtgtggatgaaagataacattagactgaggagctctcctagcttctcgagcctgcactaccaggacgctgggaactatgtgtgcgagactgctcttcaagaggtagagggactcaaaaagcgggagtcactgacactgatcgtggagggcaaacctcagattaagatgaccaaaaagaccgacccatctggcctctctaagaccattatttgccatgtagaagggttccccaagccagcgatacagtggactatcactggcagtgggtctgtcattaaccaaacagaagagtctccttacatcaatggtaggtattattccaagatcattattagccccgaggagaacgtcaccctgacttgtacggcagaaaaccaactcgaacgaacagtaaatagcctaaacgtgagtgcaatttccatccccgaacatgatgaggctgacgaaatctcggacgagaaccgcgaaaaagtgaatgatcaagccaaactcatcgtggggattgtcgtgggattgctcctagcagccttggtcgccggggtggtatattggctgtatatgaagaaatcgaaaacggcgtccaaacacgtcaataaagacctgggaaatatggaagaaaacaaaaaactggaggagaataaccataaaacagaagcgtag

SEQ ID NO: 177721 - DNA, 1713 bp, Artificial Sequence
  Description of Artificial Sequence: Synthetic coding sequence
atggagagcaagggcgccagcagctgccggctgctgttctgcctgcttatttctgctacagttttccgccctgggctcgggtggtacactgtgaactccgcctacggcgatactatcatcatcccttgccgactggatgtcccccagaacttgatgtttggcaaatggaaatatgaaaagccagacggctccccagtttttattgcttttcgctcaagcactaagaaaagcgtccagtacgatgacgtcccagagtacaaagaccggctgaatctgtcagaaaactacactttgagcattagcaacgcgcgcatcagcgacgaaaagagattcgtgtgtatgctcgtgacggaagacaacgttttcgaggcacccaccatcgttaaggtgttcaagcagccgtccaaacccgaaattgtaagtaaagctctgtttctggaaaccgagcagctaaagaagctgggggactgtatcagcgaagacagttacccagacggcaatatcacgtggtacaggaatggcaaggtcttgcaccccctggagggcgctgttgtaattatttttaaaaaggaaatggaccccgttacccagctttacaccatgacaagcactctggaatataagaccacgaaagccgatattcagatgccgtttacctgctccgtgacatactatgggccaagcggccagaaaaccattcattcagagcaggccgtgtttgacatctactatccaacagagcaggtgaccatccaggtactgcccccaaagaatgctattaaggagggagataacattacccttaaatgcctgggaaacgggaaccctcccccagaggaattcttgttctacctgccaggtcagccagagggaattcggtcatcaaacacttacactttaacagatgtgcgtcgcaacgctacaggagattataaatgcagcctcattgacaaaaaatcaatgatcgcgagcacagccattaccgtgcactatctcgatctgtccctgaacccctcgggtgaagtgaccagacagattggcgatgcccttccagtcagctgtacaataagcgcttcccgtaatgctaccgtggtgtggatgaaagacaatatccgcctgcggtcgtcgccatccttctcatcactgcactatcaggatgctgggaattacgtctgtgaaacggctttacaagaagttgagggtttgaaaaagcgcgaatcattgaccttgatagttgaaggcaagccacagatcaagatgacaaagaagaccgacccctctggcctgtctaaaaccatcatctgccatgtcgaaggatttcctaagccagccattcaatggactatcactggcagcgggtctgtcatcaatcagacagaggagtccccatatattaatggtaggtattacagcaagatcataattagtccagaagaaaacgtaactctcacctgcaccgccgagaaccagctggaacgcacagtcaattcattgaacgtgtctgcgaacgagaatagagagaaagttaatgaccaggctaaactgattgtgggaattgttgtggggctgctcctcgccgccttggttgcgggagtcgtctactggctctacatgaaaaagtctaaaacagcaagtaagcacgtcaacaaagacctgggcaacatggaggaaaacaaaaagcttgaggagaacaatcacaaaaccgaagcatag

SEQ ID NO: 177722 - DNA, 1074 bp, Artificial Sequence
  Description of Artificial Sequence: Synthetic coding sequence
atggaggtgctgcggccccagctgatccggatcgacggccggaactaccggaaaaatccagtgcaggaacaaacataccagcacgaagaagatgaggaagacttctatcagggaagtatggagtgcgcagacgagccatgtgatgcctacgaggtggagcagaccccacagggcttccgttccacacttagagctccatctctcctttacaaacacatcgtgggaaaacgcggcgatacccggaagaaaatagaaatggagactaaaactagcatcagtatacccaagcctggacaagacggagaaatcgtgattacgggccaacatcggaacggtgtgatatccgcaaggacacgcattgatgtgttgcttgacacattccggagaaagcaacccttcacacacttcttagcatttttcctgaatgaggtggaggtccaagaaggcttcttgaggtttcaggaggaggtacttgctaagtgctcaatggatcatggtgtggactcctcgatcttccaaaaccctaagaaactgcatctgaccattggcatgctagtgctactctctgaagaggaaatccagcagacttgtgaaatgttgcaacagtgcaaggaggagttcatcaacgatatctctggaggtaagcccttggaagttgagatggccggtattgagtacatgaatgatgacccgggcatggtggatgtcctgtacgcaaaggtacacatgaaagatggatcgaatcggctccaggagctcgtggacagagttcttgaacgcttccaggcttctggcctaatcgttaaagaatggaacagcgtcaaattgcacgcaacagtgatgaatactctgtttcggaaagaccctaacgcagagggcagatataacctttatactgcggaggggaaatacatcttcaaggagcgggagtcttttgacggacgcaatatcctcaagctgtttgagaatttctattttgggtcattaaagttgaacagcatacacatctcccagaggtttacggtggacagttttgggaattacgctagttgcggacagattgacttcagctag

SEQ ID NO: 177723 - DNA, 1074 bp, Artificial Sequence
  Description of Artificial Sequence: Synthetic coding sequence
atggaggtgctgcggccccagctgatccggatcgacggccggaactaccgcaagaaccccgtgcaggagcaaacttaccagcacgaagaggacgaagaagacttctaccagggttcaatggagtgcgctgatgagccttgcgacgcatacgaggtggagcagactccgcagggtttccgtagtacccttcgagctccctcactcctttacaagcacatagtgggtaagcggggggatacccgcaaaaaaatcgagatggagaccaagacgtcaatttcaattcccaaaccagggcaggatggcgaaatcgtgatcaccgggcaacaccgtaacggcgtgatctctgccagaacaaggatcgatgtgctgttagataccttccgtcggaagcaaccctttacccacttcttggccttcttccttaacgaggtcgaagtccaggagggcttccttcgattccaggaagaggtgctcgccaagtgctccatggaccacggcgtcgactcatccattttccagaaccccaagaaactccacctcaccataggcatgctggtgttactcagcgaggaagaaatccagcaaacctgtgaaatgcttcaacaatgcaaagaggagttcatcaatgacatatcagggggaaaaccactagaagtcgagatggccgggattgagtatatgaacgatgaccctggcatggtggatgtgctctacgccaaggttcatatgaaagatggatccaaccgactccaagagctggttgatcgtgtcctagagagattccaagccagcgggctgatagtgaaagagtggaactctgtaaagctgcatgcaacagtcatgaatactctgttccgtaaggaccccaatgccgagggacgctataacctgtacactgccgagggcaaatacatctttaaggagagggagagcttcgacggacggaatattcttaaactctttgaaaatttttactttggatcactaaaactaaactctatacacataagccagcggtttactgtagatagttttggcaactacgccagctgcgggcagattgacttttcttag

SEQ ID NO: 177724 - DNA, 1203 bp, Artificial Sequence
  Description of Artificial Sequence: Synthetic coding sequence
atggaggtgctgcggccccagctgatccggatcgacggccggaactatcgcaagaatcccgtccaggagcagacttatcagcacgaggaagatgaagaagacttctatcaaggatccatggaatgtgccgacgagccttgcgatgcttacgaagttgagcagaccccccagggcttccggtctaccctacgggccccaagcctcctatacaatctgattcacctgaatactagcaacgattgcggatttcagaagatcacactcgactgccagaatatctacacctggaaatcacgccatattgtgggcaagaggggtgatacccgcaaaaagatagaaatggagaccaaaacaagtatcagtattcccaaaccaggccaggacggagagatcgtgatcaccgggcagcaccgcaacggtgtgatcagcgccagaaccaggatcgacgtattgcttgacaccttccggagaaaacagccctttactcatttccttgcattcttcctgaatgaggtcgaggtgcaggaggggtttctgagatttcaggaggaggtcctcgccaagtgttcaatggaccatggagtcgactccagcatcttccagaatcccaagaaactgcacctcactattggaatgttggttttactgagtgaagaggagattcaacagacctgtgagatgctccagcagtgtaaagaggagttcattaacgatatcagcggagggaagcctctggaggtagagatggccggaatcgagtacatgaacgatgacccggggatggtggacgtgctgtacgccaaagtgcacatgaaggatggcagcaacaggctccaggaactggtcgaccgggtgctggagaggtttcaggcttcagggctaatcgtgaaagagtggaatagtgtgaagctgcacgccacagtgatgaatactttgttcaggaaggaccccaatgccgagggacgctataatctctacaccgccgagggaaagtatatcttcaaagagcgcgagtcttttgacggtcgtaacattctaaaatccttcgctctgctaccaaggctagaatacaacgatgcaatctcggctcattgcaatctgtgcctgcctggctcatccgactccccagccagcgcatcccaggtagcaggcatcacgggagtcagcgacgcatactcccagtccctacccggtaagtcgtag

SEQ ID NO: 177725 - DNA, 1074 bp, Artificial Sequence
  Description of Artificial Sequence: Synthetic coding sequence
atggaggtgctgcggccccagctgatccggatcgacggccggaactaccgaaagaatccagtccaagagcagacctaccagcacgaggaagatgaagaggatttttatcagggttccatggagtgtgcagacgaaccctgcgacgcctatgaggtcgagcagactccacaaggctttcggagcacccttcgcgcaccctccctgctatataagcacatagtcggtaagcgaggcgacacccgaaagaaaattgagatggagactaagaccagcatcagtatccccaaaccaggtcaagacggagagatagtaattaccggccagcatcgcaacggcgttatatctgctcgtacaaggatcgatgtgctcctggataccttccgccgtaaacaaccattcacacacttcctggctttcttcctgaacgaagttgaggtacaagagggattcctgcgcttccaggaggaggtcttggcgaaatgcagcatggaccatggtgtggacagttctattttccagaatcccaagaaactgcatttgactatcggcatgttggtgctactctcagaggaggagattcagcagacttgtgaaatgctgcagcaatgcaaagaagaattcatcaatgatatttccggcggaaaaccgctggaagttgaaatggccggcatcgaatatatgaatgacgaccccggcatggtggatgtactatacgccaaagtgcacatgaaggatggttccaataggctgcaagagttagtcgacagggtcttggaaagattccaggcctcaggtctgatagtgaaggaatggaacagcgtgaaactgcacgctactgtgatgaatacactgtttcgcaaagacccaaacgctgaaggtcgctataacttatacaccgcagaaggaaagtatatctttaaagaacgagagagctttgacggtaggaacattctgaaactgtttgagaatttttatttcggttccctcaagctgaacagcatccacatctcccagcgttttaccgtggatagcttcggcaattacgccagctgtgggcagatagatttcagttag

SEQ ID NO: 177726 - DNA, 1203 bp, Artificial Sequence
  Description of Artificial Sequence: Synthetic coding sequence
atggaggtgctgcggccccagctgatccggatcgacggccggaactaccggaaaaatcctgtgcaggaacagacatatcagcatgaggaggatgaggaggacttttaccaagggtctatggagtgtgctgacgagccctgtgatgcgtatgaagtggagcagacccctcagggattcaggtctactctgcgagctccttctctcctatacaatctgattcatctgaacacatccaatgattgtggattccagaagatcacactcgactgtcagaatatctacacctggaaatcaagacatattgtcggcaaacggggggacacacgcaaaaagatagagatggaaacaaagacttcgatctccatccctaagcccggacaggatggggaaatcgttattactggccaacatcgcaacggagttattagcgctcggacccggatcgatgtgctgcttgacacgttcagacggaagcaaccattcacccactttctcgcctttttcctgaacgaagtcgaagtccaggaaggatttttgcgcttccaggaggaagtactggccaaatgctcaatggaccacggagtggattcctcaatcttccagaaccctaaaaaactccacctgaccattggaatgctggtgctactcagcgaggaggaaatccaacagacctgtgagatgctgcagcagtgtaaggaggagttcatcaatgacatctctgggggcaaaccattagaggttgagatggccggcatcgagtacatgaacgacgatcctggtatggtagatgtcctgtatgcaaaagtacacatgaaagacgggagtaatcgcttgcaggagcttgtggatcgcgtacttgaaaggtttcaggccagcggtctcatcgtgaaagaatggaatagcgtgaagctgcacgccaccgtgatgaatacgctgtttaggaaagacccaaatgccgagggtagatataatctgtacaccgccgagggcaaatatatcttcaaagagcgggagagcttcgatggaagaaatattctgaagagctttgcgctgctcccccggctggagtacaatgatgccatttccgcacactgcaacctgtgcctaccaggaagtagcgacagcccagccagcgccagccaagtcgctggaataacgggtgtctccgatgcatatagccagagtttgcctgggaaatcctag

SEQ ID NO: 177727 - DNA, 1074 bp, Artificial Sequence
  Description of Artificial Sequence: Synthetic coding sequence
atggaggtgctgcggccccagctgatccggatcgacggccggaactatagaaagaacccggttcaggaacagacctaccagcatgaagaggacgaagaagacttctaccaggggagtatggagtgcgcagacgaaccatgcgacgcgtacgaagtagaacaaacgccacagggttttcgttctaccctgcgcgccccaagcttactctataagcacattgttggaaagagaggcgatactcgcaaaaagattgagatggagacaaaaacctccatctctataccaaagcctggtcaggacggtgagatcgtaatcacgggccagcaccgcaacggagtgatctctgcccggactagaatcgacgtgctcctcgatacgttccgcagaaaacagcccttcacgcactttttggcatttttcctcaatgaggttgaggtgcaggagggtttcctccggtttcaggaggaagtgctggcgaagtgttccatggaccacggcgtcgactcgtcgatcttccaaaacccaaagaaactacatctgacaatcgggatgctggtcctcctgtccgaggaagagatacaacagacatgcgagatgctgcagcaatgtaaagaggagtttatcaacgatatctccggcggcaaacccctggaggtcgaaatggcggggatcgaatatatgaacgatgatcctggcatggttgatgtgctctatgccaaggtccacatgaaggacggctcaaaccgcctgcaggagcttgtggaccgggtgctggaacggttccaggcttcgggtctgatcgtgaaggagtggaactctgtcaagcttcacgctactgtaatgaacactctgttcaggaaagaccccaatgctgaaggccgctataacctatataccgcagaaggcaaatatatcttcaaggagcgcgaaagctttgatggccggaacattctgaagctattcgagaacttctacttcggcagtttgaagctcaattcaatccatatctcccaaaggttcacagtggattccttcggaaactatgcgagctgcggccaaatcgacttctcttag

SEQ ID NO: 177728 - DNA, 879 bp, Artificial Sequence
  Description of Artificial Sequence: Synthetic coding sequence
tgatacaagcacatcgtgggcaagcggggcgacacccggaagaagatcgaaatggagaccaagacaagcatcagcatccccaaacctggtcaagatggtgagattgtgatcactggtcagcacagaaacggtgtgatttccgccaggacaagaatcgatgtgttgcttgacaccttccgccgtaaacagccatttacccacttcttggcgttctttttgaatgaagtggaggtgcaggaagggtttttgcggtttcaggaagaagtgcttgcgaagtgctctatggaccacggcgtggactcatctattttccaaaatccaaaaaagctgcacctaaccataggtatgctggtgctcctcagtgaggaagaaatccaacaaacttgcgagatgttacagcagtgtaaagaggagttcatcaatgatataagtgggggaaagcccctggaggtggagatggcggggatcgagtatatgaacgatgacccgggcatggtggatgtgttgtatgcaaaggtgcacatgaaggatggttctaatcgtttacaggaactcgtggacagagttctggaaaggtttcaggcaagcggccttattgttaaggaatggaattctgtaaagctacatgctacagttatgaatacgctctttcgtaaggatccaaacgccgagggccgatacaatttatacacggcagaaggcaaatatatcttcaaggaaagagaaagttttgacggcaggaatatcttaaaatcttttgccctgttaccccgcctcgagtacaatgatgcaatcagtgcgcattgtaacctatgcttacctgggtcttcagactcccccgcctcagcctcgcaggtagccgggattaccgtagtgtag

SEQ ID NO: 177729 - DNA, 828 bp, Artificial Sequence
  Description of Artificial Sequence: Synthetic coding sequence
atggagaccaagaccagcatcagcatccccaagcccggccaggacggtgagatcgtaataaccgggcagcatcgcaacggagtgatcagtgcgcgcactaggatagacgttctgttagacactttccgcagaaagcagcctttcactcacttcctcgcattcttccttaacgaagtggaggtgcaggagggttttctccgattccaagaagaagtgctggcgaaatgttcaatggatcacggtgtggattcttcaatcttccagaatcctaagaaactgcacttgactatcggaatgcttgtcctgctcagtgaggaagaaatacagcagacctgcgagatgctgcaacagtgtaaggaagagtttataaacgacatatcgggcggcaagcccctggaagtggagatggccggtattgagtacatgaatgacgacccagggatggtggacgtgctgtacgccaaagtgcatatgaaggatggaagcaacaggctgcaggaactggtcgaccgggtgcttgagcgctttcaggccagcggcctgattgtcaaggagtggaatagtgtgaagctgcacgcaacagtcatgaacaccttattcagaaaggacccgaatgccgagggaagatacaatctttacacagccgagggcaagtatatcttcaaggagagggaatcatttgatgggagaaacattttaaaatcttttgccctcctgccaaggctcgaatataatgacgcaatctcagcccattgcaatttatgtctcccgggtagcagcgacagtcccgcttccgcgtctcaagtcgccggcataacagtggtgtag

SEQ ID NO: 177730 - DNA, 372 bp, Artificial Sequence
  Description of Artificial Sequence: Synthetic coding sequence
atggaggtgctgcggccccagctgatccggatcgacggccggaactacagaaagaacccagtacaggagcaaacctatcagcacgaggaggatgaagaagatttctatcagggatcaatggagtgcgcagacgagccctgcgatgcctacgaggtagaacagaccccacaagggtttcggtcaactcttagggccccaagcctgctctacaagcacattgtaggcaagcgcggggatactagaaaaaaaatcgagatggagacaaagactagcatttcaatccccaagccgggacaagacggcgagatcgtgatcaccgggcagcatcggaacggggttatatcagctcggacaagaatcgatgtgctctag

SEQ ID NO: 177731 - DNA, 312 bp, Artificial Sequence
  Description of Artificial Sequence: Synthetic coding sequence
atggaggtgctgcggccccagctgatccggatcgacggccggaactaccgcaagaacccagtgcaggagcagacataccagcatgaggaggacgaggaggacttttatcagggttctatggagtgtgcagatgagccgtgtgatgcctacgaggtggaacagacaccacagggattccggagtacactgcgggctccttccctgctttacaagcacatagtgggcaaaaggggagacaccagaaagaagatcgagatggagacaaagacatctatctcaatacccaaacccggtcaggatggcgagatctag

SEQ ID NO: 177732 - DNA, 459 bp, Artificial Sequence
  Description of Artificial Sequence: Synthetic coding sequence
atggaggtgctgcggccccagctgatccggatcgacggccggaactaccgcaagaatccagtgcaggagcaaacctatcaacacgaagaggatgaggaggatttttaccagggatctatggaatgcgctgatgagccgtgtgatgcgtacgaagttgagcaaacacctcagggcttccggtctacactcagggcgcccagtcttctttataagcacatcgtgggcaagaggggtgatacgcgaaaaaaaatcgaaatggaaaccaagacctctatcagtattcccaagccaggacaggacggtgagattgttattactgggcagcacagaaatggggttatctccgcccggacaaggatcgacgtcctactagacactttccgtcgaaagcagccttttacccacttcctggcctttttccttaacgaagttgaagtgcaggaggggtttctgcgctag

SEQ ID NO: 177733 - DNA, 171 bp, Artificial Sequence
  Description of Artificial Sequence: Synthetic coding sequence
atggaggtgctgcggccccagctgatccggatcgacggccggaactacaggaaaaaccccgtccaggagcagacgtaccagcacgaagaggacgaagaggatttctaccagggaagcatggaatgcgctgatgaaccatgtgatgcttacgaagtcgaacagactccatag

SEQ ID NO: 177734 - DNA, 1140 bp, Artificial Sequence
  Description of Artificial Sequence: Synthetic coding sequence
atgatgaagtaccccggcacctggccctgccagggcatcatcggcatttcatttggggagtcagtcatggaagtgctgcggccacaactaataaggatcgatggaagaaattatcggaagaacccagtgcaagagcaaacataccagcatgaggaggacgaagaggacttttatcaaggaagcatggagtgtgcagacgagccctgtgacgcctacgaggtggagcagactccccaaggtttccgtagcactttgcgcgcaccaagtctgttgtataaacatatagttggaaagaggggcgacaccagaaagaaaatcgagatggaaacgaaaacctccattagcatccccaagcccggccaggacggagagatcgtcattaccggccaacaccgaaatggcgtgattagtgcgcggactcgcattgatgtccttctggacacatttcgacggaagcaacctttcacccattttttggcatttttcctgaacgaggttgaggtacaggagggctttctgagatttcaggaggaggtgctggctaagtgttcaatggaccacggcgtcgactcgtccattttccagaaccctaagaagctgcatctcacgattggtatgcttgtcctcctgtctgaggaggaaatccaacagacatgtgagatgctgcagcagtgcaaagaagagttcatcaatgatattagcggaggtaagccactggaagtcgagatggcaggaatcgagtatatgaacgacgatcctggtatggtcgacgtgttgtatgccaaggttcatatgaaagacgggagcaaccggctccaggaattagtggaccgagtcctggagagattccaagcttcggggctgattgtgaaggagtggaatagcgtaaagctccacgctactgtgatgaatacactcttccgcaaagatcccaacgccgaggggcggtataatctttacaccgctgaaggaaaatatatctttaaggaaagagaatcctttgatgggaggaacatcctaaagctgttcgagaacttctacttcggctccctgaagctgaattcgatccatatttcacagaggttcacggtagattctttcggtaattatgccagttgtggtcagatcgacttctcatag

SEQ ID NO: 177735 - DNA, 2274 bp, Artificial Sequence
  Description of Artificial Sequence: Synthetic coding sequence
atgcccgccctgcccctggaccagctgcagatcacccacaaggaccccaaaactggtaaactgaggaccagccccgcactccaccccgagcaaaaagccgataggtattttgtcctgtataagccaccacctaaggacaacattcctgcccttgtggaagagtaccttgagagggctacattcgtagccaacgacctggattggttactggccttgccccatgacaagttctggtgccaggtgatcttcgacgagaccttgcaaaaatgcctcgactcctatcttaggtatgttccgagaaagttcgacgaaggggttgcttccgctcctgaggtggttgatatgcaaaagcgcctgcatagaagcgtgttcttgacctttctgcgcatgagtacccataaggagtccaaagatcatttcataagcccttcagctttcggagagatcctatataataattttctgtttgatattccgaagatccttgatctttgtgtgttgttcggaaagggtaattctcctttgctccaaaaaatgatcggtaacatcttcactcaacagccttcctattactcagatctcgatgagacccttcccactattcttcaggtgttcagtaacatcctacagcattgcggactccagggtgacggagcgaataccactccccagaaactagaagagagaggcagactgactccctccgatatgcctctcctggaactaaaagacatcgtgctatatctctgcgatacctgcacgacactctgggcatttctcgacatcttccctctggcatgccaaactttccagaagcacgatttttgttatagattagcttccttttacgaggccgcaatacctgagatggagtctgccatcaagaagagacgtctggaagacagcaaactgctgggagacctctggcagcgactgagtcactccagaaagaaactgatggagatctttcacatcatcctaaaccaaatctgcttgttaccgatcctggagtcgtcatgtgataatattcaggggttcatagaggagttccttcaaatcttttcaagcctgcttcaggagaaaaggtttctgagggattatgacgctctattcccagtcgcggaggatatttccctactccagcaggcttcttccgtgctcgatgaaacaaggaccgcctacatcctccaggctgtggagtcagcttgggaaggcgtggataggcggaaggcaaccgatgctaaggatccctcagttatcgaggagcccaacggagagcccaacggagtcaccgttacagctgaggctgtgtcccaggccagctcgcaccctgaaaattcagaggaagaagagtgtatgggcgccgccgcagctgtcggccctgctatgtgtggcgtggaactagatagcctgataagccaggtaaaagacttgcttccagacctgggcgaggggttcatactagcatgtttagaatattatcactacgaccccgagcaggtcatcaataacatactggaagagcgactggccccaacccttagccagctcgaccggaatctggatcgcgaaatgaaacctgatccaactccgctcctcaccagccgacacaatgtctttcaaaatgatgaatttgacgtttttagtcgcgacagcgtcgatctgtctcgggtgcacaaaggtaagagtactcggaaggaggagaacactcgcagccttctcaacgacaagagggctgttgccgcccaaagacaaaggtacgagcagtattccgtggtagtcgaggaggtgccactgcagccgggagaaagtttgccataccactcggtatactacgaagacgagtacgacgacacatacgatggcaatcaagttggagccaacgatgccgattctgatgatgagctgattagcaggaggccgtttactatcccacaagttctgcggacgaaagtgcccagagagggccaggaggaggacgacgacgatgaagaagatgacgccgacgaggaggcaccgaaaccagatcattttgtgcaggaccctgccgtgctgagagaaaaggccgaggcaaggagaatggccttcctcgcaaaaaaaggctatcgccatgattcatccaccgccgtggcgggctctccacggggtcacggacaatcccgtgagacaacccaggaaaggcgtaaaaaagaggcaaacaaagctactcgcgcaaatcacaatagacgcaccatggcagatcggaagcgcagcaaaggcatgataccttcttag

SEQ ID NO: 177736 - DNA, 2274 bp, Artificial Sequence
  Description of Artificial Sequence: Synthetic coding sequence
atgcccgccctgcccctggaccagctgcagatcacccacaaggacccaaagacaggcaaacttcggacctcacctgccctgcacccagaacagaaggcagatcggtatttcgtgttgtataaaccccctccgaaggataacattcccgcgttagtggaggaataccttgaacgggctaccttcgtggctaacgatctagactggcttctcgctttacctcacgacaagttttggtgtcaggtaatctttgatgagaccttgcagaagtgtctcgattcgtacctgagatacgtgcctcgcaaatttgatgaaggggtggctagcgcaccagaggtggtggatatgcagaagcggctgcaccggtcagtgttcctgactttcctgcggatgagtacccataaagaaagtaaggaccattttatctcccccagcgccttcggcgagatcctgtacaataacttccttttcgacatcccaaagatcctggatctgtgcgtgcttttcggaaaggggaatagtcccctgctgcagaagatgatcggtaacattttcacgcagcaaccttcatactactcagatctcgacgaaaccttaccaacgatcctccaggtcttctccaatattctgcagcattgcggcctgcagggggacggggcaaacaccacccctcagaaacttgaggaaaggggtcggttgaccccaagcgatatgccccttcttgagctaaaagatatagtactgtacctgtgtgacacttgcactactctatgggctttcctggacatcttcccattggcttgccaaacctttcagaagcacgatttctgctatcgtttagcctctttctacgaggctgcgatccccgaaatggaatccgcgattaagaaacgaaggctggaggacagcaaactcttaggtgacctgtggcaacgcctcagccactcccggaagaaactgatggagatcttccacatcatcctcaatcagatctgcctgctgcctatcttggaatcaagttgtgataatattcaggggtttattgaagagtttctgcagatcttttcctcactcctccaggagaagcggttccttcgtgactatgatgctttattccccgtagctgaagatatttcattactccaacaggcatcgagcgtgctggatgaaactcggacagcctatatactgcaggctgtagagtccgcgtgggagggtgtggatcggcggaaagcaacagacgccaaggatccatccgtcatcgaggagcccaatggcgagcccaacggtgtgacagtcaccgccgaggcagtctcacaggccagcagtcacccggaaaactcagaagaagaggagtgtatgggtgccgccgcagcagtaggccctgccatgtgcggcgtcgagctagattcccttatttcccaggtgaaggatctgttgccggacctaggagaaggattcatcctagcttgcctggaatattaccattacgaccccgagcaagttatcaacaatatcctggaggaacgtctggcacctaccctgtctcagttagacaggaacttggatagagagatgaagccggatcccaccccactgctgacatctcgacataatgtgtttcagaatgacgagtttgacgtattttccagggattccgttgacctcagccgagtccacaaagggaagagtacgaggaaagaagagaataccagatctctactaaacgataagagagccgttgccgcacagcggcagagatatgaacagtatagtgtcgtggtggaggaagtccccctccagccaggggaatccctgccctaccactccgtatactacgaggacgagtacgatgacacgtatgacggaaaccaggtgggggccaatgatgctgactccgacgacgaattgatatcacgtcgcccctttacaattcctcaggtccttagaactaaggtgccccgcgaagggcaagaggaggatgatgatgacgaggaggacgacgctgatgaggaggcacccaagcccgaccattttgtacaggatcccgctgtgctgcgcgaaaaggcagaggcccggcgaatggctttcttagccaagaaaggataccggcacgatagctctactgcagtagctgggtcccccaggggccacgggcagtccagggaaactacccaggaacgcaggaagaaggaagctaacaaggctactagagctaatcataatcggcgtacaatggcagacagaaagcgtagcaaaggtatgatcccctcctag

SEQ ID NO: 177737 - DNA, 723 bp, Artificial Sequence
  Description of Artificial Sequence: Synthetic coding sequence
atgcccgccctgcccctggaccagctgcagatcacccacaaggaccccaaaactggtaagctacgcacaagtcctgctctgcatcctgaacagaaggccgaccgctatttcgttctctataagcccccgccaaaagataatattcctgcactggtagaggagtatctagaacgggcaacttttgtcgctaatgatctggactggttgttggctctgccccacgacaaattttggtgccaggttattttcgacgagactctacagaagtgtttggattcctaccttcggtacgtgccccgcaaatttgacgagggggttgctagcgcacctgaggtagtcgatatgcagaaaagattacaccggagtgtgttcttgacgttcttgcgtatgagcacgcacaaagagtctaaagatcacttcatcagcccgtcggcttttggcgaaatcctgtataataattttctgtttgacatacctaagatcctcgatctctgtgtcctctttggcaagggcaatagcccgcttctgcagaagatgataggtaacatcttcacacagcagccatcatattactccgacctcgacgagaccttgcccacgattctgcaagtgttcagtaacatactgcagcattgcggcttgcagggagacggcgctaacaccacgccccaaaagctggaggagaggggacggctcaccccgtctgacatgcctctactctag

SEQ ID NO: 177738 - DNA, 2046 bp, Artificial Sequence
  Description of Artificial Sequence: Synthetic coding sequence
atgcccgccctgcccctggaccagctgcagatcacccacaaggacccaaaaaccggtaaactgcgcacgtccccagctctcgttatttttgatgaaactctgcagaagtgtctcgactcatacctgcggtatgtccccaggaagtttgacgaaggcgtggcctctgccccagaggtagtagatatgcagaagaggctacaccgcagtgtttttctgacctttctccgaatgtcaacacataaggagtctaaaattttggatctatgcgttctttttgggaaaggtaattcacccttattgcagaagatgataggcaatatattcactcagcagccttcttactactctgacctggatgagaccctccccaccatcctgcaagtgtttagcaacattcttcagcattgtggactccagggggacggagctaataccaccccccagaagctggaggagcggggaagactgaccccctctgatatgcctctgctggagctcaaagatattgtactctatctgtgtgatacttgcaccacactgtgggcattcctggacatctttcctttggcttgccaaacttttcaaaagcatgatttttgttatcgattggcatcattctacgaggcggcaatacccgagatggaatcagcaattaaaaagcgaaggctggaggattccaaactgcttggagacctgtggcagcggctgagtcattctcgaaaaaaactcatggaaatttttcacatcattttaaatcagatatgcctgttgccaattctggagtcctcttgtgacaatattcaggggtttatcgaagagttcttgcagatcttcagttccctgctgcaagaaaaaaggttcctgagggattatgacgccctgtttcccgtggcagaggatatcagcctgctgcagcaagcctcttccgtcctggatgaaaccaggacagcttacatcttgcaggctgtggaatcagcctgggaaggagtggatcggcgcaaggcaaccgacgctaaagatccaagtgtcatagaggaacccaatggagaacctaacggcgtgactgtcacggctgaagccgtgtcccaggcatcctctcatcccgaaaacagcgaggaggaggaatgcatgggggccgccgcagccgtgggaccggccatgtgcggcgtggaactggattcgctgatctcacaagttaaggatctgctgcccgatctgggcgaaggattcattctcgcctgtctcgaatattaccactatgaccccgaacaggtgatcaacaatattctggaagagaggttggcccctactttgtcccagctcgaccgcaacctggatcgcgagatgaaacctgatccaacacccctgcttacaagtagacataacgtgtttcagaatgatgaattcgatgtcttctccagggattccgtagatctgagcagggttcataaaggtaaaagcacaagaaaagaggaaaatacccgctccctattaaacgacaagagggccgtcgcggcccaacggcaacgctacgagcaatatagcgtggtggtggaagaggtccccttacagcctggtgaatcactgccataccactccgtctactatgaggacgaatacgatgatacctatgacgggaaccaggtcggtgcgaatgacgcagatagtgacgacgagcttatatcgcggcgacctttcactattccccaggtgctgcgtacgaaagtgcctagagagggccaggaggaggatgacgacgatgaggaggacgatgctgacgaggaagctcctaaacccgaccacttcgtgcaggaccctgctgttctgcgcgagaaagccgaagcgcgaaggatggccttcctcgcaaagaagggctaccgacacgactccagcacagccgttgcaggatcccctcgagggcatggccaatctagagaaacaacacaggagcgtcggaagaaggaggccaacaaggcaacacgtgccaaccacaatcgccgtaccatggctgatcgcaagagaagtaaagggatgattccctcttag

SEQ ID NO: 177739 - DNA, 531 bp, Artificial Sequence
  Description of Artificial Sequence: Synthetic coding sequence
atggccctgccccggctgaccggcgccctgcggagcttcagcaacgtcaccaaacaagacaattataatgaagaggtggctgacctgaagataaaacggagcaagctccatgagcaggtccttgaccttgggctgacgtggaagaagatcatcaagtttctcaatgagaaacttgagaaaagtaagatgcagtccatcaacgaggacctgaaggacatattgcatgcggccaaacagattgtcggcacagataatggtagagaagctatcgagtctggagctgccttcctgtttatgacctttcatcttaaagattcagttggccataaagaaaccaaagccatcaagcagatgttcgggccatttccctcatcctctgctacagccgcatgtaacgccacaaataggataatttcacacttttcacaggacgatctgacagctttggttcagatgaccgagaaagagcatggcgatagggtgttctttggcaagaacctggcattcagctttgacatgcacgacctgtag

SEQ ID NO: 177740 - DNA, 336 bp, Artificial Sequence
  Description of Artificial Sequence: Synthetic coding sequence
atggccctgccccggctgaccggcgccctgcggagcttcagcaacgtaaccaaacaggacaattataacgaggaagtggcagatttgaagattaaaaggtccaagcttcacgaacaggtgctggacctggggctgacgtggaagaagataattaaatttttgaacgaaaaattggagaaaagcaaaatgcagagtatcaatgaggatctcaaagatatccttcacgccgccaagcaaatcgaggtcaattgccccttccagaagcgcagactggatggaaaagaggaggatgagaagatgagtagggcttctgatagatttcgcgggctccgatag

SEQ ID NO: 177741 - DNA, 6609 bp, Artificial Sequence
  Description of Artificial Sequence: Synthetic coding sequence
atggccctgccccggctgaccggcgccctgcggagcttcagcaacgtcaccaagcaggacaactacaatgaagaagtggcagacttgaaaatcaaacgttcgaagttacacgagcaagtacttgatctgggtctgacctggaaaaagattataaagtttttgaacgagaagcttgagaaatctaaaatgcagagtatcaacgaagatcttaaagatatcctgcatgcagctaagcaaattgttgggaccgacaatggaagggaagccatagagtcaggtgccgcctttctgtttatgaccttccacttgaaagacagtgttggccacaaggagaccaaggcgattaaacagatgtttggcccatttccctcgtctagtgcaaccgcggcctgtaacgcaacaaatagaattatcagtcacttctctcaggatgacttgactgcactggtgcagatgaccgaaaaagaacacggagatcgcgttttctttggaaaaaatctcgccttctcattcgatatgcatgacctggaccactttgatgaactccccattaacggggaaacccagaagacaatatccttggactacaagaagttccttaatgaacatttgcaggaggcgtgtacccccgaactgaagccggtagagaagaccaacggatccttcctctggtgcgaagtggagaagtatctaaactccactctaaaagagatgacggaggttccaagagtagaggatctgtgctgcaccctgtatgacatgctggcttctataaagtcaggagacgagctgcaagacgagctgtttgagttgctcggtcctgagggcctcgaactgattgagaagcttctccagaatagaattaccattgtggataggttcctcaattctagcaatgatcataggttccaggcccttcaggataactgcaaaaaaattctgggagaaaacgctaagccgaattacggatgccaggtaaccattcaatccgagcaggagaaacagttgatgaaacagtaccgccgggaggaaaagagaattgcccgcagagagaaaaaggctggcgaagatcttgaggtgagcgagggacttatgtgctttgaccccaaggaattaaggatacaacgcgagcaggccttgctgaatgcacgctctgtgcctatcctgagtagacagagagacgcagacgtggagaagatccattacccgcacgtctacgattcacaggcggaggccatgaaaacctccgcattcatcgccggggctaagatgatcttgcctgagggaatccaaagggagaacaataaactttatgaagaggtccgcatcccttactccgagcctatgcccttaagctttgaggagaaacccgtttacatccaggacctggacgagattggccagctggcctttaaaggcatgaagcgcctgaaccggattcaaagcatcgtgttcgagaccgcatacaataccaacgaaaatatgctgatctgtgctcctacaggcgcgggtaagacaaatatagcaatgctgaccgtgctgcacgagatacgacagcattttcagcagggcgtcattaagaagaacgagtttaagattgtctatgtggcccctatgaaggctctcgctgcggaaatgaccgattacttctctagacgtttagagcctctcggtataatcgtcaaggaactcaccggcgatatgcaactgagtaagtcagaaatactgaggacacagatgttagtaacgactcctgagaagtgggatgttgtaacacgcaagagtgtgggggacgttgccttaagccagatcgtgcggctgctgattctggatgaagtgcatctgttacacgaggatcgcgggcccgtacttgaatcgattgtggcacgtactttaagacaggttgaaagtactcagtcaatgattaggatcctcggactttccgctaccctgcccaattacttggatgtggcaactttccttcacgttaatccatacatcggattatttttctttgacgggcgatttcgccccgtgccactgggccagacatttctcggaattaaatgtgccaataagatgcagcaacttaacaacatggacgaggtgtgctatgagaatgtgctcaagcaggtgaaagccgggcaccaggtcatggtcttcgttcatgctaggaacgcgaccgtgcgaacggcgatgtcactcatcgagagagccaaaaactgcgggcatattcccttctttttcccaactcagggtcacgactatgttctggctgaaaagcaagtgcaacgcagtcgtaataagcaggtgcgggagcttttccccgatggattctccatccaccacgccggaatgttgcgccaggatcggaatcttgtggaaaatctattctctaacggccacataaaagtgctagtgtgcaccgctaccctagcgtggggcgtgaatctgcccgctcacgccgtcatcatcaaaggcacccagatttatgccgctaaaaggggatcatttgtggaccttgggatcctagacgtgatgcagatcttcggacgggcggggcggccacagtttgacaaatttggggagggtattataatcactacccatgacaagctgtctcattacctgacattgctgactcagagaaatccaatagaaagccagttcctagagtctctggctgataatctgaatgccgagattgcactgggaactgtgactaatgtggaagaggccgtgaaatggatctcttacacttacctgtatgtgcgcatgagggcgaaccccttggcatacggcatcagccacaaggcgtatcagatcgatcctaccttgcgtaagcatcgagagcagctggtcatagaggtgggccgaaaactcgacaaagcccagatgatccgttttgaagaaagaacaggatattttagtagcacagacttagggaggacagccagccactattatattaaatacaacactatcgagactttcaatgagctgtttgacgcccacaagacagagggcgatatctttgcgatagtgtccaaagcagaagaatttgatcagatcaaagtgcgggaagaagaaattgaggaactggatacattgctctcaaatttctgcgaactgagcacgccagggggagttgaaaatagctacggcaaaataaatattctgttgcagacatatatctctagaggtgagatggacagtttctctttgattagcgatagcgcatacgtggctcaaaatgcggcacgtatcgttagggctttgttcgaaatcgctctgcgtaagcgttggcctaccatgacttacaggctgctcaatctgtcaaaagtgatagacaagaggctgtggggatgggccagccctctgcgccagttttcaatactgccaccccacattctgacacggctggaggaaaagaaactcacagtggacaaactcaaagacatgcggaaggatgaaataggtcatattctacaccacgtgaacatcgggttgaaggtgaaacagtgtgttcaccaaataccatcagtgatgatggaggcctccatacagcccataacgcggacagtgctccgagtcacgctgtccatctacgctgattttacctggaacgaccaggtgcacggcaccgtcggagagccttggtggatttgggttgaggatccaacgaacgaccacatctatcacagtgaatacttcctggccctcaagaaacaggtgatctctaaggaagcccagctgttggtcttcactatccctatcttcgagccactgccgtcacagtactacatacgcgccgtatctgataggtggctgggagccgaggctgtttgcattataaattttcagcacctaatactgccagagcgtcaccctccccataccgaactgctggatctccagcctctcccaatcaccgccctcggatgtaaggcctatgaagctctttacaacttttcacacttcaaccccgttcagacacagatctttcacacactttatcacactgattgcaacgtgctcctgggggcgcctacgggctcaggcaagactgtggcggccgagctggctattttcagggtgttcaacaagtacccaacgagcaaggcagtctacatagcaccactcaaggccctggtaagggaacgcatggacgactggaaagttcgcattgaagaaaaacttggcaaaaaagtcattgaactgaccggtgatgtcacccctgacatgaagagcattgctaaagctgacctgatcgtgactacccccgagaagtgggacggcgtgagcaggtcgtggcagaacagaaactatgtgcagcaggtgactatcttaattatcgatgaaatacatttgttgggcgaggagcgcgggccggtgctggaggtaattgtctctcgaaccaattttatttccagtcatactgaaaaacctgtccgcatcgtgggactttcaacggctcttgcgaatgcgcgggacctcgccgattggcttaacatcaaacagatgggcctgttcaattttaggccaagtgtgcggccagtaccactggaagtgcacatccagggattccctggccaacactactgcccaaggatggcttctatgaacaaacccgcctttcaggccattcgttctcactccccagccaagcccgtgttgatttttgtttccagccggaggcagactaggctgaccgcacttgaactgattgcctttctggctaccgaagaggacccgaagcagtggctgaacatggatgaacgagaaatggagaatatcatagcaactgtcagggactcgaatttgaagctcaccctggccttcggaatcggcatgcatcacgccgggctccatgagcgcgatcgtaagaccgtggaagaactgtttgttaactgtaaggtgcaggtactgatcgctacttctacgctcgcttggggcgtgaattttccagctcacctggtgattatcaaggggaccgagtactacgatggcaagactcggagatacgtggacttccccataaccgacgtgctgcagatgatgggccgcgccggacgcccacaattcgatgaccagggtaaggccgtgatcctggttcacgatattaagaaagacttttataaaaagttcctgtacgagcctttccctgtcgaatcaagcctgttaggggtgctctccgatcacctaaacgccgaaattgccggagggacaattacctcgaagcaggatgcccttgattatataacttggacctatttctttagacgtcttatcatgaacccgtcatattataacctgggcgatgtttcccatgactccgtgaacaagtttttgtctcacttaattgaaaagagtctcatagaattggagctatcctactgtattgagatcggcgaagacaacagaagtattgaaccccttacttatggccgcatcgcttcttattactacctgaagcaccagaccgtcaaaatgtttaaggatagattgaagccagagtgtagcacagaggagctactgagcatactctccgacgcagaggagtacaccgatctgccagtccggcacaacgaggaccacatgaattcagagctggcaaaatgtcttcccattgaaagtaatccacattctttcgacagcccacataccaaggctcacctcttgctgcaggcccatctgagccgtgctatgctcccctgtcccgactacgacacggatacaaaaactgtgctggaccaagctttgcgggtttgtcaggctatgctggatgtggccgccaatcagggatggttggttacggtgcttaatataactaacctgatccagatggtaatacagggcagatggctgaaagattcatcgctgttgacgctgccaaacatcgagaaccatcatctccacctcttcaagaaatggaaacctatcatgaaggggccccacgctaggggtaggacttccattgaatctctgcccgagctaatccacgcatgtggggggaaagaccatgtcttttcttcgatggttgaaagcgagcttcacgccgcaaagactaaacaggcttggaactttcttagccatctgccagttatcaatgtggggatttctgtaaaaggaagctgggatgacttggtcgaaggacacaacgaactgtcggtttcgactcttacggcggacaagagggatgataataaatggatcaaattgcacgcggatcaagagtatgtcctccaagtgagcttgcagcgcgttcacttcgggtttcacaaagggaagcccgaaagctgtgccgttacacctcgctttcccaaaagcaaggatgaggggtggttcttaatactgggtgaagtcgacaagagggagctgatcgctctaaaacgcgtgggctacatacgcaaccaccacgtggcctctctgtcattttataccccagagatcccaggaagatacatctacacgctgtacttcatgagtgattgctatttaggcctcgaccagcagtacgacatatacctcaacgttacacaggcctccctgtccgcacaggtgaataccaaagtctctgattccctaaccgatttggccctgaaatag

SEQ ID NO: 177742 - DNA, 816 bp, Artificial Sequence
  Description of Artificial Sequence: Synthetic coding sequence
atggaggacagccacaagagcaccaccagcgagaccgccccccagccaggctccgctgtgcagggcgcgcatataagccacatcgcgcaacaagtcagctctttgtccgagagtgaagagtcccaagactccagcgattccattggctctagccagaaagcccacggaatcctggcgaggcggccaagctacaggaaaattctgaaagatctgagttccgaagacactagagggcgaaagggagacggtgagaatagtggcgtgtctgccgccgtgacgtccatgagcgtgcccacgccaatctatcagacaagttctggccaatatatagccattgcaccaaacggcgctctacagctagcgagcccgggaacagatggagtgcagggccttcagaccctgacaatgacaaattctggctctacccaacaggggaccaccatcctacagtacgcccaaacaagcgacggtcagcagattctcgtgccaagcaatcaagtagtggtgcagacagcaagcggggatatgcagacttatcagattagaacaacgccttccgcgacttccctgccacagacagtcgtcatgactagccccgtgactctcacaagccagactaccaaaacggacgatccacagctgaagcgcgagatccggttgatgaagaacagggaggcggcccgagaatgtcgaagaaagaagaaagagtacgtgaagtgcctggaaaatagagtggccgtgctcgagaaccagaataagaccctcattgaagaactgaagactctcaaggatctctatagcaataaaagcgtctag

SEQ ID NO: 177743 - DNA, 411 bp, Artificial Sequence
  Description of Artificial Sequence: Synthetic coding sequence
atgaccaacagcggcagcacccagcagggcaccaccatcctgcagtatgctcagactagcgacggtcaacagattttggtaccctccaaccaggtcgtagttcaaaccgcttcgggtgatatgcagacatatcagatccggacaacaccatcggcgaccagcctgccccagaccgtagtgatgacctctccagtgaccctcacctctcagactacgaagactgatgacccgcagttgaagagggaaatccgtctcatgaaaaacagagaagctgccagagagtgtcgaagaaaaaagaaggagtatgttaaatgtctcgaaaatcgtgtggcagtcctggaaaatcaaaataagacactgatcgaggaacttaaaacgctgaaggacctgtacagcaacaaatccgtatag

SEQ ID NO: 177744 - DNA, 603 bp, Artificial Sequence
  Description of Artificial Sequence: Synthetic coding sequence
atggaggacagccacaagagcaccaccagcgagaccgccccccagcctggctccgccgtgcagggggcgcatattagccatatcgcccagcaggtgtcatctctgagcgagtctgaagaatcacaagactcttccgactccatcggttcctctcagaaggcgcatggcatcctggcacgccgaccaagctatcgtaaaatcctcaaagacctgagttccgaggatacaagaggaagaaaaggtgatggtgagaatagtggggtgagcgcagccgtgacttcaatgtccgtgccaacccccatctatcagacctcttctggccagtacatagccatagcaccaaacggcgctcttcagctcgcaagccccggcacggatggcgtgcaggggttgcagacactcaccatgactaacagcggctccactcagcagggtaccacaatcttacagtacgcccagacatcggacggccagcaaatcctcgtgccttccaaccaggttgtggtccagaccgcttctggagacatgcagacctatcagattagaaccaccccgtctgccacatccctgccacagaccgtggtgatgacttcacctgtatag

SEQ ID NO: 177745 - DNA, 513 bp, Artificial Sequence
  Description of Artificial Sequence: Synthetic coding sequence
atggaggacagccacaagagcaccaccagcgagaccgccccccagcccggaagcgcagtccagggagcccacatttctcatatcgcccaacaggtatcaagcctgagcgaaagtgaagagtcgcaggactcatcggattccatcggttccagccagaaggcccatgggattctcgccagacggccatcctacaggaaaatattgaaggaccttagtagtgaagatacccgcggcaggaagggagacggcgagaactctggggtttccgcggctgtgacttcaatgtctgtgccaacgccaatttatcagacaagcagtggacagtacatagccatcgctcccaacggagccctccagcttgcttcgcccggtacagatggagtccagggtttgcagacactgaccatgacaaattcaggcagcacccagcagggaacaaccattctgcagtacgctcagactagtgatggccaacaaatattagtgccttctaaccaggtggtggttcagtag

SEQ ID NO: 177746 - DNA, 321 bp, Artificial Sequence
  Description of Artificial Sequence: Synthetic coding sequence
atgatgctgcagcaccccggccaggtgagcgccagcgaggaggagttgcgcttcgccatccagaacaaacacctgtgccatcgcatgtcgagtgctttagagtccgtgaccgtgagcgatcgccccctgggcgtgagcattaccaaggccgaagtggccccagaagaagatgagcgtaagaagcgccggcgagagcggaataaaatcgccgcggctaagtgtcgcaacaagaaaaaggagaaaacagaatgcctgcaaaaactgcctcgcccattttgggtgcagaaaacctgtatttgggctgtggatagctgcaaatag

SEQ ID NO: 177747 - DNA, 546 bp, Artificial Sequence
  Description of Artificial Sequence: Synthetic coding sequence
atgatgctgcagcaccccggccaggtgagcgccagcgaggtgagcgcatccgctatcgtgccatgtctctcccctccggggtcactggtgttcgaagacttcgccaatttgaccccctttgtcaaggaggagctgcgcttcgccatacagaacaagcacctgtgccacaggatgtcctctgcattggaaagcgtgaccgtgtctgaccggccattgggggtatccattactaaggccgaggtagctcccgaagaggatgaacgaaagaagcgccggagggagcgaaacaaaatcgctgccgccaaatgccggaataaaaaaaaggagaagacagagtgcctacagaaagaatcagagaaactggagagcgttaatgcggaactgaaagcgcagattgaagagctgaaaaacgagaagcagcacttgatatacatgcttaacctgcaccgacccacctgtatcgtgcgcgctcaaaatggtcgaacccctgaagatgaaaggaatctttttatccaacagatcaaggagggcacactgcagtcctag

SEQ ID NO: 177748 - DNA, 528 bp, Artificial Sequence
  Description of Artificial Sequence: Synthetic coding sequence
atgatgctgcagcaccccggccaggtgagcgccagcgaggtgagcgcttctgcaatcgtcccttgtcttagccctccaggctctctggtctttgaagactttgcaaaccttactcctttcgttaaagaagagttgagatttgcgatacaaaataaacacctctgccaccgcatgagctccgccctggagtctgttactgtttccgaccgaccccttggtgtttctataaccaaagcagaggtggcccccgaggaggacgagcgcaagaagcgtaggagagagcgtaacaagatcgccgctgccaagtgtcgcaacaagaaaaaagagaagactgaatgtctccaaaaggagagtgagaagctggagtctgtcaatgctgaacttaaagcacagattgaagagttgaaaaacgagaaacagcaccttatctacatgctcaatctgcacagacccacgtgtatagttcgggcccaaaatggccggacgcctgaagacgagcggaacttatttattcaacaaattaaatag

SEQ ID NO: 177749 - DNA, 408 bp, Artificial Sequence
  Description of Artificial Sequence: Synthetic coding sequence
atgatgctgcagcaccccggccaggtgagcgccagcgaggtgagcgcctccgccatcgtcccttgcctgagccctcctgggtccctggtgttcgaagatttcgcgaacctgactcctttcgtaaaagaggaactacgatttgctattcagaataagcacctctgtcatcgtatgagcagcgcactcgagagtgtgactgtctcagaccgaccattgggtgtgtccattaccaaagccgaagtggcccccgaagaggatgaacgaaagaaaaggaggagagagcgtaacaagatcgcggctgcaaagtgtagaaataaaaagaaagagaagaccgagtgtctgcaaaaactcccaaggcccttctgggtgcagaagacgtgcatatgggccgttgactcctgcaagtag

SEQ ID NO: 177750 - DNA, 375 bp, Artificial Sequence
  Description of Artificial Sequence: Synthetic coding sequence
atgagcagcgccctggagagcgtgaccgtgagcgaccggcccctgggtgtgtctattaccaaggcggaggtggcccctgaggaggacgaacggaaaaaacgtaggcgggagcgtaacaaaattgccgcagctaaatgcaggaacaaaaagaaagagaagaccgagtgtctccagaaggaatccgagaaacttgagtcagtaaatgcagagttgaaggcacagattgaggaactgaaaaatgaaaagcaacacctgatttacatgctgaatttgcataggccgacttgtatcgtgagggcccagaacggtcggacgcccgaggacgagcggaacctgtttattcagcaaattaaagaggggaccctccagtcttag

SEQ ID NO: 177751 - DNA, 546 bp, Artificial Sequence
  Description of Artificial Sequence: Synthetic coding sequence
atgatgctgcagcaccccggccaggtgagcgccagcgaggtgagcgcttccgccatcgttccatgcttgtcacctccaggctccctcgtgtttgaagatttcgctaatctgacccccttcgtgaaggaggagcttaggttcgccatacagaataagcatttgtgccaccgtatgtcctccgccctcgagagcgtgacagtgtcggataggccgcttggagtctctatcacaaaagccgaggttgctccggaagaggacgaacgtaagaagagacgcagagaaaggaacaaaatcgccgctgccaagtgccggaacaaaaaaaaggaaaagactgagtgtttgcagaaggaatcagagaagcttgagagtgttaacgccgagctgaaggcccagatcgaggaattgaagaatgaaaagcagcaccttatctatatgctgaacctgcacagacccacatgcatcgttcgtgcgcagaacgggagaaccccggaggacgaaagaaatctgttcattcaacagattaaggagggcactctgcagagctag

SEQ ID NO: 177752 - DNA, 408 bp, Artificial Sequence
  Description of Artificial Sequence: Synthetic coding sequence
atgatgctgcagcaccccggccaggtgagcgccagcgaggtgagcgcttccgcaatcgtgccgtgcctgtcccccccaggatctctggtgtttgaggacttcgccaacctcacaccgttcgttaaagaagagcttagattcgctatccaaaataagcatctttgccaccggatgagctccgctctggagtcagtgacagtgtccgataggcccctgggggtgtctattaccaaagccgaggtagcaccggaagaggacgagagaaaaaagaggagaagggagagaaacaaaattgccgctgccaagtgccggaacaagaagaaggagaagaccgaatgcctgcagaagctcccccggcccttttgggtgcagaagacttgcatctgggccgtggatagctgtaagtag

SEQ ID NO: 177753 - DNA, 1056 bp, Artificial Sequence
  Description of Artificial Sequence: Synthetic coding sequence
atgaccgagatgagcttcctgagcagcgaggtgctggtgggcgacttaatgtcgccgttcgaccagagcggcctgggggccgaggaatctttgggactgctagacgattacctcgaagtggccaaacactttaagccccacggcttcagctctgataaggcaaaggctggtagcagcgagtggctggccgtagacggattggtgtcgccaagcaacaattccaaagaggacgcttttagcggaacagactggatgctcgagaaaatggatctcaaagaatttgatctcgatgccttgctgggaattgatgatctggaaactatgcccgacgaccttttgactaccttggacgatacctgcgacctgttcgcacctcttgtgcaggagactaataagcaacccccccaaaccgtcaatcccattggacacctcccagagtccttaacgaagcccgaccaagttgcccccttcactttcctgcagccactcccgttatccccaggagtactttcgagcacccccgaccattctttctcgctggagctgggatcagaagtggacattaccgagggggatagaaaacctgattacacagcctacgtcgccatgatcccacagtgtatcaaggaagaggatacgccttctgacaatgacagcggcatatgcatgagtcccgaatcttatctgggcagcccccagcattctccttctacccgcggcagccctaaccgctccctgccttctccaggggtgctgtgcggaagcgctcggcccaagccttatgatcccccaggggagaagatggttgcagctaaagtaaagggcgagaagcttgataaaaaattgaaaaagatggagcaaaacaagactgccgcaacccgctaccgccagaagaaacgcgccgagcaggaggccctgactggcgagtgcaaggaactagagaagaagaacgaggccctgaaagaacgcgccgacagtctcgccaaagaaatccaatacctgaaggacctgatcgaagaagtgcgcaaggcaagggggaagaaacgggttccatag

SEQ ID NO: 177754 - DNA, 1056 bp, Artificial Sequence
  Description of Artificial Sequence: Synthetic coding sequence
atgaccgagatgagcttcctgagcagcgaggtgctggtgggcgacctgatgtccccattcgatcagtctgggttgggcgcagaggaatccctgggcctactggacgactatctggaggtcgcaaaacattttaaacctcatggcttctctagcgacaaggccaaggctgggtcatccgagtggttggcggtcgacggactggtatcccccagtaacaactcaaaggaagacgcattctctggcactgattggatgctcgaaaaaatggatttaaaagagtttgatctagacgcgctgttggggatcgatgacctagagacaatgcctgatgatttgctgaccactttggacgacacctgcgacctattcgcaccccttgtgcaagagacgaataaacagccgccacaaaccgtgaatcccattggtcatcttcccgagtcattgacaaagccagaccaggtggctccattcacttttctccagcctttgcccctctcacccggagtgctcagctctactcctgatcactcctttagcctggagctcggatctgaggtggatatcacagaaggggataggaagcctgattataccgcctacgtggccatgatccctcaatgcatcaaggaggaggatactcctagtgacaacgattccggaatttgtatgtccccggagtcatacttgggcagccctcagcattcgccgtcaacacgaggatcccccaacaggagtctcccatctccaggtgtgttgtgcggaagcgcgcggcccaaaccatacgaccctccaggtgagaaaatggtagccgcgaaagtcaagggggagaaactggataagaaactaaagaagatggagcagaataaaaccgccgccacccgataccgacagaagaagagggctgagcaggaggctttgacaggcgaatgtaaggagctggagaaaaagaacgaagctctgaaagagcgggccgatagcttagccaaggagattcagtacctcaaggacctgatcgaagaggtgcgaaaagctcggggaaaaaaaagagtgccgtag

SEQ ID NO: 177755 - DNA, 1056 bp, Artificial Sequence
  Description of Artificial Sequence: Synthetic coding sequence
atgaccgagatgagcttcctgagcagcgaggtgctggtgggcgacctgatgagtcctttcgatcagagcggcctcggtgccgaggaaagcctcgggcttttagatgattacttagaagtagccaagcacttcaagccccacggatttagcagtgataaggccaaggccggaagctcggaatggctggccgtcgatggtttggtgtccccatctaataactccaaggaggacgctttttccggaaccgactggatgctggagaaaatggacctaaaggagttcgatctggacgcgcttctcgggattgatgacctcgaaactatgccggatgacttactgacaactctcgatgatacctgcgacctttttgccccgcttgtgcaggaaaccaacaaacagccacctcagactgtgaatcccatcggacacttgccagagtctctcactaagccggatcaggtggctccattcacattcttacaaccacttcctctttccccaggagttttgtcttcaactcctgaccatagcttttcactggagctcgggtctgaggtggatatcaccgaaggcgaccgtaagcctgattacactgcatatgtggccatgatcccccagtgcatcaaagaggaagatacacctagcgataatgactctgggatatgcatgagtcccgagtcttacctgggcagcccccagcacagccctagtacgcgaggcagccctaacaggtccctaccaagtccaggtgtgctttgcggttccgcgcggcccaagccttatgatcctcccggcgagaaaatggtcgcagctaaggttaagggggagaaactggataaaaagctgaagaagatggagcagaacaagacggcagcgacacgttatagacagaagaagcgagcagaacaggaggcactgaccggcgagtgcaaagagctggagaagaagaatgaagctttgaaagagagagccgacagtctcgcaaaggagatacagtatttgaaggatttaattgaggaggttagaaaggcccgcgggaagaagagggtcccttag

SEQ ID NO: 177756 - DNA, 849 bp, Artificial Sequence
  Description of Artificial Sequence: Synthetic coding sequence
atgagcctgctggccaccctgggcctggagctggaccgggccctgctccccgcttccggcctggggtggctcgttgactatggcaaactgccaccagcgccagcccctttagctccatacgaagtgttaggtggcgcgctggagggcggcctcccagtcggcggggagcccctggctggtgacgggttttcggattggatgactgagcgggtagactttactgcacttttacccctggagccacctttacctcccgggacgcttccccagccctcccctactccacccgaccttgaagcaatggctagcctgctgaaaaaggaacttgagcagatggaagactttttcctcgacgctcccccccttccgccaccaagtccacccccacttcccccgcctccgctgccgccagccccctccctgccactttccctcccctccttcgacctgccgcaacccccggtacttgataccctcgaccttttggctatttactgtcggaatgaggccggacaggaagaagtgggtatgccccctctgccgcccccccagcagccacctcctccctctccccctcagccaagtcggctagccccttaccctcaccccgctactacccgcggagatcgcaagcaaaagaaacgcgatcagaataaatccgctgctcttcgttataggcagcggaaacgcgccgaaggtgaggcactggaaggagaatgtcagggtttggaggcaagaaatcgcgagctgaaggaacgggccgagtctgtcgagcgggaaattcagtatgttaaagacttactgattgaggtatacaaggcccggagtcaaagaactaggtcctgttag

SEQ ID NO: 177757 - DNA, 2013 bp, Artificial Sequence
  Description of Artificial Sequence: Synthetic coding sequence
atgggcgagcccgccggcgtggccggcaccatggagagccccttctcccctgggctgtttcaccgtttggacgaagattgggattctgccttgttcgcggaattgggttatttcacagacactgacgaattacagctcgaggccgcaaacgagacatacgagaataactttgacaacctggacttcgaccttgacctaatgccatgggaatcggatatctgggatatcaacaaccagatctgcacggttaaggatattaaggccgagccccaacccctgagcccagctagctcgagttactctgtgtcatccccgcggagtgtggactcatatagcagtacccaacacgtgcctgaagagctggacctaagcagctcttcccaaatgtctcccctcagcctctatggagaaaatagcaacagtttgtcttctgctgagccccttaaggaggacaagcccgtgactggaccgcgtaataaaaccgagaacggtctgactcctaaaaaaaaaatccaggtgaactctaagcccagcattcaaccaaagccactgctgctgcccgccgcccccaaaacacaaacaaactcgagtgttccggcgaaaaccattattattcaaacagttcccaccctcatgcctctggccaagcaacagcccatcatcagcctgcaacccgctccaacaaaaggacagactgttttgctctcccaaccgactgtagtccaacttcaggccccaggcgtcctgccaagtgcccagcccgttctggccgtcgctggaggggtgacgcaactccccaatcacgtggttaacgtagtgcctgccccatcagccaacagtccagttaatggcaagctcagcgtgaccaagcctgtgctccaatctactatgagaaatgtgggcagcgatatcgccgtgctccgccgccagcaacgcatgattaagaacagagaaagtgcctgtcagagcaggaaaaagaagaaggaatatatgctggggttggaggccaggctcaaggctgcactctcagagaatgagcaactgaaaaaggaaaacggcaccttgaagcgccagctggacgaggtggtctccgaaaaccagcgactaaaggttccttcgccgaaaaggcgtgtggtctgcgtcatgatagtgttggcctttataatcctcaattacggtcccatgtccatgctggaacaagactctcgccggatgaacccatccgtctcccccgccaatcaacgacgtcacctgctaggcttctctgccaaggaggcacaggataccagcgatgggattatccagaagaactcctaccggtacgaccattccgtgtccaacgataaggccctgatggttctaaccgaggagcccctactctatatacccccacccccttgtcagcccttgatcaataccactgagtctctgcgcctgaaccatgagctgagaggctgggtccaccgccatgaggtggaacgaacaaagagtcggcggatgaccaacaaccagcagaagactaggattctgcagggtgctcttgaacaaggatccaacagccagctcatggcagtgcagtatacagagaccaccagttccatttccagaaacagtgggtctgagctgcaggtatattacgcatcaccaagatcttatcaagatttttttgaagctattaggcggagaggggacacattctatgttgtgagcttccgcagggaccacttactcctgccggctacgacgcacaataaaaccacaagacctaagatgagcatcgtgttacctgcgattaatatcaacgagaacgtgattaatggacaagactacgaagttatgatgcagatcgattgtcaggtgatggacaccagaatcctccacatcaaaagttcctccgtgccaccatatcttagggaccagcagcggaatcaaaccaacacctttttcggttctccccctgctgccacagaagccacacatgtagtttccacaattcccgagagcctacagtag

SEQ ID NO: 177758 - DNA, 2112 bp, Artificial Sequence
  Description of Artificial Sequence: Synthetic coding sequence
atggccgagctgatgctgctgagcgagatcgccgaccccacccggttttttacggacaaccttctctcacccgaggactggggtctccaaaactccacgctgtactctgggctagacgaagtggctgaggaacagacacagctgtttagatgtccagaacaggatgtgccatttgacggcagcagcctcgacgtggggatggacgtgtccccctcggagccaccttgggagcttcttcccatctttccggatctccaggtaaaatccgagccctcttccccatgctcaagcagcagcttgagttctgaatctagccggctgagtacggagcccagttctgaagcactgggcgtcggagaggtgctccatgtcaagactgaaagcctggcccctccactctgcctattgggtgacgatcccacctcctccttcgagacagtccagattaacgttatcccgacctctgatgatagttcagacgtccagacgaaaatcgagcccgtatctccatgtagtagcgttaactcagaggcatctttgctctccgcagactccagttcacaagcttttattggagaagaggtactggaagtgaagactgaaagtctgtcacctagtgggtgtctgctgtgggacgtgccagcccccagcttaggtgcggtccagatctcaatgggaccctcattggacggctctagtggtaaggctttgcccaccaggaaacccccactccagccaaagcctgtcgtgttgaccactgtaccaatgccttctagagcagttccaccttccaccacggtgctgcttcagtcgcttgtgcagccgccaccggtgtctccggtggtgctgatccaaggggcgatacgggtccagcctgagggacccgctccctctctaccacgtccggagcgaaaatccattgtccctgcccctatgccgggaaattcttgtccacctgaagtggatgccaagctgctcaagaggcagcaacgtatgattaagaatcgggagtcagcttgtcaaagcaggcggaaaaagaaggagtatctgcagggtttggaagccaggcttcaggcagtacttgcagataatcagcagcttaggcgggagaatgcagcgttgaggcgccgcctggaggcactgctcgccgaaaattcggagttaaaactgggatcaggaaaccggaaagttgtttgcatcatggtctttctcctgtttatcgcgtttaactttggcccagtcagcatctctgaaccccccagcgcccccatttctccaagaatgaacaaaggcgagccccagccgaggagacacctccttggcttctccgagcaggaaccagtccagggagtggagcctctgcagggatcatcccaaggtccaaaggaaccacaaccttctccgactgatcagccctctttctccaatctcactgctttccctggcggagcaaaggaattgttgctgcgggatctggatcaactgtttctatcttccgattgtcgccacttcaatcgcactgagtccctgaggctggctgatgaacttagcggctgggtccagaggcatcaaagagggcggcgtaaaatccctcagagagctcaggaaagacaaaaaagccagcctcggaagaaaagcccccccgtgaaggcagttcctattcagcctcccgggcccccagagcgggactctgtggggcaactgcaattgtataggcatccagatcgttctcagcctgcattccttgatgctatcgatagaagagaggacacgttttatgtggtttccttccggcgagaccacctcctgctccctgccatcagccacaataagacttcaaggcccaaaatgagcctggtgatgcctgccatggctcctaatgagaccctgtcaggcaggggcgctccgggggattacgaggagatgatgcagatcgaatgcgaggtcatggacactagggtgattcatatcaagaccagcacagtgcctccctcattgaggaaacaaccctcgcctactccagggaatgccacaggaggccctctaccagtgagcgcagccagccaggcccatcaggcctcccaccagcccttgtatctgaatcacccgtag

SEQ ID NO: 177759 - DNA, 669 bp, Artificial Sequence
  Description of Artificial Sequence: Synthetic coding sequence
atggccgagctgatgctgctgagcgagatcgccgaccccacccggttcttcactgataaccttctaagcccagaggactgggggctgcagaatagtacactgtactccggccttgacgaggtcgccgaggagcagacacagcttttccgctgccctgaacaggacgtcccctttgatggatcgtctctcgacgtgggaatggatgtgagccccacggaccaaccgtctttcagcaacctcaccgcctttcctggaggtgccaaagagcttttgctgagagatctggaccagctgttcctttcatctgactgcaggcactttaacagaaccgagagcctacgtctggcagatgaattgtctggctgggtgcagcgtcatcagagggggcggaggaaaatcccacagcgggcccaggagcggcaaaagtcccagcccagaaagaagtcccctcctgtgaaagccgtccctatccagccaccaggtccccctgaaagagatagcgttgggcagctgcagctgtacagacatccagatcgcagtcaacctgcattcctggacgcaatcgaccgaagggaagacaccttctacgtggtatcattccgccgtacgacttgttgttctcagccttccgctactacacggcctccggggccaaggtgtccttggtag

SEQ ID NO: 177760 - DNA, 2103 bp, Artificial Sequence
  Description of Artificial Sequence: Synthetic coding sequence
atggccgagctgatgctgctgagcgagatcgccgaccccacccggtttttcacggataatctgctttcccctgaggactgggactccaccctctattccgggcttgacgaggtcgctgaagaacagacccagctgttccgttgccctgagcaggatgtccccttcgacgggtcatctctggacgtgggaatggacgtgagcccttcagagcctccatgggagctcctccctattttccctgacctccaggttaagagcgagcccagcagtccatgttcatcgtcttctctctctagcgagtcgtcccggctatcaacggagcccagcagtgaggcattaggcgtgggggaagtgcttcacgttaagacggagtccctcgcccctcctctgtgcctactcggggacgatcctacaagtagctttgaaactgtgcagattaatgtgattcccacctccgatgattcaagcgacgttcagactaagatcgaacctgtgagcccctgcagtagcgtgaactctgaagcctcattgcttagtgccgacagcagttcgcaagccttcattggagaagaagtccttgaagtcaagaccgagtctttgagtccgagcgggtgcctgttgtgggacgtcccagccccttcccttggagccgtgcagatttccatgggtcctagtctggacggatcctctggcaaggccctaccaaccaggaagcccccattgcagcccaagcccgtcgtgctcacaacagtgcccatgcccagtcgtgcagttccaccatctacaaccgtactgttacaaagtttggttcagcccccacccgtgtcacccgtagtcctgattcagggggcaatcagagtgcagcctgagggtccagcaccctcactgcccaggcctgagagaaaatctattgtaccagcacccatgcccggcaatagctgcccccccgaggtggacgcaaaactcctgaagcgccagcagcgcatgatcaaaaacagagaaagtgcttgtcaaagtcgccggaaaaaaaaggaatacctccaagggttggaggcaaggttacaggccgtcttggccgataaccagcagctgcgccgggagaacgcagccctgcggcgacggcttgaggctcttttagcggagaacagcgagctgaagctgggctctggcaatcgaaaagttgtctgtatcatggtgttcctcttatttatcgcctttaactttggcccagtgtccatttccgagccccccagtgctccaattagccctagaatgaataagggggagcctcaacctcgaaggcatttattaggttttagtgaacaagaaccagtccaaggtgttgagccactgcaggggtcaagtcagggccccaaagagccacagcctagtccgaccgaccagccttctttctccaacctgaccgcgtttccaggcggcgccaaggaactgctactgcgcgatttagatcagctctttctttcctctgattgcaggcattttaaccgcactgaaagtttgcggctggctgacgagttgtctgggtgggttcagaggcatcagagagggaggcggaaaataccacagagagcacaagagagacagaagtctcaacctaggaaaaagagcccacccgtcaaggcagtccctatacagcccccaggccctccagaacgcgattctgtggggcaactccagttataccgtcatcctgaccgcagtcagccagccttcctagacgcaatcgatcgcagagaggatactttctacgtggtgagttttaggagggatcacctcctcttgcctgccatctcgcacaacaaaacttcgagacctaaaatgtccctcgtgatgcctgccatggctcctaacgagactctgtcaggacgcggcgcccctggagactatgaggagatgatgcagattgagtgcgaggtgatggataccagagttatccatataaagacaagcaccgtgccgccaagtctcagaaagcagccttcaccaacacccgggaatgccacggggggacctctacccgtcagcgccgcctcccaggcgcatcaggccagtcaccagcccctttaccttaatcacccatag

SEQ ID NO: 177761 - DNA, 2112 bp, Artificial Sequence
  Description of Artificial Sequence: Synthetic coding sequence
atggccgagctgatgctgctgagcgagatcgccgaccccacccggttcttcactgacaatttgttatcccctgaggattggggcctgcaaaacagtaccctgtacagcggtttggatgaggtggccgaggagcaaacgcagctgttcagatgtcctgagcaggatgtcccatttgatggtagttcattagacgtcggtatggacgtctccccttccgaacccccgtgggaactgttgcctatctttcctgacctgcaagtcaagagcgagccctcttccccatgctcgtccagtagcctgtccagtgagagttcgcggctttccacagagcccagctcagaggccctgggagtgggcgaggtattgcatgtgaaaactgagtctcttgccccccccttatgtctgttaggtgacgatcctaccagttccttcgagactgtgcagattaatgtgattcccacaagtgacgactcttcagacgttcagaccaaaatcgagccagtctcgccatgttccagcgtcaattccgaggcaagtctcctgagcgccgattcatcctcccaggcctttataggagaggaagttcttgaagtcaaaaccgagagcctgtcacccagcggctgcttgctttgggacgtacctgctcctagcctgggggccgttcagatttcaatgggcccgtccctcgatggctcatctggaaaggccctgccaaccaggaagccacctctgcaaccgaagcccgtagtgctcacgacggtccctatgcccagccgggccgtccccccttcgactaccgttttgttacagtcactcgtgcaaccccctccagtgagtcctgtggtgctaatccaaggtgctatcagagtacagccagaaggccccgcccctagccttccgagacctgaaaggaagagcatcgtgcctgccccaatgcctgggaactcttgcccaccagaagtagacgcaaaactgctcaagagacaacagcgcatgatcaagaaccgcgaatccgcttgtcagtcaagacggaagaagaaggagtacctgcagggactcgaggcgagacttcaggcggtcctagccgataaccagcagttgagaagagagaacgccgcactcaggcggcgcttggaggcactcctcgccgaaaactctgaactgaagctgggtagcggaaataggaaggtggtgtgcatcatggtcttcctcttatttatcgcattcaattttggaccagtcagtatttccgaacctccatccgcaccaatcagtccccggatgaacaaaggagagccccagcccaggagacacttgctgggcttcagtgagcaagagcccgtccaaggcgtggagcctctccagggcagtagtcaggggccaaaagaacctcagccctcacccacggatcagccatcctttagcaacctcacagcttttcctggcggggcaaaagagctgttgctgcgggatctggaccagctctttttaagctcagattgccgccactttaatcgcacggaatcgctgagactggcggacgagctgtccggatgggtgcagcggcaccagagaggccgccggaagattcctcaacgagctcaggagcggcaaaagtctcagccacgaaagaagtctcctcccgtgaaggccgttccaattcagcccccaggcccccccgagagagattccgtcggccagctacaactgtacagacaccccgaccgttcccagcctgcctttcttgatgctatagatcgcagagaggatacattttacgttgtgtcttttcgccgcgatcacctgctcttaccggccatcagccacaataagaccagccgccctaagatgagtctggtcatgcctgctatggcccctaacgagaccctctcagggaggggggcccccggtgattacgaggagatgatgcagatagaatgcgaggtcatggacacaagggtgatccacatcaaaacttcaaccgtgccaccttcactgagaaaacagccctcacctactcctggaaacgcaacaggcggccctcttccagtctccgccgcttcccaagcccatcaggcctctcatcagcccctatacctgaaccacccctag

SEQ ID NO: 177762 - DNA, 2103 bp, Artificial Sequence
  Description of Artificial Sequence: Synthetic coding sequence
atggccgagctgatgctgctgagcgagatcgccgaccccacccggttttttacggataatctgttgagccccgaggactgggactcaacactctacagtggcctggatgaggttgccgaagaacagacccagcttttcagatgtccagaacaggatgtgcccttcgatggctcctccctggacgtgggcatggacgtgtccccctctgaacctccttgggaattgttacctattttccctgatctccaggtcaaatccgaaccctcctcaccatgttcgtcaagttccctatcatccgagagctcgcggctgagtaccgagccatcatcagaggctctgggagtaggggaggtccttcacgtcaaaactgagagcctggctccgcccctctgcctgctcggggacgaccctacatccagctttgaaacagtgcagatcaatgtaatccccacatctgacgatagcagcgatgtacagaccaagattgaaccagtttctccttgctcaagcgttaactctgaagcatccctgctgtcggccgactctagctctcaagctttcattggggaggaagtcctcgaggttaagactgagtcactgagccccagcggatgtctcttgtgggacgtcccagcccccagccttggcgctgtgcagatttccatgggaccctcattggacggctccagcggaaaggctcttcccactcggaaacctcccctccagccaaagcccgtggtgcttacgaccgtcccgatgccatccagggccgtccccccctctaccacggtgctactgcaatccctggttcagcctccgcccgtcagtcccgtcgtactgattcagggcgccattagagtccagcccgagggccctgcccccagcctgccaagacccgagcgtaagtcgatcgtccctgcccccatgcccggcaacagctgtccccctgaagtggacgcaaaattgctgaaacgccaacagcgtatgattaagaatcgggagtcggcttgccagtctaggcggaagaaaaaggaatatctgcaaggactcgaagccagattgcaagccgtcctggccgacaatcagcaactccggagagaaaatgctgccttgaggagacgtttggaggcactcttagcagagaactcagagcttaagctcggctccggcaatcggaaggtggtgtgcataatggtgttcctgttattcatcgcttttaacttcggcccagtaagtatttctgaacctccttctgcgcccatttctcctcggatgaataagggcgagcctcaaccccgccgccatctgctcggtttttccgagcaagagccggtacagggagttgagcccctgcagggctcaagccagggaccgaaggagccgcagccgtccccaactgaccagcccagtttctcaaacctgaccgcctttccaggtggcgctaaagaactgctgctgagagacttggaccagctctttctgtctagcgattgccgacattttaaccgcaccgaaagccttcgcctagcagacgaattatcagggtgggtccagcggcaccaacggggccggagaaagatccctcagagagcacaggagcgacagaagtcccagccaagaaaaaaatcccccccggtgaaagccgtcccgatccagccgcccggaccaccggaacgcgattccgtgggtcaactgcagctataccgccatcctgaccgctctcaacccgctttccttgatgctatcgacaggagagaggataccttttacgtcgtctcttttcgacgggaccatctactcctacctgcaataagtcacaacaaaacttccagaccaaagatgtccctggtcatgcccgcgatggccccaaacgagacgttgtcaggacgtggcgcccctggcgattacgaggagatgatgcagatcgaatgcgaggtcatggacacacgcgttatccatatcaaaacatccacggttccccctagcctacggaagcagccatccccaaccccaggcaacgctaccggggggcctctcccggtctcggcggcctctcaggctcatcaggcttcccatcagccactatatctgaatcacccctag

SEQ ID NO: 177763 - DNA, 429 bp, Artificial Sequence
  Description of Artificial Sequence: Synthetic coding sequence
tgacagcccagccccaccgaccagcccagcttcagcaacctgaccgcctttcctggaggggccaaagaacttctgttacgagacttggaccagctattcttatcctccgattgccggcacttcaatcggactgagagcctgcgtctggccgacgaactgtcaggatgggtgcagcggcatcagaggggacgaagaaagattccgcagcgggcccaggagcgccagtcgctggatacaagcccctcacgcagtctgtcacatgggcgcagccatctgcaactgagacagtctccgagcaatccgttggacccacagaaaggtatactatgggcctcttgcaactacatcgcaacccagaccgtcagaagtcagcactcatggatgcagttgacggacgggaaaacacattttatgctctccttgagctag

SEQ ID NO: 177764 - DNA, 429 bp, Artificial Sequence
  Description of Artificial Sequence: Synthetic coding sequence
tgacagcccagccccaccgaccagcccagcttcagcaacctgaccgccttccctggtggggccaaggaattactcctgagggacctggatcagctgttccttagtagcgactgcagacatttcaatagaactgagtcccttcggttagcagacgagctttctggatgggtacagcgacatcagaggggacgaagaaagatccctcagcgggctcaggaacgccaaagcctggacacctccccaagccgctcccttagtcatgggcggtcccatctgcagctgagacaatcccctagcaatccactggacccacagaaaggcattctgtgggcctcctgtaattatatcgccacacagaccgtacgctcccagcatagctggatgcaactcaccgacggcaagacccacttcatgctatctttgagctag

SEQ ID NO: 177765 - DNA, 2112 bp, Artificial Sequence
  Description of Artificial Sequence: Synthetic coding sequence
atggccgagctgatgctgctgagcgagatcgccgaccccacccggttctttactgataatctgttatcaccagaggactggggcctgcagaattccactctctactctggcttggatgaagtggccgaggaacagacgcagcttttccggtgcccagagcaagatgtacccttcgatggatcatcactggacgttgggatggatgtatccccatccgagccaccttgggagttgcttcccattttccccgacttacaggtgaagtccgagccgagctctccctgtagctcctctagtctgtctagcgagagctctcgtcttagtacagagccctccagcgaggccttaggagtaggggaagtgcttcacgtgaagacggagtcattggcacccccactatgcctgctgggcgatgaccctacgtcctcattcgagactgtccagatcaatgtgataccgacatccgacgatagtagcgacgtccagacaaaaattgaacccgtctcaccatgttccagcgtgaactccgaagcgtccctgttatctgccgatagctccagccaggcatttatcggagaggaggtcttggaggtcaaaacagagagcctgtccccatctggctgtctgctgtgggatgtgccggcccctagtctcggggccgtgcaaatctccatggggccaagcctggacggcagttcagggaaggcccttccaacacggaagccccctctccaacccaagcctgtggtactcactaccgtgccaatgccctcaagggccgtccccccttctactaccgtgcttctgcagtccttggtgcaacctccacctgtgtcgccggtcgtgctgattcagggcgctatccgagttcagcctgaagggcccgctccaagcctccccagacccgagcggaagtccatagtcccagcccctatgccaggcaactcttgcccccccgaggtcgatgctaagctcttgaagagacagcaacgcatgattaaaaaccgcgaatcagcttgtcaatcccggcgcaagaaaaaggagtaccttcaggggctggaggctcggttgcaggcagtgttagccgataatcagcagctgaggcgggagaacgccgctctgaggaggcggctcgaagccctcctcgctgagaattccgaactgaaactggggtccggaaatcgtaaggtggtgtgcattatggtgttcctgctgtttatcgccttcaactttggacccgtgagcatctccgaaccaccgagtgcgcctatctcacccaggatgaacaaaggtgaaccccagccacggcggcatctcctgggcttctcagaacaggaaccagtccagggtgtggagccccttcaagggtcctctcaaggaccaaaggaaccacaaccctcacctacagatcagccgagtttttctaacctgactgccttccccggaggtgcgaaagaactcctcctaagggacttagatcaactgttcctgtcaagtgattgcagacatttcaacagaacagaaagtcttcgacttgccgacgagctgagtgggtgggtccagcggcatcaacggggacgcagaaaaattccccagcgggcccaggagaggcagaagtcacagcccaggaagaagtccccaccagttaaagcagtaccgatccagcctccggggcccccagaaagagatagtgtggggcagctgcagctgtacagacatcctgaccgttcacagcctgcctttcttgacgctattgacagacgtgaagacaccttctacgtcgtttcttttcgcagagaccatctgctgctgcccgcaatatcacacaataagacatcaagaccaaagatgtcattagtcatgcctgctatggctcctaatgaaactctttccggacgaggagcccctggggactatgaagaaatgatgcaaattgagtgtgaagttatggatacccgtgtcatccacataaaaaccagcaccgtgcccccttctctgcgtaagcagccttcacccacccccggcaatgcaacaggcggtccgttacctgtctcagcagctagccaggcacaccaggccagccaccagcccctatacctgaaccatccctag

SEQ ID NO: 177766 - DNA, 2112 bp, Artificial Sequence
  Description of Artificial Sequence: Synthetic coding sequence
atggccgagctgatgctgctgagcgagatcgccgaccccacccggttttttacagataaccttctgtcacccgaggattggggcttgcagaattccaccctttactccggcctcgacgaggtggcggaggaacagacgcagctgtttcgctgcccggaacaggatgtgcctttcgacggttcatctctcgacgtgggcatggatgtctcacccagcgagcccccctgggaactcttgccgatcttccccgacttacaagtgaagtccgaaccgtccagcccctgcagttcctcctccctttcctccgagtccagcagattaagcactgaaccatccagcgaggcactgggcgtgggagaggtgctccatgtgaaaaccgagagtctggcgcctccactttgcttgctcggggatgatccaaccagctcattcgaaacagtgcagattaacgtcattcccacatccgacgacagtagcgacgttcaaacaaaaatcgagcccgtcagtccctgttccagcgtgaactccgaagcgtcactgctgtcggcggactcttcatcccaggcatttatcggagaggaggtactcgaggtcaaaaccgaatccttatccccatcggggtgtcttctgtgggacgttcccgctccttccctgggtgcagtgcagataagtatggggccctctctggacggatctagcgggaaggccctccctacacgcaagccacccctccagccaaaacctgtcgtattaacgaccgtacctatgccctccagagctgtgcccccaagtaccactgtactgctacagtcactcgtgcagccacctcctgtgtctcctgtggttctgatacagggtgcaatcagagtacagccggaaggccctgccccatccttacctaggccggaaagaaagtcaattgtgcctgcccctatgcctggcaactcatgccctccggaagtagatgccaagctactgaagcgacagcagcggatgataaagaaccgggagtccgcatgccagagccgcaggaaaaaaaaggaatatctgcagggcctggaagcgcggcttcaggccgttctggccgataatcagcagctcagacgcgagaatgccgctctcaggcggcggctggaggctctgcttgcggagaattccgaacttaaattggggtctggaaatcgaaaggtggtatgcatcatggtctttctgctcttcatcgcattcaacttcggtccagtttcaatctcagagcctcccagcgctcctatctccccaaggatgaacaagggagagccccagccccggcgccacctgctggggttcagtgaacaggagccagtgcaaggggttgaaccattgcaggggagtagtcagggccccaaggaaccccagcccagcccaactgatcagccctccttttcaaatctcaccgctttcccgggtggggccaaagaattattgctgagggacctagatcagttattcctctcctccgactgtcggcatttcaatcgcactgagtcactgaggctggcagatgagctgagcggatgggtccaacgtcaccagaggggccgacgcaagattcctcaacgggcacaagaacggcaaaaatctcagcctagaaagaaatctccccccgtgaaggctgtgccaatccagccccccggacctccagaaagggacagtgtgggccagctgcagttgtatcgccatcctgatagaagtcagcccgcctttttggatgcgattgaccgccgggaagacacattttacgtagtctcatttcggagggaccaccttctgctgccagcaatctcacataacaagacaagtcggcccaagatgtctctggtaatgcctgcgatggcccctaacgagacactgtccgggagaggggcacccggagactatgaagagatgatgcaaatcgagtgtgaggtgatggacacccgcgttattcatataaaaacaagcacagtcccaccctccctgcggaagcagccatccccgaccccaggtaatgctacaggtggtcctctacctgtgagtgctgcaagccaggctcaccaggcaagccaccagcctttgtatctcaatcatccgtag

SEQ ID NO: 177767 - DNA, 2103 bp, Artificial Sequence
  Description of Artificial Sequence: Synthetic coding sequence
atggccgagctgatgctgctgagcgagatcgccgaccccacccggttcttcaccgacaacctcttatctcccgaagactgggactccactctctattcaggacttgatgaagttgcggaggaacagacccaattgttcaggtgtcctgaacaggacgtcccgttcgacggaagttctctagacgtgggaatggatgtttctcctagtgagccgccctgggagctgctgcctatttttccagatcttcaagtgaaatctgaaccatcatctccttgctcctcctcttccttgtcatctgagtcctccaggctgtctacggaaccttcaagcgaggctttgggcgtgggcgaggttcttcatgttaaaactgaatccctggctcctcccctgtgtctcctgggcgacgaccctactagtagctttgaaaccgtgcaaataaacgttattccgacctctgatgatagttccgatgtgcagactaagattgagcccgttagcccctgttcctctgttaacagcgaagcctcactgctgtcagctgacagctctagtcaagccttcatcggtgaggaggtccttgaagtgaaaaccgaaagcctcagcccatccgggtgcctgttatgggacgtgcccgctccctcactaggagccgtccagatcagcatgggccccagcctcgatggtagcagcggaaaagccttgcctacccgcaagcccccgcttcaaccgaagccagttgtgctgaccacagtaccaatgccttcacgcgcagtgcctccgtccacaacagtgctgcttcagagcctggttcaacccccacccgtgtctccggtggttttgattcaaggggcgatcagggtgcagccagaagggcccgccccctcactcccgagacctgagcggaagtcaatcgttcctgctcccatgcctgggaacagctgcccgccggaagtggacgccaagctactcaagaggcaacagaggatgattaagaatcgcgagtcagcctgccaaagtaggcgaaaaaagaaggagtatcttcagggcctggaggcccgcctgcaggccgtgctggcagataaccagcagcttcgcagagagaacgccgcgttgcgtagacggctggaagcgctgctcgcagagaacagtgaattaaaactgggcagcggaaatcggaaagtggtgtgcataatggtgttcctcttgtttatcgccttcaacttcggccccgtgagcataagtgagccccccagtgcgcctatctcaccaaggatgaataaaggcgagcctcagccacggagacacctcttgggattctccgagcaggagcccgtgcagggagtggaacctctccagggttcctcacaaggccctaaggagcctcagcctagtcctaccgaccaaccttctttctccaacctcaccgccttccccggcggtgccaaagagctgctgctgagggatctcgatcagctttttctctcatccgattgcaggcacttcaatcggaccgagtctctcagattggccgacgaactttccggctgggttcagcggcatcagagaggacgcagaaagataccccaaagagcccaggagcggcagaaatcccagccacgcaaaaaatctccccctgtgaaggcagtcccaattcagccccctggacctcctgaaagggattctgtaggccagttgcagctgtatcgccatcctgatcgcagtcagccagcgttcctggatgctattgaccgacgggaagacacattctatgtggtttcctttcgcagggaccacctcctattgcccgccattagccataataagacaagtcgtcctaaaatgtcattggttatgcctgcaatggcccctaacgagacactcagtgggagaggggcgccaggggactatgaggagatgatgcagatcgaatgcgaagtgatggatacaagggtcatccacattaaaacctccacagtgcccccaagcctgaggaagcaaccgagtcccactcccggcaacgccaccggtgggccattgcccgtctcagctgcatctcaagcgcaccaggccagtcatcagccactgtaccttaaccatccttag

SEQ ID NO: 177768 - DNA, 429 bp, Artificial Sequence
  Description of Artificial Sequence: Synthetic coding sequence
tgacagcccagccccaccgaccagcccagcttcagcaacctgaccgcttttcccggaggggctaaagaactcctgctcagggacctggaccagttgttcctgagctcagattgcaggcacttcaaccgcacggagtcactccgactggcggatgagttgtccggttgggtgcagcggcaccagaggggaaggagaaagattccgcagcgagcacaagagcgtcagtcacttgacacatcgcccagcagaagtctgagtcacgggcgtagtcacctacagctgagacaaagtccctctaatcctctcgacccacagaaaggaatcctctgggcatcttgcaactacatcgcaacccaaactgtcaggtcccagcacagttggatgcaactgactgacgggaagacacacttcatgctgagtttatcttag

SEQ ID NO: 177769 - DNA, 2103 bp, Artificial Sequence
  Description of Artificial Sequence: Synthetic coding sequence
atggccgagctgatgctgctgagcgagatcgccgaccccacccggttttttaccgacaaccttttgtccccggaagattgggactctacactttactcaggcctggatgaggtcgccgaagagcaaacacagcttttcaggtgtcccgaacaggatgtgccattcgacggtagttctcttgacgtcggcatggatgtctctccctctgaacccccgtgggaactcctgcctatttttcccgatttgcaagtcaaatccgagccctcctctccgtgttcctcaagctctctgagttcagagtccagtcgcctctccactgagccttccagtgaggctctaggcgtaggagaagtgttacacgtgaaaacagagtctctggctccacccttgtgcctgctgggcgacgacccaacctcttcattcgagacggtccaaattaatgtgattcctacttccgacgattcatcggacgtgcagacaaagatcgagcctgtaagtccatgctctagtgtcaatagcgaggcatcacttctgtctgcagactccagcagtcaggctttcatcggggaggaggttctggaagtcaagacagagtccctctccccttccggctgcctgctgtgggacgtgccagcccctagcctgggcgccgtccaaatctcaatggggccctccttggatggttcttccggaaaggcactgcccaccaggaaaccaccattacaacccaaaccggttgtgttgacaaccgtccctatgccctccagagcagtcccaccctctaccaccgtccttctccagtctcttgtgcagcctccgccagtttctcccgtcgttcttatccagggtgccatccgagtccagcctgaggggcccgcgcctagcctcccacggcccgagcgaaagtctatcgttcccgctccaatgcctggaaactcatgcccacccgaggtcgacgcaaagctccttaagcgacagcagcgcatgatcaagaaccgcgaatctgcttgccagagccgccggaaaaagaaggaatatctccaggggctggaggcccggctccaggcagtgctggccgacaatcaacagttaaggcgcgaaaacgccgcgctgcggcggcggctggaggccctactcgctgaaaatagcgaattgaagctcgggtctggtaaccgcaaggtcgtctgcatcatggtgttcctcctctttatcgcctttaatttcggcccggtgtccatttcagagccccctagtgcccctatcagtccacgcatgaataagggggagccccaaccaagacgccaccttctcggtttctctgagcaagagcccgtacagggagttgagccactgcaggggtcttctcaagggccgaaggagccacagccttcacccacggatcagccttcattttcaaacctgacggcctttcccggcggggcaaaagaactgttgttacgcgatctggatcaattgttcctctcctctgattgtcggcacttcaatcgcactgaaagccttaggctcgccgatgagctgagcggctgggtgcaacggcaccaacgtgggcgcaggaagatcccccagcgcgcccaggaacgccagaagtcacagcctagaaagaaaagtcctcccgttaaagccgtccccattcagccaccaggtcctccagagcgggactctgtcggacagctccagctctacagacatccagatcggtcccagcccgcctttctggacgccatagatagaagagaggatacgttttacgtagtctcgtttcgccgcgatcacctgctcttgccagccatatcgcataacaagacttcccggccaaaaatgtctctggtgatgccagcaatggcgccgaatgaaaccctatcggggcgcggggcaccgggggactacgaagaaatgatgcagattgaatgcgaagtgatggacaccagggtgatccacatcaaaactagcacagttcccccctccctccggaaacaaccttcgccaacccctgggaacgcaacgggtggccctctgcctgtgtctgcagccagccaggctcaccaggcctcccatcagccactttatttgaaccatccttag

SEQ ID NO: 177770 - DNA, 429 bp, Artificial Sequence
  Description of Artificial Sequence: Synthetic coding sequence
tgacagcccagccccaccgaccagcccagcttcagcaacctgaccgcattccctgggggagcaaaggagctgttactgcgggacttagatcaattgtttcttagcagtgactgtaggcacttcaaccgcaccgagagtctgcgactggccgacgaactaagcggatgggtccaacgacatcagagaggacggcgcaaaatcccccaacgagctcaggaacgccagagcctcgatacatcaccctccagatcacttagccacgggcgaagccaccttcagctccgccagtctcctagtaatcccttggacccccagaaaggcatcctgtgggccagttgcaattacattgcaacccagaccgtgagatcccagcacagttggatgcagctaactgacggcaaaactcactttatgttatcgctctcatag

SEQ ID NO: 177771 - DNA, 669 bp, Artificial Sequence
  Description of Artificial Sequence: Synthetic coding sequence
atggccgagctgatgctgctgagcgagatcgccgaccccacccggtttttcacagacaatctcctctctcctgaggactggggcctgcagaattcaaccctgtatagcggcctcgatgaggtggcagaggaacaaactcagctttttagatgtcccgaacaggacgtgccctttgatggttcttcgctggatgtaggaatggatgtttccccgaccgaccaaccgtctttctctaacttgacggccttccccggtggcgcaaaggagctcctgctgcgcgacctagatcagctttttttgagcagtgattgtagacacttcaaccggactgaaagcctgaggctcgcagacgaactgtcggggtgggttcagcgccatcagcgtggtaggcgtaaaatcccccagcgggcgcaggaacggcagaaatcgcagccaaggaagaagtccccgcctgtgaaggcagtcccaatacagcccccaggacccccggagcgggactccgtcgggcagcttcaactataccggcatcctgatagaagccagcccgcatttctggacgccattgacaggcgagaagatacattctatgtcgtctcattcaggagaacaacatgctgcagccaaccgagcgctacaactaggccccctggtccccgctgcccttggtag

SEQ ID NO: 177772 - DNA, 669 bp, Artificial Sequence
  Description of Artificial Sequence: Synthetic coding sequence
atggccgagctgatgctgctgagcgagatcgccgaccccacccggttttttaccgacaacctccttagccctgaagattggggcctgcagaactccactctgtacagtggcttagatgaagtggcggaagagcaaacacagctattcaggtgccccgaacaggacgtgccattcgacggtagtagtctcgacgtgggaatggatgtatcccccacagaccagccaagtttttcgaatttaaccgccttcccggggggcgccaaggaattgctactccgcgatttggatcagctctttttgtccagcgattgtaggcactttaatcgaacagagagtctgagactggctgacgagctcagcgggtgggtccagcgtcatcaacgtggccgacgcaagatccctcagagagctcaagagcgccagaaatcccaaccgagaaagaaatcccctccagtgaaagcagtacctattcagccaccaggccccccggagagggattctgtcggtcagctccagctttaccgccacccagatcgatcacagcctgcctttcttgatgcaattgaccgaagggaggatactttctatgtggtgtccttcagaagaaccacctgctgctcgcagccctctgcaactactcgacccccgggacctcgatgtccttggtag

SEQ ID NO: 177773 - DNA, 669 bp, Artificial Sequence
  Description of Artificial Sequence: Synthetic coding sequence
atggccgagctgatgctgctgagcgagatcgccgaccccacccggttctttacagacaatctcctgagcccggaggattgggggctccagaacagtactctgtatagcggcttagacgaggtcgcagaggaacagacccaattattccggtgtccggagcaggacgtccccttcgacggctcaagtctcgacgtcggcatggatgtgagccctaccgaccagccaagcttttctaatcttactgctttccctgggggcgccaaggaactccttttacgagatctcgaccaactgtttctctcatctgattgtagacattttaatagaactgaatcattaagactggccgatgagctgtctggctgggtgcagcgccatcagagagggagaagaaaaatccctcaacgggcacaggagagacagaaatcccaacctcggaagaagtcccctcccgtcaaagcagtgccgattcaacccccagggcctccagagcgcgactctgttggccagctacaactttataggcacccggacagatcacagcccgctttcttggatgccatcgacaggcgggaagatacgttttatgtcgtcagctttaggagaacaacgtgctgtagtcagccttcggccactacccgccctccggggcctaggtgtccatggtag

SEQ ID NO: 177774 - DNA, 924 bp, Artificial Sequence
  Description of Artificial Sequence: Synthetic coding sequence
atgggcgacgaccggcccttcgtgtgcaacgcccccggctgcggccaacgcttcaccaatgaggaccacttagccgttcataagcacaagcacgagatgacgttgaagttcggccccgctcggacagactccgtaattatcgccgaccagacaccgactcccacaagattcctgaagaactgcgaggaagtggggctctttaatgagctggcctcttcattcgaacatgagttcaaaaaagctgccgacgaggacgagaaaaaggccgccgcaggcccgctggacatgagcctgccttccacacccgatattaaaatcaaggaggaagagccagtcgaggtcgacagctcgccgcccgacagtcccgcctctagcccttgttctccgcccctgaaagaaaagtcaccagcccagcccacccctagcactgggggacggcggcggcgcacggttgacgaggacccagacgagcggcggcaaagatttcttgagcggaatcgcgcagcagcttcccggtgtaggcagaagcggaagctttgggtgtccagcttggagaagaaggccgaagagcttaccagccagaatattcagctcagtaacgaggtgaccttgctgcggaacgaggtcgcccagctcaagcagttgcttttggcacacaaagactgtccagtcacagccctgcagaaaaaaacgcagggatacctggaaagcccaaaggaatccagcgaaccaactgggtcgcctgcccctgtgatccagcactctagcgcaacggcaccgtccaatgggttgtcagtccggagtgctgcagaggccgttgccacctctgttcttacacagatggcttcgcagagaaccgaactgtccatgccaatccagtcccacgtaatcatgacaccacagagccagtccgctggaagatag

SEQ ID NO: 177775 - DNA, 1485 bp, Artificial Sequence
  Description of Artificial Sequence: Synthetic coding sequence
atgggcgacgaccggcccttcgtgtgcaacgcccccggctgcggccagaggtttaccaacgaggatcacttagcagtccataaacacaagcatgaaatgactttaaaattcgggccagcccggacagattctgtaatcatcgccgatcagacacccacgcctacaagattcttgaagaactgcgaagaggtgggtttgttcaacgagttagcctcatccttcgaacatgaattcaagaaagcggccgacgaggatgaaaagaaggctcggtcaaggaccgtagctaaaaagctcgtggccgctgcaggcccactcgacatgagcctgcccagcacgcccgatattaaaattaaagaagaggagccggtcgaggttgactccagccccccggatagcccagcgagtagcccatgctcacccccactgaaggagaaagaggtgaccccaaagcccgtcctgattagcacccctacgcctaccatcgtccgccctggatccctgccattacatctgggatatgacccgcttcatcccacgcttccatctccaaccagcgttatcacacaggcaccaccttccaaccgccagatgggcagccccacaggaagtctgccgctggtgatgcatctggctaacggccagacaatgccagtgctcccggggccccccgttcaaatgccgtctgtcatctcccttgcaagacccgtgagcatggtgcccaatattcccggcatccccggacccccagtgaacagttccggatccataagcccaagcggtcaccctatccctagcgaggcaaagatgaggctgaaggctacccttactcaccaggtaagctcaattaatggaggatgcggtatggtggtggggaccgcatctactatggtgactgcgcgacctgagcaaagtcaaatcctaattcagcaccccgacgcccctagcccggcccagccccaagtctctcccgctcagccaacaccaagcacgggcggccggagaaggaggactgttgatgaagaccctgacgagcgacggcagagattccttgagcggaaccgcgctgctgcttctcggtgcaggcaaaagcgcaaactctgggtgtcatcactggaaaaaaaagctgaggagttaacctcccaaaacattcagctctcaaacgaggtgacgttactcaggaatgaggtagcccagcttaaacagctcctgcttgcccacaaggactgtcccgttactgctctgcaaaagaagacacaggggtacttggagtccccaaaagaatcaagcgagccaactggctctcctgcccctgtgattcagcactcctcagcaaccgctcctagtaacggactgagtgtgagaagcgcggccgaagcggtcgccacgtcagttctgacccagatggcctcccaaaggactgagctgtcaatgccaattcagagccatgtgatcatgactcctcaatcacagtcggctggcaggtag

SEQ ID NO: 177776 - DNA, 1389 bp, Artificial Sequence
  Description of Artificial Sequence: Synthetic coding sequence
atgggcgacgaccggcccttcgtgtgcaacgcccccggctgcggccagaggtttactaatgaggaccacctggcagtgcacaaacacaagcatgaaatgacactgaagtttggaccagctagaacggatagcgttataattgccgaccagacacccacacctacacgcttcctcaagaattgtgaggaggtcgggctattcaatgagctcgcttcttctttcgaacacgagtttaaaaaagcagctgacgaggacgaaaaaaaagcggctgcaggccccctggatatgtctctgccatcaacacctgacattaagattaaggaagaggagcccgtcgaggaggtgactccgaaaccagtccttatctctactcccacaccaaccatcgttcgcccaggcagcctgcccctgcatctaggttatgacccgttacacccaaccttgcctagccctacctcagttataacgcaggccccgccgagtaaccgtcagatgggatctcccactggctccctcccactggtgatgcatctggccaatggacagaccatgcccgtgctgccagggccacccgtgcaaatgccatctgtaatcagcttggctagacccgtctccatggtccccaatattcctggcatccctggccctccggtgaatagctccggctcaatatcccccagcggtcaccctattccctccgaggctaagatgcgactgaaagctactttgactcatcaagtcagctctataaacggggggtgtggtatggtggtggggacagcctcaaccatggtcactgctcgaccagaacagtcccagatcctgatccagcaccctgatgcaccgtcccccgcccagccacaggtgtcgccagcccaaccaaccccctccaccggtggcaggaggcgccgcaccgtcgatgaggaccctgacgaaagaaggcagcgttttctggagaggaatagggccgctgcgtcccgatgtagacagaagcgtaaattgtgggtttcatccctcgaaaaaaaggccgaagagctcacaagccagaatattcagctctctaatgaagtcacgctgcttcggaatgaggtggcccagttgaagcagttgttgctggcccataaagactgccctgtcacggcccttcaaaaaaagacacagggctaccttgaaagcccaaaagagagttccgagccaactgggagccctgctccagttatccagcacagctcagccaccgccccgagcaacggactgtccgtgcgatccgcggctgaagctgtggctacgagcgtgctgacccagatggcttctcaacgtactgagctctccatgcccatccagtcgcatgtgatcatgaccccgcaaagccagagcgcgggacggtag

SEQ ID NO: 177777 - DNA, 1452 bp, Artificial Sequence
  Description of Artificial Sequence: Synthetic coding sequence
atgggcgacgaccggcccttcgtgtgcaacgcccccggctgcggccagcggtttactaacgaagaccacctcgcggtacacaagcataagcacgagatgacacttaaattcggaccagcgcgcacagacagtgtgattattgctgaccagacaccgactcccaccagattcttgaaaaattgtgaagaagtgggcctgttcaatgagctagcctcctctttcgaacatgagttcaaaaaggccgccgatgaagacgagaaaaaagctgcagccggccctctcgatatgtccttaccctctactcccgatattaaaatcaaggaggaggagcctgtggaggtagacagtagccctccagacagtcccgccagcagcccatgctctccccctttgaaagaaaaagaggtgaccccaaagccagttttaatcagcacccctacacccacgattgtgcgacccggctccttgcccctgcatctgggttatgaccctctgcatcccacactgcccagccccacgagcgtaatcactcaagcaccaccctctaatcgccagatgggctcacctaccggatccctccccctggtcatgcacctggccaatggccagactatgccagtccttcccggtcccccagtacaaatgccgtcagtgatatcccttgcgcgccccgtaagcatggtgccgaacatcccaggaatccctggaccccctgtaaattcatcaggatctatcagcccaagcgggcatccaatcccctcagaggcaaaaatgcgacttaaggccacactcacacatcaggtgtcttcgatcaacggcgggtgtggaatggtggtggggaccgcaagcactatggtcaccgctagacctgagcagagccagatcttgatccagcaccctgacgctcccagtcccgcacagccacaagtgagtccggctcagccaactcctagcacagggggtcgaagaaggcgaacagtggatgaggacccagatgagcgtcggcagcgcttcctggagcggaacagagccgccgcatcaaggtgccgccagaaaagaaagctatgggtgtcaagccttgaaaagaaggccgaggagctcacaagccagaacatacaactgagtaacgaggtaacgctgctgcgcaacgaggtcgcacagttgaagcagttattgctggcgcataaagattgccctgttacagcccttcagaaaaagacccaaggttaccttgagtctcccaaagagtcgtctgaacccactgggtcccccgcaccggtgattcagcacagctcagctactgccccctccaacggcttgagcgtgcggagcgcagccgaagctgtggccacatcagttctcactcagatggctagccagcggaccgagctgtcaatgcccattcagagccacgtaattatgaccccccaatcccaaagcgctggcaggtag

SEQ ID NO: 177778 - DNA, 1452 bp, Artificial Sequence
  Description of Artificial Sequence: Synthetic coding sequence
atgggcgacgaccggcccttcgtgtgcaacgcccccggctgcggccagcgatttaccaacgaagatcatctcgccgtccataagcataagcacgagatgacactcaaattcggtcccgcgcgtacagactctgtcattatcgccgaccagactcctacccctacccgcttcttgaagaattgcgaggaggtggggctattcaatgagctcgcgagctcatttgagcacgagtttaagaaggctgcagacgaggacgagaagaaagccgcagccggccccctcgacatgtctctcccatcgacgcccgacatcaagattaaagaggaggaaccagtcgaggtggactccagtccacctgatagtccagcttctagcccctgttctcctcctctgaaagaaaaggaggtgactcccaagcctgtgctgatctcgacgcccacgccgacaattgttagaccaggctccctgcctctacatctcggatatgaccccctgcacccaacactgcctagccctacctcggtgatcacccaggctccacccagtaatcggcaaatgggatcacctacaggatccctgccacttgtcatgcatctggcaaacggtcagactatgccggtgctgccaggaccgcctgtgcagatgcccagtgtgataagcctcgctcgaccagtttctatggttcccaacatacccgggatccctggtcctcccgtgaactcctctggctccatatctcctagcggccacccgatccccagtgaagcgaaaatgaggttaaaagccaccctcactcaccaggtcagcagtatcaacggaggctgtggcatggtagtaggcaccgccagtaccatggtgacagctagaccagaacagtcccagatcctgatacaacacccagacgccccatcccctgcccagccgcaagtatctccagcgcagccaaccccttccactggcggacggagaaggcgaactgtggacgaagatccagatgagaggaggcagagatttttggaacggaatagagccgccgcgtcaagatgtaggcagaagcgtaagctgtgggtcagtagcctggagaaaaaagccgaagaactgacgtcgcaaaacatccaattgtctaatgaggtgacactgctacgtaatgaagtggcacaattgaagcagctactgttagcgcacaaagactgccctgtcactgccctgcagaagaagacacagggctacttagaaagcccaaaagagtcatctgagcccaccgggagccctgcacccgtgattcagcatagcagcgcaaccgctcctagtaatggcctgtccgttcggtccgccgctgaggccgtggccacctcggtcctgactcaaatggccagccagagaaccgagctttccatgcctatccagtcccacgtgatcatgacaccgcaaagccagagtgccggccgatag

SEQ ID NO: 177779 - DNA, 1485 bp, Artificial Sequence
  Description of Artificial Sequence: Synthetic coding sequence
atgggcgacgaccggcccttcgtgtgcaacgcccccggctgcggccaacggtttactaacgaggaccacctggctgtgcataaacataagcacgagatgacgctgaaattcggaccagctcgcactgacagcgtcataatcgcagatcagacgccaactccgactcgtttcctgaaaaactgcgaggaggtgggcctgtttaacgagctggcttctagctttgaacacgagtttaaaaaagccgccgacgaagacgagaagaaggccagatcccgaaccgtggccaagaagctcgtggccgccgccggcccactggacatgtccctgcccagtacacccgatatcaagatcaaggaggaggagcccgtggaggtggacagcagtcccccagactctcctgctagcagcccatgcagtccccctcttaaagagaaagaggtcacaccgaagccagtactcatttctacccccactcccaccatcgtgcggcctggcagcttgcccctgcaccttggctacgaccccctgcatcctacactcccaagtccaacttccgttatcacacaggcaccaccatcgaacagacagatgggctcaccaacagggagcctgcctctcgtcatgcatcttgctaatgggcagacaatgcctgtactgcccggaccaccagttcagatgcccagcgtaatttcgctggcccggccggtgtcaatggtacccaacatccctggaattcctggccctcctgtgaacagctctggatccatcagcccttcggggcaccccatcccctcagaagcgaaaatgcggctaaaggcaacactcactcatcaggtgtcttctattaatggaggctgtggcatggtggtcgggaccgcaagcacaatggtcacagcaaggcccgaacagagtcagattcttattcagcatccagacgccccgagtcccgctcagcctcaggtatccccagctcagcccaccccaagcactgggggccggcggaggcgcaccgtagatgaggaccccgatgaacgacgccagcgcttcctggagcggaatagggccgcagccagtcgctgccgtcagaagaggaagctctgggtgagttctctcgaaaagaaggctgaggagcttacttcccagaacatccaactgtcaaatgaagtaaccctgctccggaacgaagttgcacagttgaagcagttgctgttggcccataaagactgtcctgtgacggcactccagaaaaagacacagggctatctcgaaagtcccaaggagagttcagagcccacaggctccccagcgcctgtcatccaacactccagtgcaaccgctccaagcaacgggctgtctgttaggagcgccgcagaagccgtcgccacatctgtgttaacgcagatggcatctcaacgtaccgagctctcgatgcccatccagtcccacgtgattatgacgcctcaaagccagtctgccggacgctag

SEQ ID NO: 177780 - DNA, 354 bp, Artificial Sequence
  Description of Artificial Sequence: Synthetic coding sequence
atgggcgacgaccggcccttcgtgtgcaacgcccccggctgcggccagaggtttacgaatgaggatcacctcgctgtgcacaagcataaacacgaaatgaccctcaagttcggcccggccaggactgatagtgtcatcatagccgatcaaacaccaactccgacacgcttcctgaagaactgtgaagaggtgggccttttcaatgagctggcatcctccttcgaacatgagtttaaaaaggccgccgacgaggacgaaaaaaaagctaggtcccggaccgtagccaaaaagctagtggtctttaggccgcgcctcttcctcttgtgtttcggaataatcttcctcatagggtag

SEQ ID NO: 177781 - DNA, 354 bp, Artificial Sequence
  Description of Artificial Sequence: Synthetic coding sequence
atgggcgacgaccggcccttcgtgtgcaacgcccccggctgcggccaacgcttcactaatgaggaccacttagcagttcacaaacacaaacacgaaatgaccctcaagtttggcccggctaggacagacagcgtcatcatcgccgaccagacccctacccccactcgctttcttaaaaactgtgaagaggtggggttatttaatgagttggccagcagcttcgaacacgagtttaaaaaagctgcagatgaagatgagaagaaagcaagatctcggacagtagctaagaagctggtggtcttcagaccaagattgttcctcctgtgttttggaatcatattcctcattggatag

SEQ ID NO: 177782 - DNA, 3813 bp, Artificial Sequence
  Description of Artificial Sequence: Synthetic coding sequence
atggacagcctggaggagccccagaagaaggtgttcaaggcccggaagacaatgcgcgtgagtgataggcagcagcttgaagcggtctacaaggtgaaggaggagcttctcaagacagatgtaaaactccttaatgggaatcacgaaaacggagacctggatcccacatcaccactggaaaacatggattatattaaagacaaggaagaagtgaatggtatcgaggaaatctgttttgatcccgagggcagcaaggctgagtggaaagagaccccatgtatcctctccgttaacgtaaagaacaaacaggatgacgacctgaactgcgaacccctgtctccccacaatatcacaccagaaccagtttctaaactgcctgcagagccagtttctggcgacccagctccaggcgacttggatgccggcgacccagctagcggcgttctggccagcggtgacagcacaagtggcgacccaacaagttctgaacccagctcttccgatgcagctagcggcgatgcaacttccggagacgctccaagcggagacgtgagtcctggcgacgccactagtggggacgcaacagcggacgatctttctagcggagaccccacttcctccgatccaatccccggggaaccagtgcccgtcgagcccatttctggagattgcgcagcagacgacattgcgtcatctgagattacctctgtggatcttgcatccggagctcctgcaagcacagatcctgccagcgatgacctagcctccggtgatctcagctctagtgagctggcatccgacgatctggcaaccggagagctggccagtgacgagctgacatcagaatccacttttgatagaacgtttgaacctaagtccgttcccgtttgtgaaccagtgcccgagatcgataacatcgagccctcctcgaataaagatgatgatttcctggagaagaatggtgcggacgaaaagctagaacagatccagtccaaagacagcctggatgagaagaacaaggctgataacaatattgatgcaaacgaagaaacgttagagacggatgacaccactatctgttctgacagaccgccggaaaatgaaaagaaggtcgaggaggatatcatcaccgagctcgccctgggggaagacgctatctctagttctatggaaatagaccagggggaaaagaacgaagatgagacatctgccgatctggtggaaaccattaatgaaaacgtgattgaagataataagtccgaaaacatcctggagaacacagattccatggaaaccgacgagatcattccgatcctggaaaaactcgctccttcagaagacgaattaacttgcttttcgaaaacctccctgcttcctatcgacgagactaacccagatttggaggaaaaaatggagtcttccttcgggtctccatctaaacaggagagctctgagtctctgccaaaagaggctttcctggtactatccgatgaagaagacatcagcggggaaaaagatgagagtgaagtgatctcacaaaatgagacctgcagtcctgctgaggttgagagtaatgaaaaagataataagcctgaggaggaagaacaggtcatccacgaggatgatgaaaggccctccgaaaagaatgaatttagccgtaggaaaaggtcaaaatctgaagacatggataacgttcagagcaagcggagacggtatatggaagaggaatacgaagctgaattccaggtgaaaatcacagccaagggtgatattaaccagaaactgcagaaggttatccagtggttgctggaggagaaactctgtgctctgcaatgtgcagtcttcgataaaacacttgctgagctgaagactcgggtcgagaagattgaatgtaataagcgccataaaacagtgctcaccgaacttcaagccaagatcgctcgcctgaccaagaggtttgaggcagctaaggaggacctgaagaagcgccacgagcacccaccaaacccccccgtatcccccggcaaaaccgtaaatgacgtgaacagcaataataacatgtcttacaggaacgccggcactgttagacagatgctggaatccaagcggaatgtctccgagtctgcccccccaagttttcagacccctgtaaacactgtgtctagtaccaacctggtcactccgccagcagtggttagttcccagcccaagctccagaccccagtcacatccggttctctgacagctacatcggtccttcctgccccgaatacagccactgtagtggctactacccaggtgccatctgggaatccccaacctacaatctctcttcaacccctccccgtgatccttcacgtgcccgtagccgtgtcgtcacagccacaattgctccagtcccatcccggtactcttgttaccaatcagccctccggcaacgtggagttcatctctgtgcaatctccccccactgtgagtggtctaacaaaaaaccctgtctctctgccgtccctaccaaatcccaccaaacctaataatgtcccatccgttccttcccctagcatccagagaaatccgaccgcaagcgctgctcctttgggtacaactctggctgtgcaggcagttcctaccgctcacagcattgtgcaggcaactcgtacatctttacctaccgtgggtccgagcggcttatactctccttcgacaaaccggggacctattcagatgaagattccaatctcagctttctcaacatcttcagcagcggagcaaaacagcaatactaccccccgaatcgagaatcaaactaataagacaatcgatgcatcagtcagcaagaaggcggccgattctaccagccagtgcggaaaagccactggttccgattcctcgggggtgatagaccttaccatggatgatgaagaaagcggcgcatcacaggatcccaagaagctgaatcacaccccagtgagcactatgagctcatctcagcccgtgagtagacctcttcagccaatccagcctgcaccacctctgcagcctagcggggtaccaaccagtggacctagtcagacaacgatccacctgctgcctaccgctcctacaacagtgaacgtgactcataggccggtgacgcaggtgaccacacgtctgcccgtgcctcgggctcccgcgaaccatcaagtggtgtacacaaccttgccggccccaccggcccaggcacctctccggggcaccgtgatgcaggctccagcagtgagacaagtgaatcctcagaatagcgtgactgttcgcgtcccccagaccaccacctatgtagtgaacaatggcctaaccctaggtagcacgggcccgcagctcacggtccatcatcggccaccccaggtacacaccgagccaccccggccagtacacccggcaccactgcccgaggcaccacaaccccagcgactgccgcctgaggccgcttccacatcccttccccagaaaccacacttaaaactggctcgggttcagagtcagaacgggatcgtcctgagttggtccgtgctggaggtggacaggagctgtgccactgtcgattcttatcatctctacgcctatcacgaggaaccgtctgccacggttccgtctcagtggaagaagatcggtgaggtgaaggccttacccctccctatggcatgcacgcttacacagttcgtgagtgggtccaagtactattttgccgtcagggccaaggatatttatgggcgtttcggccctttttgtgaccctcagagcaccgacgtcatcagcagtacccaatcctcttag

SEQ ID NO: 177783 - DNA, 1548 bp, Artificial Sequence
  Description of Artificial Sequence: Synthetic coding sequence
atggacagcctggaggagccccagaagaaggtgttcaaggcccggaaaacaatgagagtgagcgacagacagcagctggaagccgtttacaaggttaaagaggagcttctcaagactgatgtgaagcttctgaatggaaaccatgagaacggcgacttagacccgactagtcctctggagaacatggattacattaaggacaaagaggaggtcaacgggatcgaagagatatgttttgatcccgagggctcaaaagccgagtggaaggagactccgtgtatccttagtgtcaatgttaagaacaaacaggacgacgacctgaactgtgaacccctctcgccccataacatcacacccgagcctgtgtccaagctgccggcggaaccagtgagtggggatccagcaccaggagatctcgatgccggagaccccgcctcaggcgtcctagcatccggtgactctactagtggagatcccacaagttctgaacccagctcttcagatgccgcgtcgggggatgctacaagtggagacgccccttctggtgacgtcagtcccggggacgccacatccggcgatgctacagctgatgatctaagttctggagacccgacctcatccgaccccattcccggcgagcccgtccctgtagagccaatcagtggtgactgcgccgccgatgacattgctagcagcgagatcacatcagtagatctagcttccggcgctccggcttcaacagatccagctagcgacgatttagcctccggtgacctttcctcctccgaactcgcctctgatgacctggcaacgggtgagctggcaagcgacgagctgacttccgaatcgaccttcgacaggacatttgagccgaagtccgtgccagtttgcgagcccgtgcccgaaatcgacaacatcgagccaagctctaataaagatgacgattttctcgagaagaacggcgccgacgagaagttggagcagatccagtccaaggacagccttgacgagaagaataaagccgacaacaacatcgacgccaacgaagaaacactggaaaccgacgacacaaccatctgtagcgaccgccctcctgagaacgagaaaaaggtggaggaggacatcattaccgagctcgctttgggagaggacgctatcagcagctccatggaaattgaccaaggggagaagaacgaggatgaaacatccgcggacctggtcgaaactatcaacgagaatgttatagaggataacaagtccgagaacatcctcgaaaatactgacagtatggagacagacgagattattcccattcttgaaaaactggctccgagtgaagacgagctgacttgctttagcaagacatctctcctaccaatagacgaaaccaaccctgaccttgaggagaaaatggaatcatcatttggctctccaagtaaacaggaaagcagtgaatccctgccaaaggaggcgttcttggtgctgagcgacgaagaggacatttccggcgagaaagacgagtctgaagtgatatctcagaatgagtag

SEQ ID NO: 177784 - DNA, 378 bp, Artificial Sequence
  Description of Artificial Sequence: Synthetic coding sequence
atggacagcctggaggagccccagaagaaggtgttcaaggcccggaagacaatgagggtctccgacagacagcagctcgaggcagtttacaaggtgaaagaggagttgctgaagactgatgtgaagctgctgaatggaaatcacgaaaatggggacctggaccccaccagcccattggaaaacatggattatatcaaagacaaagaagaggtcaacggaattgaagagatttgtttcgatcccgaagggtccaaagccgagtggaaggagactccctgtatattgagtgtgaatgttaaaaacaagcaagacgatgatctcaactgcgaacccctatccccacataacattactcccgagccggtgagtaaattgtag

SEQ ID NO: 177785 - DNA, 459 bp, Artificial Sequence
  Description of Artificial Sequence: Synthetic coding sequence
atggacagcctggaggagccccagaagaaggtgttcaaggcccggaaaaccatgcgagtgagcgaccgtcaacagttagaagcagtttataaagtgaaagaggaactcttgaaaacagacgtgaagcttttgaatggaaatcacgagaatggcgatctggatcctacaagtccactggagaacatggattacattaaggacaaggaggaagttaacggcattgaggagatctgctttgaccccgaggggagtaaggctgagtggaaggaaaccccgtgcatcctcagcgtcaacgtgaaaaataaacaggatgatgacctgaactgcgagcctctctcgccccacaatattacccctgaacccgtgtcgaaactacccgccgaacccgtgtcaggggaccccgctcctggggacctggacgcgggcgacccggctagtggcgtgctagcatctggctag

SEQ ID NO: 177786 - DNA, 312 bp, Artificial Sequence
  Description of Artificial Sequence: Synthetic coding sequence
atggacagcctggaggagccccagaagaaggtgttcaaggcccggaagacaatgagagttagcgacaggcagcagctggaggcagtgtataaagtcaaggaagaacttttaaagacagatgttaagctgctaaatgggaaccacgagaatggagatctagatccgacaagccccctggaaaacatggattatatcaaagacaaagaggaagtcaacgggattgaagagatttgctttgatcccgaaggcagtaaggcagaatggaaggagaccccatgcattctcagcgtcaatgtcaagaataagcagtag

SEQ ID NO: 177787 - DNA, 270 bp, Artificial Sequence
  Description of Artificial Sequence: Synthetic coding sequence
atggacagcctggaggagccccagaagaaggtgttcaaggcccggaaaacgatgcgagtgtctgatcgacagcagctggaggctgtgtacaaggtcaaagaggaactgctgaaaactgacgtgaagctcctgaatggcaatcatgagaacggagatcttgatccgacgagtcctctagagaacatggactacataaaggataaagaggaggtcaacggcatcgaagagatctgcttcgatccagaaggatctaaagccgagtggaagtag

SEQ ID NO: 177788 - DNA, 534 bp, Artificial Sequence
  Description of Artificial Sequence: Synthetic coding sequence
atggacagcctggaggagccccagaagaaggtgttcaaggcccggaagacgatgagggtctccgaccggcagcagctggaagccgtctataaggtgaaggaggagctcctgaaaacagatgtcaaactcctcaacggtaatcacgagaatggggatctcgatcccacctcccccctggaaaatatggactatatcaaagataaagaggaagttaatgggatcgaagaaatatgtttcgatcccgaggggtccaaggccgagtggaaggagaccccttgcatccttagtgtgaatgtaaagaacaaacaggacgacgatctgaactgtgagcccttgtccccgcacaacattacacccgaaccagtctctaaactgccagcagaacccgtgtctggggacccggctcctggcgatctggacgctggcgaccctgctagcggagtgctggcgagcggggactccaccagtggggatcccacctcctcagaaccatcttctagcgacgcagctagcggcgacgctacttccgggtag

SEQ ID NO: 177789 - DNA, 3813 bp, Artificial Sequence
  Description of Artificial Sequence: Synthetic coding sequence
atggacagcctggaggagccccagaagaaggtgttcaaggcccggaagaccatgcgggtctccgacagacaacagcttgaagctgtgtacaaagttaaagaagagctcttgaaaacggacgtgaaattgttaaacgggaaccatgaaaacggggatcttgaccccacatcccccctcgagaatatggactatataaaagataaagaggaagtcaacgggattgaagaaatttgctttgatcctgagggaagcaaggccgagtggaaagaaacgccatgcattctgtctgtgaatgtaaaaaataagcaggatgacgatcttaactgtgaacccctgtctcctcacaatataacaccagagcctgtttccaagttgcctgctgaaccagtgtccggagaccccgccccaggggacctcgacgcaggcgaccccgctagcggagtgctggcatctggagactcgacctctggtgaccccacgagctcagaaccctcttcatccgatgccgcttcaggagacgctacctccggcgacgcccccagtggtgacgtgtcgcctggggatgctacttccggggacgccacagccgacgaccttagctcgggtgaccctacctcttccgatcctattccaggcgaacccgtccctgtagagcctatctcaggcgattgtgctgcagacgatattgccagttccgaaattacgagcgtcgatctggcctcaggcgcccccgccagcaccgaccccgccagtgacgatctagcatccggggacctcagctcaagcgaactggcaagcgatgacctagccacaggcgagctggcaagcgatgagctaactagcgagtctaccttcgataggaccttcgagcctaaatctgtgccagtgtgtgagccagtgccagaaatcgacaacattgaaccgagttccaacaaggatgacgatttcctggagaagaatggtgctgacgagaaactggaacagattcagtccaaggactctcttgacgagaaaaataaggctgacaacaacattgatgccaacgaggagacgttggagacagatgacacaacaatttgctctgaccggcctcctgaaaacgaaaagaaggtcgaggaggatatcatcacagaattggccctgggggaggatgcaatttcatcctcaatggagatagaccagggagaaaagaacgaagacgagacgagcgccgatctagtggagactattaacgagaacgttattgaagacaacaagagtgaaaacattctggaaaatacggatagcatggaaacagatgagatcatcccaattctcgaaaagctcgctccaagtgaggacgaactgacttgctttagtaaaacgagcctgcttccgattgatgaaacaaatccagatctagaagagaagatggagagctccttcgggtccccaagtaagcaggaatcctcagagagcctgccaaaagaggcttttctggtcctgagtgacgaggaagacatttcaggagagaaggatgaaagcgaggtcattagtcagaacgaaacatgtagtcctgcagaggtggagtcaaatgagaaagacaataagcccgaggaagaagagcaggtgattcacgaagacgatgaaagaccatcagaaaaaaatgaattctctagaagaaagaggtctaagagcgaagacatggacaacgtccaaagtaagcggagacgctatatggaagaggaatatgaggccgagttccaagtcaaaatcaccgcgaagggcgacatcaaccaaaagttgcaaaaggttatccagtggctgctcgaggagaagctttgtgctttgcagtgtgctgtgttcgataagacgctggcagagctcaaaacacgcgtggaaaaaattgagtgtaacaaacgtcacaaaaccgtacttacagagctgcaggcaaaaattgctaggctgacgaaaagatttgaagcggcaaaggaggaccttaagaaacggcatgaacaccctccgaatccgccagtgagccctggtaagacagtcaatgatgtgaattctaacaataacatgtcctatagaaatgccggcacagtccgccagatgctagaatcaaagagaaacgtttcggagtctgctcctccaagctttcagactcctgtcaatacggtttcctctacaaatctcgtaactcctccagccgtggtgtcttcccagcccaagctgcagacacccgttacttctggctctctaaccgcgacttcggtgctgcctgcgcccaacacagccactgtggtcgcgactactcaagtgccttcgggaaacccacagccaacgatctccctccagcccctccccgtcatccttcatgtcccagtggccgtgtcctcccagcctcaactgctgcagagccaccccgggaccctggtaactaaccagccctcagggaatgtagaattcatctcagtccagtccccgcctacagtttctggtcttactaaaaatccagtgagcctgccctctctgcccaatcctaccaaacccaacaacgtcccgagcgtaccaagtccgtctattcaacggaaccccactgcatccgccgcgccacttggtacaaccctcgccgtgcaggccgtccccaccgctcattctattgttcaggccacgagaacaagtctccccaccgtgggcccctcaggcctttactctccaagtacgaaccggggcccgatacagatgaagataccaatctcggcattctctacaagtagcgcggcggaacagaacagtaacacaacccctcggattgagaatcagacgaacaagacaattgacgcttccgtcagcaaaaaagctgcggactcgacatctcagtgtggcaaggcgactgggagtgacagcagcggcgtgattgacttaacaatggacgacgaggagagcggagcttcccaggatccaaagaaactgaaccataccccagtttcgactatgtcatcctcccagcctgtgtctaggcctctgcagcccatccagcctgccccgcccttgcagcctagcggcgtgcctaccagcggaccttctcaaaccactatccacctgctgcccacagccccaactactgtaaatgtcacccacaggcctgtgactcaagttacaacgcgcctgcctgtccccagggctccggctaaccatcaggtggtgtacaccaccttgccggctccaccggcccaggcccctctaaggggaacggttatgcaagcgccagcagtccgtcaggtcaatcctcagaactccgtgaccgtcagagtgccccaaaccactacttacgtcgtcaataatggacttaccctgggctccactggcccccagttaaccgtgcatcaccgtccgccccaggtgcacacagagccaccaaggccagtacatccagcccccctcccggaggctccacaaccccaaagactgccccccgaggcagcatctacgtctctgccacagaaaccacaccttaagctggcccgcgtccaaagccaaaatggcatcgtgctgtcatggtctgtgctcgaggtagacaggagttgcgccactgtggacagctaccacttgtacgcttaccatgaggaaccctccgcgacagtgccaagtcagtggaaaaaaatcggggaggtcaaagccctgcccttacccatggcctgtacactgactcaattcgtgtcaggcagcaagtactacttcgctgtgcgggccaaggacatttatgggcgtttcggccccttctgtgatccccagagtaccgacgtcatcagttcaacccaaagttcttag

SEQ ID NO: 177790 - DNA, 510 bp, Artificial Sequence
  Description of Artificial Sequence: Synthetic coding sequence
atggacagcctggaggagccccagaagaaggtgttcaaggcccggaaaaccatgagggtcagcgacaggcagcaattggaggccgtttacaaggtgaaggaggagctcctgaaaactgatgtgaagctgctgaacggaaatcacgaaaatggggatttagacccaacatccccactcgaaaatatggactatattaaagataaggaggaggtcaatgggatagaggagatttgctttgatcccgaaggatccaaagccgaatggaaagagaccccttgtatactgtcagtgaatgtcaaaaacaagcaggatgatgatctgaattgtgagcctctttcgccacataacattactcccgagcccgtctctaagttacccgccgaaccagtgagtggggatcctgcgcccggcgaccttgacgccggcgatccagcgtctggcgttttagcatcaggcgacagcacctcaggagacccaaccagcagcgagcccagcagctccgacgcttag

SEQ ID NO: 177791 - DNA, 99 bp, Artificial Sequence
  Description of Artificial Sequence: Synthetic coding sequence
atggacagcctggaggagccccagaagaaggtgttcaaggcccggaaaacaatgagagtaagtgataggcagcagctagaggctgtgtacaaggtgtag

SEQ ID NO: 177792 - DNA, 399 bp, Artificial Sequence
  Description of Artificial Sequence: Synthetic coding sequence
atggacagcctggaggagccccagaagaaggtgttcaaggcccggaagactatgagagtatcagaccggcagcaattggaggctgtgtacaaagtcaaagaagaactgctgaaaaccgatgttaagcttctgaacggtaaccatgaaaatggcgatcttgaccccacatctcccttagagaacatggactacatcaaagacaaggaggaagtaaacgggatagaagaaatctgcttcgacccagagggctccaaagccgaatggaaggaaaccccttgcatcctgtctgtgaatgtgaagaataagcaggacgacgacctgaactgtgaacccctatccccccacaacataactccggaacctgttagcaaactgcctgctgagcccgtttccgggtag

SEQ ID NO: 177793 - DNA, 531 bp, Artificial Sequence
  Description of Artificial Sequence: Synthetic coding sequence
atggacagcctggaggagccccagaagaaggtgttcaaggcccggaagactatgagagtatcagatcgacagcaactggaagcagtatataaggttaaggaagagctcctgaagaccgatgttaaactgctcaacgggaaccacgagaatggggacctggacccaacctcacccctggaaaatatggactacatcaaggacaaggaagaagtgaacggaatcgaagagatttgctttgatccggaagggtccaaggctgaatggaaagaaactccttgtattctttccgttaatgtaaaaaataagcaggatgatgaccttaactgtgagccactctccccccacaacatcactcccgagcctgttagcaaactgccagctgagcccgtgagcggcgaccctgcccccggggatctggacgcgggagatccagcaagtggcgtgctggcgagtggggactctacttctggagaccctacgtccagtgaaccaagtagctccgacgcagcaagtggagatgctacaagttag

SEQ ID NO: 177794 - DNA, 180 bp, Artificial Sequence
  Description of Artificial Sequence: Synthetic coding sequence
atggacagcctggaggagccccagaagaaggtgttcaaggcccggaagaccatgagagtgtccgataggcagcagttagaagccgtgtacaaagtgaaggaggaactgctgaagacagatgtgaagctactgaatggtaaccacgagaacggcgatctcgaccctacatcacccctctag

SEQ ID NO: 177795 - DNA, 3318 bp, Artificial Sequence
  Description of Artificial Sequence: Synthetic coding sequence
atggacagcctggaggagccccagaagaaggtgttcaaggcccggaaaaccatgcgcgtatccgacagacagcagctcgaggccgtatataaggtgaaggaggagttactgaagacagacgtcaaactcctcaatggcaaccatgaaaatggtgatctggaccccacaagccccctagaaaacatggattacatcaaagacaaagaggaagtgaacgggattgaagaaatttgttttgatcccgaagggagcaaggccgagtggaaggagacaccgtgtattctctcggtgaatgtgaagaataagcaggacgatgatctcaattgtgagcctctgtctccccacaacattacccctgaacccgtctcaaaattgccggccgaacccgtgagcggcgaccctgcgcccggggatcttgacgcgggcgacccagcctcaggcgtgttggcttccggcgattccaccagcggggaccctacatcaagtgaaccttccagttccgacgccgcatctggagacgcaacctctggcgatgccccttccggagatgtttcgcccggggacgcaacctcaggggacgctactgctgacgatctgtcatccggagatcccacctccagcgatccgattcctggggaacctgtaccagtggaacctatttccggcgattgtgcagcggacgatattgcctcgtctgaaataaccagcgtcgatttggctagtggtgccccagcttctactgatccagcatctgacgacctggcttcaggcgatctgtcctccagcgagttggcttctgacgacctggctacgggggagttggccagcgacgaactgactagtgagagtacgttcgacagaacctttgaacctaaaagtgtacccgtctgcgagcccgtgccagagatcgacaatatcgagccaagttcaaataaagacgacgattttctcgaaaagaacggggcagacgaaaaattggagcagatccagtcaaaagactccctagacgagaagaacaaagccgataacaatatcgacgccaatgaggagacgctggaaacagacgacaccaccatttgttccgaccggcccccggaaaatgagaaaaaagtggaggaagatattattactgagctcgctctgggggaagacgccatctcatcatctatggaaatcgaccagggtgaaaagaatgaggacgaaactagtgcagatctcgtggagacaattaatgaaaatgttatcgaagacaacaagtcagagaacattttggaaaatacagacagcatggaaactgacgagatcatacctattctggaaaagttagctcctagtgaggatgagctcacctgcttttctaagacatctcttctccctatagatgagacaaaccctgacctcgaggagaaaatggagagttccttcggctctccaagcaaacaagagagtagcgagagcctccctaaggaggcatttctggtccttagcgacgaagaggatataagcggagaaaaagacgagtctgaggtgattagccagaacgaaacctgctcacctgaagttgagtccaacgagaaggacaataagcccgaagaggaggagcaggtgattcatgaggacgacgagcgcccttcagaaaagaatgagttttcccgcaggaagcgctcaaagagcgaggacatggacaatgtccagtcaaagcgccgacggtatatggaggaggagtacgaagccgaatttcaagtgaaaatcacagcaaagggcgatatcaatcagaaattgcagaaagttatccagtggctgcttgaagaaaaactttgtgccctgcagtgcgctgtgttcgataaaaccctggctgagctgaagacaagagttgaaaaaattgaatgcaacaaacgccataaaactgtactgacggaattgcaggcaaaaatcgctaggctgaccaagaggttcgaggccgccaaggaggatctcaaaaagcgccacgaacaccctccgaatcctcccgttagtcctgggaaaactgtcaacgacgtgaatagtaacaacaacatgtcttatcggaatgccggaaccgtgcggcagatgttagagtccaagcggaatgtgagcgaaagtgccccaccctcttttcagacgccagttaatacagtcagctctactaatcttgtgacaccaccggctgtggtctcctcccaacccaagcttcagacgcccgtgacgagcggatcactgacagccacgagcgtcctgccagcacccaacaccgccactgtggtcgccaccacccaagtgccatcaggcaatccccagccaactatcagcctgcagccattgccagttatacttcacgtgcccgttgccgtgagcagccagccccaattactgcaatctcatccaggaacattggtgacaaaccagccctctgggaacgtcgagttcatttctgtgcagtctccccccacagtgtcgggactgactaaaaatccagtcagtctgccttccttgcccaaccccactaaacctaacaatgtgccctccgttcctagccctagcatccagaggaatcctaccgcttctgctgctccgctgggtactacattggccgtgcaagccgttcctactgcccattctattgtgcaggctacccgcacctcattacccaccgtcgggccgtctggactctacagtcctagtactaatcgtggtcccatacagatgaaaattccgatatctgcattttcaacttcctccgctgccgagcagaacagcaatactactccacgcatcgaaaatcagactaacaaaaccattgatgcatcagtctctaaaaaagctgccgatagcactagccagtgcggcaaagcgacaggctctgattcctcaggagtcattgacttaacaatggatgacgaagaatcaggagcgtcacaggatccaaagaagctgaatcacaccccagtgtccaccatgagttcctctcagcccgttagtcggcctctgcagccgatccagcccgctcctccgctccaacccagcggcgttccaacatccggtccttctcagaccacaattcatctgctgccaacggcacctacgactgtgaacgtcacgcatcggcctgtgacacaggtgaccacaagactgccagtgcctcgggccccagctaatcatcaggtggtttatacaactctgccagctcctcccgcccaggcccctctgaggggtacagttatgcaggcccctgcggtgaggcaggtcaacccccagaatagcaaacgtttttttctgtacatggcccccagatacatgtag

SEQ ID NO: 177796 - DNA, 3837 bp, Artificial Sequence
  Description of Artificial Sequence: Synthetic coding sequence
atgcaccaggaccagcggttccggatggacagcctggaggagccccagaagaaggttttcaaagcccgtaagaccatgcgtgtgagtgatagacaacagctagaagccgtttataaggttaaagaagagcttcttaagactgatgtgaagctcctcaatgggaaccacgaaaacggagacctggatccaacgagccctttagagaatatggactatataaaagataaggaagaggtcaatggcatcgaagaaatatgcttcgaccccgagggttccaaggctgagtggaaagagacaccctgcatcctgtccgtgaacgtgaagaacaaacaggacgatgacctgaactgtgagcccttgtctccacataacattacccccgagcccgtgtcaaagctgccagcagagcctgtgtcaggagacccagctcctggggacctggacgcgggtgatccagcctcaggtgtgcttgcatcaggcgactctaccagtggcgacccaacttcatcagagcccagcagcagcgatgcggcgtctggtgacgcaacttcgggcgacgccccatccggtgacgtgagcccaggggacgcaacaagtggcgacgcaaccgcagacgatctcagttccggtgatcccacttcttctgatcccatccccggtgagccagttcccgtcgagccaattagtggtgactgtgcagccgacgatatcgcaagctctgaaatcacgagtgtagaccttgcttccggggctcccgcatccacagatcccgccagtgatgaccttgcatcaggggacttatcttcaagtgagttggcctctgatgatctagctacaggggagctagcatctgatgagctgacgagcgaatcaaccttcgatagaacttttgagcctaagtccgtgccagtttgtgaacctgtaccagaaatcgacaacatagagccttcttcaaataaagacgatgattttctcgagaaaaacggtgccgacgagaagcttgagcaaattcagtccaaagactcccttgacgagaagaacaaggctgataacaacatcgatgccaacgaggagaccctggagacagatgacacgaccatctgtagcgacagaccacccgagaacgagaaaaaggtcgaggaagatatcatcaccgagctggctctaggcgaggacgctatttcatcatctatggagatcgaccaaggggagaaaaacgaagacgaaacatctgccgacctagtggaaaccattaatgaaaacgtgattgaagataacaagagtgaaaacattctggagaatacagattccatggaaacggatgagattatccccatattagagaaactggccccttccgaagacgaactcacttgtttcagcaagaccagtttactgcctatagatgagacaaaccccgatctcgaggagaaaatggagtctagttttggctcccccagcaaacaagaatcatccgagagcctgcccaaggaggcattcctggttttaagtgacgaagaggacatctcgggcgagaaagacgagagtgaagtgatcagtcagaatgagacttgtagtcccgcggaggtggagtcgaatgaaaaggacaacaaaccagaagaggaggagcaggtgattcatgaagacgacgaacgtccatctgaaaaaaacgaatttagccggaggaagaggagcaagtcagaagatatggataatgtccagtcaaagcgccgcaggtacatggaagaagaatatgaggctgaattccaggtgaagatcactgccaaaggcgacatcaatcagaaactgcagaaagtgatacaatggttgcttgaggagaaactgtgcgcacttcagtgtgccgtctttgacaagactctcgcagaactgaaaactcgtgtggagaaaatagaatgcaataagagacataagactgtgttaaccgagctgcaggcaaaaatcgcccgtctcacaaagcgtttcgaggctgcaaaagaagacttgaagaaaagacatgagcatccccctaacccacctgtatccccagggaaaacagtgaacgacgttaatagtaataataatatgagctaccgtaatgctggaaccgtgcggcaaatgctcgaatctaaacgaaacgtgtcagagtcggccccaccatcatttcagacaccagtgaatacggtcagctctacaaatctcgttaccccccctgccgtcgtctcgtcacaacccaaactccagacccccgtcacctccggaagcctcaccgctacatctgtgctgccagcacccaacacagctaccgtcgtggccacgactcaggtcccaagtgggaatcctcagcccaccatctccctgcagccattgcccgtcatactccacgttcccgtcgccgtctccagtcagcctcagttactccagtcacacccaggtacacttgttacaaatcagccatccgggaacgtagagttcatctctgtgcagtcccctcccacagtgagcggcttgacaaaaaatcctgtgtccttaccgagcttgccaaaccccactaaacctaataatgtcccctccgttccctcaccctcgattcagcgcaatccaaccgcctctgccgcacctctcggcactaccctggctgtgcaagcggtccccaccgctcactccattgtccaggcaacacgcacatctttaccaacagtcggcccgtctggcctctatagtccgtctaccaatcgcgggcccatccagatgaagatccctatttcggcgttttcaacctcctctgccgccgaacaaaattctaataccaccccacgaatcgagaatcagaccaataagacaatcgacgcaagcgtgtccaagaaagctgctgactccactagccagtgcggcaaagcgactggttctgactccagcggtgttatcgatctcaccatggatgacgaggagagtggcgcttcgcaagatccaaagaagctgaatcacacccctgtgtcaacaatgagtagcagccagccagtgagccgcccacttcagcctatccagcccgctccacctctacaaccttccggagtcccaaccagtggaccctcgcagactacaatccatttactcccaaccgcacccacaaccgtgaatgtcactcatcggcccgtcacccaggtgacgacaagactgcctgtgcccagagctcctgccaaccatcaagtggtctacaccacactgcccgcccctcctgcacaagcccccctacgcggtaccgtcatgcaggcgcccgcggtgcgccaggtaaacccgcaaaactcagtgaccgttcgagtgcctcagacgacaacatatgtggtgaataatggactgaccctgggctcaaccggcccccaactgactgtccaccaccgcccacctcaggtacacaccgagcccccacggcctgttcaccctgccccactgccagaagcaccacagccacagagattaccgccggaagctgcctctacctctctaccccagaaaccccacctgaagcttgcccgggtacaatcccagaacggaattgtgctgtcatggtcagtgctggaggtggacaggagctgcgcgacagtggactcctaccacttgtatgcataccacgaggagcctagtgcgacggtccctagtcagtggaaaaagatcggcgaagttaaagccctgccactaccaatggcctgtacactgactcagttcgtgagcggatccaagtactattttgcggtccgcgcaaaagacatctatggtcgctttggccctttctgtgacccccagagcacagacgtgatatcttcaactcagtccagctag

SEQ ID NO: 177797 - DNA, 510 bp, Artificial Sequence
  Description of Artificial Sequence: Synthetic coding sequence
atggacagcctggaggagccccagaagaaggtgttcaaggcccggaagactatgagggtgagtgatcgacagcaacttgaagccgtgtacaaagtgaaggaagagcttttaaagactgatgtcaagctgctgaatgggaaccatgagaatggggacttggacccaacatcacccctggagaacatggattatatcaaagataaagaagaggtgaatggtatagaggagatatgttttgacccagaaggatccaaggccgaatggaaagagaccccatgcattctctctgttaatgttaagaataagcaggacgacgacttgaattgtgagcccctgagcccccacaacattacacctgagcccgtgagcaaactaccggctgagcccgtatcaggggatccggcacccggcgacctggacgctggagatccagcatccggcgtgctggccagtggcgacagcacgagcggagaccctaccagctctgaaccctcctcttcagatgcatag

SEQ ID NO: 177798 - DNA, 1632 bp, Artificial Sequence
  Description of Artificial Sequence: Synthetic coding sequence
atggccagccccgaccggagcaagcggaagatcctgaaggccaagaaaactatgccactgtcttgtaggaaacaagtcgagatgctcaataaatctaggaatgttgaggcccttaaaactgctataggctcaaatgtgccttcggggaatcagtctttttcaccctccgttatcaccagaaccaccgaaatcaccaagtgcagcccttcagagaatggggcttccagtttggactcaaacaaaaatagtatttccgagaaatcaaaggtcttcagccagaattgcattaagccagtggaggagatcgtccacagcgagaccaagcttgagcaggtcgtgtgttcctaccagaaaccatctcgcacgaccgagtctccctctagggtgttcacagaggaggctaaggactcactgaacaccagcgagaatgacagcgaacaccagactaatgtgacgaggagtctttttgagcatgagggcgcgtgctctctaaagagctcctgctgtcccccatcagtgctgtccggtgtggtgcagatgcccgaatccacggtgacttctaccgtgggggacaagaagactgaccagatggtgttccacctggagacaaattccaattcggagagccatgataagagacaaagtgacaatatcctgtgctcagaggattccggtttcgtgcccgtcgaaaagacacctaacctcgttaacagcgtcacttctaataattgcgccgacgacatcctgaaaacggacgagtgctccagaacctccatttctaactgcgagtccgcggactccacctggcaatcgagcctggacaccaataataattctcactatcagaaaaaaaggatgttcagcgagaatgaagaaaacgtgaagaggatgaagaccagcgagcagatcaatgagaacatctgtgtgtcactggaacggcaaactgcttttctggagcaggttcgccatctgatccaacaggagatctattcaattaactatgaactttttgataaaaagctgaaggagctgaaccagaggataggaaaaaccgaatgccgtaacaagcacgagggtattgccgataagcttctggccaagatcgctaagctacagagaagaattaagactgtcctgctatttcaaaggaattgtctgaaacctaatatgcttagctccaacggtgctagtaaggtcgccaactctgaggcaatgatcctcgacaaaaacttagagagcgtgaattcccccatcgagaagtcttccgttaattatgagcccagcaacccctctgagaaagggtctaaaaagattaacctgtcatctgatcaaaataaaagcgtctctgagtcaaacaacgacgatgtaatgcttattagcgttgaaagtccaaatctaacaactccaatcactagcaatcccacagataccaggaaaattacatccggtaactcaagtaactcgcccaatgccgaggttatgaaggttcagtatccgccttggtctcatattagaaaactcctgcagacccaaaggaaacaaccccactggcacaagatgcagtcccggttcctaagccccctgtccacctgccatctctcacaaaatcaccagcaccactaccttaactag

SEQ ID NO: 177799 - DNA, 2049 bp, Artificial Sequence
  Description of Artificial Sequence: Synthetic coding sequence
atggccagccccgaccggagcaagcggaagatcctgaaggccaagaagaccatgcctttgagctgccggaagcaggttgaaatgcttaacaagtcaagaaatgttgaagccctgaagacagcaattggaagcaacgttcccagtgggaatcagagcttcagcccttcagtgattacacgaacaaccgaaatcacaaagtgttcacctagcgagaatggcgcctcctctcttgactctaacaagaatagcatcagtgagaagtcaaaagtgttcagtcagaattgtatcaaaccagtcgaggaaattgtgcactcagaaactaagctggagcaagtggtctgttcttatcagaaaccgagtcggactactgagtctccaagccgggtgtttactgaggaggctaaagatagcttgaatacaagcgagaatgactccgaacaccagaccaacgtaacacggagccttttcgagcatgagggggcatgcagcctgaaaagctcttgctgtccaccatctgtcctgagcggtgtggtgcagatgcccgaatcaactgtgacgtccaccgtcggagacaagaagactgaccagatggtgttccatctggagactaattccaatagtgaaagccatgacaaacgccagtccgacaacatcctgtgttcagaggactccggattcgtgcctgtggagaagactcctaacttagtgaactccgtgacttcaaataactgtgcagatgacatcctgaagaccgacgagtgctctagaacatcaatcagtaattgcgagtccgccgacagcacatggcagtctagtctggacacgaacaataatagccactatcagaagaagcgcatgttctcggagaacgaagaaaacgtcaaacgtatgaagacttcagaacagattaacgaaaatatctgcgtatccctagagcggcagacagctttcctcgaacaggttagacacttgatccaacaggaaatctacagtatcaactacgagctgttcgataagaagctcaaggagctcaaccaaaggatcggcaagaccgagtgtcggaataaacatgaaggtattgcagataagctccttgctaagatcgccaaattgcagagacgcattaagactgttctgctgtttcaaagaaattgcctgaagcccaacatgctttctagcaacggagctagcaaggtggcaaattcagaggccatgattctggacaagaaccttgaatccgtgaatagccctatcgagaagtcgtccgtaaactacgaaccatcaaacccttccgagaaagggagtaagaaaatcaacctaagtagtgaccaaaacaaatctgtaagcgagagcaacaatgacgacgtgatgctgatcagcgtggaaagccccaacctcaccactccaattacgagtaatcctaccgacaccagaaagattacatctggcaacagttctaattctcctaacgctgaggtaatggccgtgcagaagaagctggattctataatcgacttaactaaagagggcttgtctaattgcaatactgagtctccagtatctcccctagaatcccactccaaagccgcctccaactctaaagaaacgaccccactagctcagaatgcagtgcaggtcccggaaagctttgaacacctccctccacttccagaaccccctgctccactgcctgaattagtcgacaagaccagagataccctaccccctcagaaacctgagttgaaagtgaaacgggtgttcaggccaaatggcatcgctttgacatggaacatcactaagatcaaccccaagtgtgcccctgttgaatcctatcacctgttcctgtgccatgagaactccaacaacaagttgatttggaagaaaatcggggagataaaggcccttccactccctatggcttgcacactctcacagttcctcgcttccaatcgatactacttcacagtacagtctaaggacatcttcgggcggtacggacctttttgcgacatcaagtcaattcccggattttcagaaaacttgacctag

SEQ ID NO: 177800 - DNA, 1632 bp, Artificial Sequence
  Description of Artificial Sequence: Synthetic coding sequence
atggccagccccgaccggagcaagcggaagatcctgaaggccaagaagacaatgcctctcagttgtcggaaacaagtggagatgctcaacaaaagcaggaacgtggaggcccttaaaactgctatcgggtccaacgtgccgagcggcaaccagtccttctctccttctgtcatcaccagaacgacagaaattactaaatgttccccatccgagaacggagcgtctagtctggattccaacaagaattccataagtgagaagagtaaagtcttttctcaaaactgcatcaaacccgtggaggaaattgtccattctgagactaagttagagcaggtagtctgttcttaccaaaaaccatctcgtaccacagagtccccttccagagtgttcactgaggaggccaaagatagcctgaatacgagcgagaatgattccgaacatcagaccaatgtgactcggagcctgttcgaacacgagggggcctgctccttgaaatcctcctgctgtccacccagtgtgctgagcggtgtcgtccagatgccagagtcaacagtgacatccaccgtcggggataaaaaaactgatcagatggttttccacctggagacgaacagcaattccgaatctcatgacaagcggcaaagtgataacatcctttgtagcgaggactcaggcttcgttcccgtggagaaaacccctaatttggtgaattcggtgacttccaataattgtgcagatgacatcctcaaaacagacgaatgttcccgcacgtcaatcagcaactgcgagagtgcagactcgacatggcagtcctcactggacacaaataataatagccattaccagaaaaaaagaatgttctctgaaaatgaagaaaacgtgaagcgtatgaagacaagtgagcagatcaatgagaatatctgcgtctcgctcgagcggcagaccgccttcctcgagcaggtgcggcatcttatccagcaggagatttatagcatcaactatgaattatttgataagaagctcaaggagctgaaccagaggatcggaaaaacagagtgtcgtaacaagcacgagggcattgcagataaactgctggcaaagatcgctaagttgcagcgcagaatcaagaccgtgctgctcttccagagaaactgtctgaaaccgaacatgctgagctccaacggagcctctaaggtggccaatagcgaggcaatgatcttggacaaaaatcttgaatctgtcaactcacctatagagaaatcatcagtgaactacgagccctccaacccttctgaaaagggctcaaagaagataaacttgagctcggaccagaataagtcggtttccgagtccaataacgatgacgttatgctgattagtgtggaaagccctaaccttaccacgccaattacatcgaaccccactgacactcgcaagataaccagcggaaacagctcgaattctccgaatgcagaggttatgaaggtgcagtatccaccatggagccacatacggaaactactccagacccaacgaaagcaaccacactggcacaaaatgcagtcccgattcctctcacctctgagtacgtgccacttgtctcagaaccatcagcatcactacctgaactag

SEQ ID NO: 177801 - DNA, 2049 bp, Artificial Sequence
  Description of Artificial Sequence: Synthetic coding sequence
atggccagccccgaccggagcaagcggaagatcctgaaggccaagaagacaatgccacttagctgccggaagcaagtagaaatgttaaataagagcagaaacgttgaagccctaaagaccgccataggaagcaacgttccatcagggaatcagtccttctcaccttctgtgatcactcgaacgacagagatcacaaagtgtagcccaagtgagaatggcgcctcatccctcgattctaacaagaacagcataagtgaaaagtcgaaggtgttcagccagaactgcattaaaccagtggaagagatcgtccatagcgaaacaaaattagagcaggtggtgtgttcctaccaaaaaccaagtaggaccaccgagtccccttctcgcgtttttaccgaggaggctaaagatagcctaaacacctctgagaatgattccgaacaccagactaacgtcacaagaagtctgttcgagcatgagggggcctgctcactgaaaagttcatgttgcccaccatcggtcctcagcggagtggttcagatgccagaatcgactgtcacttctaccgtgggggataagaagaccgatcagatggtttttcatctcgagaccaattcaaactctgagagtcacgacaaaagacagagcgataacatactgtgctccgaggatagcggattcgtgcccgtcgaaaagacacctaatctggtgaactcagtgacatcgaacaactgcgctgacgacatcctaaaaacagatgagtgttcaaggacttctatctctaactgcgaatcagcagatagcacgtggcagtcctctttagacacaaacaacaactcccactatcagaaaaaacgtatgttctctgagaacgaggaaaatgtgaaacgtatgaaaacttcagagcaaattaacgagaatatttgcgttagtctggagcggcaaacagcgtttctggagcaggtgcgacatcttatccagcaggagatctactccatcaattatgaactctttgacaaaaaacttaaggagctgaaccagaggattggtaagacagagtgccgcaacaagcatgagggtatagccgataaacttctggccaaaatcgcaaagttgcagaggaggatcaagaccgtgctcctgttccagcgtaactgcctgaagcctaacatgctctctagcaacggagctagtaaagtcgctaactcggaggcaatgatcctcgacaagaacctcgaatccgtcaactccccaattgaaaaatcctcagtaaactatgaacctagcaaccccagcgaaaaaggttccaagaaaattaacctctccagtgatcagaataaaagcgtctccgagtctaacaatgacgacgtgatgctcataagtgtcgagtcaccaaatctgacaacgcccataactagtaacccaacagacacacgcaagattacctccggaaattcaagcaattctcctaatgccgaagtgatggcagtgcagaagaaattagattcaattattgatctgacaaaggaagggctcagcaattgtaacacagagtctccagtatcaccactcgagtcccattccaaggccgcatcgaattccaaagaaacgacccccctcgctcagaacgccgtgcaagtgccggagtccttcgagcatctccccccgcttcccgaacctcctgcgccacttccagaactcgtcgataagacacgtgacacactgccaccgcagaagccagaattaaaggtgaagcgcgtctttcgtccgaatgggatcgcactcacctggaacatcaccaaaatcaaccctaagtgcgctccggtagagtcctaccatctttttctttgccacgagaattcaaataacaagctgatctggaagaagataggtgagatcaaggccttaccgctgcctatggcctgtacactgtcacaattccttgcatccaataggtattactttactgtgcagtctaaggatatcttcggacgctacggcccgttttgcgacattaaaagcatacccggcttttccgaaaacctgacctag

SEQ ID NO: 177802 - DNA, 1278 bp, Artificial Sequence
  Description of Artificial Sequence: Synthetic coding sequence
atggccagccccgaccggagcaagcggaagatcctgaaggccaagaagacaatgcctctctcctgtcgcaaacaggtggagatgctgaataagagccgtaatgtcgaggctctgaaaactgcgatcggtagcaacgtgccttccggaaaccagagtttcagcccgagcgtgattactcgcacaaccgagatcaccaagtgttcaccaagcgagaatggggccagttctttggactcaaacaagaattccatttccgaaaaatccaaggtgttcagccagaattgcatcaagcccgttgaagaaatcgtgcatagcgagaccaagcttgagcaggtagtgtgtagctatcagaaaccatcaaggaccacagaaagcccatcacgcgtctttaccgaggaggctaaggactctttgaatacgagcgaaaacgactcagaacaccagacaaatgtcacaagatccctatttgagcatgagggcgcctgctccctcaagagtagctgctgtccaccgtccgtcttgtccggtgttgtgcaaatgccagagtccactgtgacaagtacggtgggtgacaagaagactgaccaaatggtctttcacttggagaccaactccaactcggaaagtcatgataagaggcagagcgataacattctctgcagcgaggactcaggcttcgtcccagtcgagaagacaccaaacctggtaaacagcgtgactagtaacaactgcgccgacgacatcctgaagacagacgagtgcagccgcaccagcatttcaaattgcgaaagcgcagatagcacctggcagtcttcgttagacactaataacaattctcattatcagaagaagaggatgttcagcgaaaatgaagagaatgtcaaacgtatgaagacaagcgaacagatcaatgagaatatttgtgtgtccctggagagacagacagccttcctcgagcaggtgcgccacctcatccaacaagagatatattcgattaattacgaactgtttgacaagaagctaaaggagctgaaccagcgcattggtaagactgagtgtcgcaataagcatgagggcatcgctgacaagcttctcgctaaaatcgccaagcttcaaagacgcataaagactgtactgctcttccagcgaaactgcctgaagcccaatatgctgtctagcaatggggctagcaagatccccgagaaactccatcaggaaatcctggcgatccttcccatgctgaagctgtggttataccgtcggaaccttatactgtag

SEQ ID NO: 177803 - DNA, 681 bp, Artificial Sequence
  Description of Artificial Sequence: Synthetic coding sequence
atgctgatcagcgtggagagccccaacctgaccacccccatcaccagtaaccccacagatactcgcaagatcacctcaggaaacagcagtaattcacctaacgccgaggtgatggcagtgcagaagaaactggactccattatcgatcttaccaaggagggcttaagtaactgcaacacagagtcaccagtaagtcctctggagtcgcactctaaggctgccagtaatagcaaggaaacgacaccccttgctcagaacgccgtccaagttccagaaagctttgagcacctgccgccactgcccgaaccacccgcccctcttccagaattggttgacaagacacgagacactctccctcctcagaaacctgagttaaaagtaaagcgcgtctttcggcctaatggaatcgccctcacttggaacattacaaagatcaatccaaagtgcgccccagtggaatcctaccacctgtttctgtgtcacgaaaattctaacaacaagctcatctggaagaaaattggagagattaaggccctgcctctgccgatggcttgcactttgtcacagtttcttgcttccaatcggtactattttaccgtgcagtcaaaggatattttcggaagatacggacccttttgcgatattaagtcgatcccggggtttagcgagaatttgacctag

SEQ ID NO: 177804 - DNA, 714 bp, Artificial Sequence
  Description of Artificial Sequence: Synthetic coding sequence
atgaccagcgagatcacctacgccgaggtgcggttcaagaacgagttcaaatcatcaggaatcaacaccgctagcagtgcagcctcaaaggaacgcaccgccccccacaagtccaacactggctttcctaagttgctgtgtgcctccctgttgatttttttcttgctcctggccatttccttcttcatcgcattcgtcatctttttccaaaaatatagccaactccttgagaaaaagacgaccaaggaactggtccacacgacactggagtgcgtgaagaagaatatgcccgttgaagaaaccgcttggtcctgctgccctaagaattggaagagttttagttcaaactgctactttattagcactgagtcagccagctggcaggactcagagaaggactgcgctagaatggaggcacacctgctcgttatcaacacccaggaggagcaagactttatcttccagaacttgcaggaggagtctgcttatttcgtggggctaagcgatcccgagggacagcgtcattggcaatgggtggaccagactccatataatgagagtagcactttttggcacccgagagagccttccgatcctaacgagcgatgcgtggtgttaaacttccgtaagagccccaagcggtggggatggaacgatgtaaattgcctgggcccacagcgcagcgtttgcgagatgatgaagatccacctgtag

SEQ ID NO: 177805 - DNA, 2469 bp, Artificial Sequence
  Description of Artificial Sequence: Synthetic coding sequence
atggaggaggaggaggaggccatcggcctgctggacaaggtgctggaagacgaggatgtgtttctcttggaagagtgcgaattagggactccaacctcaccaggaagcgggagtccctttctggtggctgtgaaagtcgaggctgggaaggggctcgaaatgcggaagttggttctctcagggttccttgcctccgaagaaatttacatcaaccagttggaggccctactgctgccaatgaaacctttgaaagccactgcgaccacttcacagcccgtgttaaccatacagcagatagagaccatcttttacaagatacaggacatctatgagatccacaaagagttctatgacaatttgtgtcccaaagtacagcagtgggattcccaggtcaccatgggacaccttttccaaaagttagcatcccaattgggcgtctataaggctttcgtcgacaactacaaagtggcactggaaacagcagagaagtgtagtcagagcaacaaccagttccagaagatcagcgaggagttaaaagtcaagggaccaaaggattctaaggattcacacacatcagttaccatggaagccctcctttataagccaatcgacagagtgacaagatctacgttggtgctgcacgatctacttaaacacacaccggttgaccacccagactaccccctcctacaagacgctctgagaatttcccagaatttcctatcaagcattaatgaagatatcgacccccgtcgtacagctgtgaccacccctaagggggagactcgtcagctggtgaaggatggatttctcgttgaagttagtgaaagtagcagaaagctgagacatgtatttttgttcaccgacgtactcctgtgtgctaaactgaagaagacgtcagcaggtaagcaccagcagtatgattgcaaatggtatatccccctagccgatctggtgttcccctctcctgaggaaagcgaagcaagtccacaggtacacccctttcccgaccacgaactggaggacatgaagatgaaaatttcagctttgaagtctgaaatacagaaggaaaaagctaataaaggccagtctcgcgcaatagagcgcctgaaaaagaaaatgtttgagaacgagttcctgctgcttctaaacagtccgaccatcccttttcggatacataatcggaatgggaaatcttatctctttctattgtcctctgattacgaacggagcgaatggagggaagccattcagaagctccaaaagaaagatctccaggctttcgtcctgtcctctgtggagcttcaggtgttgacaggttcctgcttcaaactccgtacagtccacaacattcccgtgacctcaaacaaggatgacgatgaaagtccaggtctctacggattccttcatgttattgtccatagtgctaaaggctttaaacagtccgcaaatttgtactgcaccctcgaggtggactcatttgggtacttcgtgtccaaagctaagacgcgcgtgttccgggatacagcagagccgaaatgggacgaggagtttgaaatcgagctagagggatctcaatctctacgcatcctttgctatgagaaatgctatgacaaaacaaaagtgaataaggataataacgaaattgtggacaaaattatgggaaaaggccagattcagctagatcctcagaccgtggagactaagaactggcatactgacgtcatagaaatgaatgggattaaggttgaattctccatgaaatttacttctcgtgacatgagcctgaagagaacccctagcaagaaacagaccggggtctttggagtgaagatttcagtggtgactaagagggagagaagcaaggtgccttacatcgtgcggcagtgcgtggaagaagttgagaagcgcggcatcgaggaggtgggaatatacaggattagtggagtcgcaactgatatccaagctttgaaggcagttttcgacgcaaacaataaggatattctgctcatgctctctgacatggatattaacgctattgcagggaccctcaagctttactttagagaactacccgagcctcttctaactgataggttatatccagcctttatggaaggaatagctctgagcgacccagctgccaaggaaaattgtatgatgcacctcctgcgttccttgcctgatcccaatcttattaccttcctgtttctgctggagcaccttaaaagagttgctgagaaagagcccatcaataagatgtcgctgcacaacctggcgactgtgttcgggcccacccttctacgacccagcgaagtggagtctaaggctcacctgacctctgcagcagacatttggagccatgatgtgatggcccaggtgcaggtactcttgtattatctgcagcatccacctatttccttcgccgagctaaagaggaataccctttattttagcaccgatgtatag

SEQ ID NO: 177806 - DNA, 2580 bp, Artificial Sequence
  Description of Artificial Sequence: Synthetic coding sequence
atggagcccctgagccaccggggcctgccccggctgagctggatcgacactctttattcaaatttctcatatggtaccgatgagtatgatggtgaagggaatgaggagcagaagggtcctccagagggtagtgagaccatgccgtatattgacgagtctccaacaatgtccccgcaactgagtgcccggagccaggggggtggagatggcgtgtcgcccactcctcccgaaggtctggctcctggggtggaagctggcaagggactggagatgagaaaactggttctgagtgggttcctggcttccgaggaaatatacattaatcaactggaggctctcctgctgcctatgaagcccctcaaagctacagccactacatcgcagccagtactgaccatccagcagattgaaaccatcttctacaagatccaggacatctacgagatccataaagaattttacgacaacctctgcccaaaggttcagcagtgggactcgcaggttaccatgggccacctgtttcagaaactcgcatcccagctaggtgtgtataaagccttcgtggacaattataaggtagccctcgagactgccgaaaaatgctcccaaagcaataaccagttccagaaaatctcagaagaacttaaagttaaaggtccgaaagatagcaaggattcgcacactagcgtgaccatggaggccctgttatacaagccaatagaccgggtgactcgcagtaccttggtgctccacgatctccttaagcatacaccagtggatcatcccgattatccccttttgcaagatgccctgaggatttctcaaaactttttaagttcaatcaacgaagacattgacccaagaaggaccgcagtcactactcccaagggagagacacgtcagctagttaaagacggatttctcgtagaagtgtccgaatcttcaagaaagttgagacacgtcttcctgtttactgatgtgttgctatgcgctaagctgaagaagacgagcgccggcaagcatcagcagtacgattgtaagtggtatatccctctagcagacctcgtgtttccatcccctgaggaatcagaggcctcaccccaggttcatccctttcctgaccacgaattagaggatatgaagatgaagattagtgccctgaaatcagagatacaaaaagaaaaagccaataaagggcagtcacgggctattgagcggctgaagaaaaagatgtttgagaacgaattcttgctgctactcaattcgcccaccatcccatttaggatccacaataggaatggcaagtcatatctatttttgctttcatctgattatgagagaagtgagtggcgcgaggccattcagaaactgcaaaagaaggatttgcaagcattcgtcttgtcctcagtggagttgcaggtgctgacagggagttgtttcaaattgcgtactgtacataacatacctgttacaagcaacaaggacgacgacgagtcgcccggtctgtatggattcttgcacgttatagttcattcagctaagggctttaaacagagtgcaaacctatattgcactctcgaagtcgattcattcggatattttgtttctaaagctaagacacgagtgtttcgggatacagccgagcctaagtgggacgaggagttcgagatcgaacttgaggggtcgcagtctctgcggatcttatgttacgaaaaatgttatgacaaaactaaggtaaacaaagacaacaacgagatcgtggacaagattatgggcaaagggcagattcagttggatccccagaccgttgagaccaagaactggcatacagacgtgatcgaaatgaatggaatcaaagtggagttttcaatgaagttcacgtcccgcgacatgtctctcaagaggacgcctagtaagaagcagaccggtgttttcggggtcaaaatttccgttgttaccaaacgagaacgtagcaaagttccgtacatcgtaagacagtgcgtcgaggaggtggagaaaaggggcatcgaagaggtaggaatttaccgcatatccggcgtagccactgatattcaagcgctgaaagctgttttcgacgccaacaacaaagacattctcctcatgctgtcagatatggatataaatgcaattgccggcaccctcaagttgtactttcgggagttgccagaacctctgttgactgaccggctctaccctgcattcatggaaggcatcgcactcagcgaccccgccgccaaggaaaactgtatgatgcatctgttgcgatccttgcctgatccgaatctgattactttccttttcttgctcgaacacttgaagagggttgccgaaaaggagccgatcaataaaatgtcactccacaatctagctaccgtgttcgggccaacgttgctcagacccagcgaagtagaaagtaaagcgcatctcacctcggctgcagacatctggagccacgacgtcatggcgcaggtgcaggttttactgtactacttgcaacacccccctattagttttgccgagttaaaacggaataccctgtatttttccactgacgtgtag

SEQ ID NO: 177807 - DNA, 1092 bp, Artificial Sequence
  Description of Artificial Sequence: Synthetic coding sequence
atgaagcccctgaaggccaccgccaccaccagccagcccgtgctgacaatacagcaaatagaaaccatcttttacaagatccaggatatctacgaaatacacaaggagttctacgacaacttgtgtccaaaggtacagcagtgggattctcaagttaccatggggcatctttttcagaaacttgcctcccaacttggcgtgtataaggcatttgtcgataactacaaagtcgcactggaaaccgcggaaaagtgctcacagtccaataatcagttccaaaagatcagtgaagaactcaaggtgaagggacccaaggacagcaaagactctcacacaagtgtaacgatggaagcccttctgtataagccaatcgaccgagtcactaggtccaccctggtgctgcatgatctcctgaaacacaccccagttgaccaccccgactacccgttactccaggatgcacttcgcatctcgcagaactttctctcttcaattaatgaagatattgaccccagaagaaccgcagttaccacccctaaaggggagacacgacaacttgtcaaggatggctttctggtggaagtatccgaatcctctcggaagctccggcacgtttttctgttcacagatgtgctgctgtgcgccaagttgaagaaaacaagtgctggtaagcatcagcagtacgactgcaagtggtatatcccactcgctgatctagtatttccgtcaccggaggagtctgaggcctccccccaggtccaccctttccccgatcacgagttagaggacatgaaaatgaaaatttccgcactgaagagcgaaattcagaaagaggaggtggaaaaacgcggcatcgaggaagtggggatttaccggatctctggtgtcgctaccgatatccaggctttgaaggccgtttttgatgcgaacaataaggatattttactgatgctgagcgacatggacatcaacgccattgcgggtacgttgaagttatacttccgcgagctgccagagccgcttttaacagatcggctgagtccttgcccaacacccacatctagcccctccagctcttgctggaatacctag

SEQ ID NO: 177808 - DNA, 1926 bp, Artificial Sequence
  Description of Artificial Sequence: Synthetic coding sequence
atggagatcctgctgatcatccggttctgctgcaactgcacctacgcccttttatataagcccatagatcgtgtgacccgcagtacactggtcctgcacgacctgctgaaacacacccctgtggatcaccctgactaccccctcctacaggatgcgctacgtattagccagaactttctatcctccatcaacgaagatatcgaccctcgacgcaccgctgtgacgacccctaagggggagaccaggcagcttgtcaaggacgggttcctcgtcgaggtttccgaatcatccaggaaactgaggcacgtcttcctcttcaccgacgttctgctgtgtgccaagctcaagaagacaagcgccggcaaacatcagcagtacgactgtaaatggtacattccacttgcagaccttgtctttccctctcccgaggagagcgaagcgagcccccaagtgcatccgttccctgaccacgagttggaggacatgaaaatgaagatctccgctttgaaaagtgagatccaaaaagagaaggctaataaggggcagtctcgggccattgaacggctgaaaaagaaaatgtttgagaatgaatttctgttgttactgaattcacctacaatcccatttcgcatacacaatagaaacggcaaaagctatctgttcctcctctcttccgattatgagcgttctgagtggcgggaagctatacaaaagctacagaagaaagacttgcaggcttttgtcctatcgtccgtcgaactgcaagttcttacagggtcatgctttaagctaagaactgtgcacaacatccccgttacctcgaataaggatgacgacgagtcgccagggctgtacggatttctgcacgtaattgtccatagcgccaagggatttaaacagtcagcgaatctctattgtaccctcgaagtagactcctttggttactttgtgtcaaaggctaagacacgcgttttcagagatacggccgagccgaaatgggatgaagaatttgaaatcgagctggaaggctcacagagtctgcgaatcctgtgttacgaaaagtgttacgacaaaaccaaagtcaacaaggataacaatgagatcgtggataagataatgggtaaaggccagatacaactggacccgcaaacagtggagactaagaactggcatacagatgtaatcgagatgaacgggattaaagtggagttctcaatgaaatttaccagtcgggacatgagtttgaagcgaacacctagcaagaaacagactggcgtgtttggggtgaagatctccgttgtgactaaaagagaacggagcaaagtgccatacatagtgcgacagtgtgtcgaagaggtcgaaaaaagagggattgaggaggtgggcatctatcgaatcagcggtgttgccactgacattcaggctttaaaagcagtgttcgacgccaacaataaggatatactgctgatgctgagtgacatggatataaacgctattgcgggcaccctgaaactgtatttccgtgagctgcccgaaccgcttctgactgacaggctgtatcctgctttcatggaagggatcgccttaagtgacccagccgcgaaggaaaactgcatgatgcacttgctgaggagtctaccagaccccaatctcatcaccttcctgtttctgctcgagcatctcaaaagagtggcagagaaggagcccataaataagatgagcctacataacctggccacagttttcgggcctaccttgctgcgcccttctgaggtggagagtaaggcacacctgacctctgctgcagatatatggtcccacgacgtaatggctcaggtgcaagttcttctttattacctccaacaccctccgatcagttttgcagagctgaaacgaaatacactctacttttctaccgacgtgtag

SEQ ID NO: 177809 - DNA, 933 bp, Artificial Sequence
  Description of Artificial Sequence: Synthetic coding sequence
atgaccgacgtgctgccccagcccgactgcagccccaaggccggccgcgagccactggccctcgaagaatctggatccaaacgaccccccaacacaggagctagattgtggggccgggtgcgtaacaagctgctaagaaacaaactagaccctcagacagtcgaaactaaaaactggcacactgacgtgattgaaatgaatgggataaaagtggaattttcaatgaagtttacgagcagggatatgagtctgaagcgcaccccctctaagaaacaaaccggagtatttggcgtgaaaatctctgtggtgacaaaacgggaacgctccaaagttccttatatagtaaggcagtgtgtcgaagaagtggagaaacgcggaatcgaggaagtaggtatatacagaatatctggtgtggccacggacatacaggccctgaaagccgtatttgatgcaaacaataaggacatcctactgatgctctccgacatggacataaacgcgattgcaggcactctaaagctgtactttcgcgaactgcccgagcccctcctcacggatcgactatacccagctttcatggagggcatcgcactgagcgaccccgcagcaaaggagaattgcatgatgcatctgctcagatcattgccagaccctaacctaatcacttttctgttcctgctcgagcacctcaagagagtcgcagagaaggaacccataaacaaaatgagtctgcacaacctggccacagtgttcggccctacactgctgaggccctctgaggtcgagtccaaagcccacttgacaagcgctgcagatatctggtcgcacgatgtgatggcccaggtccaggttttattgtactatcttcagcacccccccattagctttgctgagctcaagcggaacaccctatattttagcacggacgtttag

SEQ ID NO: 177810 - DNA, 2442 bp, Artificial Sequence
  Description of Artificial Sequence: Synthetic coding sequence
atgccctacatcgacgagagccccaccatgagcccccagctgagcgcacgatcccagggtgggggtgacggtgtatcccctacccccccagagggtctggcccccggagtcgaagctggcaaggggcttgagatgcggaagttggttctgtccggttttttagcatccgaggagatctatattaatcagctggaagctctactgttacctatgaaaccactgaaagcaactgcgacgacgagtcagccggtgttaactattcaacaaattgagaccatcttttataagattcaagacatctacgaaattcataaggaattttacgacaacctttgcccaaaggtacagcagtgggactcccaggtgacaatgggccatttattccagaagcttgcgtcacagctgggggtgtacaaagcttttgttgataattataaggtggcccttgaaacagcagagaagtgtagccagtccaacaaccagtttcagaagataagtgaggaactgaaagttaaagggccaaaggattctaaagattctcacaccagcgtgactatggaggccctactgtacaagccaattgatagagtgacccgatccaccctggttctccacgacttactcaagcatactccagttgaccacccagattatcccctactccaagatgctctgagaatctctcagaacttcctgtccagtattaacgaagacatcgatccacgccgcaccgctgtcacaactccgaaaggcgagacccggcaattggtgaaggatggcttcctcgtagaggtgagcgagagcagccggaagctgcgacatgtcttcttatttacagatgttctcctctgcgccaaactaaaaaaaacctcagccggtaagcatcaacagtatgattgtaagtggtatatccctctcgctgacttagtttttccgtctcccgaggaatctgaggcgtccccacaggtgcatccctttccagaccacgagctggaggatatgaagatgaagattagcgccttgaagtcagagattcagaaggagaaggccaacaaagggcagtctcgagccattgagcgccttaagaaaaagatgtttgaaaacgaattcctgttattgctcaattcccccaccatcccatttagaatccacaacagaaatggaaagtcatatctcttcctcctctcctccgactatgaacgcagcgaatggagagaagccatccagaaactccagaagaaggacctacaagctttcgttctatccagcgtcgagctccaggtgcttactggtagctgttttaaattgcgtacagtgcacaacataccggttacttccaataaggacgacgacgagagtcccgggctgtatggatttctgcacgtcatcgtgcacagtgccaagggcttcaagcagtccgctaacctgtattgcacactcgaagtggattcattcggctattttgtcagtaaagctaagacaagagtgtttagagacaccgcagaacctaagtgggacgaagaattcgagatcgagctggaaggttcacagagcctgcggattctgtgttacgagaaatgctacgataagacaaaagtgaataaggacaacaacgagatagtcgacaaaatcatggggaaggggcagattcagctggacccccagaccgtcgagactaaaaattggcacaccgatgtgatcgagatgaatggcattaaagttgaattctccatgaaattcacttctagggatatgtctctcaagcggacgcccagcaaaaagcaaaccggggtcttcggcgtaaagatctctgtggtcaccaagcgtgaacggtcgaaggtgccctacatcgtcagacagtgtgtggaggaggtagaaaagcgtggcatagaggaggtgggcatctaccggatttctggagttgccaccgacatacaagctctcaaagccgtgttcgacgccaataacaaagacatcctgctgatgctctctgatatggatatcaacgctatagccggaacactaaaactctatttccgagagctgcctgagccgcttttgaccgacaggttgtaccctgcgtttatggagggaatagcattaagcgatccagctgccaaagagaactgcatgatgcatcttctgcgcagcctacccgatcctaacctcattacattcctctttttactggagcatctcaaacgggttgccgagaaagagcccatcaacaaaatgtccctccataatctggctacagtgttcggccctaccctcctgcgtcccagtgaagtggagagtaaggctcatttgaccagcgccgcggacatttggtcccacgatgtcatggcgcaggtgcaggtcctcttatactatctgcagcacccacctattagtttcgcggaactgaaaaggaataccctgtacttcagtaccgatgtgtag

SEQ ID NO: 177811 - DNA, 1332 bp, Artificial Sequence
  Description of Artificial Sequence: Synthetic coding sequence
atgctgaccaacggcaaggagcaggtgatcaagagctgcgtgagcctcccggagttgaacgcacaggtattctgccactcatcaaataacgttacaaagaccgaatgctgcttcacagatttttgcaataatatcaccctgcatctcccaacagcctcccctaatgcccctaagctgggaccgatggagctggctattattatcactgtccccgtctgtcttctctcaatcgccgccatgttgacagtgtgggcctgtcagggccggcagtgcagctacagaaagaagaaacgccccaatgtggaggaacccctgagcgagtgtaacctggtgaacgctggaaaaactctgaaggatctgatctatgacgtgaccgcgagtggttctggatctggcctccccctgttggtccagcgtactatcgcccggactatagtgctgcaggagatcgtgggcaaggggagattcggcgaggtctggcacggcagatggtgcggagaagatgtcgccgtgaaaatttttagttcccgtgacgaacggtcttggtttagggaagcggagatttaccaaactgtaatgctgagacacgagaatatactgggcttcatcgcagctgacaacaaagataacgggacatggacccagctgtggctcgtcagtgaatatcacgagcagggttccctgtacgactacctcaatcggaatattgtgactgtggctggcatgatcaaactcgctttgagcatcgcaagcgggttggctcacttgcacatggagatagtcggaactcagggtaagcctgcaattgcccacagagatattaaatctaagaatatcctggtgaagaagtgcgaaacatgcgctattgccgatctcggccttgctgtaaagcacgacagcattcttaatacgattgatattccacaaaaccctaaagtaggcacgaagcggtacatggctcctgaaatgcttgacgacactatgaacgtgaatattttcgaatctttcaaaagggccgacatttattccgtgggcctggtgtactgggagatagcccgaaggtgcagcgtggggggcatcgtcgaagagtaccagctgccctactatgacatggtgccttctgatcccagcatagaggagatgcgtaaggtcgtctgcgatcagaaatttaggccctctataccaaatcagtggcagagctgtgaagccctgagagtgatggggcgtatcatgcgcgaatgttggtacgctaacggtgctgcgcgtcttacagctttgcggattaaaaaaacgatcagccagctgtgtgtcaaagaagactgtaaagcttag

SEQ ID NO: 177812 - DNA, 1512 bp, Artificial Sequence
  Description of Artificial Sequence: Synthetic coding sequence
atgaccctgggcagcccccggaagggcctgctgatgctgctgatggccctggtcacacaaggggatcctgtcaaaccttctagagggcccctggtgacctgcacctgcgagtcgccccactgcaagggccctacttgccggggcgcatggtgcactgtcgtcctggtccgcgaggagggaagacacccgcaggagcatcgcggctgtggcaacctgcacagagagctatgtcgggggcgtccgaccgaatttgtgaaccattactgttgtgacagccatctgtgtaaccacaatgtcagtctggttcttgaagcgacacagcccccatcagagcagccgggtactgatggtcagctggctctgattctgggccctgtgcttgcactgttggctctcgtagcgctgggggtattgggcttatggcatgtgagacggcgccaggagaagcaaagaggcctgcactcagagctgggcgagtcatccctcattctgaaggcatccgaacagggcgattccatgctgggcgatctgctggattccgactgtacaaccggatctggctctgggctgcccttcctggtgcagcggaccgtcgccaggcaggtggctctcgtggagtgtgtgggaaaggggcgctacggagaagtgtggagaggcctctggcacggtgagagtgtggccgtgaagatcttctctagcagagacgagcaatcctggttcagggagacagagatttacaacactgtgctcctcaggcatgacaatatactcggcttcatcgcgagcgacatgacgagccgcaatagttcgactcagctgtggctcatcacccactaccacgaacacggcagtctttatgattttttacaacggcagacactggaacctcatctggctttgcggctggccgtgtccgctgcttgcgggctagctcacttgcacgtggaaattttcggaacacaaggcaaacctgccatagctcacagggactttaaaagtcgcaacgtgcttgtgaagtctaatctccaatgttgcattgcagacctgggcctggcagtgatgcatagccaggggtctgattatctggacataggcaacaacccacgggtggggacaaagcgctatatggcacctgaggtgctggatgaacagatcaggactgattgtttcgagtcctacaaatggaccgacatttgggcatttgggctagtcctgtgggagattgctaggagaaccatcgtgaacggtatagtcgaagattatcgcccccctttctacgatgttgtgcctaatgacccctcttttgaggatatgaaaaaagtggtatgcgtggatcaacagacacccacaatccctaatcggcttgcagctgatccagtgctcagtgggctggcccaaatgatgcgagaatgttggtatccaaacccatctgctcgcctcaccgccctgagaattaaaaagactctgcaaaagatctccaactcccctgagaaacctaaagtgattcagtag

SEQ ID NO: 177813 - DNA, 1512 bp, Artificial Sequence
  Description of Artificial Sequence: Synthetic coding sequence
atgaccctgggcagcccccggaagggcctgctgatgctgctgatggctctggttacgcagggtgatccggtgaaaccttcacgcggcccgctagtgacgtgcacttgtgagtcgcctcactgcaaaggtcctacctgtcgaggcgcatggtgtacggttgtgctggtgagagaggaaggccgtcatccacaagaacatcgaggatgtggcaatttgcaccgcgagctctgcagggggaggcctaccgagttcgtcaaccactattgctgcgattctcacctctgtaaccataatgtgagcctggtgctggaggcaacgcagccacctagcgaacagcccggcaccgatggccaattagcactaatcctcggacccgtgctagctctgctagccctggtagctctgggggttctgggcctgtggcatgttcggcggcgccaggaaaagcagcggggcctccacagcgagctgggtgaatcttcgctcatcctgaaagctagtgagcagggcgactctatgcttggggatctgctcgactcagactgcacaaccggaagcgggagcgggctgccatttttagtccaaagaacggtcgccaggcaggtcgcgctcgtagagtgtgttggtaaaggccgatacggtgaggtctggagggggttgtggcatggagagtcagtggcagtgaagatcttttctagtagggatgagcaatcatggtttcgggagacggagatatataatactgtgttacttaggcacgataatatcctggggttcatcgctagcgatatgacttctcgcaacagttccacacagctctggctgatcactcactatcacgagcacggctcactgtatgatttcctgcagagacagacgctggagccacatcttgccctccgcttagccgtgtcagccgcttgcggcttggcccacctccacgtcgagatctttgggacccaaggtaagcccgcgattgcccacagggactttaagagccgaaacgtcctggtgaagtccaatctgcagtgctgcatcgccgatttaggacttgcagttatgcacagccagggctctgactatctagacattggtaataatcctcgtgtggggactaaacgctatatggcacctgaagtactggacgagcaaattcggactgattgttttgaaagttacaaatggaccgacatttgggccttcgggctggttctctgggaaatcgcccgacgcacaatcgtgaacggcattgtggaggactaccgaccccctttctatgatgtcgtacccaacgacccctcattcgaagacatgaaaaaggtagtctgcgtggaccagcagacaccaaccatccccaacaggctggccgccgatcccgtcttgagcggtttggctcagatgatgagagaatgttggtacccaaacccctccgcccgcctaaccgcgctgcgaattaagaagaccctgcagaagatcagtaacagccccgagaagccaaaagtaattcaatag

SEQ ID NO: 177814 - DNA, 990 bp, Artificial Sequence
  Description of Artificial Sequence: Synthetic coding sequence
atggccctgaccccccccctgctgctgctgagcgccggcaccatgactttgggaagccctcggaaaggactgttgatgctgctgatggctctggtaacccaagggaagggacgttacggagaggtatggagaggcctctggcatggagagagcgtcgctgtcaaaatattttcctctagggatgaacagagctggtttcgggaaacggagatctataacacagtgctgctgcggcacgataatatcttgggtttcatcgcatcagacatgacaagtcgtaacagttcaacacagctctggctgatcacccactaccacgaacacggctccctctatgattttcttcagaggcagacactggagccacacttagcccttcgtctggccgtgtcagctgcatgcggtttggcccatttacacgttgagatttttggaacacagggcaagccagccatagctcaccgtgatttcaaatctcggaacgttctggtgaagtccaacctgcagtgttgcatagctgatctaggattagccgtcatgcactcccagggcagtgactaccttgatatcggcaacaacccacgagttgggacaaaacggtacatggctcccgaggtgttagacgagcagatacgcactgactgttttgaaagttataagtggacggacatttgggcctttggactcgtcttatgggagatagcccggagaacgatagtgaatggcatagtggaggattaccggcctcctttttacgacgttgtccccaacgacccctctttcgaggatatgaaaaaagtagtttgtgtcgaccagcagaccccgacaatcccaaacaggctggcggcagatccggttctgagcggccttgcgcagatgatgcgggagtgctggtacccgaatccctctgctaggctgaccgctctcagaattaagaagacactgcagaagatcagcaacagccccgagaaaccgaaggtaattcagtag

SEQ ID NO: 177815 - DNA, 480 bp, Artificial Sequence
  Description of Artificial Sequence: Synthetic coding sequence
atggccctgaccccccccctgctgctgctgagcgccggcaccatgacattggggagtcctcgcaaggggctgctgatgctgctcatggcactggtaacacagggagacccagtcaagcctagccggggccctctggtgacgtgtacttgtgagagtccacattgtaagggacccacatgtcgcggagcctggtgtaccgttgtgttagtgcgcgaggaggggcgacaccctcaggagcaccgcggatgcggtaatttgcatcgcgaactgtgcaggggaagaccaacagagttcgtgaaccactattgctgtgacagtcacttgtgtaatcacaatgtgagtctggtgctggaaggcaaaggacggtatggagaggtgtggcgtgggctgtggcatggagaaagcgttgcagtgaagatttttagtagtagagatgagcagagttggttccgagagacagagatttataataccgtatag

SEQ ID NO: 177816 - DNA, 1554 bp, Artificial Sequence
  Description of Artificial Sequence: Synthetic coding sequence
atggccctgaccccccccctgctgctgctgagcgccggcaccatgacacttgggagcccccgaaagggactactaatgctgctgatggccctcgtcacccaaggtgatcctgtcaagccgagtagaggaccattggtcacatgtacctgtgagagtcctcactgcaagggcccaacatgccggggcgcatggtgtaccgttgtgctggtgcgtgaagaagggagacacccccaagaacacagagggtgcggaaatctccaccgagaactgtgtcgggggcgccccactgagtttgtgaatcactattgttgcgacagtcatttatgcaatcacaatgtcagtctcgtactggaagccacccaacctcccagcgaacagcccggcacagacgggcagctcgctctgattctggggcctgtactggccctcctagcgctggtggccctgggagtgcttgggctttggcatgtgaggagacgccaagaaaaacagagaggcctgcactccgagctgggcgagtctagtctcatactgaaagcatccgagcagggcgattcaatgcttggcgacctactggattcagactgtacaacaggatcagggtcaggcctgccctttctggttcaacggaccgtcgctagacaggtagccctcgtggaatgcgtggggaagggtaggtacggggaagtttggagagggttgtggcatggagagtctgtcgcggtcaagattttctcatctagggacgagcagtcttggtttagagagactgagatatacaataccgttcttttgaggcacgacaatatacttggttttatcgcttcagatatgacatcccggaatagctccactcagctgtggctgatcactcattaccacgagcacggctctctgtacgacttcctgcagcggcagactctggagccccacctggctctgagactggcagtgagcgctgcctgcggcttagctcatctgcacgttgaaatcttcgggacccaaggaaagcccgccattgcacaccgggactttaagtcgagaaacgtgctggtaaaaagcaatctccaatgttgcatcgcagatttgggtctggctgttatgcattctcagggcagcgactacctagacatcggtaataatccccgagttggaactaaaagatatatggcccccgaagtgctggatgagcagatcaggaccgattgcttcgagtcgtacaagtggacggacatatgggccttcggcctggtgctatgggagatcgcacggcgcacaatcgtgaacgggatcgtcgaggactatcggccaccgttctacgacgttgtgcccaacgacccatcctttgaggatatgaagaaagtagtttgtgtcgaccagcagacgcccactatccccaatcgtctggcagccgatcccgtgctgtccggactggctcagatgatgcgcgagtgttggtaccctaatccaagcgcaaggctgacggccctgcggattaagaaaacgctgcagaagatctcaaattcccctgagaagccaaaagttattcaatag

SEQ ID NO: 177817 - DNA, 1530 bp, Artificial Sequence
  Description of Artificial Sequence: Synthetic coding sequence
atggtggacggcgtgatgatcctgcccgtgctgatcatgatcgccctccccagcccaagcatggaggatgagaagccaaaagttaaccccaaactgtacatgtgtgtatgcgaaggtctgtcatgcggaaacgaggatcactgcgagggacagcaatgtttcagtagcctttctatcaacgacggctttcacgtgtatcaaaaaggttgctttcaggtatacgaacagggcaaaatgacctgtaaaaccccacctagccctggacaggccgtcgagtgctgtcagggggactggtgcaatagaaatattactgcccagctccctaccaaaggcaagtcctttcccggtactcagaactttcaccttgaggtcggattaatcatcctctccgtggtgtttgccgtgtgtctgctggcatgcctgctgggagtcgccctccgcaaattcaagcgccgcaaccaagagcggctcaatccacgcgacgtggaatatggaactattgaggggctcatcactacaaacgtcggcgactcaactctggccgatctgttagatcacagttgtacttcaggatctggctctggtctccctttcctggtccaacggactgttgctcgccaaataacactgttagagtgcgtgggaaagggcaggtatggtgaagtctggcggggttcttggcaaggcgagaatgtggccgtgaaaatcttcagctctcgagatgaaaaatcttggttcagggagaccgagctctacaacacggttatgctccgccacgagaacattctcggctttattgcctcagacatgacatctcggcactcttctactcaactgtggcttatcacacattatcacgagatggggtccttgtatgattacctgcaactgactactcttgatacggtatcatgtctgcgcattgttctttctatcgcctccggattggctcatctacacatcgagatattcggtacacagggcaaacctgccatcgcgcaccgtgatctcaagtccaaaaatattttagtgaagaagaatggccaatgttgcatcgcagatctgggcctggcagtgatgcactctcagtcgacaaaccagttagatgtggggaacaaccctcgagtgggaactaagcgctacatggcacccgaggtcctcgatgagactatccaggtggattgtttcgattcatacaaacgcgtggacatctgggcattcggattagtactctgggaggttgctcggaggatggtgtcgaacggaatcgttgaagattacaagcctccgttttacgacgtggtcccaaacgatccatctttcgaagatatgaggaaagtggtctgtgtggatcagcagagacccaatatccccaatcgctggttctcagacccgacactcactagcctcgccaagctgatgaaagaatgctggtaccagaacccttcagcccggctcaccgctctcagaattaaaaaaacattaaccaagattgataacagccttgacaagttaaaaacagactgctag

SEQ ID NO: 177818 - DNA, 1530 bp, Artificial Sequence
  Description of Artificial Sequence: Synthetic coding sequence
atggtggacggcgtgatgatcctgcccgtgctgatcatgatcgccctcccaagtccaagtatggaggacgaaaaacctaaggttaatcccaagctatatatgtgcgtttgcgagggactcagctgtgggaatgaggaccactgcgaggggcagcagtgtttcagcagtctaagcataaacgacggattccatgtttatcagaagggatgtttccaggtgtacgaacaggggaagatgacctgcaaaactcctccaagtccggggcaggccgtcgaatgttgccagggcgactggtgtaatcgaaatatcaccgcacagctccccacaaagggcaagtctttccctgggacacagaatttccatttggaagtgggcctcatcatccttagtgtggtattcgcagtgtgtctcctcgcctgtttgctgggcgtcgctcttcgtaagttcaagaggcggaatcaggaaaggctgaacccccgggacgtagagtacggaactatcgagggactgatcacaactaacgtgggagactctacactggctgatctcctggaccattcctgcactagtggatcaggatctgggctgccattcctggtacagcggaccgtggcacgccagattaccctcttggagtgcgttgggaaggggcgctacggtgaggtttggcggggcagttggcaaggagaaaacgtcgcagttaagatcttttcctcccgagacgagaagtcttggttcagggagactgaattgtacaacaccgtgatgctgcggcacgaaaatattctgggttttatagcatccgatatgaccagcagacacagttccacgcaactctggctgattacccattatcatgagatgggttctttgtacgactatttgcagttgacaacacttgacaccgtgagctgtctccggatagtgctgagcattgccagcggactagcccacctccatatcgagattttcggaacccaaggtaaacctgctatcgcccatcgggatctgaagtccaagaacattctcgtgaagaagaacggccagtgctgtattgccgaccttggtttggctgtcatgcactcgcagtctaccaaccaactggatgttggcaacaacccacgcgttgggaccaagagatacatggcacccgaagttttagacgaaacgatccaggtagattgcttcgactcgtacaagagagtggacatctgggcatttggacttgttctctgggaggtggcaagacgcatggtctctaatggcatcgtggaagattacaaaccacccttctacgatgtggtgcctaatgaccctagctttgaggatatgcgcaaggtggtgtgtgtcgatcagcagcgcccaaatatccctaaccgttggttctccgatcccacactcacttctctggcgaagctgatgaaggaatgttggtatcagaatccatcagctcggctgaccgcgttgcgtatcaaaaaaactctgacaaaaatagataacagtttggacaagctcaaaaccgactgttag

SEQ ID NO: 177819 - DNA, 1530 bp, Artificial Sequence
  Description of Artificial Sequence: Synthetic coding sequence
atggtggacggcgtgatgatcctgcccgtgctgatcatgatcgccttgcctagcccctctatggaagacgaaaagccaaaggtgaatcccaaactttacatgtgtgtgtgtgaaggcttatcgtgcgggaacgaagaccattgtgagggacagcagtgtttttcctcactgtccattaatgacggctttcacgtttaccaaaagggctgttttcaggtatacgaacagggtaaaatgacatgcaaaacacctccgagccccggccaggccgtggaatgctgccagggtgattggtgcaaccgcaatatcactgcccaactgcccactaagggaaaaagttttcctggaactcaaaattttcacctcgaagtgggactcataatcctgtctgtggtctttgccgtgtgcttgctcgcctgtctactcggggtcgcactgcggaaatttaaaagaaggaatcaggaacggctcaatccccgagatgtagagtacggcactatcgaaggcctgatcaccacaaacgtcggcgattcaacactggctgatcttctggatcactcatgtacctctggatcaggcagcggtttgccttttcttgtccagagaaccgtcgctaggcagattaccctcttagaatgcgtgggcaagggcagatacggcgaggtttggaggggcagctggcaaggcgaaaatgtagcagtaaagatattctccagcagggatgaaaagtcatggtttcgcgagaccgaactctataatacagtcatgctacggcatgagaatatcctggggtttatagcctcagatatgacctctcgccacagctcaactcagctgtggctgatcacacactatcacgagatgggatctctgtacgactatcttcagttaactactctggataccgtgtcatgtcttcgcatagtcctgtctatcgccagcggactcgcccacttacatattgagatctttggtactcaggggaagcccgccatcgcacaccgagatctgaagtctaagaacattcttgtgaaaaaaaacggacagtgctgcatcgcagaccttggccttgctgtgatgcattcccagagcacgaatcagctggacgtaggaaacaacccccgggtgggtactaaaagatatatggctcccgaagtgttagatgagacaatccaggtggactgcttcgactcttacaagcgggtcgacatttgggccttcggtcttgttctgtgggaagtcgctaggcgcatggtttctaatgggattgtggaggactacaagcctccattttatgatgtggtgcccaatgatcctagcttcgaagacatgcgcaaggtggtatgcgtcgatcagcagcgcccaaatattcctaataggtggtttagtgatccgactctcacctccttggccaaactgatgaaagagtgctggtatcagaatcccagtgctcggctgacagcgttacgcataaaaaagacactcacgaagatcgacaacagcttagataagttaaaaaccgattgttag

SEQ ID NO: 177820 - DNA, 264 bp, Artificial Sequence
  Description of Artificial Sequence: Synthetic coding sequence
atggtggacggcgtgatgatcctgcccgtgctgatcatgatcgccctgcctagcccgtctatggaggacgaaaagcccaaagtgaaccctaaactgtatatgtgtgtttgcgaggggctttcctgcgggaacgaggaccactgcgaagggcagcaatgtttctcgtccctctcaattaacgatgggttccacgtgtaccaaaaaggttgctttcaagtctatgagcaggggaaaatgacctgtaaaacccctcccagcccttag

SEQ ID NO: 177821 - DNA, 66 bp, Artificial Sequence
  Description of Artificial Sequence: Synthetic coding sequence
atggtggacggcgtgatgatcctgcccgtgctgatcatgatcgcccttccttctcctagcatgtag

SEQ ID NO: 177822 - DNA, 216 bp, Artificial Sequence
  Description of Artificial Sequence: Synthetic coding sequence
atggtggacggcgtgatgatcctgcccgtgctgatcatgatcgccctaccctccccaagcatggaagatgagaagccaaaagtcaatcctaagctgtacatgtgtgtgtgcgagggtctttcttgcggaaacgaggatcactgtgaagggcagcagtgcttcagcagtctgtccattaacgatggctttcatgtgtaccaaaaagggtgtttttag

SEQ ID NO: 177823 - DNA, 1530 bp, Artificial Sequence
  Description of Artificial Sequence: Synthetic coding sequence
atggtggacggcgtgatgatcctgcccgtgctgatcatgatcgccctaccttctcctagcatggaagacgaaaaacccaaagttaatccgaagctctacatgtgcgtttgtgagggcctatcatgtggcaatgaggaccactgtgagggtcaacagtgcttcagctctctgtctattaacgatggcttccatgtgtaccagaagggctgttttcaggtgtacgaacagggaaagatgacatgtaagactcccccgtctcctggacaagccgttgaatgctgccaaggcgactggtgcaatcggaacattacggctcagctcccaactaagggtaaatcatttcccggcacacagaattttcacctcgaggtcgggctgatcatcttaagcgtggtctttgctgtctgcctcctggcctgccttctgggggtggctctgcggaaattcaagagaagaaatcaggagaggctcaaccccagggacgtggaatacggaactatcgaaggcttgatcacaactaacgtgggagattctacacttgccgacctcctcgatcattcctgcacttccggctcaggctctggcctgccctttctggtgcagagaacagtggctcgacaaattaccctgctggaatgtgtaggtaagggaaggtatggggaagtgtggaggggaagttggcagggcgagaatgtggctgtgaaaattttttccagccgcgacgagaagtcctggtttagagagacggagctctacaacaccgttatgcttagacatgagaatattctcggcttcattgcgtccgatatgacctccagacactctagtacacaactctggcttatcactcactatcatgagatgggatctttatacgattatctgcagcttacaaccttggataccgtctcctgtctgaggattgtgctctcgattgcttcggggctcgctcatctgcatatcgaaattttcgggacacagggcaagcccgccattgcccatagagacctaaagagcaagaatatattggtgaaaaaaaatggacaatgctgtatcgccgacctgggactcgccgtcatgcactcccagtcaaccaatcaacttgacgtgggcaataaccctcgggttggcaccaagcggtacatggcccccgaggtgctggatgagacgattcaagtcgactgcttcgatagctataagagggtggacatctgggccttcgggttggttctgtgggaggttgccaggcgcatggtgtctaatggtattgtagaagactataagccacctttctatgacgtcgtgccaaatgatcccagctttgaggatatgagaaaggtggtctgtgtggatcagcagcgtcccaatatccctaatcgatggttctctgatcccaccctaacaagtttggctaagctaatgaaagaatgctggtatcagaatccctccgcacgcctcactgccctgagaatcaaaaaaaccttgacaaaaatcgacaattccctcgataagctgaaaactgactgttag

SEQ ID NO: 177824 - DNA, 264 bp, Artificial Sequence
  Description of Artificial Sequence: Synthetic coding sequence
atggtggacggcgtgatgatcctgcccgtgctgatcatgatcgccctgccgtccccctcaatggaagacgaaaaaccaaaggtgaaccccaagttatatatgtgtgtgtgtgaggggctttcttgtggcaacgaggatcattgcgaagggcagcagtgcttcagcagcttgagcatcaacgacggatttcacgtctaccagaagggatgtttccaagtgtatgagcagggaaaaatgacctgcaaaacccctccctccccgtag

SEQ ID NO: 177825 - DNA, 222 bp, Artificial Sequence
  Description of Artificial Sequence: Synthetic coding sequence
atggtggacggcgtgatgatcctgcccgtgctgatcatgatcgccttgccttccccatcaatggaggatgaaaagcctaaagtgaaccccaagctgtacatgtgcgtgtgcgagggattgtcctgtggcaatgaggatcactgcgaggggcaacagtgtttcagcagcttaagtattaacgacggcttccacgtgtaccagaagggctgttttcaagtctag

SEQ ID NO: 177826 - DNA, 1518 bp, Artificial Sequence
  Description of Artificial Sequence: Synthetic coding sequence
atggccgagagcgccggcgccagcagcttcttccccctggtggtgctcctcctggctggcagcggtgggtccggtcctaggggagttcaggccctgctgtgtgcctgtacatcgtgtttacaggctaattatacctgcgaaacagatggagcctgtatggtgagcattttcaatttagatggcatggagcaccatgtgaggacttgcatacctaaggttgagcttgtgcccgccggaaaacccttctattgcctttccagcgaggacctgcggaacactcactgctgctacacagactattgtaaccgcattgatcttagagtgccctcaggacacctgaaggagccagaacatccatctatgtgggggccggtggagttggttggtatcattgcaggccctgtgttcttgttgttcctgatcataatcattgtctttctggtaataaactaccaccagcgggtataccacaatcggcagagattagatatggaggatccttcgtgcgaaatgtgtttatctaaggacaaaaccctgcaggatctggtttacgacctgagcaccagcgggtcaggaagtggacttcctctgttcgtacagcggacggttgcaagaacaatcgtattgcaggagatcatcggcaagggccgcttcggagaggtttggcgcggacgttggcggggaggcgacgtggcagtaaagattttctcttctagagaggaaagatcttggtttcgtgaggccgagatttatcagacagtgatgctccgacatgagaacattctcggatttatcgccgcagataataaggataatggtacttggactcaactgtggcttgtttcagattatcacgaacatggcagcctgtttgactacttgaatcggtatactgttacaatcgaggggatgattaagctggcactctctgcagcctccggtctggcccatcttcacatggaaatagttggcacccagggcaagcctgggatcgcccacagggatctgaagtccaagaacatcctcgtcaaaaaaaacggtatgtgtgccatcgctgacctcggcctcgctgtgaggcatgatgccgtgacggataccattgacattgctcctaatcagagagtagggacaaagaggtacatggcccccgaagtgctggatgagacgatcaatatgaagcacttcgactctttcaagtgtgccgacatctatgctctgggccttgtgtactgggaaatcgctagacgctgtaattccggaggagtgcatgaagaataccaacttccatattatgacttagtgccatccgatccaagcatcgaggaaatgcgcaaagtggtttgtgatcagaagctgaggcccaatatacccaactggtggcagtcatacgaagcgctgagggttatgggcaagatgatgagggaatgctggtacgccaatggcgccgctcgattaactgcgctgaggattaaaaagaccctaagtcagttgagcgtccaagaagatgtgaagatatag

SEQ ID NO: 177827 - DNA, 1464 bp, Artificial Sequence
  Description of Artificial Sequence: Synthetic coding sequence
atggccgagagcgccggcgccagcagcttcttccccctggtggtgttgctgctggccggcagcggcgggagcggaccccgcggcgtgcaggctcttctttgcgcctgcacttcttgcctccaagccaactacacctgcgaaaccgacggagcctgcatggttagcatttttaatctggacggcatggaacatcacgtgaggacatgcatccccaaggtggagctcgttccagccggaaaacctttttactgcctgtcatccgaggacctgcggaacactcattgttgctacacagattactgcaatcgaatcgacctgcgcgtcccaagtggccacctgaaggagccagagcatccttcaatgtggggcccagtcgagttggttgggatcatcgcaggtccagtgtttctgctgttcctgataattattatagtgttccttgtgattaattatcatcagcgcgtgtaccacaaccgtcagagacttgacatggaagatccgtcatgtgaaatgtgtctctctaaagacaagactcttcaggacctggtgtacgacctctcaacttctgggagcgggagtggcttacctctcttcgttcagcggacagtggctaggaccatcgtactgcaggaaattatcggaaagggccggttcggagaggtttggcgcggccgatggcgaggcggcgacgtcgcagtgaaaattttttcatcccgagaagaacgctcatggtttcgtgaagccgagatataccaaactgtcatgttgagacatgaaaacatattaggctttattgcagccgataacaaggacaacggcacctggactcagctctggctggtcagcgattaccacgaacacggttccctgtttgactacctcaacaggtataccgttactattgagggaatgattaagctcgccctgagcgctgctagcgggctggcacacctccacatggagattgtagggacacaggggaagccggggattgctcatagggacttgaaatccaagaacatactggtgaagaaaaacggaatgtgcgctatcgctgaccttggcttagctgtaagacacgatgccgtaaccgacactattgatatcgccccaaatcagagggtcgggacaaagcggtacatggctccagaggtgctggatgaaaccatcaatatgaaacacttcgacagttttaagtgcgccgacatctacgccctgggactcgtgtactgggagatcgcccgccgctgcaacagtggcgggacgttcctcttttgtctttgctcttacctacccttccaggatgccggctccccaaaagctgtactgctgcctcctttcttcctgcagcccgtaggttgtttgctgcctgaaccagagagttcctttaaggttgccatcaaaggtgttgaagtcgctgtgttgagagttcgtttatttttccgggatcaattcgtggaatag

SEQ ID NO: 177828 - DNA, 1431 bp, Artificial Sequence
  Description of Artificial Sequence: Synthetic coding sequence
atggccgagagcgccggcgccagcagcttcttccccctggtggtgctcctcctagcaggatctggcggcagtggccctcggggtgttcaagccctgctgtgtgcatgcaccagctgtttgcaggctaattatacatgcgaaactgacggtgcctgtatggtaagcatttttaatctcgatggaatggaacaccacgtgaggacatgcataccgaaagttgagctggtgcccgccgggaagccgttttattgtctgtcgtccgaggacctacgaaatactcattgctgttacacggactattgcaaccggattgatttgcgcgtaccctccggccacctcaaggagcccgagcacccttccatgtggggcccagtggaactcgtgggcatcatagctggacctgtctttctgctgtttctaattataatcattgtatttctagtaatcaattaccatcagcgtgtctaccacaaccgacagcgccttgacatggaggatcctagttgcgagatgtgcctcagcaaagataaaacgttgcaagatttggtgtacgatctgtcgaccagtggcagcggatcagggctgcctctgtttgtacaacggaccgttgcacggaccattgttcttcaggagatcatcggcaaggggaggtttggtgaggtgtggagggggcggtggcggggcggggacgtggccgtcaaaatcttttcaagtcgcgaggagcggtcttggtttcgggaggcagaaatctaccagaccgtaatgctgcgccacgagaacattctaggctttatcgctgccgacaataaagataacggaacttggactcagctctggctggtaagcgattatcacgagcacggcagcctcttcgactatttgaatcgctacaccgtgacaattgaggggatgattaagttggcactgtctgcggctagcgggctcgcgcaccttcatatggagatcgttgggacccagggcaagccagggatcgcacacagggatctcaagtctaaaaatatcttggtgaagaagaacgggatgtgcgctattgccgaccttgggcttgccgtcaggcacgatgcggtaacggataccatcgacatcgctcctaatcagcgcgtgggaactaagcggtacatggcccctgaggtgttagatgagactatcaacatgaaacatttcgattcattcaaatgcgcagacatctacgccctggggctggtctactgggaaatcgcaagaagatgcaattcagggggagtccacgaagaataccagttgccatattatgacctggttccatctgacccttcaattgaggagatgcgcaaggtagtttgcgaccagaagttgaggcctaacatccccaactggtggcagtcctacgaggttcggtcctggcctccagcagctttcccctcagcctag

SEQ ID NO: 177829 - DNA, 1641 bp, Artificial Sequence
  Description of Artificial Sequence: Synthetic coding sequence
atggccgagagcgccggcgccagcagcttcttccccctggtggtgctgttgttggcgggctctggcggttcaggcccccgcggggtgcaggcccttctgtgcgcttgcacatcctgtcttcaggccaattacacttgtgagacagacggggcttgcatggtgtctatattcaaccttgacggcatggagcaccacgtcagaacctgcatcccaaaggtggagctggtgccggctggaaaacccttttactgcctcagcagcgaggatttacgcaacacgcactgctgttatactgactactgcaaccgcatcgacttgcgcgtgccttccgggcacctcaaggaaccagagcacccgagcatgtggggaccagtggaactagtggggattatcgcaggacctgtgttcctgctgttcctcattataatcatagtgttcctggtcataaactaccaccagcgagtataccacaatcgccagcggttagatatggaagaccccagctgtgaaatgtgcttaagcaaagataaaactctccaggacttagtgtacgacctgtccactagtgggtcgggcagcggactacccctgtttgtacagaggaccgtggcccggacgatcgtgctccaggagattatcggcaaaggccgatttggcgaggtatggaggggtaggtggcgaggtggagacgttgccgttaaaattttctccagcagagaggaaagaagctggttcagggaggcagaaatatatcagaccgttatgctgcggcatgaaaatattctgggcttcatagccgccgacaacaaggccgattgcagttttctaacactgccatgggaagtcgtaatggtaagcgctgctccaaaactgcggagtcttaggctccagtacaaaggcggaaggggaagagcgaggttcctttttccactgaacaatggcacttggacgcagttgtggttggtgtcagactaccatgaacatggtagcttgtttgactacctgaaccgatatactgtcactattgaagggatgattaagctggcattgtctgccgcctcgggactggcgcatttacatatggaaattgtggggactcaaggaaaacccggcatagcccaccgggacctgaagtccaagaatatcctggttaaaaaaaacggcatgtgcgcaattgccgacttaggtctggccgtgagacatgacgcagtgactgataccattgatattgcccccaatcagcgcgtgggcaccaaacggtatatggcccccgaggtgttagatgaaaccataaatatgaagcatttcgactcatttaagtgtgccgacatctacgctctgggcctcgtatattgggaaatcgctagacgctgtaactccggaggagttcacgaggagtatcagctgccttattatgatcttgttccgtccgatccatcgattgaggaaatgcggaaagtggtatgtgatcaaaaactgcgtccaaacatccccaactggtggcagtcctatgaggcattaagggttatggggaagatgatgcgcgaatgttggtatgccaatggcgccgcccgcctgaccgccttacggatcaagaagaccctaagccagttgtctgtgcaggaggacgtcaagatctag

SEQ ID NO: 177830 - DNA, 1362 bp, Artificial Sequence
  Description of Artificial Sequence: Synthetic coding sequence
atggtgagcatcttcaacctggacggcatggagcaccacgtgcggacctgcatacccaaagtcgagctggtgccggcaggtaaacctttttattgtctgtcctccgaggatttgcgaaatactcattgctgctacacagattactgtaacaggatcgacttgagggtgccctccggacaccttaaggaaccagaacatccctcaatgtggggacccgtggagttggtgggaatcatcgctggacctgtgttcctgctgtttttaatcattattatcgtgtttctggtaataaactaccatcagcgtgtttatcataacagacagcgattggacatggaagatccttcctgtgagatgtgtctgtccaaggataagaccctgcaggatcttgtctatgatcttagtacttccggctccgggagcggactgcctttgttcgtacagcgtaccgtcgcccgaactatagtcttgcaagagatcatcggcaaggggcggttcggggaggtatggcgaggccggtggagagggggcgacgtggcagtgaagatcttttccagccgagaggagagatcatggtttcgggaggctgagatctatcaaactgtgatgctgcggcacgagaatatactggggttcattgcggccgataacaaagacaatggaacatggacacagctgtggctggtgtctgattatcatgaacacggctccctgtttgattatttgaacagatataccgttacaattgaaggcatgattaagctcgccctcagcgccgcctcaggattggcccacttgcatatggagatcgtcggaacacagggcaagccaggaattgcccaccgggacctaaagtctaaaaatattctcgtgaaaaagaacgggatgtgcgcaatagcagacctcggactggctgttcgtcacgacgctgttacagatacaatcgacattgctccaaaccagcgggtcggcaccaaaaggtacatggccccggaggtgttagatgagacaatcaatatgaaacatttcgactcctttaaatgtgctgatatctacgcgctgggattggtttactgggaaattgctcgacgatgtaatagcggcggtgtgcacgaggaatatcagctgccctattacgatttagtgccaagcgatccctccattgaggagatgcgcaaagtggtctgtgaccagaagctgagaccgaatatccccaactggtggcagagctacgaggctctgagagtgatgggaaaaatgatgcgggagtgttggtacgcgaacggagccgctaggctgaccgccctgcgcatcaaaaagacgctttcccagttgtccgtgcaggaagatgttaaaatctag

SEQ ID NO: 177831 - DNA, 1482 bp, Artificial Sequence
  Description of Artificial Sequence: Synthetic coding sequence
atgacccgggccctgtgcagcgccctgcggcaggccctgctgctgctagctgcggctgctgaattgtcacctggactaaaatgtgtatgcttgctatgcgactcctcaaatttcacttgtcagaccgaaggcgcttgctgggcctccgtgatgttaaccaacggcaaggaacaggtgatcaagagctgcgtatccctgcctgaactgaacgctcaggttttttgccacagcagcaacaacgtgaccaagactgaatgttgtttcacggatttctgtaataatattactctgcacctgccaaccgctagccccaacgctcctaagctgggaccaatggaactggccatcattattacagtgccggtgtgtctcctcagcatcgccgccatgttgactgtctgggcctgccaaggccgccagtgtagttatcgtaaaaagaagcgcccaaacgttgaggagcctctgagtgagtgtaacctcgttaatgctggtaaaaccctaaaagatctcatctacgacgtgactgcctcaggatctggctccggcctgcctctgttggttcaacggaccatcgcccgtactatagtgctccaggagattgtcgggaaaggccgctttggggaagtgtggcatggccgttggtgcggagaagatgtggccgtgaaaatattctcatcccgagacgagcgcagttggtttagggaggcagagatatatcaaaccgtcatgcttcggcatgagaacatcctgggattcatcgctgcagataacaaggataatggcacttggacgcaactgtggttggtgagcgaataccatgaacaggggtccctgtatgattatctcaaccgaaacatcgtaacagttgctggcatgatcaagctggcactcagtattgcaagtggactcgcgcatcttcacatggaaattgtaggcacacagggaaagcccgcgattgcccatagggacatcaagagcaagaacattctggtgaagaagtgcgagacctgtgcaatcgcggatctgggacttgctgtgaaacacgatagcattctcaacactatagatattccccagaatcccaaggtcgggacaaagaggtatatggcccctgagatgctggacgacaccatgaatgtcaatatttttgaaagttttaaacgcgccgatatctacagcgtgggtctcgtgtattgggaaattgcacgaaggtgttcagtcggagggatcgttgaggagtatcaacttccctattatgacatggtcccgtccgatccctccattgaagaaatgaggaaggtggtttgtgatcagaaatttagaccctcgatacctaatcaatggcagtcttgcgaagcgctgcgcgtcatgggaaggatcatgcgagaatgctggtacgcaaacggcgccgctcgcctgacagcactgcgcatcaagaagaccatttcccaactctgtgttaaggaggattgtaaggcttag

SEQ ID NO: 177832 - DNA, 1242 bp, Artificial Sequence
  Description of Artificial Sequence: Synthetic coding sequence
atgacccgggccctgtgcagcgccctgcggcaggccctgctgctgctagctgcggcagcagagctgtcacccggtcttaagtgcgtgtgtttactctgcgacagttcaaattttacctgtcaaacagaaggcgcctgttgggcttctgtcatgctcacgaacggcaaagaacaggtaattaagagttgcgtatccctgcccgagctgaatgcgcaggttttttgtcacagctcgaacaatgtcacgaagaccgagtgctgctttacagatttttgtaacaacatcaccctacatctgcctacaggactgccactcctggtacaacggactattgctaggaccatcgtgcttcaggagatcgttggcaaaggacgttttggcgaggtgtggcatggtagatggtgtggtgaggatgtggccgtgaagatcttttcttctagggatgaacggtcctggtttcgggaagcagagatataccagacagtgatgctgcgccacgagaacatcttggggtttatcgctgctgacaacaaagataacggaacgtggactcaactgtggctggtttctgaatatcacgaacaaggttccttgtatgactatctgaacagaaacattgtaacagttgccggaatgataaagctcgccctgtccatcgcctctggcctcgcccatcttcatatggagatcgtgggcacgcagggtaaaccagccatcgctcaccgggacattaagtcaaagaatatcttagttaagaagtgtgagacctgcgctatagcagacctcggcctggccgtgaaacacgactcaatactgaataccatcgacataccacagaatcccaaagtcgggacaaaacggtacatggccccagaaatgttagacgacactatgaacgtgaatatctttgaatcattcaaaagggcggatatctattccgttggcctggtatactgggagattgccaggagatgttctgtgggagggatcgtggaggagtatcagttgccgtattatgatatggtaccatcagatcctagtattgaagagatgagaaaggtggtttgtgatcaaaagttcaggcccagcataccaaaccaatggcaaagttgcgaagccctcagggtcatgggccgcataatgagggaatgctggtatgccaacggagcagcccggttaacagcgctccggatcaagaagactatctcccagctatgtgttaaggaggattgcaaagcctag

SEQ ID NO: 177833 - DNA, 1011 bp, Artificial Sequence
  Description of Artificial Sequence: Synthetic coding sequence
atgacccgggccctgtgcagcgccctgcggcaggccctgctgctgctggcagctgcggcagaactgtcacccggcctgaagtgcgtatgtctattgtgtgactctagcaacttcacttgtcagaccgagggagcatgttgggcctcagtgatgttgaccaacggaaaggaacaggttattaagtcatgcgtctctctgcctgaactgaacgctcaggtgttctgtcatagttccaacaacgtgaccaaaacagagtgctgtttcaccgacttttgtaacaatataacactgcacctgcctaccgataacggcacttggacacaactgtggttggtatcagagtaccacgagcaaggctcactctacgattacctgaacaggaatatcgtgacagtggcaggcatgatcaagctggcactgtctatagccagtggtttggcacacctccatatggagattgttggaacccaaggaaaacctgcgattgcccaccgcgacattaaaagtaagaacatacttgtcaagaagtgcgagacctgcgccattgcagacctgggacttgctgtgaaacatgacagcattcttaatacaattgacatcccccagaacccgaaagtagggaccaaacgctacatggcaccagaaatgctggacgataccatgaacgtgaacatatttgagtctttcaaacgcgcggatatctactcggtgggcttagtgtactgggagatcgccaggcgatgttctgttggaggtatcgtggaagaatatcagctgccgtattatgacatggtgccatcagatccatctatagaggagatgcggaaagtcgtgtgcgatcagaaattccgcccatcgatcccgaatcaatggcagtcttgcgaggccctgagggtgatgggacgaattatgcgcgaatgttggtatgccaatggcgccgcccgcttgaccgcactgaggatcaaaaaaacaatctctcagctgtgtgttaaagaagactgtaaagcatag

SEQ ID NO: 177834 - DNA, 1542 bp, Artificial Sequence
  Description of Artificial Sequence: Synthetic coding sequence
atgggcgccgccgccaagctggccttcgccgtgttcctgatcagctgttcaagcggagctatactgggccgtagtgagacacaggaatgcttatttttcaacgccaattgggagaaagatcggaccaatcagaccggcgttgagccttgctacggcgataaagataaaagacgacattgttttgctacctggaagaacatcagcggctctatcgagatagtaaaacagggatgttggcttgacgatattaattgttacgatagaacggactgcgtggaaaagaaagactctccggaagtttacttctgctgctgcgagggaaacatgtgcaatgagaaattctcatacttccctgagatggaagtgacccagcctacaagtaatcccgtgacgcctaagcccccatattataacatactgctgtatagtctcgtgcctttaatgctcatagcaggaattgtaatttgcgccttttgggtttaccggcaccacaagatggcctatccgcctgtgttggtcccaacacaggatcctggtcctcccccaccttctcccctcttaggactgaagcccctgcaactgctcgaggttaaagcgcgcgggcgatttggatgtgtgtggaaggcgcaactgctcaacgagtacgtcgcagtcaagattttccccatccaggacaaacagagctggcagaacgagtacgaagtttactcactacccggcatgaagcacgagaacatcctccaatttatcggcgcggagaagcggggcacatctgtagatgtcgatttgtggctgataaccgcgtttcatgagaaaggttccctctcggacttcctgaaggccaacgtggtgagctggaatgagctttgccacattgctgagactatggcccggggcttggcatacttgcacgaagatatacctggcctgaaggatggacacaaaccggctatctctcatagagatatcaaatcaaagaacgtgttactaaaaaacaatctgacggcctgtatcgcagatttcggcctagctctgaagtttgaggccgggaagtcagcgggagatacccatggacaggtgggcactagaagatacatggctcctgaggtcctagaaggcgcgattaactttcagcgtgacgcttttctgcgcatagatatgtacgccatgggcttagtactctgggagctggcctcaagatgtacagcggctgacggcccagttgacgagtacatgcttccgttcgaggaagagatcggccagcacccttcactggaggatatgcaggaggtggtggtccacaagaagaaacggccggtcctccgggattattggcaaaaacacgcaggaatggccatgctgtgtgagactattgaggaatgctgggaccatgatgccgaagctcgattgagtgccggttgtgttggcgagcggatcacccagatgcagagacttacgaacatcataaccaccgaagatattgtcaccgttgtgacaatggtgaccaacgtggacttcccccctaaggaatctagcctctag

SEQ ID NO: 177835 - DNA, 1542 bp, Artificial Sequence
  Description of Artificial Sequence: Synthetic coding sequence
atgggcgccgccgccaagctggccttcgccgtgttcctgatcagctgctctagcggagcaatactggggagaagtgagacccaggagtgcctgttctttaacgctaactgggagaaggatcggacaaaccagaccggcgtagaaccttgctatggagacaaggacaagaggaggcattgtttcgccacttggaaaaacatctcaggctccatcgagattgttaagcaaggttgttggctcgacgacatcaactgttatgatcgtacagactgcgtggagaagaaagactcccccgaggtgtacttctgttgctgtgagggtaacatgtgcaacgaaaaatttagctattttcccgaaatggaggtgacgcaaccaacgagcaaccccgtgacgccaaagcccccttattataacatcctgctgtactctctggtccctctgatgctgattgccgggatcgtgatctgcgcattctgggtataccggcaccataagatggcatatcctcccgttttggtgcccacacaggatccggggcctcctccaccaagcccgctgttaggtctgaagccacttcaactcctcgaggtcaaagcgaggggacgctttgggtgcgtgtggaaggcgcaactgctgaatgagtatgttgcggttaagattttccctatccaagataaacagtcatggcagaatgagtatgaggtgtattctctcccagggatgaaacatgaaaacattctccagtttataggcgcagagaagagaggaaccagcgtcgacgttgacctatggctgataacggcctttcacgaaaagggcagtcttagcgacttcctcaaggctaatgtggtttcttggaatgagttatgtcatatcgccgagactatggccaggggacttgcctacttgcatgaggatattcctggtcttaaggacggccataaacccgctattagccaccgggacatcaagtcaaagaatgtactgttaaaaaataatttaaccgcttgcatcgccgacttcggtctggcccttaaatttgaggccggtaaatctgccggagacactcacggccaggtggggaccagacggtatatggcccccgaagtcctcgagggggccattaacttccagcgtgatgccttcctgcgcatagacatgtacgctatgggcttagtactgtgggaactagcctccagatgtactgctgcggacgggccagtggacgagtacatgctgccattcgaggaggaaataggacagcacccctcactggaggatatgcaagaggtcgtagtacacaagaaaaaaagacctgtcctccgggattattggcagaaacacgccggaatggcgatgctctgtgagaccattgaagagtgctgggatcacgacgcggaggcccgcctcagtgctgggtgcgtgggcgagagaattacacaaatgcagcggctgaccaatatcattaccactgaagacattgtcacagttgttactatggtcacaaacgtggacttccctcccaaggagtcttccctttag

SEQ ID NO: 177836 - DNA, 1218 bp, Artificial Sequence
  Description of Artificial Sequence: Synthetic coding sequence
atgtgcaacgagaagttcagctacttccccgagatggaggtgacccagccgacttctaatcccgtcacacccaaaccaccatattacaatattttactatacagtctggtgccactgatgctgattgctggcatcgtaatttgtgccttctgggtatataggcaccataagatggcctatcctcctgtcttggtacctacacaagatcctggtccaccaccccccagtccgttactggggctcaagccactccagttgctggaggtcaaggctcgcggtagatttggctgcgtttggaaggcccagcttctgaatgagtatgtcgcagtgaaaatttttcctatacaggataaacaatcatggcaaaacgaatatgaggtttactcgctccccggcatgaagcatgagaacatactgcaatttataggagcagaaaagcggggtacatcagttgacgtcgatctgtggctgattactgcatttcacgagaaaggaagcctttccgacttcctcaaggcaaacgtggtcagctggaatgaactgtgtcatatcgccgagaccatggctagaggtctggcctacctgcacgaagacattcctggcctcaaagacggccataagccggccatttcccatagggacatcaaaagcaagaacgtgctgcttaaaaataacctgacagcctgtatcgctgacttcggccttgcccttaaattcgaagcagggaagtccgctggcgacacccacggacaagtgggaacaagaaggtatatggcaccggaagttctcgagggggccattaatttccaacgggatgcttttctgaggattgacatgtacgcaatgggcctggtgctctgggagctcgcatcacgctgtacagcggccgacggacctgtggacgagtatatgctaccatttgaggaggagatcggccaacacccaagtctcgaagacatgcaggaggtggtggtgcacaaaaagaagcgaccagtcttacgtgactattggcagaagcacgccgggatggcaatgctatgtgaaaccatcgaagagtgctgggaccacgatgccgaggccaggttatccgctggttgcgtcggtgagaggatcactcagatgcagcgcctcaccaacataatcaccaccgaagacatcgtcactgtggttaccatggtcactaatgtggacttccctccaaaggaaagttctctatag

SEQ ID NO: 177837 - DNA, 1539 bp, Artificial Sequence
  Description of Artificial Sequence: Synthetic coding sequence
atgaccgccccctgggtggccctggccctgctgtggggcagcctgtgtgccggttccggaagaggggaagccgagacaagagagtgcatttattacaatgctaattgggaactcgaacggacaaatcaatccggcctggaaagatgtgagggcgaacaggataaaagacttcattgctatgcatcttggcgtaactcgtccggaactatcgagctcgttaagaagggctgttggctcgacgattttaattgctatgaccgacaggagtgtgttgcgacagaagagaaccctcaggtctacttttgctgctgtgaaggcaacttttgcaacgagcggttcactcatctccctgaagcaggcggtcccgaggtcacatacgaaccaccgccgaccgcaccaactcttctgaccgtactggcttactctttattgcctataggtggtctgagccttattgtactgttggcgttttggatgtacagacatcgaaaaccaccttacggacacgttgacatccatgaggacccaggccctcccccaccctcccctctggtaggcctgaagccgctgcagcttttggagataaaggcaagggggagattcggctgcgtgtggaaagcacagcttatgaacgactttgtagctgtcaaaatatttccgcttcaagataagcaatcttggcagtcagagagggaaatttttagcacacccggaatgaagcacgagaacctgctgcagttcattgcagccgagaagaggggatccaacctcgaagtagaactttggctgatcaccgccttccatgacaaaggaagcttaaccgactacctcaagggtaacattatcacttggaatgagctttgtcatgtcgctgagacaatgagtaggggactcagttacttacatgaggacgtcccgtggtgcaggggggagggccacaagccgagtatcgcccaccgggactttaaatccaagaacgtgcttcttaaatctgacctgaccgccgtcctcgccgacttcggcttggcggtgagatttgagccaggcaaaccaccaggcgacactcatggtcaggtgggcactcgcagatacatggccccggaagtgctggagggcgcaattaacttccagagggacgcatttttaagaattgatatgtacgccatggggctcgtgctgtgggaactcgtgtcacgatgcaaggccgctgatggccctgtagatgagtacatgctcccctttgaggaagaaatcggacagcatccttcgctagaggagctccaggaggtcgtggttcacaagaaaatgcgacccactattaaagaccactggctcaaacacccaggtcttgcccagctctgcgtgacaattgaagagtgctgggaccatgacgcagaagctaggctcagcgccgggtgtgtagaggaacgagtgtcgctaattagacgcagcgttaacgggacaacaagcgattgtctcgtttctctcgtgacctcagtgacaaacgtcgatctccctccaaaggaaagttcgatctag

SEQ ID NO: 177838 - DNA, 1191 bp, Artificial Sequence
  Description of Artificial Sequence: Synthetic coding sequence
atggagctggaccaccggaccagcggcggcctgcacgcctaccccggcccccgtggaggtcaagtggcgaagccaaacgtgatcctgcagattggtaagtgcagggccgagatgctggagcacgttcggcgaactcatcgccacctcctggccgaagttagcaaacaagtggaaagggaactgaaagggctccatcgcagtgtgggcaaactagaatccaatctggatggctacgtgcccacaagcgactcccagaggtggaagaaatcgatcaaggcctgtctgtgtcggtgccaggagactattgccaacctcgaaaggtgggtgaaacgagaaatgcacgtttggcgggaggtgttctataggctcgaacgatgggccgataggctcgaaagtacaggagggaagtaccccgttggctctgaatccgcgaggcacaccgtttcggtcggagtaggcggtcctgagagctattgccacgaagcagacgggtacgattatacagtcagtccctatgccatcacacccccacctgctgcaggagaacttcctggacaagagccagccgaggctcagcagtaccagccttgggtgcctggagaggacggtcaaccctcgccgggggtggatactcagatcttcgaggatccacgggagttcctttctcatttggaggaatacctgcgtcaagtgggcgggtccgaagagtactggcttagtcagatccagaatcacatgaatggcccagccaaaaagtggtgggaattcaaacaaggctctgtgaagaattgggtggaatttaaaaaagagtttctacagtattctgagggaactctgagtcgcgaggctatccaaagggaactcgatcttccccaaaagcagggggaacccctggaccaatttctatggcggaagagggacctgtatcagaccctgtatgtggacgcagacgaggaggagattatccagtacgtggtgggaactttgcaaccgaaactgaaacgattcctcagacaccccttaccgaagaccttggaacagttgatccagcgtggtatggaagtacaagatgacctcgagcaggcagctgaaccagccgggcctcaccttccggtagaagacgaagctgaaacgctgactcctgcaccgaattcggagtcagttgccagtgataggacgcagcctgagtag

SEQ ID NO: 177839 - DNA, 1587 bp, Artificial Sequence
  Description of Artificial Sequence: Synthetic coding sequence
atggccgccgtgctgaacgccgagcggctggaggtgagcgtggacggccttacgctgtcacccgatcccgaggaaaggcccggcgcggagggggcacccctgctcccaccaccacttccccctcccagccctcctgggagcggaagagggcctggggcctctggcgaacagccagaaccaggtgaagccgctgcagggggcgccgccgaggaagcgcggagacttgagcaaaggtggggctttggcctggaggagctctacggtttggctctccgtttttttaaggagaaggatggtaaggccttccatcccacttatgaagaaaagttgaagctggtggccttgcacaaacaggtgctcatggggccctataatccagacacttgcccagaggtgggttttttcgacgtcctgggcaacgatagacggagggagtgggccgccctgggcaacatgtccaaggaggatgccatggtcgaattcgtcaaacttttgaacagatgctgtcaccttttctccacctacgtggcttcccacaagatcgagaaggaggagcaggaaaaaaaacggaaagaggaagaagagcgccgtagaagggaagaggaggagagagagagactccagaaggaggaagagaagcggaggagagaggaagaagaacggcttcgcagagaagaagaggagcggagacggatagaggaggaacggctgaggttagagcaacagaagcaacagataatggctgcattgaatagccagaccgccgttcagtttcagcagtatgcagctcagcagtatcctgggaattacgagcagcaacaaatcctgattaggcagctccaggaacagcattaccagcaatatatgcagcagctctatcaagtgcagttggcccagcagcaggccgcgttgcagaaacagcaagaggtggtagtggctggaagctcactccccaccagttcaaaagtcaacgcaactgtcccttctaatatgatgagtgtaaatgggcaggctaagacacatactgattcgtccgaaaaagagctggagcctgaagctgctgaggaggccctggagaacggccctaaggagtcccttcctgtgatcgccgccccatccatgtggacacgtccacagatcaaggacttcaaggagaagatccagcaagacgcagattctgtaataaccgtaggacggggggaagtggtaactgtgcgggttccaacacacgaagagggatcctatttgttctgggagttcgccactgacaactatgatattgggtttggcgtgtatttcgagtggaccgacagccccaatactgcagttagcgtacacgtgtctgagtcttccgatgatgacgaggaagaagaggaaaacatcggctgcgaagagaaggccaagaagaatgccaataaacccctcttagacgaaatcgtgcctgtgtaccgcagagactgccatgaggaagtgtatgccgggtcccaccaatatcctggaagaggtgtttaccttctgaagttcgataacagctactcgctatggagaagcaagagcgtttattacagagtctactatacccgttag

SEQ ID NO: 177840 - DNA, 2343 bp, Artificial Sequence
  Description of Artificial Sequence: Synthetic coding sequence
atgaagcccggcgccaccggcgagagcgacctggccgaggtgctgccacagcataagtttgatagcaagtcccttgaagcttatctgaatcagcatctgtctgggttcggcgccgagagggaggccaccctgaccatcgcccagtatcgcgctggtaagagcaatccgactttctatcttcagaaaggcttccagacatatgtgcttcgcaagaagcctcccggatcccttctccctaaggcacatcagatcgatcgcgaattcaaagttcagaaggcccttttttccattggctttccggttcccaagcctattctgtattgcagcgatacgtcagtaatcggtacagaattttatgtcatggagcatgtacaggggaggatctttagggacctaactataccgggattgtcacccgctgaacgctcagccatctacgtggctactgtggagaccctcgcgcaactacgcagtctgaacatacagagtctacaactggaaggttacggaataggtgccgggtactgcaagagacaagtgtccacttggactaagcagtatcaagctgctgctcaccaggatattccagccatgcagcaactgtccgagtggctgatgaagaacctcccagacaatgataacgaagagaatctaattcacggagactttagactcgataacatcgtgttccatccaaaagaatgtcgggtgatagctgtgctagattgggaactgtcgacaattgggcacccactcagcgacctcgcgcacttttcattattctatttttggcctcgcactgtgcccatgatcaaccaaggcagttattcagagaactccggaattccatccatggaagaattaatctctatctactgtcggtgtaggggaatcaacagcatcttgcccaactggaacttttttcttgcactctcttactttaaaatggctggcattgcacagggagtctattccaggtatctgctaggtaacaacagtagcgaagattcgttcctgttcgcgaacatcgtgcagcccttggctgagacaggactccagctgtccaagcgcacatttagcacagtcctgcctcaaatcgatactaccggccagttgtttgtgcagacacgcaaaggccaagaagtgttgataaaggtgaagcacttcatgaagcagcacattcttccagctgagaaggaagtcaccgagttttatgttcagaatgagaattcggtcgataaatggggcaagcctcttgtgattgacaagcttaaggagatggccaaagttgagggcctatggaatctgttcttgcctgccgtttcaggcctttcccacgtggactacgcactgattgctgaagaaacaggaaaatgctttttcgcgcccgacgttttcaactgtcaggctccagataccgggaatatggaggtcctccacctgtatggttctgaagagcagaagaagcagtggttggaacccctgctccagggtaacatcacctcttgtttttgcatgacagaacccgatgttgctagctccgatgcaaccaacattgagtgcagcatacaaagggatgaggatagttacgtgatcaacggaaaaaagtggtggtcaagtggcgcaggtaaccccaagtgcaaaatcgcaattgtgcttggccgaacacagaacacctctttgtccaggcataagcaacactccatgatcctggtacccatgaacacccccggcgtgaagataatccggcccctgtctgtgtttgggtatacagataactttcatggaggacatttcgagatccactttaaccaggtccgggtgccagccacaaatctgattttaggagaggggcgcggattcgagatttcacaggggagactgggccccggtcgcattcatcattgtatgaggacagtgggtttagccgagagggctttgcagattatgtgcgaacgggctacccagcggatcgcttttaagaaaaagttgtatgcccacgaagtcgttgcccattggattgccgagtcgcgcatcgccattgaaaaaatccgtctccttacccttaaagccgctcattctatggacaccctgggatcggccggcgccaaaaaagagatcgctatgataaaagtagcagccccaagggctgtttctaagatcgttgactgggccatccaggtgtgcggcggggccggcgttagccaggactatccactcgccaacatgtatgccatcactagggttctgaggctcgccgacggcccagatgaagtccacttatccgctattgcgaccatggaactgcgggaccaagctaagaggttaaccgcgaaaatctag

SEQ ID NO: 177841 - DNA, 2031 bp, Artificial Sequence
  Description of Artificial Sequence: Synthetic coding sequence
atgaagcccggcgccaccggcgagagcgacctggccgaggtgctgccccagcacaagttcgattccaaatcactggaggcatacctgaaccagcatctctctggttttggggccgagcgcgaggccaccttaactatcgcccagtatagagcaggtaaaagcaatcccacattctatcttcagaaagggtttcaaacatacgtgttgaggaagaaaccgcccgggagtctgctgccaaaagctcaccagattgatcgcgagtttaaagtacagaaagcactcttctctatcggttttccggtgcctaagcctatcctctactgctccgatacttctgtgattggcacagagttttacgtaatggaacatgtacaggggcggatcttccgagacctcactattccaggcctgagtccagctgagaggtctgccatctatgtcgcgacagtggaaacccttgctcagctgagatcgctgaatattcaatccctgcagctggaaggttacggtatcggggctggatactgcaagaggcaggtttccacgtggactaagcagtaccaggcagccgcgcatcaggacatacctgccatgcagcaactgtcagagtggctaatgaaaaatcttccagacaacgataatgaggaaaatcttatacacggggacttcaggttagataatattgtattccatccaaaggagtgtagagtgatcgctgtattggactgggagctcagtacgatcggccatcctctgagtgatcttgcccatttttccctgttctacttctggccgcgaactgtgcctatgatcaaccaggggtcatactcagagaacagtggaattccaagcatggaggaattgattagtatctactgcagatgtcggggaattaattcaattctgccaaactggaactttttcctcgcacttagctattttaaaatggctggtatcgctcagggcgtctacagcagatacctgcttggcaataattcctccgaggattcattcctcttcgccaatatagtgcagccactggccgaaaccgggctgcagctgagcaaaagaacattttccacagtgcttccccagattgacacaactggccagctgtttgtccagacgcggaaagggcaagaggttctcatcaaggtgaagcatttcatgaaacagcacatcttgccagccgaaaaagaggtgactgagttttacgtccagaacgagaactccgttgataaatggggtaagcctctggtcatagacaaactaaaagaaatggcgaaggtcgagggcctctggaatctgttcttacccgcggtgtctggactgtcgcatgtcgactacgccctgatcgccgaagagactggcaaatgtttcttcgcacccgatgttttcaactgtcaagctccagacacaggcaacatggaggtgctgcatctctacggcagcgaagaacaaaagaaacaatggctcgagcctctccttcagggtaatattacgtcttgcttctgcatgactgagcctgatgtcgcctcatctgacgctacaaacattgagtgttcaatccagcgcgacgaagacagttatgttattaacggaaaaaagtggtggtcatcaggggccggaaaccctaagtgcaagatcgcaatcgtccttggccgtacccagaacacgtcactatcccgtgaagtcgttgcgcattggattgccgagagcagaattgccatcgaaaagatacgactgctgactctgaaggccgcgcattccatggatactctgggatctgccggcgcaaagaaagagatcgctatgattaaagtagctgctcccagagcagtgagcaaaatcgtagattgggcaatccaggtgtgtggtggggctggcgtgagccaggactatccccttgctaacatgtatgcgattacgcgagtgcttcgcctggcagatggcccggatgaggtgcatctttccgccatcgctaccatggaactgcgggatcaggctaaaagactgaccgccaagatctag

SEQ ID NO: 177842 - DNA, 918 bp, Artificial Sequence
  Description of Artificial Sequence: Synthetic coding sequence
atggaggtgctgcacctgtacggcagcgaggagcagaagaagcagtggctggaaccgctcctgcagggtaacatcacaagttgtttttgcatgaccgagcctgacgtcgccagtagtgacgccaccaacattgagtgctcgattcaaagggatgaggactcatacgttatcaatgggaagaagtggtggtctagcggggccggtaatccgaagtgcaagatcgcaatagtcctggggcgaactcagaatacttccctaagccggcataagcagcacagcatgatcctggtgcccatgaacacccccggcgtaaaaattatcagaccattaagcgtgtttggctataccgataacttccatggaggccacttcgaaattcatttcaaccaggtgagagttcctgccacaaatcttatcttaggcgaaggccgcgggtttgagataagccagggaaggctggggccaggtcgaatacatcattgtatgagaacggtcggcctggcggagcgcgctctccaaattatgtgtgagcgcgccacccagcgaatcgcgttcaaaaagaagttatacgcccacgaagtggtggcccactggatcgccgagtctagaatcgccatcgagaagatccgtctcctgacattaaaggctgcacactccatggacactcttggttccgctggggctaagaaggagattgctatgattaaagttgccgcaccgagagccgtgtctaaaatcgtagattgggcaatccaggtatgcggtggggcgggagtgagccaagactaccctcttgcaaatatgtacgccatcacgcgagtcttgcgactggctgatggaccagacgaggtccacctgtctgccatagctacaatggagcttagggaccaggctaagcgccttaccgctaagatatag

SEQ ID NO: 177843 - DNA, 1248 bp, Artificial Sequence
  Description of Artificial Sequence: Synthetic coding sequence
atgctgtggagcggctgccggcggttcggcgcccggctgggctgccttcctggggggctcagagtgctcgtgcagacaggtcacaggtccctgacctcttgtattgatccatcaatgggactgaacgaggagcagaaggaatttcagaaggtagcctttgacttcgccgcacgagaaatggcacccaatatggctgaatgggaccagaaagaactgtttcctgtcgacgttatgcggaaggctgcccaattaggattcggtggcgtgtatatccagactgacgtgggcgggagcggactgagcagattagacaccagcgtcatctttgaggcacttgccaccggctgtacctctactaccgcatatataagtatccacaatatgtgcgcctggatgatcgactcttttggaaacgaagagcaaagacacaaattctgtccccctctttgtaccatggaaaagtttgcctcctactgtctcaccgaacccggatctgggagcgatgcagcctctctcctgacctctgccaagaagcagggagatcattatatcctaaacggcagtaaagcgttcatttctggcgccggggaatccgatatctatgtcgttatgtgtcgaaccggcgggccgggacccaagggcatatcctgtattgttgttgaaaaggggacccctggtctcagttttgggaagaaggaaaagaaggtgggttggaatagccagccgaccagggccgttatctttgaagattgtgctgtcccagtggcaaaccgcattggcagtgaaggccaggggttcctgatcgctgtgcgcgggttaaacggcggaaggatcaatattgcttcatgctccttgggcgcagctcatgcctccgtgatcctgacacgggaccatctcaacgttaggaagcagttcggtgaacctctggcgtccaaccaatatctgcaatttactctggcggacatggcgacgcggctcgtcgccgcgcgtctcatggtcagaaacgctgcggtcgcactgcaagaagaacggaaagacgccgttgcgctctgctccatggctaaacttttcgctactgacgaatgctttgctatatgcaaccaggccttgcaaatgcatggggggtatggctatctaaaagattacgccgtgcaacagtacgtacgagactcccgggtacaccaaattctggagggcagcaacgaggtgatgcggattctaatatcccggagtctgctgcaggaatag

SEQ ID NO: 177844 - DNA, 1074 bp, Artificial Sequence
  Description of Artificial Sequence: Synthetic coding sequence
atgcggaaggccgcccagctgggcttcggcggcgtgtacatccagactgatgtagggggtagcgggctttcccgactggacacatccgttattttcgaggcgctcgccactgggtgtacctcaacaacggcttatattagcatccacaatatgtgtgcctggatgattgactcctttgggaacgaggaacagcgccacaagttttgtcccccattgtgtacaatggagaagttcgcatcatactgcctgacagaacctgggtctggctcggatgcagcatctttgctgacatctgctaagaagcaaggagatcactacatccttaacgggtcaaaggcctttatcagtggagctggcgagagtgacatctatgtggtgatgtgtcggacggggggccccggaccaaaggggatctcctgcatcgtagtggaaaaggggactccaggactgagcttcggcaaaaaggaaaaaaaggtgggctggaacagtcaacctactagagctgtgatctttgaggactgcgccgtccccgtggccaaccgaattggctcagagggccagggattcctgatagccgtgcgaggcctaaacggaggacggataaacatcgcgtcatgctctctcggagccgcccacgcatcagtcattcttacgcgcgaccacctgaatgtgcgaaaacagttcggcgaacccttagcttctaaccagtacctgcagtttaccctggccgatatggccaccaggttggtggctgctcgactgatggtccgaaacgccgctgtggctctgcaagaagagcgcaaagatgcagtagccttatgcagcatggcaaaactgttcgcgactgacgagtgctttgctatttgtaaccaggctttacaaatgcacggcgggtatggctacctgaaagactatgccgtgcagcagtacgtgagagacagtcgcgtgcaccaaatcctcgaggaactgttctggcagggtcctggggtgcagagccgaagctttgttcctttcgggggcccccagattgcattgctattgccatttagcagtggagatctgagagagggctag

SEQ ID NO: 177845 - DNA, 819 bp, Artificial Sequence
  Description of Artificial Sequence: Synthetic coding sequence
atgggcctgaacgaggagcagaaggagttccagaaggtggccttcgatttcgccgcccgggagatggctccaaacatggccgagtgggaccagaaggaactgtttcccgtggatgttatgcgcaaggcagcgcagcttggattcgggggagtgtatatccagaccgacgtgggtggttcgggtttgagtcgactagatacaagcgtgatttttgaggccctggcaaccgggtgcacttctaccactgcatacatcagcattcataacatgtgtgcctggatgatcgacagtttcgggaacgaggaacagagacataagttctgtccgcccctgtgcactatggaaaagtttgcttcctattgcctcactgaacctggttcagggagtgacgcagcgagtctgctgaccagcgcaaaaaagcagggcgatcactatatcctgaatggatcaaaggcatttatcagcggagcgggcgaatctgatatttacgttgtgatgtgcaggaccggcggtcctgggcctaagggcatttcatgcatagttgtcgagaagggtactcccggacttagtttcggaaaaaaggagaaaaaagttggatggaacagtcaacctacccgggccgtcatctttgaggattgcgccgtgcccgttgccaaccgtatcggttcagaaggacaaggattcctcatcgccgtgcgaggtctcaatggaggccgtatcaatatcgctagctgttcccttggctgtcctcgtctctgtcaccctcacccaaggcctccccaatgtcccgaagcagtgtggcgagcttcagggcaatag

SEQ ID NO: 177846 - DNA, 681 bp, Artificial Sequence
  Description of Artificial Sequence: Synthetic coding sequence
atgaagagccggaagaacttcaagaagtggcccctgaccctgctgccagagcgctggctccagatctggcaatctggaacgcggagtatgtgtgcttggatgatcgacagctttgggaacgaggaacagagacacaagttctgtcctccattatgcaccatggagaagttcgcttcctattgcctgacggaacccgggagcggctccgatgctgcatctcttctcacctccgccaaaaaacagggggaccattacatcttgaacgggagtaaagcctttattagtggagctggggagtcagatatttacgtggtcatgtgccgtaccggagggccaggtcccaaagggatctcctgcattgtggttgaaaaggggacccctggcttaagttttggcaaaaaggaaaagaaggtggggtggaattcccaaccaacccgagcagtgatcttcgaggactgcgctgttcccgtagctaacagaataggaagcgaaggacaggggtttctcattgctgtaaggggattaaacggcggacgcatcaacatcgctagctgttccttaggagccgcacatgcaagcgttatcttaactagggaccatcttaacgttaggaagcaattcggcgagcctctggcatctaatcaaaaaaagcaggagacccttaaactgtggatcacctag

SEQ ID NO: 177847 - DNA, 1866 bp, Artificial Sequence
  Description of Artificial Sequence: Synthetic coding sequence
atgagcggctgcggcctgttcctgcggaccaccgccgccgcccgggcttgcagggggctggtggtaagcacagctaaccgtagattgcttcgcacgtcaccacctgtgagggcatttgccaaggagctctttctcggaaagatcaagaaaaaagaagtgttccccttcccagaggtatctcaagacgagctcaacgaaattaaccaatttttaggccctgtagaaaagttcttcactgaggaggtggacagcagaaagatcgatcaagaagggaaaatacccgacgagaccttagaaaagctcaaaagcctgggcctcttcggcctacaggtgcctgaagaatacggaggtttagggttctccaacaccatgtacagcaggctgggcgaaatcatctcaatggacggatcaataactgtaaccttggcagctcaccaggcaattggtctcaagggcatcatcttggctggtaccgaggagcagaaagccaagtatttaccaaaattggccagtggagagcatatcgctgcattttgtctcacagagcccgcttcagggtcggacgccgcgtcgattcgcagtagagccactctgtcagaggacaagaagcactatattcttaatggctctaaagtgtggataacaaacggcggtctggccaatatctttacagtgtttgctaagactgaagttgttgactccgatggaagcgtcaaagacaagattacagctttcattgtggaacgagatttcgggggcgtgacgaatggcaagcccgaggacaagctcggtatcagaggatccaatacatgtgaagtccacttcgaaaacactaagatccctgtagagaatatcctgggagaagttggtgacgggtttaaggtagccatgaacatcctgaacagcggacgatttagtatggggagtgtggttgctggcctcctcaaacggttgattgagatgactgcggagtacgcttgcactcggaaacaattcaacaagaggctgtcagagttcggcctaatacaggagaaattcgccctgatggcgcaaaaagcctatgtcatggagtcaatgacctacctcaccgctggtatgctggaccaaccaggatttcccgattgtagcatagaggccgcaatggtcaaagtattcagttccgaagctgcttggcagtgcgtctcagaggctctgcaaatcttaggagggcttgggtacacaagagattacccatacgaacggattttacgagatacccggattcttctgatttttgagggcacaaatgaaattttacgcatgtatatagcgttaactgggctgcagcacgccggtaggattctgacaactaggattcacgagctcaagcaggctaaggtgtcgaccgtcatggacaccgtgggacgacggctgcgagacagcctagggagaactgtggatctgggactgacgggaaatcacggggtcgttcacccatcactggcagactctgccaacaagttcgaggaaaatacatactgttttgggaggaccgttgagacactcctgcttcgcttcggcaaaactatcatggaggagcagctggtcttgaagagggtcgccaacattctgattaacttatatggtatgactgcggttctttcacgcgcatctcgctcaatacgcattggtttgcgaaaccacgaccatgaggtgctgctcgctaacactttttgcgtagaagcctacctgcaaaacctctttagcctgagccagttggataagtatgcccctgagaacttggatgaacagatcaagaaagtgtcacagcagatccttgaaaagcgtgcctacatttgtgcccaccctctagacaggacctgctag

SEQ ID NO: 177848 - DNA, 1467 bp, Artificial Sequence
  Description of Artificial Sequence: Synthetic coding sequence
atggacggcagcatcaccgtgaccctggccgcccaccaggccatcggcctcaaaggcatcattcttgcgggcacagaagagcagaaggccaagtatttacccaagttggcctccggcgagcacatagcggccttctgcctcactgagcccgcaagcggctctgatgccgcatccattaggagtcgagcgacactgtctgaggacaagaagcactatatccttaacggcagcaaggtatggataactaacggaggcttagccaacatatttactgtttttgccaaaactgaagtggtggacagcgatggatccgtcaaggacaagattactgcattcatcgtggaacgggactttggcggagtgacaaatggtaagcctgaggataagctggggattcgcggatcaaacacctgcgaagtccactttgagaataccaaaatccccgtggagaacattctcggtgaggtgggggatggcttcaaagtggcaatgaacatcttgaattccggaaggtttagtatgggctccgtggtggccggactccttaaacggctaatagaaatgacagctgaatatgcgtgcacacggaaacaattcaacaaacgtctgtcagaattcggactgatccaggagaaatttgcgctgatggcacaaaaggcctatgtcatggaatcaatgacctacctaacggccggcatgctggatcagccggggtttcctgattgctcgatagaggcggcaatggtcaaagtgttctctagtgaggcagcttggcagtgcgtgagcgaggcgctgcagattctcggcggcctgggctacactcgcgactacccatatgaacggatcctgagggatacaaggatcctcctgatattcgagggcaccaacgagattctcagaatgtatatcgcgcttacagggctccagcatgctgggagaattctgacgacacgtattcacgagctgaagcaggcaaaggtgagcaccgtgatggacactgtgggcagacgattaagggattctcttggtcgcacagtggatttgggcctgactggcaatcatggcgttgtccacccctcgctggcagacagtgcaaacaaattcgaggagaacacatattgcttcggcagaacagtggagactctacttttgagattcgggaagacaatcatggaagagcaactggttctgaagcgtgtcgctaatatcttaattaatctttatggaatgaccgccgttttgtctcgcgcctcgcgtagcatccgcatcgggctaagaaaccacgatcatgaagtgctcctggccaacacattttgcgtagaggcctatctccaaaatctctttagccttagccagctggataagtatgctcccgaaaatttggatgagcaaattaaaaaagtgagccagcagattttggaaaagagggcctacatctgcgcccatcctttggatcggacatgttag

SEQ ID NO: 177849 - DNA, 507 bp, Artificial Sequence
  Description of Artificial Sequence: Synthetic coding sequence
atggaggagcagctggtgctgaagggcggccagcacccccaccagcctgtctggcacgatggacgcgccgtggccggccagcctctgcatccccactgggccccccagccccgtccccggggctcactggggcagcacctgctccgaggatcactgctggctgagagtttacagccactgagtgccggtcaggtgtgcagtcgcaaaccgcggtccaggttgcgcaaatgcccatcccggagtctaagaagtgagcctatttccgtgccaactctttggacaggccacgccgagagggggcagtgccccctgcttccacctgccccaacccatggccccttgttagacgactgttattcattcttcaggcgtctaggccttagtcaggtcaagccttttgtaccccgactgcatctcaaagggtgtcgtctagcctgggaaagtttgtttcaggtgttgacctgccggcagtgtagtctgacaggccctagccagctcctgaactag

SEQ ID NO: 177850 - DNA, 1239 bp, Artificial Sequence
  Description of Artificial Sequence: Synthetic coding sequence
atggccgccgccctgctggcccgggccagcggccccgcccggcgggcgttgtgccccagggcttggcgtcagctacatacaatctaccagtccgtggagctgcccgaaacccaccagatgctgctgcagacatgtcgggattttgccgaaaaggaactcttccctatagctgctcaagttgacaaggagcatctgttccctgctgcccaggtgaaaaaaatgggaggcctaggactcttggccatggatgtgccagaggagcttggtggtgcgggcctcgactacttagcctacgctattgccatggaggaaatttccagggggtgcgcgagcacaggcgtaataatgtccgtgaataactcactgtacttaggcccaatcctgaagtttggcagcaaagagcagaaacaggcatgggtgactccctttactagcggcgacaaaataggctgtttcgccctgtctgagcccggcaatgggtctgatgccggagcggcgagcaccaccgcccgcgctgaaggcgacagctgggtgctcaatgggacaaaagcttggattacgaatgcttgggaagcaagcgcggccgtggtgttcgcatccaccgaccgtgccctgcaaaataagggtatttctgcttttctagtcccaatgcccactccagggctcactcttggcaagaaggaggataaactggggattcgaggaagctccacagcaaatctgatattcgaggactgcagaatccccaaggatagcattttgggtgaacccggcatgggcttcaaaattgctatgcagaccctggacatgggacggatcggaattgcctcccaggctctaggcatagcccagactgccttggattgtgctgtgaactatgcggagaatcgcatggccttcggagctcctctcacaaaactgcaggtgatacagtttaagcttgcagatatggcactcgcacttgagagcgcaaggcttctgacctggagagctgccatgctcaaagacaacaaaaaacctttcataaaagaggccgccatggctaagctggcagcctccgaggccgcgacggctatctctcatcaggctatacagattctgggggggatgggatatgtaacggagatgcccgcggagcgtcattatcgcgacgcgcgcataactgagatttatgagggaacctccgagatccagcgtctcgtcatcgctggtcacctcctgaggtcatacagaagctag

SEQ ID NO: 177851 - DNA, 1365 bp, Artificial Sequence
  Description of Artificial Sequence: Synthetic coding sequence
atggccgccggcttcggccggtgctgccgggtgctgcggagcatctcgagatttcactggaggagtcagcataccaaggcgaatagacagagagagcctggcctgggttttagctttgagttcactgaacagcaaaaagaatttcaggctaccgccagaaagttcgctcgagaagagatcatcccggtggctgcagagtacgataagaccggggaatatcctgtgccattgatccgccgcgcttgggagcttgggctgatgaatacccatatccctgaaaattgcgactatagcgtgtgtcccctattagaggcctgtactttatatttggacgctttttttcttctcttaactggcagcaacctgaacctgcacttaaacctgggtggactcggactggggacgttcgatgcttgtctcattagtgaagagctggcttacggctgcactggagtgcagaccgccattgagggaaactctctgggtcaaatgcccatcatcatcgctgggaacgatcagcagaaaaagaagtacctcggtcgaatgactgaagaaccactgatgtgtgcctactgtgtaactgagcccggggccggtagcgacgtcgccggtatcaaaacaaaggccgagaagaaaggggacgagtacattatcaacggccaaaaaatgtggatcactaacggtggcaaagccaattggtactttctcctagcgagatccgatcccgatccaaaggcccctgccaacaaggcctttactggattcatagtagaggccgacacacccgggattcagattggtcggaaggagcttaacatgggacagcggtgttctgacactaggggaatcgtgttcgaggacgttaaagtcccaaaggagaacgtgctaataggggacggtgcaggttttaaagtggccatgggagcattcgacaaaacgcgacctgttgtggctgctggtgccgtaggtctagcacagcgcgccttagatgaggccacaaaatacgcactcgaaagaaaaactttcggtaagctactggtggagcaccaagccatctctttcatgttagctgagatggccatgaaggttgagttggcacgcatgtcttatcagcgtgccgcctgggaagtcgacagcggccgccggaacacgtactatgcttcaatagccaaggcgttcgccggggatatcgcaaatcagctggccacagacgcagtacagattctaggtggtaacggctttaacaccgaatatcccgttgaaaaactcatgagagacgcaaaaatttatcaaatttacgaaggtacctctcaaatccaaagattaattgtcgccagagaacatattgacaagtataagaactag

SEQ ID NO: 177852 - DNA, 1266 bp, Artificial Sequence
  Description of Artificial Sequence: Synthetic coding sequence
atggccgccggcttcggccggtgctgccgggtgctgcggagcatcagccgttttcattggcgcagtcaacataccaaggccaacagacaacgggagcctgggttgggtttttcgtttgaatttaccgagcaacaaaaggagttccaggctaccgctaggaagtttgcaagggaagagattatccctgttgcagcagagtacgataaaactggcgagtaccccgttcccctgatccgacgggcatgggagctgggcttaatgaacacacatattcccgaaaactgtggcggcttgggattaggcacattcgacgcatgcctaatcagcgaggaactcgcctatggttgcaccggggtccaaacagccatagaaggaaattccctgggccagatgcccataatcattgctgggaacgaccaacagaagaaaaagtatctgggccgcatgactgaggaacctcttatgtgcgcttactgtgtgaccgagcctggtgccggcagcgacgtggcgggtatcaagactaaggcggagaagaagggtgacgagtacattatcaatggccaaaaaatgtggattacaaatggaggcaaggccaactggtacttcctcctggcaagatcagatcccgacccgaaggctcccgcgaacaaggcattcaccggatttattgtggaagctgatacccctggtatccaaatcggacggaaggagttgaatatgggtcagcgctgctctgacactcggggcatagtttttgaagacgtcaaggtgccaaaggagaatgtcctaattggcgacggggccggctttaaagttgccatgggcgcattcgacaagaccagacctgtagtggccgccggggcagtggggctggcgcagagggcgctggacgaggctaccaaatacgccctggaacggaagacctttgggaagttattggtcgagcatcaggctatttcctttatgctggcagagatggcaatgaaggtcgagttggctcgcatgtcttaccagagagcagcttgggaagtggattctggccgacgtaacacatattacgcctccattgccaaggcgttcgccggcgacatagcaaaccagctcgcaactgatgctgttcagatattggggggtaatgggttcaacactgagtaccctgtggaaaagttgatgagggatgcaaagatataccagatctacgagggcacatctcaaatccaacgtcttatagtggcccgggaacacatcgacaagtacaagaactag

SEQ ID NO: 177853 - DNA, 1278 bp, Artificial Sequence
  Description of Artificial Sequence: Synthetic coding sequence
atggccgccggcttcggccggtgctgccggtgcagcctgcaggtgttacgatccatctccaggttccattggcggtcccagcatactaaagcaaatagacagcgcgagccagggctcgggttttctttcgaattcacagagcagcaaaaagaatttcaggcaactgcacgaaagtttgctcgtgaggagattattcctgtggcagcggaatacgacaagacgggggagtacccggtcccactaattcgtcgggcatgggaactcggactaatgaatactcacattccagagaactgcggcggcttagggctgggcaccttcgacgcctgccttatatccgaagagctagcctatggatgcactggagtgcagaccgccatcgaaggcaactcccttggtcaaatgccaatcattatcgcaggcaatgaccaacagaagaagaagtacctcgggcgcatgacggaagagccccttatgtgtgcttactgcgtaacagagccaggggccgggtcagacgtggctggcatcaagaccaaagctgagaagaaaggcgacgagtacatcatcaacggacaaaagatgtggatcacaaacgggggcaaggcaaactggtactttctgctggcacggtcagatcccgaccctaaagctccggctaacaaagcctttactggcttcatagtggaggccgacactccaggaatccagattgggagaaaagaattgaatatgggccagagatgttccgatacccgggggattgtgttcgaagatgtaaaggtccctaaagagaacgtcctcattggcgatggtgctggttttaaagtggcgatgggggcattcgataaaacacggccagttgtcgctgctggggccgttggccttgctcagcgcgccctggacgaagcgacgaaatacgccctagaaagaaagaccttcggtaaactgctggtggaacaccaagccatctcattcatgctcgctgagatggccatgaaagtggaactggctcgtatgtcataccagcgggctgcgtgggaagtcgattccgggcgtcggaatacctactatgcttctattgccaaagcattcgccggggacatagccaaccagcttgcaaccgacgcggtgcagatcctgggcgggaatggtttcaataccgagtatcctgtggagaaactgatgcgcgatgccaagatatatcagatttatgagggcaccagccagattcagaggcttattgtggcaagggaacacatcgataagtacaagaattag

SEQ ID NO: 177854 - DNA, 1158 bp, Artificial Sequence
  Description of Artificial Sequence: Synthetic coding sequence
atgctgcaggagttcaccgagcagcagaaggagttccaggccaccgcccgcaagttcgctagggaggagatcatccctgtcgccgcggaatacgacaaaaccggagaatatccagtgcctcttatcagaagagcgtgggagctcggactgatgaacactcacatccctgaaaactgtgggggcctggggctcggcaccttcgacgcgtgtcttataagcgaagagttggcctatggttgtactggagtgcagacggcaatagagggcaactccttaggtcaaatgccaattattatcgcaggcaacgatcagcagaaaaaaaaatatcttggcagaatgaccgaggagccgcttatgtgtgcctattgtgtaaccgaacccggcgccggatctgacgttgcaggcattaagaccaaagctgaaaaaaaaggagatgagtacataattaacgggcaaaagatgtggatcactaacggcgggaaagccaattggtactttctcctcgccaggagtgaccctgatccaaaagcaccagcaaataaagcattcaccgggttcatcgtagaggctgacactcccggaatacagatcgggcggaaggaactgaacatgggacaacgatgctcggacacaagaggcatcgtattcgaggacgtgaaagtgcctaaggaaaatgttctgatcggcgacggtgccggcttcaaggtcgccatgggggctttcgataaaacacgccctgtggttgcggccggtgccgtgggcctggcgcagcgggctttagatgaggcaaccaaatatgcgctggagcggaaaacttttggcaaacttctcgtagagcatcaggctatctcttttatgctggcagaaatggctatgaaggtcgagctagctcgcatgagttaccagagagctgcctgggaagtggattctggtagacggaacacatactacgccagtattgccaaggcctttgctggcgacatcgccaaccagttggcaacagacgcagttcaaattttgggcgggaacggttttaataccgagtaccctgtggaaaagctcatgcgcgatgctaaaatctatcagatttacgaagggacgtctcagatccagaggctcatcgtggcaagggaacatatcgacaagtacaagaattag

SEQ ID NO: 177855 - DNA, 699 bp, Artificial Sequence
  Description of Artificial Sequence: Synthetic coding sequence
atgtggatcaccaacggcggcaaggccaactggtacttcctgctggcaagatcagaccccgatcctaaggcaccggccaataaagccttcaccgggtttatcgtggaagccgacactcccggcattcaaatcggccgcaaagaacttaatatggggcagaggtgttctgataccagggggatagtgttcgaggatgtcaaggttcccaaagagaacgtcctcataggagacggcgctggatttaaggtagctatgggcgccttcgacaaaacaagaccagtggttgccgcaggcgctgtcggcctggctcagcgcgcccttgatgaggccaccaagtacgctctcgagaggaagacctttggaaagctcctggtggagcaccaggcaatctcattcatgctcgccgagatggccatgaaggttgagctggcgcgaatgtcctaccagcgcgccgcgtgggaggtcgactctggccggaggaatacctattatgcatctatcgccaaagcctttgccggcgacatcgctaatcagcttgctaccgatgccgtccagatattggggggaaacggcttcaatacagagtacccagtcgagaagcttatgcgcgacgctaagatctaccagatctacgaaggaacttcacaaatacaacgcctgatcgtcgcacgcgaacatattgataaatacaaaaactag

SEQ ID NO: 177856 - DNA, 1446 bp, Artificial Sequence
  Description of Artificial Sequence: Synthetic coding sequence
atggacggcgccgtgatggagggccccctgttcctgcagagccagcggttcgggactaaaagatggcgaaagacctgggctgttctgtatccggcctccccccacggagtagcgaggctagaattcttcgaccataagggttcaagcagtgggggtggaagggggtccagtaggaggcttgattgtaaagtcatccggctggctgaatgcgtgtctgtcgcacccgttacagtggaaacaccccctgaaccgggagccactgcattccggttggataccgctcaacggtcccacttgctcgctgccgatgctccatccagtgccgcgtgggtgcagactctgtgtcgtaacgcctttcccaaaggcagctggacactggcgccaacagataatcctcctaaattgtctgcattagaaatgctcgagaacagtctgtattccccgacatgggaaggatctcagttttgggtgaccgtgcagcgaaccgaggcggccgagaggtgcggcctccacgggagctacgtcctccgagttgaggcagagcgactgaccctgctgaccgtgggtgcccaatcacagatccttgagccccttctcagttggccatatactctgttgaggcgctatggtcgcgataaagtgatgttcagttttgaggcaggcagacgatgcccatcaggccccggtacatttacctttcagactgcacaaggcaacgacatctttcaggcagtggaaactgccatccacagacagaaggctcaggggaaagctgggcagggtcacgacgtcctccgcgctgacagccacgagggtgaggttgccgagggaaaacttccgagccctcccgggccacaggaactcctggactcgccaccggcactgtacgcggaacctttggattccttgagaattgcaccatgcccatcccaggacagcctttactcggaccctttggattccactagtgcccaagctggcgaaggagtacagagaaaaaagcccctctactgggacctctacgaacacgctcaacagcaacttctgaaggccaagcttactgacccaaaagaggaccccatctatgatgagcctgaaggtctggccccagtgcctccacaggggctgtacgatctgccccgtgaacccaaggatgcttggtggtgccaggctcgggtcaaagaggagggatacgagttaccatacaaccccgcaactgacgattacgcggtacctccccccagatcaactaagccgttgctagcccctaaaccgcagggccctgccttccccgaaccgggaacggccacagggtctggaatcaaatctcacaacagcgccctatattcacaggtgcagaaatcaggcgcttccggcagttgggattgcggcctttcacgggtaggcaccgataaaacaggcgtaaaatccgaaggctccacttag

SEQ ID NO: 177857 - DNA, 1299 bp, Artificial Sequence
  Description of Artificial Sequence: Synthetic coding sequence
atggagggcctggccgtgcggctgctgcggggcagccggctgctgcgccggaattttctcacctgcctaagttcttggaaaattccacctcacgtcagtaaaagttcgcagtccgaggcactcctcaacattaccaataacggcattcattttgcacccctgcaaacatttaccgacgaggaaatgatgataaaatcttcagtgaagaaattcgcccaggaacagattgcccctctagtctccacaatggatgagaacagtaagatggaaaagtcggtcatccaggggttatttcagcaaggactgatggggattgaggtggacccggaatatggaggcacaggcgcgtcctttctgagcaccgtgctggttatcgaagagcttgccaaagtggacgctagcgtggccgtgttctgcgaaattcagaatacgctgataaatacactgatacgcaagcatgggacagaagagcagaaagctacttaccttccacagctgaccaccgagaaggtcgggtctttttgcctgtccgaggcgggagccggaagtgacagctttgccctgaaaacaagggccgacaaagagggcgactattacgtgcttaatggctctaagatgtggatttctagtgctgagcatgcaggcctcttcctggtgatggccaacgtggatcctaccatcgggtataaagggataaccagcttcctggtcgatcgggatacacccggactgcatatcgggaagcccgagaataaactgggcctgcgcgcatcctccacttgcccactgacttttgagaacgtgaaggtgccagaagccaatattctcggacaaatcggccacggatataaatatgccattggttcactgaacgaggggcgcattggcattgcggcacaaatgctgggtctggcccagggatgctttgattacacaattccctacatcaaggaacgaattcagtttggaaaaagacttttcgacttccagggcttgcagcaccaggtggcccacgtcgccacgcagcttgaagccgctagacttcttacctacaacgcggcccggttgctggaagctggtaagccgttcatcaaggaagccagcatggcaaagtactacgcttccgagattgccgggcaaaccacatctaaatgcatcgaatggatgggcggcgtggggtatactaaggactaccctgtggagaagtattttcgggatgccaaaattgggaccatctacgagggtgccagcaatattcagcttaacacgattgctaagcatatagacgcggaatactag

SEQ ID NO: 177858 - DNA, 993 bp, Artificial Sequence
  Description of Artificial Sequence: Synthetic coding sequence
atgggcatcgaggtggaccccgagtacggcggcaccggcgccagctttttgagcaccgtgcttgtcatagaggaattggccaaagtcgacgcttcagtggccgtgttctgtgagatccagaataccctgataaatactttgatcaggaaacatggaaccgaggaacagaaggctacatacctgccccaattaactacagaaaaggtcggttctttctgtctgtccgaggctggtgccggctcagattctttcgctctcaagacacgcgcagataaagagggagactactacgtcctgaatgggtcaaaaatgtggatctcaagcgccgagcacgccggccttttcctcgtgatggccaacgtcgacccaacaataggctataagggtatcacctcctttttggtggaccgcgatacccccggccttcacatcggcaaaccagagaataagctcggacttcgcgcctccagcacttgtccactgacatttgagaatgtcaaagtgcctgaagccaacattttgggccaaatcggccacggatacaagtacgccataggaagcctgaatgaaggcaggatcggaatcgccgctcagatgcttggcctggctcagggctgtttcgattataccatcccctacattaaggagagaatccagtttggtaaacgacttttcgactttcagggactgcaacatcaagtagcgcatgtggctactcagttggaggcagcacgcctactgacatacaatgccgcccgccttctagaggctgggaagccttttattaaggaggcatctatggcaaagtattatgcttccgagatcgcgggccagaccacctctaaatgcattgaatggatggggggggtaggttacacaaaagactatccagttgaaaaatactttagagatgccaaaatcggaacaatctacgagggcgcaagcaacatccagctaaacacaatcgctaagcacatcgacgcggaatactag

SEQ ID NO: 177859 - DNA, 1968 bp, Artificial Sequence
  Description of Artificial Sequence: Synthetic coding sequence
atgcaggccgcccggatggccgccagcctgggccggcagctgctgaggctagggggcggatcatctaggctgacggctttactgggccagcccaggccaggcccagcgcggcgaccgtatgcaggtggtgcagcccagctggcactcgataaatctgactcccaccccagcgacgcgctgaccagaaaaaagccggctaaggccgagagcaaatcttttgccgtcgggatgttcaaaggacagttgacaacagaccaggtatttccgtatccaagcgtgctgaatgaggagcagacacaattcctgaaggagctagtcgagcccgtttcacggttctttgaagaggttaacgatccagctaagaacgatgccttagagatggtggaagagactacctggcaggggttgaaggaactgggcgcattcgggctccaagtgccaagcgagctggggggcgtgggcctgtgtaatacgcagtatgccaggctcgtcgagatcgttggcatgcacgacctgggcgtgggcatcacactgggggctcaccagtcaataggttttaaagggatccttctgttcggaactaaggcacagaaggagaaatacctgcccaagctcgcctccggagagacagtggctgcattctgtctcacggagccctctagcgggagtgacgcggcgtccattcggactagcgctgttccatcgccctgcggaaaatattatacgctcaacgggtccaagctgtggatctctaacggagggctggctgatatattcaccgtgttcgccaagacgccagtcacagatcctgcaacaggtgctgtgaaggaaaaaattaccgcctttgtggttgagcgagggtttggcggtattacccacggccctccagagaagaaaatgggcattaaagcttctaacaccgccgaggtgttctttgacggcgtcagggtccccagtgaaaacgtgcttggagaggtgggcagtgggttcaaagtcgcaatgcatatcctgaataacggccgcttcggaatggccgccgcgctggcaggcacaatgcggggtataatcgctaaggccgtggatcatgctacaaataggacccagttcggggagaagatccacaatttcggactgatccaggagaagctagcccgcatggtcatgctgcagtatgtaacagagtccatggcctatatggtgtcagctaacatggatcagggtgccacagacttccagatcgaagctgcgatctcaaagatattcggaagcgaagccgcttggaaagtaacagacgagtgtattcagatcatggggggaatggggttcatgaaagaaccaggcgtcgagcgcgtgctgcgggatttgcggatcttccgaatattcgaaggaaccaatgacatcctgcgcctgtttgtggcactgcaagggtgtatggataaagggaaagagctgagcgggctggggtcagcactgaagaacccattcggtaatgctggactgcttctgggagaagccggcaaacagctcagacggagggccggactcggcagtgggttgagtctaagcggcctggtgcatcctgagctctcaagatccggggagctggccgtccgggccctggagcagtttgcaacagtggttgaagcaaaattaattaaacataaaaaaggtattgttaacgagcagttcctgctgcagagattggctgacggagctatcgatctatacgccatggtcgtcgtgctgtcaagggcgtctaggtctctgtcagaggggcatccaaccgcccagcacgaaaagatgctatgcgatacttggtgtatcgaagctgccgcaagaatcagagaggggatggcagccctgcagtccgacccctggcaacaggagctgtacagaaatttcaagtccattagcaaggccctggtggaacggggaggtgtcgtgacatcaaatcctttgggattctag

SEQ ID NO: 177860 - DNA, 1902 bp, Artificial Sequence
  Description of Artificial Sequence: Synthetic coding sequence
atgcaggccgcccggatggccgccagcctgggccggcagctgctgaggttgggcgggggcagttcacgcttaacggcgctgctggggcagccccggcccggacccgcccgtcgtccatacgcgggaggggcagcacaggaatccaagagttttgcagtgggcatgttcaagggccagctgacaacggaccaagtctttccctatccttccgtgttaaatgaagaacagacgcagttcctgaaggaactcgttgaacctgtaagtcgctttttcgaagaagttaacgaccctgccaagaacgacgcattagaaatggttgaagaaacgacatggcagggactgaaggagctcggtgctttcggcctgcaggtccctagcgaacttggcggcgtggggctatgtaatacccaatacgcccgactggtcgagatcgttggcatgcatgatctgggagtgggcattacactgggggcgcaccagagtatcgggttcaagggaatcctgctgttcggcacgaaggctcaaaaggagaagtatttacctaagttggccagtggtgagactgtggccgccttctgtttaactgagccatcctctggttctgatgccgctagtattcgtacttctgcggttccctccccatgtgggaagtactacacacttaacgggagcaaactgtggatctctaacggaggactggccgatatctttaccgtttttgcaaagacacccgtcacggatcctgctactggggccgtgaaagaaaagatcaccgccttcgttgtggaacgaggctttgggggaataacccatgggccacctgagaagaaaatgggaattaaggcctccaatacggccgaagttttttttgacggcgttcgagtaccttctgagaatgtgctgggggaagtgggcagcggctttaaagtggctatgcacatcctgaataatgggagattcggtatggcagcagccctggccgggaccatgcgggggattatagccaaggccgtggaccacgcaacaaatcgtacccagtttggggagaagatacataatttcggcctcattcaggaaaagctggccaggatggttatgttgcaatatgtaaccgagtccatggcctacatggtatcagcgaacatggaccagggcgctacagacttccagattgaggcagctatctctaaaatattcggcagcgaagccgcctggaaagtaacagatgagtgcatacagatcatggggggaatgggattcatgaaggagcccggcgtggagcgggtactgcgggatctccggatctttcgtatctttgaaggtacaaacgatattttaaggctgttcgtggcactgcaaggatgtatggataaggggaaagagctctccggcttggggagtgccttgaagaatccatttgggaatgcaggactcctcctcggtgaggctggcaagcagctacgccgccgtgctggactggggagtggcctgtcgctgagcggtttagtgcacccagaactgtctcggtcaggtgagctcgcagtccgtgccctcgagcaatttgcaactgttgtcgaggctaaactgatcaaacataagaagggtatcgtcaatgaacagtttcttctgcaacgccttgccgacggcgcaattgacctttatgctatggtggtggtcttatccagggccagccggagcttgtccgagggccatccaaccgcccagcatgaaaagatgttgtgcgacacctggtgtatcgaagcggctgcaagaattagagagggaatggcagccctccaaagcgacccttggcagcaggagctgtatcgaaatttcaaaagcatctctaaggccttagttgagcgcggcggagtggtgaccagcaacccactggggttctag

SEQ ID NO: 177861 - DNA, 2106 bp, Artificial Sequence
  Description of Artificial Sequence: Synthetic coding sequence
atgccccggggcccccagcccagcgccgcccggtgcaccgtggacgacgaatccggcctcggtgccccaggtcgcggcagagccggacgccagtcctgggtgcgtgctagggctagtggcgccagacgagattcagagatgcaggccgccagaatggccgcctcgctcggcagacaactgctgcggctgggagggggatcgtctcgtcttaccgctctgctagggcagcctaggcctggacctgccaggagaccatatgccggaggtgcagcccagctggcactcgataaatcggatagccacccatcagacgccctgactaggaagaagcctgctaaggctgagagtaagagcttcgccgtgggtatgttcaaggggcagcttacaacagaccaggtcttcccgtaccctagcgtcctcaatgaggaacagactcagttcctcaaagagctcgtggagcccgtttctcggttctttgaggaggttaacgaccctgctaaaaacgatgcactggaaatggtcgaggaaacgacctggcagggcctgaaagagctgggagcctttggactgcaagtcccatcagaattggggggggtggggctgtgtaacactcaatatgcaagattggtggagatcgtgggtatgcacgatctcggcgtcggaattaccctgggcgcccaccaatctattgggtttaaaggaattctactgtttggcacaaaggctcagaaagagaaatacctgcccaagttggcatccggtgaaactgtcgcagcattttgcttgactgagccctcttcgggatcagatgcggcttccattcgcacttctgcagttcctagcccatgtggaaagtactacaccctaaatgggtctaagctatggattagtaatgggggactggctgatatttttaccgtcttcgctaagacgcctgtaacagaccctgctaccggcgccgtgaaagaaaagatcacagcattcgtggtcgagagggggttcggaggcatcacccacggtccaccagaaaaaaaaatggggattaaagcctctaatacagctgaagtattttttgatggcgtgcgggtcccaagtgaaaatgttttgggtgaggtgggttccggatttaaggtcgcaatgcacatccttaacaacggccgctttggaatggccgccgccctggcaggtaccatgagggggataattgcaaaggcagtagatcacgcaactaatcggactcaattcggggaaaaaattcacaacttcggtctgatccaggaaaaactggccaggatggtcatgctgcaatacgttactgaaagcatggcgtacatggtctctgctaatatggaccagggcgcaacagattttcagatcgaagctgccatctctaaaatttttggttcagaggccgcgtggaaggtcacggatgagtgcatccaaatcatgggcggaatgggcttcatgaaagagcccggggttgaaagagtgcttcgtgatctccgcatcttcagaatctttgagggcactaatgacattctcaggctgttcgtggcactgcaggggtgcatggataagggaaaagaactatccgggctggggagtgccctaaaaaacccctttggtaacgccggattgcttcttggcgaggctggaaaacagctcaggaggagggccgggcttggttcagggctgtccctgagtggattggtgcacccagagctgtccagatcaggcgaattggccgtcagggcccttgaacagtttgccaccgtggtcgaagccaaattaataaagcacaagaagggcatcgtgaacgagcagtttctcctgcagcgcttagcagacggcgccatcgatctctatgctatggtggtggtcctgtccagggcatctcggagtctgagtgaagggcaccctaccgcccagcacgagaaaatgttgtgtgacacttggtgcattgaagcagcagctcgcattcgagagggcatggccgcattgcaatccgacccctggcagcaggagctatatagaaatttcaaaagtatctccaaggccttggtggagcgaggcggggtggtgacctctaaccccctgggcttttag

SEQ ID NO: 177862 - DNA, 2106 bp, Artificial Sequence
  Description of Artificial Sequence: Synthetic coding sequence
atgccccggggcccccagcccagcgccgcccggtgcaccgtggacgacgagagtgggctcggggctcccggtcgaggaagagcagggcggcagtcctgggtgcgcgcgagagcctccggagcaagaagagatagcgagatgcaggcagcgcggatggccgccagtctgggacgtcagttactgcggttaggtggcggatcttctaggctcaccgcgctgctcggccagccaaggccagggcctgcgaggagaccttacgctggcggcgccgcacaattagctctggacaaatctgactcgcacccttctgatgcacttaccagaaaaaaacctgcaaaagcggaatccaagtccttcgccgttggcatgttcaaaggacaactaaccaccgaccaggtgttcccctatccatccgtactgaacgaggaacagacacagttcctgaaagagctcgtagagccagtgtcccgatttttcgaggaagttaatgaccccgctaagaacgacgctctagaaatggttgaagagacaacttggcagggcctgaaagaactgggtgcttttggcctgcaggtccccagcgagctgggcggggttggactgtgcaacacacaatacgctcggctcgtggagatcgttgggatgcacgatctgggagtgggaatcacattgggagcccatcagtctattggattcaagggtattctgctttttgggactaaggctcagaaggagaagtacctgcctaaactggcctccggtgaaaccgtcgcagccttctgtttaaccgagccaagctccgggtctgatgctgccagtattagaaccagtgccgtgccatccccttgcgggaaatactacacattaaacggttccaagctatggatcagcaatggcggactggctgacatcttcactgtgttcgccaagacaccggtgacagacccggcgacaggcgccgtcaaagagaaaatcaccgctttcgttgtggagcgggggttcggtggaatcacgcatggtccacccgagaagaagatgggaattaaagctagtaacacagccgaggttttctttgacggagtaagggtccccagtgaaaacgtgcttggcgaggtaggatctggttttaaagtggccatgcatattctgaacaacggacggttcggaatggcagccgctctggcaggcacgatgcggggaatcattgccaaagccgtcgaccacgccactaaccggactcaattcggcgagaaaattcataattttggactgattcaggagaagctcgcccgcatggtcatgctgcagtatgtcacggaaagcatggcctatatggtgagtgcaaacatggaccaaggagcgacagactttcaaattgaggcagcaatctctaagatattcgggagcgaggcagcatggaaggtgactgacgaatgtattcaaattatgggagggatgggatttatgaaggaacctggtgtagagagggtcttgcgagacctgagaatttttcggatcttcgaaggcaccaatgatattctaagactgtttgtggccctccagggttgcatggataaggggaaggagctaagcggactcggcagcgcccttaaaaatccgtttggtaatgctggcttgctactcggtgaggctggcaagcagttgagaagaagagcaggcctcggtagtggcctcagcttgagtggcctcgttcaccccgaactgtctagatctggggagctggctgtcagggctttggaacaatttgccacagtggtcgaggccaagcttattaaacacaagaagggcattgtaaatgaacagtttctgttacaacggctcgctgacggcgcgatagacctctatgccatggtcgtcgttctgtcccgggcttctaggtccctttccgagggccaccctactgcccagcacgaaaaaatgctgtgtgatacctggtgtatcgaagctgccgcccgtattcgagagggcatggcagctcttcaaagcgacccatggcagcaggaactatataggaattttaaatcgatttccaaagcgctagttgagagagggggagtagtcacctccaacccgctgggtttctag

SEQ ID NO: 177863 - DNA, 2037 bp, Artificial Sequence
  Description of Artificial Sequence: Synthetic coding sequence
atgctgggcggcctggccgccgccgccggcacccggatcatgggcaaggagattgaggccgaggcccagaggcctctccgccagacttggcggccaggccagcccccagcaatgactgcgaaaactatgagttcacggctgacggccttattggggcagcccaggcccggaccagccaggcgaccttacgccgggggggccgcccagcttgcgttagacaagagcgactcgcatccaagcgatgccctgaccagaaagaaacccgccaaggccgaatcaaaaagcttcgcagtgggaatgttcaaagggcaactgactacggaccaggtattcccttacccttccgttctgaacgaggagcaaacccagttcctgaaagagctcgtggaaccagtcagcaggttttttgaggaagtgaacgacccagccaagaatgacgccctcgagatggtcgaggagaccacttggcagggcttaaaggaattgggcgctttcggcctccaagtgccctccgagctaggcggtgtgggtctatgtaacactcaatacgcccggttggtagagatcgttggcatgcacgatctaggcgtcgggattacattgggcgcccaccagtccattggatttaagggaattttgctgtttggaaccaaagcccaaaaagagaaatacctcccgaaactggcctctggggagacagttgccgcgttctgtctgactgaaccatcaagcggctcagatgccgcctccataaggaccagtgcagttcccagcccatgtggaaagtactacactttgaatgggtccaagctgtggatatcgaacggtggcctcgcagacatctttaccgtgtttgcaaaaacacctgtgaccgatccagccaccggcgccgtgaaagaaaagattaccgcttttgtagtggagaggggcttcggcggaatcacacatggaccgccagaaaagaaaatggggataaaggcctccaacactgctgaagtgttctttgatggtgtgcgagtgccaagtgagaatgtccttggagaagtcggctctgggtttaaagtggccatgcacattctgaataatgggaggttcgggatggctgccgctctggctggtactatgaggggcatcatagccaaagcagtggaccacgctacaaatcggacccaattcggggaaaagatacacaattttggacttatacaggaaaagctggctcgcatggttatgctacagtacgtgacagagtccatggcctacatggtgtctgccaacatggaccagggggccacagactttcagattgaagccgccatcagcaagatttttgggagcgaggcggcatggaaggttacagacgaatgtatccagattatgggcggaatgggcttcatgaaggagccaggcgtggagagagttttacgtgacctgagaatcttccgcatcttcgagggcactaatgacatactgcgcctgtttgtcgccctacagggctgtatggacaaggggaaagagctatctggccttggatctgccttgaaaaaccctttcggaaatgctggcctgctcctgggagaggccggcaaacagttgagacgacgagccggactgggctcaggtctatccctgagcggactcgtgcaccccgaattgtcacgcagcggggaactggccgtcagggcattagagcagttcgcgaccgtagtggaggcaaagctcattaagcacaaaaaaggcatcgtaaacgaacagtttctgctccaacgcctggccgatggtgcaatcgatctgtatgcgatggttgtcgtgctgagccgagcatctagatctttgtctgaagggcaccccactgcccagcatgaaaagatgctgtgcgatacatggtgcattgaggctgcggcaagaattagggaggggatggcagcactgcaatcagacccctggcagcaggagctctaccgtaattttaagagtatcagtaaagcactcgtcgagagaggcggggtggtcacctctaacccactcggtttctag

SEQ ID NO: 177864 - DNA, 1983 bp, Artificial Sequence
  Description of Artificial Sequence: Synthetic coding sequence
atgaaccccgacctgcggcgggagcgggacagcgccagcttcaacccagaactgctcacgcatattctagatgggagccctgaaaaaacgcgccgccggagggagattgagaacatgattctaaatgaccccgatttccagcatgaggatctcaacttcctgacaagatcgcagaggtatgaagttgctgtgcggaaaagtgcaatcatggtaaaaaagatgcgcgagttcgggatagctgaccctgacgagatcatgtggttcaagaattttgtccatcgtggtcggccggagccattggacctccatttagggatgtttctaccaacgttactccaccaggcaactgccgaacaacaggagagattcttcatgcctgcgtggaacctggaaattattggcacctatgcccagacagagatgggtcatggcacacacctcaggggcctggaaactacagctacttatgatccggaaacgcaggagttcatactgaattcccccacagtcacctccatcaagtggtggccaggagggttgggcaaaacttcgaatcatgctatcgtccttgcccagctgattactaagggcaagtgctatggcctgcacgcgttcattgtccccatacgtgagattggcacacacaagccccttcctggcatcactgtgggggatatcggacccaagtttggatatgacgagattgacaatggctacttgaagatggacaaccacaggatacctcgcgagaatatgctgatgaaatacgctcaggtaaagccggacgggacctatgtgaagcctctgtctaataagctgacttacgggacaatggtgtttgttcgtagtttcctcgtgggggaagccgcaagagccctctcgaaagcctgtactatagcaattcgttattcagcggtccggcaccagagcgagatcaaacccggagaacccgagccacagattctggactttcagactcagcaatacaaactgttccctcttctcgccactgcctatgccttccagtttgtaggcgcgtacatgaaagagacgtatcacagaattaatgaaggcattggccagggcgacctgagtgagctgccggagctgcatgccctgactgccggtctgaaggcctttacgtcctggacagcaaacacgggaatcgaggcttgtcggatggcctgtggggggcacggctactcgcactgctccggattgccgaacatttacgtcaattttacaccttcatgtaccttcgagggagaaaacaccgtaatgatgctgcaaacagcaagatttttgatgaagtcttatgaccaggtccactctggtaaactggtgtgcgggatggtttcttacctgaacgatttacctagccagaggatccagcctcagcaggtggcggtgtggcctaccatggtcgacatcaattctcccgagtctctgacagaggcctataaactgcgggcagcgagacttgtcgagattgcggcaaagaacctgcagaaagaagttattcaccgaaaaagcaaggaggtcgcatggaacctgacttccgtggatctggtgcgggcctccgaagcccactgccactacgtggtcgtgaagcttttcagtgagaaattgctcaagatccaggataaggccatccaagccgtgctgaggtcactttgtcttctctacagtttgtacggaattagtcagaatgccggtgacttcctccaagggtccatcatgaccgaacctcagattacacaggtgaaccagcgggtaaaggagctgttaacactgattcgttctgacgcagtagcactcgtggatgcttttgacttccaggacgtcaccttaggctctgtgctcggtcggtatgacgggaatgtgtatgagaacctgtttgaatgggctaagaactcaccattaaacaaagcagaggttcacgaatcctacaaacacctgaagtctctccagagtaagctgtag

SEQ ID NO: 177865 - DNA, 1983 bp, Artificial Sequence
  Description of Artificial Sequence: Synthetic coding sequence
atgaaccccgacctgcggcgggagcgggacagcgccagcttcaaccccgaattgctgacccacatcttggacggaagcccagaaaagacaagacggcgccgggaaatcgaaaacatgatcctcaacgatcccgattttcaacacgaggatctgaattttctaacaaggtcacaaaggtatgaagtggccgtgcggaagtcagctatcatggttaaaaaaatgcgagagttcggtatcgctgatcctgatgaaatcatgtggttcaagaagcttcacctggtaaatttcgtagaacccgtgggtctgaattactccatgttcatccccaccctgctcaatcagggcacaacagcgcaaaaggagaagtggctgttatcttccaaaggcctgcagatcatcggtacatatgcacagaccgaaatgggccacgggacacatctgcgcggactggagaccacagccacctacgatcccgaaacacaggagttcatcctgaattcccccaccgtgacgtccatcaaatggtggccgggaggccttgggaagacttcaaatcacgccattgtgctggctcaactcattactaagggtaagtgttacgggctgcacgccttcatcgtgccaattagggagattgggactcataaaccgctgcccggaatcaccgtgggcgatatcggccccaaatttgggtacgacgagattgacaatggctacttgaagatggacaaccataggatccccagagagaacatgttaatgaaatacgcacaggtgaaaccggatgggacctacgtgaaaccactcagtaataagctcacttacgggaccatggtgttcgtccggtcattcctggttggcgaggctgcgcgtgcactctccaaagcctgtaccatagccattaggtattctgcggtccgacaccagagcgagataaagcccggcgagcccgagccacagattcttgacttccagacccagcagtacaagctgtttcccctcctcgcgaccgcttatgcttttcaatttgtaggagcctatatgaaggagacctaccatagaataaacgaggggatcgggcagggggatctatccgagttgcccgagcttcacgctctgaccgccggcctcaaggcctttacctcttggacagcgaacaccggaattgaggcctgccgcatggcatgtggaggacatggatatagccactgttccggcctgccaaacatctatgtcaactttaccccgtcctgtacttttgagggggagaacacagtgatgatgctgcagaccgctcgattcctaatgaagagctatgaccaggtccacagcggcaagctggtttgtggcatggtcagctacctgaacgatcttccatcacagagaatccagcctcagcaggtggcagtgtggcccaccatggttgacattaactcccccgaaagcctgactgaggcatataagctgagagcggcaaggctcgtggagatcgctgcaaaaaatctgcagaaggaagtgattcacaggaaaagcaaagaagttgcatggaatttgacctcagtcgacctggtgagagccagcgaagctcactgccactacgttgtggtcaaattgttcagcgagaagctgttgaaaattcaggataaagccattcaagctgttttaagaagcctgtgcttgctttatagtctctatggcatcagccagaatgcaggagatttccttcaggggtccattatgaccgagcctcagataacccaggtaaatcaaagagtaaaggagcttttaacgcttatacggtctgatgcagtagccctcgttgatgccttcgatttccaagatgtgaccctgggttccgtgcttggacgctatgacgggaatgtatacgaaaatcttttcgaatgggcaaagaactctccgctgaacaaggcagaggtgcacgaatcttacaagcatttgaagtctctccagtctaaactgtag

SEQ ID NO: 177866 - DNA, 1869 bp, Artificial Sequence
  Description of Artificial Sequence: Synthetic coding sequence
atgatcctgaacgaccccgacttccagcacgaggacctgaacttcttgacacggagccagagatatgaggtggccgtgcgcaaatccgctatcatggttaagaagatgcgcgaattcggtatcgcagacccagatgaaatcatgtggtttaaaaattttgtgcaccgcgggaggccagaacccctggacttgcacctgggcatgtttttgcctacattgttgcaccaggcgaccgcagaacagcaggagagattctttatgcccgcctggaacttagagattatcggaacatatgctcaaacggagatgggtcatggaactcatctgagagggctggagacaactgccacatatgatccagagacgcaggagtttatcctgaattcccctactgtgacctcaatcaaatggtggccgggaggactaggtaagactagtaaccacgctatagtgcttgctcagttgattacgaaaggaaagtgctatgggctccacgcatttatcgtgcccattcgcgaaatcggaacacacaagcccctacccggtattaccgtgggcgatattggcccaaagttcgggtacgacgagatcgataacggctatctcaaaatggacaaccatcggatccctcgcgaaaatatgctcatgaagtacgcacaggtaaaacccgacggcacatatgtgaaaccactttcaaataagctaacatacggcaccatggtgtttgtgcgcagcttcctggtgggtgaggcagcccgggccctgtcaaaagcgtgtacaatcgctattagatactccgcagtccgccaccagtcagaaatcaaacctggagagcccgagccgcaaatcttggactttcagacccaacaatacaagttatttccgcttctggccaccgcatacgccttccaatttgtaggagcctatatgaaggaaacttaccatcgtattaatgagggtatcggacaaggtgacttatctgagctgccagagctccatgccctcacagcaggtcttaaagctttcactagctggacagccaacaccgggattgaagcgtgtcggatggcttgtggaggacatggctacagccattgcagtggcctgcccaacatatacgtgaactttaccccgtcatgcacttttgaaggagaaaatactgtaatgatgttacagactgccagatttttgatgaagtcgtacgatcaagtccactcagggaagctcgtttgtggaatggttagctaccttaatgatttgcccagtcaacgtatccagccccagcaggtcgctgtctggcctaccatggtggacattaatagccctgagtctttaaccgaggcctacaagctcagggctgccaggctcgtggagattgcggctaagaaccttcagaaagaagttatccacagaaagagcaaggaagtggcgtggaacctcacttcggttgatctagtacgagcctctgaggctcactgtcactatgtggtcgtaaaactctttagtgagaaattgctgaagatacaggataaagctatacaggcagtgctgaggagtctctgtcttctttactctctatacggaattagccaaaatgccggcgactttctgcagggctctataatgactgaaccgcaaatcactcaagtgaatcagcgagtgaaggaactgttgactctgattaggtctgatgcagtcgctctggtggacgcttttgactttcaggacgtcaccttaggatctgtgctaggtaggtatgatggtaatgtatatgagaacctgttcgagtgggccaagaactcccctttaaataaagctgaagtccatgaaagctacaagcacttgaagagtctccagtctaaactttag

SEQ ID NO: 177867 - DNA, 1779 bp, Artificial Sequence
  Description of Artificial Sequence: Synthetic coding sequence
atggccgccttcatccagcggacccccgacaactggcacctgcggccggacggaaatggccctcgatttgtgcaccgcggccgtccagaacctttggacctgcacctgggaatgttcctgcctacgctgctgcatcaggcaactgccgagcagcaggagcggtttttcatgccggcatggaatctcgagatcattgggacatacgcacagaccgaaatgggacacggcacccacctaagagggctcgagacaaccgccacatatgatcccgagacccaggagtttatactgaattcacctacagttacgagcatcaagtggtggcctggtgggttgggcaagacttccaatcatgcgatcgtcctggctcagctgatcaccaagggtaaatgctatgggttacatgcctttattgtgccgatcagagaaatcgggacccacaagccgctgcccggtattaccgtgggagatataggacccaagtttgggtacgacgaaatagataacgggtatctgaagatggataaccacaggatcccccgcgagaacatgctgatgaagtatgcccaagttaagcccgacggtacctacgtgaagccactctccaacaaactgacttacggtactatggtctttgtgcgctcttttctggtgggcgaggcggctcgcgccctctcaaaagcgtgtactattgcaatcagatacagcgccgtgcgtcatcagtccgaaattaagcctggcgagcccgaacctcagatcctcgattttcagacgcagcagtacaagctctttcccctgctcgccaccgcctacgcattccaattcgtgggcgcctatatgaaagagacctatcatagaattaacgaaggcatcggtcagggcgatcttagcgagcttccagaactgcatgcattgaccgcgggcctcaaagcctttaccagttggacagccaataccggtattgaagcctgtcggatggcatgcggcggacatggctatagccattgctcgggcctccccaacatttatgtcaatttcacaccgtcatgtaccttcgagggagagaataccgttatgatgctccagaccgctcggtttctgatgaagtcttacgatcaggtacactctggcaagctggtgtgtggaatggtttcgtatcttaacgatcttccgagtcagcgtatccagcctcaacaggtggccgtgtggccaacgatggtcgatatcaattctcctgaatcactgacggaggcctacaagttgcgcgcggcacgcttagtggaaatcgccgctaagaatctacagaaagaagtgattcacaggaaaagcaaagaggtcgcatggaacctgacaagcgtcgacctggtgcgcgcttcggaagcacattgccactacgtggtggttaagctgttctctgaaaagttacttaagatccaggataaggccattcaggcagtgctgagatcactatgtctgctctacagcctctacggaatttctcagaacgctggagatttcctgcagggatctattatgactgagccccagattactcaggttaatcagcgagttaaagaactcctcactctgatcagaagtgatgcggtggccctggttgacgcctttgatttccaagacgtcactctcggctcagtgctgggaaggtatgacggcaacgtatacgaaaatttgtttgagtgggcgaagaactctcctctcaataaagcagaggtgcacgagtcttacaaacacctgaagtccctgcagagcaaactgtag

SEQ ID NO: 177868 - DNA, 1983 bp, Artificial Sequence
  Description of Artificial Sequence: Synthetic coding sequence
atgaaccccgacctgcggcgggagcgggacagcgccagcttcaaccccgagcttctgacccacatcttggacggatcaccggagaagacacggagaagaagagagattgagaatatgatcctgaatgatcccgacttccaacatgaggatcttaattttctgacaagatcgcagcgctatgaggttgccgtgcgcaagagcgctatcatggtcaaaaagatgcgcgaattcggcatcgccgatcctgacgagattatgtggtttaagaactttgtgcaccgtgggcgcccggaacctctggacctccacctcggaatgttcctgccaaccctcctccaccaggccacagcagagcagcaggagaggtttttcatgcccgcttggaacttagaaatcatcggcacttatgcccagacagagatgggccatgggacacacttacggggactagagaccacggcgacttatgatccagagactcaggagttcattcttaacagccccacagttaccagcatcaaatggtggccaggtggcctcggcaagacatcaaatcacgccattgtcttagcacagctcataacaaaaggtaagtgttatggtttacatgcctttatcgtgcctatcagggaaatcggcacccacaagcccttgcctggtatcaccgtgggcgacatcggacctaagttcgggtatgatgagattgataatggctacctgaagatggacaatcaccggatccccagagaaaacatgctgatgaaatacgcccaggttaagcccgacggcacctatgttaaacctttgagcaacaagctcacttacggaaccatggttttcgtgaggtcttttcttgtgggagaggccgctagagccctatcaaaggcatgcactattgctattcgatacagcgcagtgaggcatcagtccgagataaagccaggagagcccgagccccagatacttgacttccagactcagcagtacaaactcttccctcttcttgcaacagcctacgccttccagtttgtcggcgcctacatgaaggaaacttatcaccggatcaacgaggggatcggccagggggacctctctgagctgcctgaactccatgccctgaccgccggcctgaaagcgtttaccagttggacagcaaacacaggtattgaggcttgccggatggcatgcgggggtcatgggtactctcactgctccggcctgcctaacatctacgttaatttcactccaagctgcaccttcgagggggaaaataccgtcatgatgctgcagacagctcgcttcctgatgaaatcttacgatcaggttcattcaggcaagttggtttgcggcatggtgtcctacctaaatgacttaccttcccagaggatacaaccccagcaggtggccgtttggcccaccatggtggacatcaatagtccagaaagtctcaccgaagcctataagctcagggccgcacgactcgttgagattgccgccaaaaacttgcagaaggaagtgattcaccggaagagtaaagaggtggcctggaatctcacatcagtcgatctcgtgcgcgccagcgaagcacactgccactatgtcgttgtaaaattgttttcggagaaactgctcaagattcaggacaaagccatacaggccgtcctcagaagcctctgtctgctgtactcgctctacgggataagccaaaatgccggcgattttcttcagggatccatcatgaccgaaccccagattacccaggtgaaccaacgggttaaggagttgctgacccttatcaggagtgatgcggttgcactcgtcgacgcttttgacttccaggatgtaacacttggaagtgtgctcggaaggtacgatgggaatgtgtacgagaacctatttgagtgggcgaaaaactccccactgaataaagccgaggtccacgagtcctataagcacctgaaatcgctgcagtccaaactgtag

SEQ ID NO: 177869 - DNA, 2046 bp, Artificial Sequence
  Description of Artificial Sequence: Synthetic coding sequence
atgggcagccccgtgcaccgggtgagcctgggcgacacctggagcagacagatgcacccagacatagagagcgagaggtatatgcagtcgttcgatgtggagcgactgaccaacatcctcgatggcggggcccagaacactgcccttcgccgcaaggtagaaagtatcatccattcttacccggagttttcctgcaaagataattacttcatgacacaaaacgagcggtacaaagccgccatgcgcagagcatttcacatccgcctcattgcaaggcggctcgggtggctggaggacggccgggagctgggatacgcatatagggcgctgtcaggggacgtcgccctgaatatccatcgagtgttcgtgagggcattgcgatcccttggcagtgaggagcaaattgctaagtgggatcctctgtgtaaaaacatccaaatcatcgccacttacgcgcaaacggagctgggccatggcacttacttgcagggcttggagacggaagctacctacgacgccgcaacgcaggagtttgtaatccactctccaacgctgactgccacaaaatggtggcctggagacctgggacgctctgccactcatgcactggtacaagcacagcttatttgcagtggggctcggcgggggatgcatgcattcattgttccaatacgcagtctgcaggatcacaccccgttacccggcataatcattggggacattggaccgaaaatggacttcgatcagacagataatggatttctgcaactgaaccacgtcagagtgccgagggagaacatgttgtctcggttcgctcaggtccttcctgatggcacatatgtgaagctggggaccgcacagagtaattacctgcccatggtggtagttcgtgtggagttgttatctggggagatactgcctatcctgcagaaggcctgcgtcatagcaatgcggtatagcgtcatcaggagacagtctcggcttcgacctagcgatcccgaggccaaagtgctagactaccagacccaacagcagaagctgtttcctcaattagcgatttcctatgcattccactttctcgcggtgtctctcctggagttttttcagcactcttatactgcaatcttaaaccaggatttctcttttctgccggaattacacgccttaagtaccgggatgaaggcgatgatgagcgaattctgcactcagggagcagagatgtgtagaagggcatgtggtgggcacggttattccaaactcagtggcctgccaagtttggttactaagctgtctgctagctgtacgtacgagggtgagaacaccgtgctgtatctccaggttgcaaggttcctggttaagtcgtacctgcagacccagatgtcccctggctccactcctcaaaggtcgttgtctccctcggttgcatacctcaccgcccctgacctggcacggtgtccagcacagagggccgccgatttcctgtgccctgagctttatactacggcatgggctcacgtggcagtgagattaattaaggacagtgttcagcacctacagactctaacacagtctggcgccgaccagcacgaagcgtggaaccaaacgactgtgattcaccttcaggctgcaaaggtgcattgctactacgtgacggtcaaaggatttactgaggcattagagaaactcgagaatgaacctgccattcagcaagtcctgaaaagactgtgtgacttgcacgctatacacgggattctcactaactcgggcgatttcttgcatgacgctttcctctctggcgcacaggtagatatggccaggaccgcataccttgacctgttacgcctgattcgcaaggacgctattcttctgacggatgcattcgacttcaccgaccagtgtctgaactccgcattgggctgttatgacggaaacgtctacgagaggttattccagtgggctcaaaaaagcccaacaaacacacaggagaatcccgcgtatgaggagtacatccgcccactattgcagagctggagatccaagctgtag

SEQ ID NO: 177870 - DNA, 516 bp, Artificial Sequence
  Description of Artificial Sequence: Synthetic coding sequence
atgggcagccccgtgcaccgggtgagcctgggcgacacctggagcagacaaatgcacccggatatcgaaagcgagagatatatgcagtctttcgatgtggagagactgaccaatattctagacggaggcgcccagaatactgccctgcgaagaaaggtggagtccatcatccactcttatccagagttcagttgtaaggacaactactttatgacccagaatgagcggtataaggccgccatgaggagagccttccatattcgattaatcgctcggaggctgggctggctcgaggacgggagggaactggggtacgcgtacagggccctttcgggggatgtggcactgaatatacaccgtgtatttgtgcgcgctctgaggtctctcggtagtgaagaacagatcgccaaatgggacccattatgcaaaaacattcagatcatcgccacgtatgctcagaccgaacttggacacgggacctatctccagggtctagagacagaagctacttattag

SEQ ID NO: 177871 - DNA, 2103 bp, Artificial Sequence
  Description of Artificial Sequence: Synthetic coding sequence
atggccagcaccgtggagggcggcgacaccgccctgctgcccgagttcccccgtggcccgttggacgcctacagagcccgcgcttcattcagctggaaagagttagcccttttcaccgagggcgaggggatgctccgcttcaagaaaaccatattttcagctctggaaaatgaccccctttttgccagaagtcccggggcggacctgagcctggaaaaatatcgcgagcttaatttcctgcgctgcaaacgtatctttgaatacgacttcttgtctgttgaagatatgtttaaatcacctttgaaagttcctgcgttaatccaatgcctgggtatgtatgactcatctctggcggccaagtacctcctacatagtttggtttttggctccgcagtgtacagcagcggatccgagaggcaccttacctacattcagaagatttttaggatggaaatatttggctgcttcgccttgacagagctgtcccacggttccaatacgaaggcgatccgcactaccgcacattacgaccctgcgacggaggaatttattatccactctcctgacttcgaggcagctaagttctgggtcggaaacatgggaaagaccgctactcatgccgtcgtctttgcgaaactctgcgtccctggcgaccagtgtcatgggcttcacccattcatcgtccagattcgcgacccaaaaacccttttgcctatgccgggcgtaatggtcggcgatattgggaagaaattggggcagaacggcctggataacggcttcgcaatgttccacaaggttcgggtgcctaggcagtccctcctcaatagaatgggagatgttacccctgaaggaacatacgtctcgcccttcaaggacgtgcggcagcgatttggcgcatctctggggagtctctcctccggcagggtgtctattgtgtcactagctattctaaatctaaaattagccgtagctattgcattgagattttctgcgacccgccgtcagttcggtcctactgaagaagaggagattccagtcttggagtatccaatgcagcagtggcggctcctgccttatctggcagctgtctacgctctggaccatttttcaaaatcattgtttcttgacttggttgaactccagcgtggtttggccagcggggataggtccgccagacaggccgagctgggtagagagatacacgcgctggcatccgctagcaaaccacttgccagttggaccacacaacagggcattcaggagtgtagagaagcatgcggtgggcacggctatttggccatgaaccgactgggagtgttgcgggacgacaacgatccgaactgtacgtacgagggagataataatattttgctgcagcagacatctaactatctattggggctgttagctcaccaagtacacgacggagcgtgctttcggtcacccctgaagtcagtggacttcctcgatgcctaccccgggatcctggaccagaaattcgaggtgagcagtgtggcagattgtctggatagtgcagtggccctagcagcctacaagtggctggtatgttacttattgcgggagacctatcagaagttgaaccaagaaaagcggagtggctcatcagacttcgaggcaagaaacaaatgtcaagtatctcatggcaggcctttggccctggcctttgtagaactgaccgtggttcaaaggttccacgagcacgtgcatcaaccatctgtgcctccttctctgagagccgtcctgggtcgcctgtccgccctttacgccctctggagtctctctcgccacgctgccctcttgtatagagggggctacttctccggcgagcaagctggtgaggttctcgaatccgctgttctcgccctttgctcccaattaaaagatgacgcagtagccctggtggatgtgattgcaccgcccgattttgtcctggacagccccatcggcagggcagacggggaactctacaagaacctgtggggcgccgttctgcaagagagtaaggtattggagcgagcttcctggtggcctgagttttcagtcaacaagcccgtgatcggctcgctcaagagcaaactttag

SEQ ID NO: 177872 - DNA, 1875 bp, Artificial Sequence
  Description of Artificial Sequence: Synthetic coding sequence
atggccagcaccgtggagggcggcgacaccgccctgctgcccgagttcccgaggggtcctctggacgcttaccgcgcaagggcctcatttagttggaaggaattggccctgtttacggaaggtgaaggtatgctccgtttcaaaaagacaattttttcagcactcgagaacgacccactcttcgctagaagtcccggggcagacctcagcctggaaaagtatcgcgagctgaacttcctccggtgtaagagaatctttgagtatgacttccttagcgtggaggatatgttcaagagcccattgaaagtgccagccctgattcagtgtttagggatgtacgattcctcccttgccgcaaaataccttcttcactctttggtgttcggctccgcagtttatagcagcggctcagaacgccatcttacatatattcagaagatcttccggatggaaattttcgggtgctttgcactcaccgaattgtcccatggttcaaacaccaaggctatcagaacgactgcccactacgatcccgcaaccgaggagtttatcatccactctcctgacttcgaggccgcgaagttttgggtgggcaatatggggaagacggccactcatgctgtggtgtttgccaagctgtgcgtcccaggtgaccagtgtcatgggctacacccatttatcgtgcaaatccgggatccaaagaccctgcttcccatgcctggtgtgatggttggagatataggaaagaagctgggccaaaacggtcttgacaacggctttgctatgttccataaggtgagggtccctaggcagagtcttctgaaccgaatgggcgacgtgacacctgaaggaacatatgtttcaccctttaaagatgtgagacagcgattcggagcatccctgggaagcttgagctccgggcgcgtgagcatcgtgtcgctggctattttgaacctgaagctcgctgtcgcaattgcgctgcggttctctgctacacgccggcagttcgggccaacagaagaggaagaaataccagtgctggaatacccaatgcagcagtggaggctcttaccttatctagccgccgtgtacgccctggatcacttctctaagtctctgtttttggatctggtggaactccagaggggcctggccagcggggaccgaagcgcacgccaggctgaactgggccgcgagatccatgccctggcatccgcctctaaacctctggccagttggacgacgcagcagggaattcaggagtgcagggaagcctgcggcggccatggctatctagccatgaataggctgggcgtcctcagagatgacaatgatcccaactgcacatatgagggggacaataacatacttttgcagcagacatctaactacctcctgggactgctggcccaccaggtacatgatggggcgtgtttccgtagtcccctcaagtctgtcgacttcctggacgcctacccaggaatcttagaccagaaattcgaagtgtcatcggtcgctgattgtttagattcagcagttgccctagccgcctataaatggctggtgtgctatctgctgcgtgaaacctatcagaaattaaatcaagaaaagcggtctggtagcagcgactttgaagcccggaataagtgtcaagtgagccacggccggcctctggcattggcattcgtggagttgaccgtggtgcagcgtttccacgagcatgttcatcaaccatcagtcccccccagcctgcgcgccgtgctgggtcggttatctgctctgtacgcattgtggagcctgagccgtcacgccgctctgctttaccgagccgagagaagatgctcttgtccggggcgcagagacagaagcagttag

SEQ ID NO: 177873 - DNA, 2103 bp, Artificial Sequence
  Description of Artificial Sequence: Synthetic coding sequence
atggccagcaccgtggagggcggcgacaccgccctgctgcccgagtttccaaggggccccctcgacgcgtatcgtgctagagcttctttcagctggaaagaactggctctgttcacagaaggagaggggatgctccgattcaaaaagaccatctttagcgccctggagaacgatccactattcgccagaagcccaggggccgatctctcattggagaagtatagggagctcaatttcttacggtgtaaacgaattttcgagtatgactttttgtcagttgaggatatgtttaagtcccccttgaaagtcccagccctaatccagtgcttaggtatgtatgattcatctcttgcggctaaatatttactgcactcacttgttttcggtagtgctgtctacagcagcggcagtgagaggcatctcacatacatccagaaaatttttcggatggagattttcggctgctttgcactcactgagctatcgcacgggtccaacaccaaggcaatacgaaccactgcccactatgaccctgcaaccgaggagtttatcatccactcgcctgactttgaggctgctaaattctgggtcggaaatatgggcaagacagccacccacgccgtcgtcttcgcgaagctttgtgtcccaggtgaccagtgccacggactgcacccgtttatagttcaaattcgagaccccaaaactcttctgcccatgcccggtgttatggtaggggatattggaaaaaagctgggccagaacgggctcgacaatggttttgccatgtttcacaaggttagggttcccagacagtcacttcttaataggatgggagacgttactcccgaaggcacttacgtctccccgtttaaggatgtcaggcagcgctttggcgccagtctaggtagtttatctagcgggagggtctctattgtatcattggccattctgaacctgaaactcgccgtcgcaatcgctctgcgcttttctgccacaagacggcagttcggcccaaccgaagaggaggagattccagtgctggaatatccaatgcagcagtggaggctgctgccctatttggccgcagtgtatgctctcgatcatttttcaaaatctttattcctcgatcttgtcgaacttcagcgcggcctcgccagcggcgacagatctgccaggcaggctgaactgggcagagaaatccacgccctagcctccgcgagcaaacccctggccagctggaccactcagcagggtattcaggagtgccgcgaggcctgcggtggccatgggtacctcgctatgaaccggttgggggtcctgcgcgatgacaatgaccccaactgcacatacgaaggagataacaatatcctcctgcagcaaaccagcaattaccttcttgggctgctagcccatcaggtgcatgacggggcatgctttagaagcccgctcaagtccgttgactttttggacgcctacccgggaatcctggatcagaagttcgaggtgtctagcgtcgcagattgccttgacagtgccgtggccctggccgcctacaagtggctagtgtgctatctgctccgcgagacctatcagaaattgaaccaggaaaaacggtccggcagtagcgattttgaggctagaaacaagtgccaggtgtcccatgggcgccctctggcattagctttcgttgaactgaccgttgtgcagcgcttccacgagcatgtccaccagccttccgttccacccagcctgagggcagtccttggccggctgagcgccctctatgcgctctggagcttaagtcggcacgctgcgttgctctaccgcgggggctatttcagcggggagcaagctggtgaagtgctggagtccgcagtactggccctttgctcacaactcaaagatgacgcggtggctttagtggacgtgatcgctcctcctgactttgtcttggattcacccattggccgagctgatggagagctatataaaaacctgtggggagctgttttacaggagtcaaaggtcctagagagggcctcttggtggcccgaattctcggtcaataagcccgttatcggctctctgaagagcaagctctag

SEQ ID NO: 177874 - DNA, 2175 bp, Artificial Sequence
  Description of Artificial Sequence: Synthetic coding sequence
atgccccggaacagcggcgccggctacggctgcccccacggcgacccttccatgctggacagccgcgaaacacctcaggagagtcggcaagacatgatcgtgcggacgacacaagagaaacttaagacatccagtttgaccgatcgacagccactgagcaaggaaagccttaatcacgctcttgagctctcggtacccgagaaggttaataatgcccaatgggatgcgcccgaggaagcgctctggaccacgcgagccgatggtagagtccgcctgaggattgacccgagctgtccacagctcccatacaccgtgcatcgcatgttttatgaagccctggataagtacggagacctgatagcccttggtttcaagaggcaagacaagtgggaacacatctcatattctcagtactatctcctggccaggcgcgccgccaagggcttcttaaagcttggactgaagcaggctcactcggtcgcgattttaggctttaacagtcctgagtggttctttagcgccgtgggaaccgtatttgctggtggtatcgtgactggtatttataccacatcttctcctgaggcctgtcagtatatagcctatgactgttgtgccaatgttattatggtagatacccagaaacagttagagaaaattctgaaaatctggaagcaactcccacatcttaaggcagttgtgatttacaaagaacccccccccaacaaaatggcaaacgtctacacaatggaggaattcatggagttgggaaatgaagtccctgaggaagcactagacgctattatcgacacacagcaaccaaatcagtgctgcgtattggtttatacctctggcactaccggtaacccaaaaggggtaatgctgtcccaggataatattacctggactgcccggtacggaagccaagctggtgatatcaggcctgccgaggtgcagcaggaagtggtggtgtcttacctcccactgtcacatatcgctgcccagatctacgatctctggaccgggatccagtggggcgcccaagtgtgcttcgcagagccagatgcactcaaaggctcactggttaacactctccgggaagtcgaacctacgagccatatgggtgtgccaagggtgtgggaaaagattatggaaaggatccaagaggtcgctgcacaatcaggtttcatacgcaggaagatgctgctgtgggcaatgagtgtcactcttgagcagaatctgacatgccccggcagcgacttgaaaccatttacaaccagactggcagactatttagtcctcgccaaagttcggcaggccctgggcttcgccaaatgtcaaaagaatttttatggcgccgcccctatgatggcagagacacagcactttttcctgggcctcaatattagactatacgctggttacgggctgtccgaaacttccgggccacacttcatgtcctcgccctacaattacaggttgtattccagcggaaagctggtccctgggtgtcgagtgaagctcgtgaaccaagacgctgaagggatcggcgagatatgtctctggggccggacaatcttcatggggtatcttaatatggaagacaagacttgcgaagcgattgatgaggagggctggctccatacaggagacgcagggagactcgacgcagatggcttcctctacatcacaggcagactgaaggaacttattattacggccggcggagaaaatgttccaccggtacccattgaggaggcagtgaagatggagctgcctataatctccaacgctatgctcatcggcgaccagaggaagttcttaagtatgctcctcactcttaagtgcacattagaccctgatacaagcgaccaaaccgataatctgaccgagcaagctatggagttttgtcagagagtgggaagtcgggcaacaacagtgtccgagatcattgagaagaaggatgaggctgtgtaccaagccattgaagaaggcatacgcagagtgaacatgaatgcagcagctcggccgtaccatatacaaaagtgggctattctggaaagagatttcagtatttcaggcggggaactcggtccaacgatgaagctcaaaaggctgaccgtgcttgagaagtataagggtataatcgattctttttaccaggagcagaagatgtag

SEQ ID NO: 177875 - DNA, 1449 bp, Artificial Sequence
  Description of Artificial Sequence: Synthetic coding sequence
atggccaacgtgtacaccatggaggagttcatggagctgggcaacgaggtgcccgaggaagctttggacgccataattgacactcaacaaccgaaccagtgctgcgtgcttgtttatacgagtggcaccacaggaaaccccaaaggagttatgttaagtcaggacaatattacatggacagctcggtacggcagtcaggccggcgatatccggcctgccgaggtgcagcaggaagtggttgtgtcttaccttccattaagccatatagccgctcagatttatgatctttggaccggcatccagtggggagcacaggtatgcttcgcagaacccgatgcactgaaagggtccctggtaaatacgctccgcgaagtcgagcccacatctcacatgggagtccctagagtgtgggagaaaatcatggagcgcatccaggaagtagctgcccaaagcggcttcatccgcagaaaaatgctcttgtgggcaatgtcggtaacactggagcagaacctcacatgtcctggctccgaccttaagccttttacaactcgtttagccgactacctggtgttggctaaggtgcgtcaagctttaggcttcgcaaagtgtcagaaaaatttttatggtgcggctccgatgatggcggagacccagcatttcttcctcgggctgaacattaggttatatgccggctatgggctgtccgagacaagtggcccccactttatgtccagcccttataattatcgactgtactcttcaggcaagttagtcccaggttgccgcgtgaagctggtgaaccaggacgcagagggaatcggggaaatttgtttgtggggaaggacgatatttatggggtatctgaatatggaggacaaaacctgcgaggccattgacgaagaaggatggctgcacacaggtgatgccggaagactagatgccgacggcttcctgtacatcactgggagacttaaagaattaattattactgccggcggagaaaatgtaccgccagtgcctatcgaggaagctgtcaagatggagctccctattatctctaacgccatgctgattggcgaccaacgaaaatttctgagtatgctcctgacgctgaaatgcactctcgatccggatacatccgatcagactgataatttgacagaacaagctatggaattttgtcagagagtgggctcacgggcaacaaccgtgagcgagatcattgagaaaaaagacgaggctgtctatcaagctatcgaggaggggataaggagagttaacatgaacgccgcagcccggccctaccacattcaaaagtgggctatcctggagcgtgacttctcaatctcgggaggcgaactgggccccactatgaagctcaagaggctcaccgtgcttgagaaatataaggggataattgacagcttctaccaggagcagaagatgtag

SEQ ID NO: 177876 - DNA, 2001 bp, Artificial Sequence
  Description of Artificial Sequence: Synthetic coding sequence
atgaccggcacccccaagacccaggagggcgccaaggacctggaggtggacatgaataagactgaagtgacacccaggctgtggaccacctgtagggatggggaagtactgcttcgcctctccaaacacggtccgggccacgagactcctatgaccatccctgaattttttcgtgaaagcgtgaaccggtttggcacctaccccgcgctggccagtaagaatgggaagaaatgggagattctgaactttaatcagtactacgaagcatgcaggaaagccgcgaaatccctcattaaactcggactagaacggtttcacggggttggcattttgggctttaacagtgctgaatggtttatcacagctgtgggcgctatcctggctggcggcctctgcgtcggaatatatgcaactaactcagctgaggtttgtcagtatgtgattacacacgctaaagtgaatattctgttggtcgagaacgaccagcagctgcaaaagatactgtccatcccccagagtagccttgagcctctcaaggcaattatccagtatcgtctgcccatgaagaaaaataataatctctattcctgggacgacttcatggagctggggaggtctatccctgacactcagctggagcaagtcattgaaagtcaaaaggccaaccagtgcgccgtgttgatatatacatcaggtactaccgggatccccaaaggggtgatgcttagccacgataacattacttggatcgccggggccgtgaccaaggatttcaaactgactgataagcacgaaacagttgtgagctatctaccactgtcgcatatagccgcccagatgatggacatttgggtaccaataaagatcggagccctgacttactttgcccaagccgacgcgctcaagggcacactggtatcaaccttgaaggaagttaagcccaccgtgttcatcggcgtgccccaaatctgggaaaagattcacgagatggtgaagaagaatagcgcaaaatcgatggggctgaagaaaaaggctttcgtttgggctaggaatattggttttaaggttaacagcaaaaagatgctgggaaagtacaatacaccagtttcataccgaatggctaagacactggttttctcaaaggtgaagactagtctaggtctcgatcattgccactcttttatatccggaacggctccccttaaccaggaaacagcagaattcttccttagcttggatataccgattggcgagctctacggactttccgagagcagcggcccccacaccatttctaatcagaacaactatcggctcctgtcgtgtgggaagattttaactggctgcaagaatatgctcttccagcaaaataaggacggaattggcgagatatgtctgtgggggagacacattttcatggggtatctcgagtccgagactgagactacagaggccatcgacgatgaggggtggctccactcgggagatctcggccagcttgatgggttaggttttctgtacgtgaccggccatatcaaagagattctgattaccgccggcggcgagaatgtaccaccaattcccgtcgaaaccctcgtgaaaaagaaaatcccaataatcagcaatgccatgctggtcggtgataaactaaagttcttgagcatgttgctgactttaaagtgtgagatgaaccagatgtccggagagcctcttgataagctgaatttcgaggccattaacttctgtcgcggactgggtagccaagcctcgacagtcacagagatcgtgaagcagcaggatcccctcgtatacaaagctattcagcaaggcatcaacgccgttaaccaggaagcgatgaacaatgcccaacggattgagaaatgggtcatcttggagaaggatttttcaatttatggaggagagttggggcctatgatgaaattaaagcggcattttgtggcacagaagtataagaagcagatcgatcatatgtaccactag

SEQ ID NO: 177877 - DNA, 1848 bp, Artificial Sequence
  Description of Artificial Sequence: Synthetic coding sequence
atggccgtgtacgtgggcatgctgcggctgggccggctgtgcgccgggtcgtccggcgtgctgggcgcgcgcgcagccctgtctcgcagctggcaggaagctcggctccagggcgtgcgctttctgagcagcagggaagtcgatcggatggtatccacccccattggtggactatcctacgtgcagggttgcacaaagaaacatctgaactcgaagactgtggggcagtgtctagagacaactgcccagcgtgtgcctgagcgggaagccctggtggtgttgcacgaggacgtgcggctaacttttgcacagctaaaggaagaggtagacaaggctgcaagcggcctcctgtccataggactttgtaaaggggataggctgggcatgtggggtccaaactcatacgcctgggtcctaatgcagttagctaccgcccaggcgggcattatcttagtctccgtgaacccggcctatcaggccatggagctggagtacgtcttaaagaaggtcggatgcaaggcccttgtgtttcctaaacaattcaagacacaacagtactataatgtgctgaaacagatctgtcccgaagtcgagaatgctcagcctggagcattgaagagtcagcgcttaccagacttaaccaccgtcatcagtgtggacgcacccctgccaggcacactgctcctggatgaggttgtggccgccgggtccacccggcagcacctggaccagctacaatacaatcagcagtttctgtcctgccatgaccctataaatatccagtttactagcggcaccacaggatcgccaaaaggggcgactctcagccactacaacatcgtgaacaacagcaacatcctcggggagcggctgaagctgcatgagaagacccctgaacaactccgaatgatccttcctaatcctctgtaccattgtctggggtctgtcgccggaacaatgatgtgcttgatgtacggagcaacactgatcctggcctctcctatttttaatggcaaaaaggccctggaggcaatcagtcgagagagggggacatttttatacggtacaccaaccatgttcgtggacatcctgaaccagcctgacttctcctcatacgatatcagtacgatgtgtggtggtgtgattgcaggctcccccgctcctccagaactcatccgtgcaatcattaataagatcaacatgaaagatctggttgttgcttacggaacaacggagaattcccccgtcacctttgcccattttcccgaggataccgtggagcagaaggccgaatcggtcggtcgcataatgccacatacagaagctcgcattatgaatatggaggccggcacactcgccaagctgaatacaccaggcgagctgtgtattaggggatactgcgtgatgttgggatactggggtgaaccccaaaagactgaagaagcagtcgaccaagataaatggtattggaccggcgacgtggccactatgaatgagcaggggttctgcaagattgttggccgctccaaggacatgatcattcggggtggtgaaaatatttacccagcagagttagaagacttttttcacacgcaccctaaggtccaggaagttcaggtggttggcgtcaaggacgatagaatgggtgaggaaatatgcgcctgcatcaggttgaaggacggggaagaaactactgtggaggaaattaaagcattctgcaaaggaaaaatatcacacttcaagattcctaagtatatcgtgttcgtgactaactacccactcacgatttctgggaagattcagaaattcaaactacgagagcagatggagcgacatctgaatctgtag

SEQ ID NO: 177878 - DNA, 1923 bp, Artificial Sequence
  Description of Artificial Sequence: Synthetic coding sequence
atggccgtgtacgtgggcatgctgcggctgggccggctgtgcgccggcagttccggggtgcttggcgctagggctgccctgagtagatcttggcaggaggctaggcttcagggcgtgcgtttcctgagtgctcgaggggggatggaggccgggaggcagaggatcagcgtgccctcctcatttactgcctcagccgctgctcactcaagagaggtggaccgcatggtgagtacaccgattggaggactgagctacgtgcaggggtgcaccaaaaagcatttgaattcaaaaacggtcgggcaatgccttgaaacaacagcccaacgggtacctgagcgcgaggccctcgtggtgctacacgaagatgttcggctgacattcgcacagctaaaggaagaggtggacaaggctgcgagtgggctgctctccattggactgtgtaagggcgacaggctgggaatgtggggaccaaatagctacgcatgggtgcttatgcagctggccactgctcaagcaggtattattttggtctccgtgaacccagcctaccaagcaatggaattggaatatgtgctcaaaaaggtaggatgtaaagcactggtattcccgaaacagttcaagacccaacagtactataatgtccttaaacaaatttgtccggaagtggagaatgcgcagccgggggctctcaaaagccaacggctgcctgatctaacgaccgtaatctccgtagatgccccgctgcccggaacgctcctgctggatgaggtggtcgctgccggttccaccaggcaacacctcgatcaattgcaatataatcagcaattcttgtcttgtcacgatcccatcaacattcagttcacttctggcactacggggtcacctaagggcgctaccctgtcccactacaatatagttaataacagcaacattttgggtgaacgtctgaagctccacgaaaaaactcccgagcagcttcgcatgatccttccaaatcccctgtatcactgcctgggttccgttgccggtacgatgatgtgtctgatgtacggcgccaccctgatcttggcctccccaattttcaacgggaagaaggctcttgaggcgataagcagggaaagaggaacgtttctctacgggactcccacaatgtttgtggatatcctgaaccagcctgatttttcctcgtatgatatttctaccatgtgcggtggagtaatagctggctctcctgctccaccggagctgattagggctattataaacaaaatcaacatgaaagatctggtggtagcatatggcaccaccgaaaactcccccgtgacgttcgctcatttcccagaggatacggttgagcagaaagctgaatctgtggggcgcattatgccgcacactgaggcaaggatcatgaacatggaggcaggaaccctggccaagctgaatacccccggcgaattgtgtatccgggggtactgtgtcatgctgggatactggggcgaacctcaaaaaaccgaagaggccgttgatcaggataagtggtactggacaggcgacgttgctaccatgaatgaacagggcttctgtaagatcgttgggaggtctaaggacatgattatacgcggtggagaaaatatataccccgccgaactagaagacttctttcatacccatcccaaggtccaggaggtccaggtggtcggcgtcaaagatgacaggatgggtgaggagatttgcgcctgtatccgcctgaaagatggggaggaaacaacggtcgaagagatcaaggccttctgtaaaggtaagatttcccatttcaagattccaaagtacatcgtatttgtgaccaactaccctctgacaatcagcggcaagattcagaagttcaaactgagagagcagatggagaggcatctcaacctgtag

SEQ ID NO: 177879 - DNA, 1809 bp, Artificial Sequence
  Description of Artificial Sequence: Synthetic coding sequence
atggccgtgtacgtgggcatgctgcggctgggccggctgtgcgccgggtcctctggggtcctgggtgcgagagccgctctcagcagaagttggcaggaggcccggctgcagggtgtccgcttcctttcctcaagggaagtcgaccgcatggtgtccaccccaatcggcggcttgtcgtatgtccagggatgcacaaaaaagcacctcaactctaagactgtcggccagtgcctcgaaacgactgcccagagggttccagaaagagaggccctcgtggtgctgcatgaagatgtacgcctcaccttcgcccagcttaaggaggaggtagacaaagccgctagtggattgttgagtattggactctgtaagggggatcggttagggatgtggggcccaaattcctacgcatgggtcctgatgcaactcgccacggcccaggctatggagctggagtatgtactcaagaaagttggttgcaaggctctggtgtttccaaaacaattcaagacccagcagtactacaacgtgctcaagcagatttgccctgaagtggagaatgctcagccaggtgcactgaaaagtcaaagattacctgatctgaccaccgttatttcagtagacgccccgctcccaggcacattgctcctggacgaggtggtggctgctggaagcaccaggcaacacctcgatcagctccagtacaaccagcagtttctgagctgtcacgatcccataaatatacagtttactagcggtactactgggtcacccaagggcgctacgttgtcccactacaatatcgttaataactccaacattctgggtgagcggctcaaactacatgagaaaaccccagagcagttgcgcatgatcctacccaatcctctataccactgcctcgggtcagtggccgggacgatgatgtgcctaatgtatggcgcaacactgattcttgctagccccatcttcaacggaaaaaaggccctggaggcaatctctagagaacgtggtacctttctctatggcacgccaactatgttcgtcgatatcctcaaccaacctgatttctcctcctatgatatctctacaatgtgcggaggcgttatcgccggatcgccagccccccctgagttaattagagccattatcaacaagatcaatatgaaagatctggtagtcgcatatggcaccaccgaaaatagccccgtgacgtttgcgcactttccagaggataccgtggagcagaaggctgagagcgtggggcggatcatgccccatactgaggctcgcattatgaacatggaagccggtactttggccaagctgaataccccaggtgagttatgtatcagggggtattgcgtgatgctcgggtactggggagagccgcagaaaacggaggaagccgttgatcaggacaaatggtactggacaggagacgtagccacgatgaacgagcagggattttgcaagatcgttgggcggtcaaaggacatgattatccgcgggggggagaatatataccctgcagagctggaggatttctttcacactcaccccaaagtgcaggaggtccaagtagtcggcgtgaaagacgaccggatgggcgaggagatctgtgcatgcatcaggctgaaagacggggaagagaccaccgtggaggagattaaggcattctgtaaaggaaagatttcacacttcaagatcccaaaatatattgtcttcgtcacgaactatcctctcaccataagtgggaaaatccagaagtttaagctgagagagcagatggagcggcacttgaacctctag

SEQ ID NO: 177880 - DNA, 1719 bp, Artificial Sequence
  Description of Artificial Sequence: Synthetic coding sequence
atggccgtgtacgtgggcatgctgcggctgggccggctgtgcgccggcagctccggagtccttggcgcgcgcgcagcattaagccggagttggcaggaagctcgcctgcagggcgtacgctttctcagcagcagagaggtcgaccgtatggtctctactcccatcggtggactttcctacgtccagggctgcactaaaaaacatctcaactcaaagaccgtgggacagtgccttgagacgactgcgcagcgggtgcctgagcgggaagctctggtggttcttcacgaggacgtgcgattgacattcgctcagttaaaagaggaagtatctgtaaatcccgcttaccaggccatggaattggagtatgtgctcaaaaaggtgggctgcaaggcacttgtattcccgaaacagttcaaaacgcagcagtactacaatgtgctaaagcagatttgtcccgaggtggagaacgctcaaccgggagctcttaaaagccagcgcctcccagacctgactactgttattagcgtggacgctcccctgcccggaactcttctgctggatgaggtggtggctgctgggagcacacggcagcatcttgaccaactacaatataaccagcagttcctgagctgtcacgatcccatcaacatccagttcacatcgggcacaaccggaagtccgaaaggagccacactgtctcactacaatatcgtgaacaacagcaacatcctcggagagaggctcaaattgcacgaaaagactcctgaacaacttcggatgattctgccaaatccactttatcactgcctgggatccgtggcaggtaccatgatgtgcctgatgtatggcgctaccctgattctggcctccccgatttttaacgggaagaaggccctggaggccatcagcagggagcggggtacattcttgtacggtaccccaaccatgttcgtggatattctcaaccagcccgatttctctagctatgatattagtaccatgtgcgggggagttattgccggttctccagctcctccagaactgattcgcgccattataaacaaaattaatatgaaggatcttgtggtcgcatatggaaccaccgagaattcccctgtgacatttgcccattttccagaggatacagttgaacagaaagcagagtcagtaggccgcatcatgccacacaccgaggcccggattatgaacatggaggcgggcacgttagcgaagctaaacacccccggcgagctgtgcatcagaggctactgtgtgatgctcggctattggggcgagccacaaaagacagaagaggccgtggatcaagacaagtggtactggacgggagacgtggcaactatgaatgagcaggggttctgcaagatcgtcggacggagtaaggatatgatcatcaggggaggagagaacatttatccagccgagctggaggatttctttcacactcatccgaaagtgcaagaagtacaggtggttggtgtgaaagatgatagaatgggggaggaaatctgcgcatgcattcggctcaaggatggtgaagaaacaacagtggaggagattaaggccttttgtaaggggaagatctcacactttaaaattcctaagtatatcgtttttgtgaccaattatcctcttaccatcagtggcaaaattcagaaatttaagcttagagagcagatggagcgacaccttaacctgtag

SEQ ID NO: 177881 - DNA, 1368 bp, Artificial Sequence
  Description of Artificial Sequence: Synthetic coding sequence
atggagctggagtacgtgctgaagaaggtgggctgcaaggccctggtttttcccaagcaatttaaaactcagcagtactataatgtcctgaaacagatctgcccagaggtcgaaaatgcccaacctggcgccctgaagagccagagattgcctgacttaacgacagtcatcagcgtggatgctcccctgccaggaacccttcttctggatgaggtggtggccgctggttccactcgtcagcacctggaccagctgcaatacaaccaacagttcctttcttgccacgaccctatcaacattcaatttacgtctgggaccacaggatctccaaaaggcgcaaccctgtcccactacaatatcgtgaataatagcaacattctgggagaacgtctgaaattacatgagaagactcctgaacaactcaggatgattctgcccaaccctctatatcactgccttgggtcagtggcagggaccatgatgtgcttgatgtacggagccacactcatcttggcgtcccccatttttaacggcaaaaaggcactcgaagccatttcgagggaacgcggcacatttctgtatggcactccaaccatgttcgtggacatccttaatcagccagactttagcagctacgatataagtactatgtgcggcggcgttattgccgggtcccctgcacctcctgagctgattcgcgctatcatcaacaaaatcaacatgaaagatttggttgtcgcctacggtacaaccgagaattccccagtaacattcgctcacttccccgaggacactgtggagcagaaagccgagtctgtcggccggatcatgccccatactgaggccaggatcatgaatatggaagcaggcacgttagcaaagttaaacacccccggcgaactgtgcattcgcgggtattgcgtgatgctgggttattggggcgagcctcaaaagacagaagaagctgtcgaccaggacaagtggtactggactggagatgtcgcgaccatgaacgagcagggcttttgcaaaatagtcggacggtcaaaggatatgatcatccgaggcggtgaaaatatttacccggcggagcttgaagactttttccacacccaccccaaagtgcaagaagtgcaggtcgtaggagtcaaggacgaccgaatgggcgaggaaatttgcgcctgtattcgactaaaggatggagaggagaccacagttgaggaaataaaggccttctgcaagggtaaaatttctcatttcaagatcccaaagtatattgtctttgtgacaaattaccctctgaccatttcaggcaagatccagaaattcaagcttcgcgaacagatggagaggcacctgaatctctag

SEQ ID NO: 177882 - DNA, 1731 bp, Artificial Sequence
  Description of Artificial Sequence: Synthetic coding sequence
atgctgccccacgtggtgctgaccttccggcggctgggctgcgccttggcaagttgcagacttgcgccagccaggcacaggggatcggggctgctgcatacggctccggtggctcggagtgatagatcggctcccgtatttactcgtgcacttgcgttcggggatcggattgctttggtcgatcagcatgggcgtcatacctatagagagctgtatagccgctctcttcgtttgagccaggagatatgtcgtctgtgcgggtgtgttggcggagaccttagggaagagcgtgtcagcttcctgtgtgcaaacgatgctagctacgttgttgcacaatgggccagctggatgtcgggcggagtcgctgtcccattgtaccgaaaacatcctgcggcgcagctcgaatacgtcatttgtgactcgcagtctagtgtagttttggcttcccaagagtaccttgaactgctgtctccagtggtgcggaagctgggagttccattacttccactgactccagccatttacacaggggcagtggaagagcccgctgaagtgccggtccctgagcaagggtggagaaataagggcgctatgattatctatacgtcggggactacaggaaggcctaagggcgtactgagcacccatcaaaacattagagcagtggtgactgggcttgtacacaagtgggcctggaccaaggatgacgttatactgcacgtgctcccactacatcatgtacatggtgtcgtgaatgccctgctgtgcccactatgggtgggggccacctgtgtgatgatgcctgaattttctccgcagcaggtgtgggagaaattcctttcgtccgagacacctcgcatcaatgtattcatggctgtgccaactatttatacgaagcttatggaatactacgacagacacttcacccagccccacgcacaagacttcctgcgtgcagtgtgcgaggaaaagatacgtcttatggtgagcggctccgccgccctgcctttgcccgtgctggagaaatggaaaaatattacaggccataccctgctagagcgctatggcatgacggagatcggaatggccttaagcggcccattgaccaccgccgttagactgcccggcagtgtaggtacacccctcccgggagtacaggtgcggatcgtgtctgagaatccccagagagaggcttgttcatacacaatccatgccgagggtgacgaacgcgggaccaaggtgacccccgggttcgaggaaaaggagggggaactcctagtccggggcccttctgtgttcagggaatactggaacaaaccagaggagaccaagtccgcttttacgttggacggttggttcaaaacaggcgacaccgttgtgtttaaggacggccaatactggatcagaggcagaacttctgtggatataatcaaaacagggggatataaggtgagcgccctagaggtggaatggcatctgctcgcacacccgagcattactgacgtggctgtcatcggggttcctgatatgacatgggggcagagggtgaccgccgtcgtaacactccgcgagggacattccctctcacaccgagagctcaaagagtgggcccgaaatgttctagcaccttatgcggtgccctccgagctcgtgctggtagaggagataccacggaatcaaatgggcaagatcgacaagaaagccttgatcaggcactttcacccctcatag

SEQ ID NO: 177883 - DNA, 1731 bp, Artificial Sequence
  Description of Artificial Sequence: Synthetic coding sequence
atgctgccccacgtggtgctgaccttccggcggctgggctgcgcccttgcttcatgtaggttagcccccgctaggcatcgcggaagcgggctcctacacaccgcccccgtggccaggagcgatcgcagcgcccctgtgttcacccgagcacttgcttttggcgatcgaatcgctctcgtggaccagcatggacgtcatacgtacagagagttatatagtagatccctgcgtctcagccaggagatatgcagactttgcgggtgcgtcggcggggatcttcgtgaggaaagggtatccttcctgtgcgctaacgacgccagctatgtggtggctcagtgggccagctggatgagtggaggcgtggctgtgccactgtatagaaagcacccggcagcccagctggaatacgtcatttgtgattcccagtcttcggtggtgctcgcctcccaggagtatttggaactgttgagccctgttgtccggaagctcggtgttccactgctgccactgaccccagcaatctacacaggcgctgttgaagaaccagctgaagtgccagtgcccgagcagggctggcgcaacaagggcgctatgatcatttacacctccggcaccaccggtcggcccaaaggcgtcttatctacgcaccagaatataagagcagtggtgacaggactagtgcataagtgggcctggacaaaagatgacgttattctgcacgtcctgcctctgcatcacgtgcacggcgttgtaaatgctttgctctgtccattatgggtcggagccacctgcgtcatgatgcccgaattctccccacagcaagtatgggaaaagttcttatcttccgagaccccccgcatcaatgtgtttatggcagtgccaacaatctataccaagttgatggagtattacgatcgacattttactcagccccacgcccaagattttctccgcgcagtgtgcgaagaaaagataagacttatggtatctggttccgctgccctacctctcccagtgcttgagaaatggaagaacatcactgggcacaccttactggaaaggtacggaatgacggagatcggcatggctctgtcaggacccctgacaaccgccgtgcggctgcctggcagtgttgggaccccgctgcctggggttcaggtacgcatcgtctccgaaaacccacagcgggaggcgtgtagttacaccatccatgctgagggggatgaaagagggacgaaggttaccccagggtttgaggagaaggagggcgagctcctagtgcgcgggccctctgttttccgcgagtactggaataagcctgaggagactaagtccgccttcaccctagatggctggtttaaaaccggtgacactgtagtgttcaaagatggccaatactggatccggggccgaacttcggttgatattatcaagacagggggatacaaagtctctgctctcgaggtcgaatggcacctgttggctcatccaagtattaccgatgtggcagtcattggcgtgcctgacatgacatggggacaacgagtcacagccgttgtcactctgcgcgagggacactccttgagccacagggagctcaaggagtgggcccggaatgtgctggccccttacgcagtccctagtgagctcgtccttgtggaagaaatccctcgcaatcaaatggggaagatcgataaaaaggctctgattagacacttccatccttcctag

SEQ ID NO: 177884 - DNA, 714 bp, Artificial Sequence
  Description of Artificial Sequence: Synthetic coding sequence
atgctgccccacgtggtgctgaccttccggcggctgggctgcgccctggccagttgtcgtttagctccagccagacacagagggtcgggcttactgcacaccgccccagttgcaagatcagacaggtcagcacctgtgtttacccgggcgttggcctttggtgaccggattgcgctggtagatcagcacggacgacacacttacagagaactgtacagtaggtcactgagactgtctcaagagatctgtagactgtgtggatgtgtggggggtgatctgcgcgaggagagggtttcattcctctgcgccaacgacgcctcatatgtggtggcccagtgggcttcatggatgtctggtggagtggcggtgcccctatatagaaagcacccagccgcacagctcgagtacgttatctgcgatagccagagcagcgtggtcttggcctctcaggagtatttggaactactgagcccagtcgtgcgaaaattgggcgtcccattgctccccctgacccccgctatctacaccggtgccgtagaggagccggccgaagtcccagtaccagaacaggggtggaggaataagggcgccatgattatttacacctcaggcacaactggcagacctaagggagtgctgtcgactcaccaaaacatcagagcagtggtgacagggctcgttcacaagtgggcttggacaaaggacgatgtttag

SEQ ID NO: 177885 - DNA, 2097 bp, Artificial Sequence
  Description of Artificial Sequence: Synthetic coding sequence
atgcaggcccacgagctgttccggtacttccggatgcccgagctggtcgacttcaggcaatacgtgcggaccctccctactaacaccctgatgggatttggggcatttgccgccctgaccaccttctggtacgcaacaagacccaagccacttaagccaccctgtgatctctctatgcagtccgtggaagtcgcaggcagcggcggcgcaagaaggagcgccctgctcgactctgatgagccactggtctacttctacgatgacgtgacaacgctctacgaaggctttcaacgaggcatacaggttagtaacaacggaccctgtcttggaagccgcaaaccggaccagccttacgaatggctgtcatataagcaggtggccgaactgagcgagtgtataggttccgccctgattcagaaagggtttaagactgcgcccgatcaatttattggaatctttgcccagaatcggccggaatgggtgattatcgaacaaggatgttttgcatacagcatggttattgtgcccttgtatgacacactgggcaatgaggctatcacctatattgttaataaggcagagttatcccttgtatttgtggataaacccgagaaagccaaactgttgcttgaaggcgtagagaataagctgatccctggactgaaaatcattgtagtgatggacgcgtatggatcagagctggtcgaacggggccagaggtgtggagttgaggtgactagtatgaaggcaatggaagatctgggccgggccaatcgcaggaagccaaagcctccagctcccgaagatctggctgttatttgcttcaccagtggtaccacagggaatcctaagggtgccatggtgacacacaggaacatagtgtcagattgctccgccttcgttaaagcaaccgagaacactgttaatccatgtcccgatgatacgctcatttcatttctgcctctggcgcacatgtttgagagggtggtcgagtgcgtaatgctgtgtcatggcgccaagatcggctttttccagggggatatccggctgctcatggacgatcttaaggtcttacagcctacagttttccctgttgtgccgaggctgttgaatcgcatgtttgacaggatttttggtcaggcaaatacgacactcaaacgatggttgctcgacttcgccagcaagagaaaggaagctgagttgagatcaggcatcattcgaaacaacagcctctgggaccggttaatattccacaaggtgcaatcgtcattagggggaagagtgcgcctaatggtgactggggctgccccagtttcggccaccgtgctgacattcctacgcgctgccttgggatgtcagttttacgagggatacggccagaccgaatgtactgctggatgttgcctgaccatgcccggcgactggaccgccggtcacgtgggtgctcccatgccctgcaacctgattaagctcgtggatgttgaggagatgaattatatggcagccgagggtgaaggagaagtgtgtgtaaagggcccgaacgtgttccagggttacctgaaagatccggcgaagacagcagaagctctggacaaagacggatggctgcatacaggcgatattggtaaatggctgccaaacgggacgctgaagatcattgatagaaaaaagcatatcttcaagttagcgcagggtgagtatatcgcgcccgagaaaattgaaaacatttacatgaggtcggagccagtcgctcaggtattcgttcacggagaaagcttgcaagccttccttattgctattgtggtgccagacgtggagacactatgctcttgggcgcagaagaggggctttgaggggagcttcgaagaactgtgcaggaataaggacgtgaagaaggctattctggaagacatggtgcgcttaggaaaagactctggtctgaaaccgttcgaacaggtgaagggtataaccttgcatcctgagctgttctctatagacaatgggctgctgactccaactatgaaagccaaaagaccagagctgcggaactacttccgttcacaaattgacgatttatactcaacgattaaagtctag

SEQ ID NO: 177886 - DNA, 1584 bp, Artificial Sequence
  Description of Artificial Sequence: Synthetic coding sequence
atggtgatcgtgcccctgtacgacaccctgggcaacgaggccatcacctacatagtgaataaggccgagctaagcctcgtgtttgtcgataaaccggagaaggccaagctcttgttggaaggggtggaaaataagctcatcccaggactgaagattatcgtggtgatggacgcatacggatccgaacttgtcgaaaggggccagcgctgcggggtagaggtgacctccatgaaagcgatggaagacttaggacgggcaaaccgccgcaagcccaagccccctgcgcctgaggatctggctgtgatatgcttcacctctggtaccaccggaaacccgaagggggccatggttacgcacagaaatattgtttccgattgcagtgccttcgtgaaggcgacagagaacaccgttaatccctgccctgatgatacgctcatctctttcctgccgctggcgcacatgtttgagagagttgtggaatgtgtgatgctgtgccatggagccaagatcgggtttttccaaggagatatacgcctgcttatggatgatttgaaggtgctgcagcccaccgtgtttcctgtggtgcccaggctgctcaatagaatgttcgaccgaattttcggccaggcgaacacaaccctgaaacgatggttgttggacttcgcctcgaaacgaaaggaggccgaacttagatctggcatcattcgcaacaactccctgtgggatcgcctcatttttcacaaagttcagtcaagtctggggggcagggtgcggctaatggtgaccggagccgcccccgtaagtgccaccgtgctaacctttctccgcgccgcccttgggtgccagttctacgagggatacggacagacagaatgcaccgctgggtgttgcttgacgatgcctggggactggactgctggacacgtgggtgccccgatgccttgcaacctgatcaagttggtcgacgtggaggaaatgaactatatggcagcggagggtgagggggaggtgtgcgtgaagggacccaacgtgtttcagggctaccttaaagatcctgcgaagacagccgaagccctggataaagatggctggctgcacaccggcgacattggaaagtggcttcccaatggtacccttaaaattattgataggaagaagcatatctttaagctcgcacagggagaatatatagcccctgaaaagatcgagaacatttacatgagaagcgaaccggtagcacaggtttttgtgcacggggagtcccttcaggcctttttaatcgcaatcgtcgtgccagacgtggaaactctgtgcagttgggcacagaaacggggatttgaagggtcatttgaagagctgtgccgaaataaagatgtcaaaaaggcaatcctggaagacatggtgcggctggggaaagactctggacttaagccatttgagcaggtaaagggcattactctgcatccagagttattctcaatcgataacgggttactgacgccgacaatgaaggctaaacggcctgagttgcgaaactactttcgctcccagatcgacgatttatatagcactatcaaggtctag

SEQ ID NO: 177887 - DNA, 1584 bp, Artificial Sequence
  Description of Artificial Sequence: Synthetic coding sequence
atggtgatcgtgcccctgtacgacaccctgggcaacgaggccatcacctatatcgtgaataaagccgaactgagcttggtgttcgtggacaagcccgaaaaagcgaaactgctcttggaaggcgtagagaataagctgatacctggcctgaaaattattgtcgtgatggacgcctacgggagtgagttagttgagcggggacagaggtgcggtgtggaggtcaccagcatgaaagcaatggaggatctgggaagggcgaaccgccgtaaacctaagcctccggcgcctgaggacctagctgtcatctgttttacaagcggcaccaccggaaatccaaaaggcgccatggtaacacaccgcaacatcgtgtccgattgcagtgcctttgttaaagctactgagaacacagtaaatccatgtccagacgacacccttatttccttcctccctctcgcgcacatgtttgaaagagtcgtagagtgcgtaatgctgtgccatggggctaagatcggcttcttccagggcgatatacgtctcctcatggatgacctgaaggtacttcagccaaccgtttttccagtggtgcctagattgctgaacagaatgtttgatcgcattttcggtcaggctaacactacattgaaacggtggttgctggatttcgcctccaagaggaaggaggcggagctccgcagcggcattatacgtaataacagtctgtgggaccggctgattttccataaagtgcagagcagtcttggcggcagggtccgtcttatggtaacgggagctgccccagtcagcgctaccgtgttgactttcctgcgggccgccttgggctgtcaattctatgaaggatacggtcagaccgaatgtactgccgggtgttgtttaacgatgccaggagattggaccgccgggcacgtcggcgccccgatgccgtgcaatcttattaagcttgtggatgttgaagaaatgaattacatggctgccgaaggcgaaggagaggtctgtgttaaaggccctaacgtgtttcaggggtatctgaaagaccctgccaaaacggctgaggcgctggataaggatgggtggctccacaccggcgacatcggtaagtggctcccaaatggtaccttgaaaatcatcgatagaaagaagcatatcttcaaattggcgcaaggggagtacattgccccagaaaagattgagaacatatacatgcgttctgaaccagtggcccaggtgtttgtccatggggagtcgctgcaggcatttttaattgccatcgtggtgcccgacgtggaaacactgtgtagctgggcccagaaacgaggatttgagggctccttcgaagagctgtgccgcaacaaagacgtcaaaaaagcaattctcgaagacatggttaggttagggaaagactcaggtttaaaaccatttgaacaggtcaaaggaatcacccttcacccagagttattttcaatagacaatgggctactcacacccacaatgaaggctaagcgccctgagttacgcaattacttcaggtctcagatcgatgatttgtattccaccataaaggtgtag

SEQ ID NO: 177888 - DNA, 2097 bp, Artificial Sequence
  Description of Artificial Sequence: Synthetic coding sequence
atgcaggcccacgagctgttccggtacttccggatgcccgagctggtggacttcagacagtacgtacgaacgttgcctacgaatactctcatggggttcggagctttcgccgcccttactaccttctggtatgccacacgcccgaagccgctcaaacccccatgtgatctgtcaatgcaaagcgtggaagtggcaggctccggcggcgcaaggcgatctgcactactggactcagacgaacccttggtctacttttatgatgatgtaaccactctatacgagggcttccaacggggcatccaagtgtcgaataacggcccctgtctcggttctaggaaacctgatcagccatatgaatggctgtcctacaaacaggttgccgaactttctgagtgtataggctcggccctgatccagaaaggcttcaagaccgcacctgatcaattcataggaatcttcgcccagaataggcctgagtgggtgataattgaacagggctgttttgcgtatagcatggtgattgtgcccttgtacgacacccttgggaacgaagcaattacctatatcgtgaataaggctgaactcagcctggtgttcgtagataaaccggaaaaggccaagttgctactggaaggcgtggaaaacaaactgatcccgggcctcaagatcatcgtggttatggatgcatacggctccgaactggtcgaaagggggcagcgctgtggtgtggaagtcacgagcatgaaagctatggaagacctcgggagggccaataggaggaaacctaagccacctgctcccgaagacttggctgtgatttgctttacaagcggtactaccgggaaccccaagggagccatggtgacccaccgaaatattgtaagcgattgtagcgcgtttgtgaaggccacagagaacaccgtcaacccgtgtcccgacgatacactgatctcctttctgccactcgcccacatgtttgagagggtggttgagtgcgttatgctgtgtcacggagccaagatcggattttttcaaggagatataagattactgatggacgatcttaaagtgcttcagcctaccgtctttcctgttgttccacggcttcttaatcgcatgttcgaccggatatttggtcaggccaatacaaccttaaagagatggctgttggactttgcctcaaagagaaaagaggccgaactccgatccggtattatcagaaataattctctttgggatagactaatattccataaggttcagtcaagcctcgggggcagagtgaggctcatggtgactggagcagcgccagtttctgcgaccgtgttgactttcctccgagccgcgctgggttgtcagttctacgaaggctacgggcaaaccgagtgcaccgcaggctgttgtttgaccatgcccggtgactggaccgccgggcacgtgggtgcacccatgccctgcaatctgataaagctggtagatgtggaggagatgaattacatggctgctgagggggagggtgaggtgtgtgtgaaagggccaaacgtgtttcaggggtatctcaaggatcctgccaaaaccgccgaagccctggataaagacggttggttgcatacgggggacattgggaagtggctgccgaatggaacgttgaaaatcatcgacagaaaaaagcacatcttcaagttagcccagggagaatatatagccccagaaaaaatagaaaacatatacatgagaagcgagcccgtcgcacaggtcttcgtgcacggagaatcactgcaggcctttctcatagctatagtggttcccgatgtcgaaaccctgtgctcctgggcacagaagagagggtttgagggcagcttcgaggagctctgccgaaataaagatgtaaagaaggctattctcgaggacatggtccgcttgggaaaggactctgggctgaagccgttcgagcaagtcaaaggaattactctccaccctgaattgttctctatagataacggcttactgacgcccacaatgaaagctaagcgccccgagcttcggaattattttcgcagccagattgatgatctgtacagcactattaaagtctag

SEQ ID NO: 177889 - DNA, 1995 bp, Artificial Sequence
  Description of Artificial Sequence: Synthetic coding sequence
atgcaggcccacgagctgttccggtacttccggatgcccgagctggtcgattttcggcagtacgtgcggacactccctaccaatacactaatgggtttcggagcctttgccgcattaaccactttctggtatgccacaagacccaagccgctgaaaccaccctgtgacctgagcatgcagtcagttgaagtagccggaagcggcggcgccaggcgctctgccctgcttgactctgacgagcctctcgtttatttctatgacgatgtcactactctgtacgagggcttccagcgtggcatccaggtgagcaacaacggtccatgtttaggctctaggaagccggatcagccatatgaatggctgagctacaaacaatgggtgattatcgagcaaggctgtttcgcctactccatggtaatcgtgcctttgtacgataccctgggtaacgaggccattacatacatcgtcaacaaagctgagctgtccctggtatttgtcgacaagcccgagaaggccaagctgctgctggagggtgttgagaataaactgatacctgggctgaaaatcatcgtggtgatggacgcttatggatccgaactcgtcgaaagagggcaacggtgcggagtagaggtgactagcatgaaggccatggaagacctcggtcgggctaatcgccggaaacctaagccacctgctccggaagatctggctgtgatctgttttacttcagggacaaccggaaatcctaagggagcgatggtcacacatcggaacatcgtatctgattgtagcgcgttcgtaaaggctactgaaaatactgtaaacccctgtcctgatgacactctgatctctttcctgcccctggctcatatgtttgagcgtgtcgtggagtgtgtaatgctgtgtcacggagcgaaaataggtttctttcagggcgacatcaggctcttaatggatgacctgaaggtcttacagccgacagtgtttcctgtggtccccaggctgttgaataggatgtttgacagaatatttggtcaagctaacacaactctcaagcgatggctgttggactttgcatccaaacggaaggaggccgaactgcgaagcgggatcatccgaaataactccctatgggaccgccttatatttcacaaggtgcagtcctctcttggaggacgcgtgcgcctgatggttactggcgctgcaccggtatcagcaacggtcttgacctttctgagagcggcccttggttgtcaattttatgaaggctatggccagacagagtgcaccgcaggctgctgtttaaccatgccgggcgactggaccgccggtcacgtgggtgcccccatgccctgtaatctgatcaaactggtggacgtggaggagatgaattacatggcagccgaaggcgagggggaggtttgcgtgaaagggcccaatgttttccaaggatacctgaaagacccggccaaaacagctgaggccctagacaaggacggctggctgcacaccggagacataggcaaatggctgcctaatggaactctgaaaatcatagatagaaaaaagcacatattcaaactggcccagggtgagtatattgcacccgagaagattgagaatatctacatgcgatccgaaccagtggcacaggtattcgtgcacggcgagtcattgcaggctttcttaattgccattgttgtccccgacgtggagactttatgcagttgggctcagaaacggggctttgagggtagctttgaggagctgtgccgaaataaagacgtgaagaaagccatactggaagatatggttcgattggggaaggactccgggctcaaacctttcgagcaggtcaagggcatcactctgcaccctgagctcttttcaattgacaatggactgctcaccccaactatgaaggctaagaggccagaacttagaaactattttagatcccaaatcgatgacctttattcaaccatcaaggtgtag

SEQ ID NO: 177890 - DNA, 2097 bp, Artificial Sequence
  Description of Artificial Sequence: Synthetic coding sequence
atgcaggcccacgagctgttccggtacttccggatgcccgagctggtggactttcgtcagtatgtgagaaccttacccactaatactttgatgggtttcggggccttcgcagccctgaccacattttggtatgcaacaaggccgaaaccgctaaagcccccttgtgacctgtcgatgcagagcgttgaagtggctgggagcggaggcgcacggagatctgccttgctggactctgatgagcctttggtttatttttatgacgacgtaacaaccttgtacgagggctttcagaggggaatccaagtgtctaacaacggcccatgcttggggagtaggaagcctgaccagccatacgagtggcttagctacaagcaggtagcagagctaagcgaatgcattgggtcagcattaatccagaaggggtttaagactgcaccagatcaatttattggaatttttgcccagaaccgccccgaatgggttattatcgaacaggggtgctttgcatatagcatggtgatcgttccgctgtacgataccctcgggaacgaggcaataacatacatcgtgaataaagccgaacttagtttggtgtttgtcgataaacctgagaaggccaaattactgcttgagggggtagagaacaaattgattccagggcttaagattattgtggtaatggatgcatacggcagcgagctggtggaacggggtcagcgatgtggagtcgaggtgacctctatgaaggcgatggaagacctgggacgggccaaccggcggaaacccaagccccccgctcccgaggacttagcggtcatttgcttcacatccggcactaccggaaatcccaagggcgctatggtgacgcatcggaacattgtttccgactgctcagcctttgtcaaggccactgagaacacagtgaatccttgccctgacgacacactgattagcttcttgcccctggcacacatgtttgaaagggtcgtcgagtgcgtgatgctgtgccatggggctaagatcggtttcttccagggtgacatacgactgcttatggacgacctgaaagttctgcagcccacggtcttcccggttgtccccaggttgctgaatcgtatgttcgatagaatatttggacaggcaaacacaacccttaagaggtggctcctggacttcgcgtcaaagcggaaagaagccgagctgcgctctggtattattcgtaataattctctgtgggacagacttattttccataaggtgcagagcagcctgggtggcagagtgaggctcatggtgaccggcgcagctccagtctccgccacagtgctgacgtttctgcgcgctgctttaggttgccagttctacgaaggctacggccagaccgaatgtacggcaggttgttgtctgaccatgcccggggattggaccgcgggccacgtcggcgctcccatgccctgcaacctgataaaattagtagacgtggaagaaatgaactatatggcagctgagggagagggcgaggtatgtgtgaaagggcccaacgtcttccaagggtacttaaaggatccagctaagaccgcagaggcactggataaagatggatggttgcacactggagatatcggtaagtggctccctaacggcacgctgaaaatcattgaccgcaagaaacacatctttaagctggctcaaggggagtatatagcccctgagaaaattgagaacatttatatgaggagcgagccggtggctcaggtgtttgttcatggtgagagtctccaagcgtttttaattgctattgtggtgccggatgtcgaaacgctgtgttcatgggcccaaaagagggggtttgaaggctcctttgaagagctttgcagaaataaagacgtgaaaaaagccattctcgaggacatggtgcggctaggaaaagacagtggcttgaagccattcgaacaggtcaaaggaatcacactgcatccggagctgttctccatcgacaacgggctccttacaccgacaatgaaagccaaacggcccgaactgcggaattatttcagaagccagattgatgacctctattccacaatcaaagtgtag

SEQ ID NO: 177891 - DNA, 2163 bp, Artificial Sequence
  Description of Artificial Sequence: Synthetic coding sequence
atgaacaaccacgtgagcagcaagcccagcaccatgaagctgaagcacactattaacccaatcctgttgtattttatccacttcttaatatcactgtatactatactgacatacattcccttctatttcttctcagagtcccgccaggaaaagtccaatagaattaaggctaaaccggttaactccaagccagatagtgcctatcgcagcgttaactcgctcgatggactcgcgtcggtgctgtatcctgggtgtgatacactagataaggttttcacatatgctaagaacaagttcaagaacaaaagactgttgggcacacgtgaagtcctgaacgaagaggatgaggtccagcctaatggtaagatcttcaaaaaggtaatcttgggtcagtacaactggctgtcctacgaggatgtctttgtccgggcattcaattttggcaatggtctccagatgctgggacagaagcccaaaacaaatattgctatattctgtgaaacacgggcagaatggatgatcgccgcccaagcctgctttatgtataatttccagttggtgacactgtacgcaaccttaggcggacctgcgatcgtgcacgcgcttaatgagaccgaggtgaccaatattattacaagtaaggagctgctgcagactaaacttaaggacatcgttagcctggtgccacggctgcggcatattatcacagtcgacggaaaacccccaacatggagcgagttccctaaaggcataatcgtacatacaatggctgcagtggaggctctcggtgccaaggcttccatggaaaaccagcctcacagcaagcccctgccttcggacatcgccgtgataatgtatacatctggctcgactggcttgcccaagggcgtcatgatctctcattctaacattattgccgggattacgggcatggctgagcggattccggagttgggggaggaagacgtgtatatcggctatctgccccttgctcatgttctagagctatctgccgagttagtgtgtttgagccacggatgccgcattggttatagttctcctcagacgctggccgaccagagcagcaaaattaagaaaggcagcaagggggacactagcatgctcaagccgactctcatggcggctgtacccgagatcatggaccggatttataaaaatgttatgaataaggtgtctgagatgagctcattccagcgaaatctttttatcctggcttacaactacaagatggaacagatctctaaaggtaggaacaccccactgtgcgacagtttcgtattccgcaaggtaagatccttgctgggtggcaatattcgcctgctactgtgtgggggcgctccattgtcagcaacaacgcagcgcttcatgaacatttgcttctgctgcccagtgggacagggctatggcctgaccgagagcgcaggggcaggcaccatcagtgaagtgtgggactacaacaccggacgtgtgggcgctccccttgtttgctgcgagattaagctgaagaactgggaggagggtgggtactttaatacggataaaccccacccaaggggggaaatcttgatcgggggccaatctgttaccatgggctattacaagaatgaggcgaaaacaaaagccgatttcttcgaagacgagaacggtcagcggtggctgtgtaccggggacatcggggagttcgagcctgacggatgtctgaagataatagataggaagaaggaccttgtgaagctgcaggctggcgagtacgtgtcactcgggaaagtagaggcggctttaaagaatcttcccttagtggataacatctgcgcatacgccaattcctaccactcttacgtgatcggtttcgtggtgcccaaccagaaagagctgaccgaactagcgcgcaaaaaagggctgaaaggaacgtgggaagagctgtgcaattcctgcgagatggagaacgaggtgttgaaggtcctttctgaggccgctatcagcgcatccctggagaaatttgagatccccgtaaaaattagactgtcacccgaaccatggactcccgaaaccggccttgtcacagatgcttttaagctgaagcgaaaagagcttaaaactcattatcaggccgacatcgaacgcatgtacggtagaaaatag

SEQ ID NO: 177892 - DNA, 2163 bp, Artificial Sequence
  Description of Artificial Sequence: Synthetic coding sequence
atgaacaaccacgtgagcagcaagcccagcaccatgaagctgaagcacacaatcaacccaatcctcctgtactttatccactttctgattagcctatatactatcctgacctacattcctttctacttcttctcggagagccgacaggagaaatcaaaccgcataaaggctaagccagtcaacagcaaacccgatagtgcatataggtccgtcaacagcctagacgggttggccagtgtgctgtaccccggatgcgacacgctggataaggtgttcacatacgccaagaacaaattcaagaacaagagactcttaggcaccagggaggtcctcaatgaagaagacgaagtgcagcctaatggcaaaatttttaaaaaggtcattcttgggcaatataactggctttcatatgaggacgtatttgtcagggccttcaatttcggtaatgggctgcagatgttgggacagaagccaaaaacaaatattgccatcttttgtgagaccagggcggaatggatgattgccgcccaggcttgtttcatgtacaattttcaactggtgaccctgtacgccaccttgggcggcccagccattgtgcatgcattgaatgaaaccgaggtcacaaacattatcacctcaaaagagctgctgcagactaagctgaaagacatagtgagtctggtccctaggcttcgacacattattaccgtagatggtaaacccccaacctggagcgagttcccaaaaggcatcatcgttcacacaatggccgcagtggaggctcttggagccaaggcttctatggagaaccagccgcatagtaagccactcccctcagatatagctgtgattatgtataccagtggctcaactggattgccgaagggagtcatgattagtcactcaaatatcatcgccggcattacggggatggcagagcgtatcccagaactgggggaggaagatgtgtacatcggatacctgccactggctcacgtactggagctgagcgccgaactggtgtgccttagtcatgggtgccgtatcggttacagttcgccccagaccttggcagaccagtcttctaaaattaagaaaggtagtaagggggatacaagcatgctcaaacccacactgatggccgcagtgccagagatcatggatcgcatttacaaaaacgtaatgaataaagtgtctgaaatgtccagttttcagcggaacctcttcattttggcatacaattacaaaatggagcagatctctaaggggaggaatacacccctctgtgacagcttcgtcttcagaaaggtgaggagcctgcttggagggaatatacgtcttttattgtgtggcggtgccccactaagtgcgacaacacagagattcatgaatatttgcttctgttgccctgtgggccagggctacggcctgacagagtcagctggagctgggacaatcagcgaagtgtgggactataacaccggtcgcgtcggcgctccgctcgtctgttgcgagattaagctgaaaaactgggaagaaggcggttactttaacactgacaaaccccatcctcgcggagagatcttgatcggaggccagagtgtgacaatgggatactataagaacgaggcaaaaaccaaggcagactttttcgaggacgaaaatggtcagcgctggctttgtactggagacataggcgaattcgaacccgatggctgccttaaaataattgacagaaaaaaggacctcgtgaagctccaggcgggggagtacgtgtctctgggcaaagtcgaagccgctttaaagaacttaccccttgtggacaacatttgcgcgtatgctaattcttaccatagctatgtaattggattcgtcgtccccaatcagaaggaactgaccgagctggcacggaaaaaagggcttaaggggacatgggaagaactttgcaacagctgcgagatggaaaatgaggtgctgaaggtgctaagcgaagccgctatctccgcttcattggagaagttcgaaatccctgtgaagatccggctctccccagagccatggacaccagagaccggcctcgtgaccgatgcatttaagctgaagcgcaaagagcttaaaacacattatcaggcggacatcgagcggatgtatgggaggaagtag

SEQ ID NO: 177893 - DNA, 267 bp, Artificial Sequence
  Description of Artificial Sequence: Synthetic coding sequence
atgaacaaccacgtgagcagcaagcccagcaccatgaagctgaagcacacgattaacccgatccttctttatttcatccacttcctgattagcttatatacaatattgacctacatccctttctatttcttctccgagtcacgccaggagaagtcaaaccgcataaaagccaagcccgtgaatagcaaacctgacagcgcctacaggtcggtgaattcacttgatggcctcgccagtgtactttaccccggatgtgatactctatag

SEQ ID NO: 177894 - DNA, 288 bp, Artificial Sequence
  Description of Artificial Sequence: Synthetic coding sequence
atgaacaaccacgtgagcagcaagcccagcaccatgaagctgaagcatacaatcaatcccatcctgctctacttcattcacttccttatttccctctatactatcttgacatacattccattttactttttcagtgaaagccgtcaggagaaatccaacagaattaaagcaaaacctgtaaatagtaagcctgactcagcctaccgctcggtgaatagtttagacggactggcctccgtcctctacccgggctgcgacaccctagacaaagtctttacctacgcatag

SEQ ID NO: 177895 - DNA, 2052 bp, Artificial Sequence
  Description of Artificial Sequence: Synthetic coding sequence
atgctgttcatcttcaacttcctgttcagccccctgcccacccccgcccttatctgtattctgacctttggtgcggccatcttcctgtggctgataactcgaccccagcccgtgctgccactgctagacctgaacaaccaatccgttgggattgagggcggggcaagaaagggcgtgagccagaaaaacaacgatctgactagttgttgttttagcgacgcaaaaaccatgtatgaggttttccagaggggtttggctgtgtccgataacggaccctgtctgggttatcgtaaaccaaatcagccctatcggtggctcagttataagcaagttagtgaccgcgccgagtacttaggatcatgcctgctgcataaaggttataagtcctctcccgatcagttcgtcggtatctttgcgcaaaaccgccctgaatggatcatctctgaactcgcctgctacacttacagcatggtggctgtgcccctgtacgacaccctgggaccggaggcaatagtgcacatcgtgaataaagctgatatcgcgatggtgatatgtgacacgcctcagaaagcgttggtcctgattggaaacgtggagaaagggtttaccccttcattgaaggtgattatcctgatggatccgtttgacgatgacctaaagcagaggggggagaaatcaggtattgagatactgagcctgtatgacgcagagaatttaggcaaagagcacttccgcaagcctgtcccaccatctccggaggatttgagcgtgatctgcttcacatccgggactacaggcgaccctaagggagcgatgataacacatcagaacatcgtgtccaatgcagctgcctttctgaaatgtgtggagcacgcatatgaacctacgccagatgacgtggccatcagctaccttcccctggcccacatgtttgagcgaattgtccaagctgtggtgtacagttgcggcgccagggttggcttctttcaaggcgacattcggctgttagctgacgatatgaaaacattgaagcctaccctctttccggctgtcccccgcctgctcaacaggatatatgacaaggtacagaacgaagctaagacgcctttgaagaaattcctactaaagctggctgtttcaagcaaattcaaggagctccagaaagggatcattagacacgacagcttctgggataagcttatcttcgccaaaattcaggactctctgggggggagggtgcgagtgattgtcacaggtgctgctcccatgagcacctccgtcatgaccttctttagggctgccatgggatgtcaggtgtatgaggcctatggacagactgagtgtacgggtgggtgcacttttactctccctggagactggacatccggacacgtgggcgttccattggcttgcaactatgtaaaactggaggatgttgccgatatgaactattttaccgttaataacgaaggggaagtttgcattaaggggactaatgtgttcaagggttatctgaaggatcccgagaaaactcaggaagccctggatagcgacggctggctacacacgggcgatatcggtagatggttacctaacggtacactcaagataattgatagaaaaaagaacatcttcaagctcgcccagggggagtacatcgcacccgaaaaaatcgaaaatatatataatcgttcccagccggtcttacagatattcgtccatggagaatctctgcggtcctctctggtgggggtagtggtcccagacacggatgtcctcccctccttcgccgctaaactaggagtcaaaggctccttcgaggagttgtgccagaaccaggtagtgagagaagcaatccttgaggacctacagaagatcggcaaggaatcaggactgaagactttcgagcaggtgaaggccatcttcctacatccagaacccttctcgattgagaacgggttgctaacccctactctgaaagcgaagcgaggtgagctttccaagtacttcagaacacagattgacagtttatacgagcacatacaggactag

SEQ ID NO: 177896 - DNA, 2052 bp, Artificial Sequence
  Description of Artificial Sequence: Synthetic coding sequence
atgctgttcatcttcaacttcctgttcagccccctgcccacccccgcgctcatttgtattctgactttcggtgcagcgatcttcctgtggctcatcacccgacctcagcccgtcctaccattgcttgacctcaataaccaaagcgtaggcattgaggggggcgcccggaagggagtctctcaaaaaaacaatgatctgacctcctgttgcttcagtgacgccaaaaccatgtatgaggttttccaacgcgggctggctgtctcggacaacggcccctgcctggggtaccgtaaacccaaccaaccctaccgttggctcagttataagcaggtctcagaccgggccgaatacttgggttcttgtctcttgcataagggttataaaagcagccctgaccaattcgtgggcatctttgcccaaaatcgacccgaatggatcatcagcgaactggcgtgctacacatatagtatggtggcggtccctctgtatgacaccctaggccccgaggcgatagtgcatatcgttaacaaggctgacatcgccatggtaatttgtgacactccacagaaggctttggttcttatcggtaatgtcgagaaggggtttacgccttccctgaaggtcatcattctgatggatcccttcgatgatgaccttaaacaaagaggagagaaaagcggcattgagatattgtcactttacgacgcggaaaatttaggcaaggagcattttaggaagcccgtgccgcctagtcccgaagatctaagtgttatttgctttacctctgggacaaccggcgacccaaagggggcaatgatcacgcatcaaaatatcgtcagtaatgcggcagctttcctaaaatgcgtggagcacgcttacgaacccactcctgatgacgtggcaatatcttatttgcctttggctcacatgtttgagagaatcgtccaggcagtagtttacagctgtggcgctagagttggtttctttcaaggcgatattaggctgttggccgacgatatgaagactttgaagcccacactgttccctgcagttcctaggctattgaatcggatctacgacaaagtgcagaacgaggcgaaaactcctttgaaaaagttccttttgaagctggcagtgtctagcaaattcaaagaactccagaaaggcatcatcaggcatgatagtttttgggacaagcttatctttgccaagattcaggactctctgggggggagggtgcgtgtcatagtgactggcgcagccccaatgagcacctcagttatgaccttctttcgggcggcgatgggctgtcaggtgtatgaggcgtatggacagactgaatgcacaggaggttgcactttcacccttccaggtgattggacgtcaggacatgtgggggtccccctcgcctgcaattatgtgaaactggaggacgtggccgacatgaactatttcacagtgaacaacgagggggaggtgtgcattaagggcactaatgtgtttaaggggtatctgaaagatcctgagaaaacacaggaggctctggacagcgatgggtggctgcatacaggagatatcggcagatggttacccaacggaactctcaagattatcgacaggaagaaaaacatattcaagctggcccagggagaatatattgccccagagaaaatcgagaacatctataaccgcagtcagcctgtcctgcaaatttttgtacatggtgagtccctccgatcttctttagtgggagtcgttgtcccagacaccgatgtactgcctagcttcgcagccaagctgggagtgaaggggtcctttgaggagctgtgtcagaatcaggtggtgagagaggccattcttgaagatctccagaagattggaaaagagtctgggctgaagaccttcgagcaggtgaaagcgatttttttgcaccccgaacctttctctatcgagaacggcctcctgacccctacactgaaagcaaagcggggtgagctgagcaagtacttccggactcagatcgatagtctgtacgagcacattcaggactag

SEQ ID NO: 177897 - DNA, 2220 bp, Artificial Sequence
  Description of Artificial Sequence: Synthetic coding sequence
atggacgccctgaagcccccctgcctgtggcggaaccacgagcgggggaagaaagaccgtgactcctgcggaaggaagaactcagaacccggatccccgcattcattggaggcactccgtgacgccgcaccctctcagggcctgaattttctgttgttgtttactaaaatgttgtttatatttaatttcctgttcagtcccctacctaccccagcactgatctgtattttgaccttcggggctgctatctttctttggttaatcactagacctcagccagtcctaccactgcttgatttgaataatcagagcgtgggaatcgagggaggagctcgaaaaggggtgagccagaagaacaatgatcttacttcctgttgtttctccgacgcaaaaacaatgtacgaggtgttccagcggggactggctgtctcagacaatgggccttgcctgggctatcgtaaacctaatcagccatatcggtggttgagttacaaacaggtaagcgatcgcgctgagtatctcggatcctgtctactccacaaggggtacaagtcctctccagaccagttcgtgggaatcttcgcccagaacagacctgagtggataatatccgagctggcctgctacacatactcaatggtcgcggttcctctgtatgacaccctgggtccagaggccattgttcacatcgtgaataaagctgacattgccatggtgatttgtgatacaccccaaaaggccttggtgctcataggaaacgtcgaaaagggcttcaccccctctttgaaggttattattctgatggacccatttgacgacgatttgaagcaacgtggtgaaaaatcagggattgagatcttgagcctgtacgatgctgagaacttgggaaaagaacacttcaggaagccagttccccccagtcctgaagacctgtcagttatatgcttcacttcaggaaccacgggtgatcctaaaggagccatgatcactcaccagaacatcgtgtcaaatgcggccgcttttctgaaatgcgttgagcatgcttatgaacctacacctgatgatgtggcaataagttacctccccctggctcacatgttcgagcggatcgtgcaggcagtcgtctactcgtgtggagccagggtgggattcttccagggagatatccgactcttagcagacgatatgaaaaccctcaagcccaccctgtttccggccgtgcctagattactgaaccgaatttacgacaaggttcagaacgaagctaaaaccccattaaagaaatttctgcttaaactcgcagtgtctagcaagttcaaggaactgcaaaaggggattatccggcatgattccttctgggataagctgattttcgccaagattcaggattccctggggggaagagtcagggtcatagtgaccggcgcagcccccatgtcaacatctgtgatgaccttcttccgcgcagcaatgggttgtcaggtatacgaagcctatggtcagactgaatgtacaggtggctgcaccttcaccctcccaggagattggacttcaggacacgtcggcgtgcccctagcttgcaattacgtcaaattagaagacgttgccgacatgaactactttactgtgaacaatgagggcgaggtgtgcattaaaggcaccaacgtgtttaagggatatttgaaggacccggagaaaacacaggaggcactcgatagtgatggttggctgcataccggcgacattggacggtggctcccgaacggaacactgaaaatcatcgatcgcaaaaagaacattttcaagttagcccagggagagtatatcgcacctgagaaaatcgaaaacatctataataggtcacagccagtgctccaaattttcgtgcatggagaatctctgcgcagctctctagtgggtgttgttgtgcctgacacggatgtcttgccaagttttgccgctaaactaggggttaaaggaagtttcgaagagctgtgccagaatcaggtggtaagggaagcaatattagaggatttgcagaagatcggcaaggagagcggcctgaaaacctttgagcaggtaaaagcaattttcctacaccctgaacccttcagtatcgaaaacgggctccttacccccacattgaaggccaagagaggcgagctcagtaagtactttcgtacgcagatcgactccctgtacgagcacatccaggactag

SEQ ID NO: 177898 - DNA, 1398 bp, Artificial Sequence
  Description of Artificial Sequence: Synthetic coding sequence
atgctgttccccggcgccagcatcgtgcccgagtgctggctgctggttctcatccaaaatctcgggaaggaacactttcgaaagcccgtgcctccctcccccgaggacctctctgtgatttgttttacatcggggaccaccggtgaccccaagggcgccatgattacccatcagaacatcgtctccaacgctgccgcatttttaaaatgtgtggaacacgcatatgaaccgacccccgacgacgtagcaattagctatctacccctagctcacatgttcgagcgtatcgtgcaagctgtagtctattcatgtggtgcacgggtggggtttttccagggagacatccggctacttgctgatgacatgaagactttgaaaccaacactcttcccagccgttccaaggctccttaaccgcatctacgataaagtccagaacgaagccaaaacacctctgaaaaagttcttactaaaactcgccgtatcttccaagtttaaggaactccaaaagggaataattcgtcacgactcattctgggataagctcatttttgccaaaatacaggactcgttgggtggacgggtgagagtgatagtcacaggtgcggccccgatgagcacatccgttatgacgtttttccgtgcagctatgggctgccaggtctacgaagcttatggacagaccgagtgcactgggggctgtacattcacactgcctggagattggacctctggacatgtcggggtgccactggcctgcaattacgtaaagcttgaagacgtcgctgatatgaattactttacggttaacaacgaaggcgaggtgtgtatcaaaggtacgaacgtgtttaagggttatctaaaggaccctgagaaaactcaggaggcactggatagtgacggctggctgcacacgggagatattggtcgctggctacctaatggaacactgaagataatcgaccgtaaaaagaacatctttaagctggctcagggcgagtatattgcacctgagaaaattgagaatatctacaatcggtcccaacccgttctgcagatctttgtgcacggcgagtcgctcagatcaagcctcgtaggagtcgtcgtgccagatactgatgtactgccatcgtttgctgccaaattgggagttaagggttctttcgaggagctctgccagaaccaggtcgtccgggaggccattctagaggacctgcagaaaattgggaaggaaagcggacttaagacattcgagcaggtcaaagctatcttcctgcacccggagcccttttcaatcgagaacgggctgcttacacctacactcaaggctaaacgcggtgaactgtcgaaatattttagaacgcaaatcgatagcttgtacgaacacatccaggactag

SEQ ID NO: 177899 - DNA, 2052 bp, Artificial Sequence
  Description of Artificial Sequence: Synthetic coding sequence
atgctgttcatcttcaacttcctgttcagccccctgcccacccccgctctcatctgcatccttaccttcggagctgcaatcttcctgtggctgatcactaggccacagcccgtgctgccattgctggacctaaataatcagtctgtcggaatagaggggggtgctcggaaaggggtcagccaaaaaaataacgacctgacctcgtgctgcttttccgacgccaaaacaatgtacgaggtgttccagcgcggcctagcagtaagtgataacggtccatgcctggggtacaggaagccgaatcagccctaccggtggctgagttacaaacaagtgtccgaccgtgccgagtacctggggagctgtctcctgcacaagggttacaagagttctccagaccagttcgtcggcatcttcgcacagaacaggccagagtggatcattagtgagcttgcctgttatacttatagcatggtggcagttcctctgtacgacactttgggtcccgaggcaatagtacatatagtcaacaaggctgacattgccatggtgatatgtgatacaccccagaaagcacttgtacttatcggcaacgtcgagaagggcttcaccccaagcctgaaagtgatcatcctaatggacccttttgatgatgatctcaagcagagaggcgagaagtcgggaattgaaatactgtcgctgtatgacgctgaaaatctggggaaggagcattttaggaagccagtcccccccagcccggaagacctgtctgtgatctgttttacatccggcacaaccggcgatcccaaaggagctatgatcacccatcagaatatagtgtcgaacgcagctgctttcttaaagtgtgtcgaacatgcatatgagcctacccccgacgacgtagctattagttatctgcccctggctcacatgtttgaaagaatagtgcaggctgtggtgtactcctgtggagccagagtcggctttttccaaggagacatccgtctgttggcagatgacatgaaaacactcaagccgacactgttccccgcagtaccaagactgctgaatcgcatctatgataaggtgcaaaacgaagccaaaacccccttaaaaaagtttctgctgaagttagctgttagctctaaatttaaagaactgcagaagggcatcatcaggcatgactcgttctgggacaaactgatcttcgctaagatccaggattcactgggcgggcgggtccgagttattgtaacaggcgctgcaccaatgtcaacaagcgtcatgactttttttagggccgccatggggtgccaggtgtatgaggcctacggacagacggagtgtacgggcggctgcacctttaccctaccaggggactggaccagcggccatgtaggagtgccactcgcctgcaattatgtcaagttggaggatgtggcagacatgaactacttcacggtaaacaatgagggcgaggtctgtattaaagggaccaacgtctttaagggatatttgaaggaccctgagaaaacacaggaggccctggactcagatggttggctgcacaccggagacatcggcaggtggctgccaaacggaaccctgaaaatcattgatcgaaaaaaaaatatctttaagctcgcccagggtgagtatatcgcccccgagaaaattgaaaacatctacaacaggagccagcctgtgctgcagatttttgtgcacggagaatccctcaggtcctcccttgtcggggtggtggttccagatacagacgtgctgccatcttttgctgctaaactgggcgtgaaagggtccttcgaggagctgtgccaaaaccaagttgtccgcgaggccattctggaggacctgcagaagatcggtaaggaatccgggctcaaaacatttgagcaggtgaaagccatcttcctccaccctgaacccttcagcatagagaacggactactgacccccaccctgaaggcaaaaagaggggagctgtcaaagtatttcaggacccagatagactcactttatgaacacattcaagactag

SEQ ID NO: 177900 - DNA, 1980 bp, Artificial Sequence
  Description of Artificial Sequence: Synthetic coding sequence
atgctgttcatcttcaacttcctgttcagccccctgcccacccccgcactgatctgtatacttacctttggtgcagcgatattcctgtggttgatcacacggcctcagccagtacttccgctgctcgaccttaataatcagagcgtaggcatcgaaggcggcgcccggaagggggtctcccagaaaaataatgatcttacatcctgctgtttcagcgatgccaaaacgatgtatgaggtctttcaaaggggcctagctgtgtctgacaatggaccatgcctaggctaccgaaagccaaaccagccgtatagatggctcagttacaagcaggtgtcagatagggctgagtatctggggagttgtctcttacataagggctacaagtccagtcctgaccaattcgtcggaatttttgcacagaacaggcccgagtggattatttctgaactggcctgttatacctattccatggttgccgtgccactctacgatactctaggcccggaggctatcgtccacatcgtcaacaaagccgacatcgccatggtcatttgcgacacaccccagaaagcactggtgctaatcggtaatgtagaaaaaggatttacccctagcctgaaggtaattattttgatggatccgtttgatgacgacttaaaacagagaggcgaaaagtctggcattgaaatactaagtctgtacgatgcagagaatctaggaaaggagcatttccgcaagcctgtacctccttcacctgaagacctcagcgttatctgtttcacctccggtactaccggcgatccaaaaggagcgatgattacgcaccaaaacatcgtatccaatgccgccgcttttttaaagtgcgtcgaacacgcctacgaaccaactcctgatgacgtcgcaatttcatacctgccactggcacatatgttcgaaagaatcgtgcaggccgtggtatattcttgtggggcaagagtgggctttttccagggcgacattcgcctgttagcagacgacatgaagaccttgaagcccaccttgtttcctgccgtgcccagattattgaatcgtatttatgataaggtacaaaatgaagccaagacccctctcaaaaagttcttgctcaaactcgctgtctcatccaaattcaaggaattgcagaaaggcataattagacacgatagtttttgggataagctcattttcgccaagatccaggactcacttggtggccgggtgcgcgtgatcgtgacgggtgcagctcctatgtctacaagtgtgatgaccttctttagggccgcgatgggatgccaggtgtacgaagcttacgggcagacggagtgtacaggaggttgtaccttcaccctgccaggcgattggacctcaggacacgttggagtccccctcgcctgtaattacgtcaaactggaggacgtggccgacatgaattactttacggtgaacaacgagggagaagtgtgcattaagggcacaaacgttttcaaagggtacctcaaggatccagagaaaacccaggaggccctggatagcgatgggtggctgcacactggcgatataggcagatggctgcccaatggaacattgaagatcattgaccggaagaaaaatatattcaagctggcgcagggagaatacatagcgcccgagaaaatcgaaaacatctataaccgatctcaacctgtcttgcagatctttgtacacggtgagtctctaagatcatcactagtcggagtcgtggtccctgatactgatgtgttgccgagcttcgctgccaagcttggcgtaaaaggctccttcgaagagttgtgccagaaccaagtgaaagcaattttcctgcacccagaaccttttagcatcgagaacggccttctcacacccacactcaaggccaaaaggggtgaactttcaaaatacttccggacgcagatcgatagcctgtacgaacacattcaggactag

SEQ ID NO: 177901 - DNA, 2169 bp, Artificial Sequence
  Description of Artificial Sequence: Synthetic coding sequence
atgctgaccttcttcctggtgagcggcggcagcctgtggctgttcgttgagttcgttctttctctcttggagaaaatgcagactcaggaaatcctccgaatcctgaggcttcccgaactgggagatttgggtcaatttttcaggtccttgagtgctaccactctggttagcatgggggccctggccgcaatactggcctactggtttacacatagaccaaaagccctgcaacccccatgtaatctgctaatgcagtccgaggaggtagaagattccggaggcgcacgccggtctgtcatcggatccggaccacaattacttacccactactacgatgatgcacggacgatgtatcaggtttttcgccgaggtctgtcaattagcggcaatgggccatgtctgggattccgcaaacccaaacaaccctaccagtggctcagttaccaggaagttgctgatcgcgctgaatttctgggtagtggcctgctgcaacacaattgcaaggcttgtacggaccaattcattggggtgttcgcccagaatcggcccgagtggattattgtggagcttgcgtgctacacctattccatggtggttgtgcctctgtacgacactctgggcccgggagccatacggtacataatcaacaccgccgatatttccacggtcatcgtcgataagcctcaaaaggccgtgttgctccttgaacacgtggaaagaaaggaaaccccaggcctcaaacttatcattctgatggaccccttcgaggaggcactcaaggaaagaggtcaaaagtgcggcgtggtgatcaaatctatgcaagcagtggaggactgtggacaggaaaatcatcaggctcccgtgcctcctcaaccggatgacctgtcgatcgtttgtttcacgagtggaacaaccggtaacccaaagggcgccatgctgacccatgggaatgtggtggccgattttagcggcttcttaaaagtgaccgagtcacagtgggcaccgacatgtgcagacgttcatatctcctatctgcccctagctcacatgtttgaaagaatggtgcagtccgtagtatactgtcacggcggcagagttggcttctttcagggcgacatacgactgctgagcgatgatatgaaagctttgtgccccacaattttccccgtggttcccagactgcttaacaggatgtatgacaagatcttttcccaggccaacacacctctaaaacgctggctgctggaatttgcagcaaaacggaaacaggccgaggtgcgcagtggaatcattaggaatgactctatctgggatgagcttttttttaataagatccaggcttcgcttggagggtgcgtacgaatgatcgtaacgggcgctgcaccagcctcccccacagtactcggtttccttcgcgctgccttgggttgccaggtttacgagggatacggccagacagaatgcaccgccggttgcacctttaccacccccggagattggacaagtgggcatgtgggggctccactcccctgtaaccacatcaagttagtggacgtggaggaactgaactactgggcctgcaagggagagggcgagatctgcgtgagaggccccaacgtgtttaagggctacctgaaggatcctgaccgcactaaagaagctctggattctgacggctggcttcacacaggtgacataggcaaatggttacctgctgggacactgaagatcatagataggaagaaacatatttttaagctcgctcagggggaatacgtggccccagagaagatcgagaatatctatataaggagccaacctgtagcccaaatttacgttcatggggacagtttgaaggccttcctcgtcggtattgtggtgcccgatccagaggtaatgccctcttgggcccaaaaaaggggcatagagggtacctacgctgacctgtgcaccaacaaggatcttaagaaggcaatactggaggatatggtgcggctaggcaaagagagcggcctgcactcgtttgagcaagtcaaagccattcacatccactcagatatgttttctgtgcagaatgggctgctgacacctacccttaaggctaaacgacccgaattgcgggagtattttaaaaaacaaatcgaggagctgtattccatcagtatgtag

SEQ ID NO: 177902 - DNA, 1869 bp, Artificial Sequence
  Description of Artificial Sequence: Synthetic coding sequence
atgcagacccaggagatcctgcggatcctgcggctgcccgagctgggggacctggggcagtttttccgatccttgagcgctacaacgctggactcaggaggggccagacggagcgtaattggaagtggtccccagctattaactcactactacgacgatgccaggacgatgtatcaggtgttccgacggggactgtccatctcaggcaatggaccatgcctgggtttccgtaagccaaagcagccttatcagtggctaagctatcaggaagtagccgatcgagccgagtttctcggcagcggcctgctgcagcacaattgcaaagcttgtacggatcagtttattggcgtgtttgcgcagaaccgccctgaatggattattgtcgagctcgcctgttatacctacagtatggtcgtggtgccactttacgacacattggggccaggcgctatacgttacatcatcaatactgcagacatttctacagtgatcgtcgacaaaccccagaaagctgtcctcctgctcgagcatgtagagagaaaggagacgcctggtctgaaactaattatcttgatggacccttttgaagaagccctcaaggagcgcgggcagaagtgcggcgtggtgatcaagagcatgcaagccgtggaagactgcggtcaagagaatcaccaagctcctgtccctcctcagcctgatgatctgagtatcgtgtgtttcaccagcggtaccactggaaatccaaagggtgctatgttaacccacggcaatgtcgtcgccgatttctctggctttctgaaggtgactgaaggcgacatcagactattatcagatgacatgaaggctctctgccccactatcttccccgttgtgccaagactgctgaatcgtatgtatgataagattttttcacaagccaacacccccttgaaacggtggttactggaattcgctgcgaagagaaagcaggcggaagtcaggagtgggattatcagaaacgactcaatctgggacgagcttttcttcaataagatacaggccagcctgggcgggtgtgtgcgcatgatcgtgacaggagccgcacccgcctctccaacagtgcttgggtttctcagggcggcattaggctgtcaagtgtatgaggggtacggtcagactgagtgcacggctggctgcactttcacaactccaggcgactggacttctggccatgtcggcgccccccttccttgtaaccatatcaaactcgtcgatgtggaagagttgaactattgggcctgcaagggagagggagaaatttgtgtccgggggcctaacgttttcaaaggctacctcaaggacccagaccgaacaaaagaagccctggactcagacggatggctgcacaccggagacattggtaagtggctccctgccggaacgctcaagattatcgataggaagaagcacattttcaagctcgcccagggcgagtatgtcgcccctgaaaagattgagaacatttatatacgctcacagccagtggcccagatctatgttcacggcgattccctcaaggctttcctcgtcggtattgtcgtgccggacccagaggtcatgccatcttgggcccagaagcgtgggatcgaaggtacctatgcagacctctgcactaacaaagacctgaagaaggctattctggaggacatggtccgtttggggaaagagtctggcctgcacagctttgagcaggtgaaggcaattcacatccactccgacatgttttcagtccagaatgggctgctgacccccaccctgaaggccaagcgccccgaactgcgggagtactttaaaaagcagatcgaagagttgtatagcattagcatgtag

SEQ ID NO: 177903 - DNA, 2094 bp, Artificial Sequence
  Description of Artificial Sequence: Synthetic coding sequence
atgcagacccaggagatcctgcggatcctgcggctgcccgagctgggagatctcgggcagttcttccggagtctgtctgccactaccctggtctccatgggagcccttgccgcaattcttgcatattggttcacccatagacccaaggctctacagccgccgtgcaacctgctgatgcagagcgaggaggttgaagattccggcggagccagacgatctgttatcggctctggacctcaactgttgacccattactatgacgatgctcgaactatgtaccaagtgtttaggaggggcttgtctatatccggcaacggtccctgtctgggattcagaaagcctaaacagccctatcagtggttatcctaccaggaggtcgccgatcgggctgaatttttggggtcaggtctgctgcaacataattgcaaagcgtgcacggatcagtttattggcgtcttcgcccagaatagacccgagtggataattgtagaactggcctgctatacatactcaatggtcgttgtacccctttatgacacacttggtccaggggctattaggtacattatcaataccgccgacataagtacagtcattgttgataagccacagaaggccgtcctcctgctggaacacgtagagaggaaagagacccccgggctcaagctaatcattttgatggaccccttcgaggaagctctcaaagagagaggacagaaatgcggagtggtgattaaaagcatgcaggctgttgaagattgcggccaggaaaaccatcaggcacccgtgcccccacagcctgacgacctgagcatagtttgcttcacatccggtactactggcaaccccaagggagctatgctgacacacggtaacgtggttgcagacttttctggctttttaaaggtaaccgaaaaagtgatctttcctcgtcaggatgacgtgcttatttccttcttaccattggcccacatgtttgaaagggtaatacaatccgtggtgtattgtcacggagggagagtgggcttttttcagggcgatataaggctgctcagtgacgacatgaaagccctctgccccacgatctttccggttgtgccaaggttacttaataggatgtacgacaagatcttctcgcaagccaatacccctcttaagaggtggctgttggagtttgccgccaaaagaaaacaggccgaggtgcgcagcggaatcattaggaacgactccatatgggacgagctgttcttcaataagatacaagcatctctcggagggtgcgtcagaatgattgtcactggagccgcccccgccagccctacggtcctgggattcttacgtgctgccctcggctgccaggtttacgaaggatatggtcagaccgaatgtaccgccggttgcacattcaccaccccgggcgattggactagcgggcatgtgggagccccgctgccatgtaatcacattaagctggtcgacgtggaggaactgaactactgggcatgtaagggcgaaggggaaatttgcgtgcgaggacccaatgtgtttaaaggctacctgaaagaccccgataggacaaaggaagccctggacagcgacggctggctccacaccggcgatataggcaagtggctgccagccggtacactcaaaataatcgataggaagaagcacatctttaaactcgcgcaaggagaatacgttgcacccgagaaaatagagaatatctacatccgtagtcagccagtggcacagatctacgtgcatggagacagccttaaagcttttcttgtgggcatcgtcgtccccgatcctgaagttatgccctcttgggcccaaaagagggggatagagggaacctacgcggatttgtgtacaaacaaagacctaaaaaaggccatccttgaggacatggtacggcttggcaaggagtctggcctgcactcttttgaacaggttaaggctatccacatccacagtgatatgttctcagttcaaaatgggctcttgactccaacgctgaaggcaaagcggcctgaactgcgagaatattttaagaaacaaattgaggaactttacagtatttctatgtag

SEQ ID NO: 177904 - DNA, 2094 bp, Artificial Sequence
  Description of Artificial Sequence: Synthetic coding sequence
atgcagacccaggagatcctgcggatcctgcggctgcccgagctgggagacttgggccagttttttcggtctttgagcgccacgacactcgttagcatgggtgccttggcagcaattcttgcatactggttcacacacagacccaaggccctgcaacccccttgcaatttgctcatgcagagcgaggaagtcgaggatagcggtggggcccgtcgttctgtgatcggctccggtccccagctcctgacacactactatgacgacgcccggacgatgtatcaggtcttccgccgaggtctttccatctctgggaatggaccttgtttgggattccggaagcctaagcagccttaccagtggcttagctaccaggaagttgccgacagagctgagtttctgggtagcgggctcctgcagcacaactgcaaggcctgcacggaccaattcatcggcgtgtttgcacagaacaggcctgagtggataatcgtggagctggcctgctatacctatagcatggtagttgtacccctgtacgatacactgggacccggggcgatccggtatattatcaatactgcagatatatcaactgttatagtggacaaaccccaaaaagcagttttgttactagagcacgtggaaaggaaggagacacctggactgaagttgattattctgatggatccgttcgaggaggctttaaaagaacgcggccaaaagtgtggggtggttattaaatccatgcaggcagttgaagattgtggtcaggagaatcatcaggcacccgtgcctccccagccagatgatctgtctatagtctgttttacctccggtacgaccggcaatcctaagggcgccatgctgacgcacggcaatgtggtcgccgatttctctggcttccttaaagtgaccgagagccaatgggccccaacctgcgcggacgtgcacatctcctatttgcccttggctcacatgttcgagcgaatggttcaaagcgtcgtgtattgccacgggggtcgtgtgggcttcttccagggcgatattaggttgctgagtgacgatatgaaagctttatgtccaaccatcttccctgtggtgcccagactgctcaataggatgtacgataagatttttagccaggccaacacaccgctcaaacgctggctgttggagtttgcagccaagcgtaagcaggccgaggtgagatccggaattatcaggaatgactcaatatgggacgaactgttctttaataagatccaagcaagtcttggaggatgcgtgaggatgatcgtgacaggggccgccccagcctcccccactgtgttagggtttctacgggcagcattaggctgccaggtatatgaaggttatgggcaaactgaatgcacggccggctgtacctttaccaccccaggtgactggacttctggccacgtgggagctccgttgccttgcaaccatatcaaactggtagatgtcgaggaactgaattactgggcttgcaagggggagggcgagatctgtgttcgcgggcccaatgtctttaaggggtacctgaaggatcccgacagaaccaaggaggcgttagacagtgatgggtggctccataccggagatatcggcaagtggttacctgccggtacactgaaaattattgatcgcaagaaacacatctttaagctcgctcaaggagagtacgtagcacctgaaaaaatagaaaacatttacataagatcacagccagtcgctcagatatacgtgcatggagacagtttgaaggcttttctggtagggatagtggtcccagatcccgaagtgatgccctcttgggcacagaaaaggggtatcgagggcacatacgctgacctctgtactaacaaggacttaaaaaaagctattctggaggacatggtcaggctgggaaaggaaagcggccttcactcttttgagcaggtgaaggctatccacatccactcagatatgttttcggtgcagaacggccttcttacccccaccttaaaggccaaaaggcctgagcttcgcgaatactttaaaaaacaaatcgaggagctttatagcatatctatgtag

SEQ ID NO: 177905 - DNA, 2127 bp, Artificial Sequence
  Description of Artificial Sequence: Synthetic coding sequence
atgcccgagttcgtgctgagcctgctggagaagatgcagacccaggaaattttgcgtatcctccgcctccctgaattaggtgatcttggacagttctttagatcactctctgcaacaacccttgtgtccatgggggcattagccgcaatcctggcgtattggtttacccaccgacccaaagccctccaaccgccgtgtaacctgttaatgcagtctgaagaagtagaggattctggcggggctagacggtccgttatcgggagtggaccacagctactgactcactactacgacgacgcccgtacaatgtatcaggtatttcgacgtggactcagcatttccggcaacggcccatgcttgggcttccggaagcccaaacagccctatcagtggcttagctatcaggaggtggctgatcgggcagaattccttggatccggcctcctccaacataattgcaaagcctgtacagaccagtttatcggagtatttgcccagaatagaccagaatggatcattgtggagctggcttgctatacatattctatggtcgtggtccccttatacgatactctcggccctggcgctatccgctacattattaacactgccgatatctcgactgtgatagtcgacaaacctcagaaggctgtattactgctggagcacgtggaaagaaaagagactccaggcctcaagctaataatcctcatggatccctttgaggaggccctcaaggagcgcggccagaagtgtggagtggtcataaaaagtatgcaggctgtggaggattgcggccaggagaaccaccaggctccagttcccccccagccagacgacctcagcatcgtgtgttttacctccggcacgactggcaatccaaaaggcgccatgctgactcacgggaacgtggttgccgacttcagcggtttccttaaagtgactgagaaggtaatatttcctcggcaggacgacgtcctcattagttttctccctctggcacatatgtttgagcgtgtgatccagagcgtggtttactgtcacggaggcagggttgggtttttccagggggatattcgcttgctgtcagatgacatgaaagccctctgccccacaatcttccccgtggtaccccggttgctgaaccgaatgtacgacaaaatctttagtcaagccaatactccgctaaaacggtggctgttagagtttgctgctaagcggaagcaggccgaggtgcgctcaggcatcatccggaatgactctatctgggatgaactgtttttcaacaagatccaggcctcattgggtggctgcgtccgcatgattgtgactggggctgcacccgcgtcacccactgtcctggggtttcttagagccgcgctgggctgccaggtttacgaaggctatggacagacagagtgcactgccgggtgcaccttcacgacaccaggagattggactagcggtcacgtgggggcacctctgccctgcaaccacatcaagctggttgacgtagaggagctgaattattgggcatgtaaaggagagggggaaatctgtgttcgagggcctaatgtttttaaaggataccttaaagatccggaccggacaaaagaagccttggatagtgacggatggctccacaccggtgatattgggaagtggttgccagctgggacacttaaaattattgataggaagaagcatatcttcaagctagctcaaggggaatatgttgccccagaaaagattgagaacatctacatacgctcccagcccgttgcccaaatttacgtacacggagattccctgaaggcgtttcttgtgggcattgtggtgcccgatcctgaagtaatgcccagctgggcgcagaagcgtggtattgaaggcacatacgcggacctgtgcacaaataaggatttgaaaaaagccattctggaggatatggtcagactcggtaaggagagcggcctccactcgtttgagcaagtgaaggcgattcacattcattccgacatgttctccgtccagaacggtctccttacccccaccttgaaagctaagcgaccggagctgagggaatactttaaaaagcagatcgaagaactctattctatatcgatgtag

SEQ ID NO: 177906 - DNA, 2004 bp, Artificial Sequence
  Description of Artificial Sequence: Synthetic coding sequence
atgcagacccaggagatcctgcggatcctgcggctgcccgagctgggggaccttggacagttctttcgctctctgagtgccacaacactcgtctccatgggtgccctcgccgccattttggcttactggtttacccatcgacctaaagcactgcagccaccttgcaacctgttgatgcaaagcgaggaggtggaggacagcggcggcgcccggaggagtgtgattggaagcggcccacagctgttaacccactactacgacgacgcacgaaccatgtatcaggtgttccgtcgcgggcttagcatatccgggaacggcccatgcctgggtttccgcaaaccaaagcaaccctatcagtggctgtcttatcaggaggtggcagacagggcagagtttctcggaagcggcctgctgcagcacaattgcaaagcatgtaccgatcagttcattggcgtcttcgctcaaaaccggcccgagtggataatcgtggagctggcttgctacacttactctatggttgtcgtgccactttatgacacactgggcccaggggctattcgctacattattaataccgcagacatttccactgtgattgtggataagccacagaaagctgtgttgctgttggaacacgtggaaagaaaggagacacccgggctgaagctgattatcctaatggatcccttcgaagaggcgctgaaggaacgcggccagaaatgcggcgtggtcattaagtctatgcaggccgtggaggactgtggccaggagaatcaccaagctcccgtgccaccacaaccagacgacttgtctatagtttgcttcacatccggaaccacaggcaacccaaagggcgccatgctcacgcatgggaacgtcgtagccgacttctctggcttcctgaaagtgacagaaagccaatgggctccaacttgcgccgacgttcacatctcctatcttcccctggcccacatgttcgagcgaatggtgcaaagcgttgtgtactgccacggtggacgggttggatttttccagggggatatcagattgctgtccgatgatatgaaggccctttgtcccacaatctttcccgttgtgcctagactcctgaataggatgtacgacaagatcttctctcaggccaacacccccctaaagcgctggctcctggagtttgctgccaagcgcaaacaggctgaggtacgcagtggaattattcgaaacgattccatatgggatgaattattttttaacaagattcaggccagcttgggaggctgtgttagaatgatcgtaactggagcagctcctgcctcacccaccgtgctgggctttttaagggcagctctgggatgtcaggtgtacgaggggtatggacagaccgagtgtaccgccggatgcacattcaccactcccggagactggacttccggacacgtgggtgcccctcttccctgcaatcacattaagctggtggatgtcgaagagttgaattactgggcttgcaagggcgagggtgagatctgcgtgagaggcccaaatgtcttcaagggctacctgaaagatcccgatcgcacgaaggaagccttggattcggatggatggctgcacaccggagatatcgggaaatggctccccgccggcacactcaagattattgacagaaaaaaacatatcttcaagctggctcagggcgagtacgtggctcccgagaagattgagaacatatacatccgcagtcagcctgtcgctcagatatacgtgcacggagacagcctcaaagcattcctggttggcatcgtagtccctgacccagaggtcatgccctcctgggcgcagaagagaggaattgaaggcacgtatgctgatctgtgcactaacaaggacctgaagaaggcgatactggaagatatggtccggcttggaaaggagtcaggcctccattcttttgagcaagatttaccacaatgtcttatccaaattaaggttttttccaaatattag

SEQ ID NO: 177907 - DNA, 2169 bp, Artificial Sequence
  Description of Artificial Sequence: Synthetic coding sequence
atgctgaccttcttcctggtgagcggcggcagcctgtggctgttcgtagaattcgtattgtcactcctagaaaaaatgcagacccaggagatccttagaatcctgagactgcccgagctaggtgatttaggacaattctttcgcagccttagcgccactacactggtgtcgatgggcgcactggcagcaatcctggcttattggttcactcaccggcccaaggccctacagccaccctgtaacctgcttatgcaatctgaggaggtcgaagattctggcggcgcacggcgatccgtgattggatcagggccccagttgttgacccactattacgatgacgcaagaacgatgtaccaggtcttcaggcgcggcctctctatatcaggtaatggcccctgcttaggattcagaaaacccaaacagccatatcagtggctgagttaccaggaagtggctgaccgagctgagttcttggggtccggattgctgcagcataactgtaaagcgtgtactgatcagttcataggagtttttgcgcagaacaggccagagtggatcatcgtggaactggcatgttacacatattcaatggtagtggtgcctctgtatgacaccttaggaccaggggccatcaggtatatcattaacaccgctgacatttctaccgtgattgtagataagcctcaaaaggcagtcctgcttttggagcacgttgagcggaaagagacacccggtttgaagctcatcattcttatggatccctttgaagaagccttaaaagaacggggccagaaatgtggcgtggtcataaaatctatgcaggctgtcgaagactgtgggcaggaaaatcaccaggcacctgtccctccccagccagacgacctttcaattgtgtgtttcaccagtggaaccaccgggaatccaaaaggggcaatgctgacacacggtaatgttgtggcagatttctccggtttcctgaaggtaactgaaaaggttattttccccagacaggacgacgtgctcataagtttcttacctctcgcccatatgttcgaacgggtgatacagagtgtggtgtactgccatgggggtcgtgtcggcttcttccagggcgacattcggttgctgtctgacgatatgaaggcgctttgtccaactatcttcccggttgttccccgactcttgaatcggatgtacgacaaaatcttttcccaggccaatactcccctcaaacggtggctgctcgagttcgcggccaaacgcaagcaggctgaagtccgctctggaatcattcggaatgactccatctgggatgaactgtttttcaacaagatacaggccagtctcggaggctgtgtgcgtatgattgtcactggcgccgcgccagctagcccgaccgtgctagggtttctccgggccgcgttgggctgccaggtttacgaagggtacggccagactgaatgtacagccggctgcacattcacaacaccgggtgattggaccagcgggcacgtgggggcacctcttccctgcaatcacatcaagttggtcgatgtcgaagaactaaattactgggcctgcaaaggtgagggggagatctgcgtgcgtggtccgaacgtctttaagggctacttgaaagatcccgatcgtaccaaggaggcactagattctgatggatggctgcacacgggggacatcggcaagtggctacctgccggcaccctaaaaatcattgatcggaaaaagcacattttcaaactggcgcagggagagtatgtcgctcctgaaaaaattgagaacatatatatcagaagtcaacccgtcgcccaaatctatgttcatggcgactctctgaaggctttcttggttggaatcgtggtgcctgaccctgaagttatgccaagctgggctcaaaaaagaggcattgaaggcacttatgcagatctgtgtactaacaaagatcttaagaaggccatactagaggacatggtgaggctcggtaaggaatctgggctacactcctttgaacaggtcaaagctattcacattcactcagatatgttttctgtgcagaatgggctgttgacaccaaccctcaaagctaagcgccctgaactcagagagtattttaagaagcagatcgaggagctctactcaatttccatgtag

SEQ ID NO: 177908 - DNA, 2139 bp, Artificial Sequence
  Description of Artificial Sequence: Synthetic coding sequence
atgcagacccaggagatcctgcggatcctgcggctgcccgagctgggggacttaggccagttttttcgctctttaagcgcaaccacactggtcagtatgggagcgctcgccgctatactcgcatactggttcactcaccgacccaaggcactgcagccaccatgcaatctgcttatgcagtcagaagaggttgaagattcagggggggccaggcgctccgtgatcgggagcggaccacagttgctcacacactattatgatgacgcccgtacaatgtatcaagtgtttcgccgcggcctgagcattagcgggaatggcccttgtctgggattccggaagcccaaacagccctatcagtggctctcataccaggaggtcgccgaccgagccgagttcctgggaagcggactgctacagcataattgcaaggcctgtacggaccagtttatcggggtgttcgcgcagaacagacctgaatggatcatcgtcgagttagcttgctacacctattccatggttgtggttcctctttacgatacgctgggacctggtgctatccgctacatcataaacaccggactatcctgtcaggagggtgcgtccgcaactgccagcactcaggcagatatcagcacggttatcgttgacaaaccccaaaaggcagttttactcctggagcatgtggaaaggaaggaaacaccaggcctcaagcttatcattcttatggatcctttcgaagaagctctgaaggagcggggacagaagtgcggagtcgttatcaagtctatgcaggcagtcgaggactgcggacaggagaaccaccaagcccctgtccccccccagccggacgacctgagtattgtttgcttcacttccggaactaccggcaatcccaagggagccatgctgactcatggaaatgtggtagcagacttttcaggcttcctaaaagtcacagaaaaagtaattttcccccgacaggatgacgtcctgatcagttttttgcctctcgcccacatgttcgagcgcgtgatccagtctgtggtgtattgtcatgggggaagagttggatttttccaaggtgacataagactgttatcagatgacatgaaggccctatgccctacaatcttcccagtcgtaccccggctcctcaacagaatgtacgataagatttttagccaagcaaacacaccgctgaagcgctggctgctagaattcgccgcgaagcgcaaacaagccgaggtgcgctcagggattataaggaacgactctatatgggacgaactgtttttcaataagatccaagcctccctgggtggttgcgtaaggatgatcgtcaccggtgctgctcctgcttctccaactgtgcttggattcctgagagccgccttgggatgtcaggtgtatgagggctatggacagaccgaatgcaccgctggctgtacttttaccaccccaggcgactggaccagcggtcacgtgggggctccgctgccatgcaatcatatcaagctcgttgacgtggaagagctcaattactgggcgtgcaagggggagggcgagatctgcgtgcgtggccctaatgtttttaagggctacttaaaagatcccgacaggacaaaggaagcccttgacagtgacggctggttgcacaccggagacattggcaagtggctgcccgcgggcactctcaagatcatcgaccgaaaaaaacacatctttaaactggcccagggcgagtatgtggctcccgagaagattgaaaacatctacattagatctcaacctgtggcccagatctatgtgcatggagacagcttgaaggctttcctggtaggaatagtggtgcccgatccggaggtcatgccctcctgggcccaaaagaggggaattgaaggtacctatgcagacctgtgcacaaataaagacctgaaaaaggccatccttgaggatatggttagacttggaaaggagtctggcttgcacagctttgaacaagttaaggcgatacatatacatagtgacatgttcagtgtgcagaatgggctcctcacaccgacactcaaggccaagagaccagagttgagggaatatttcaagaaacaaatagaagagctctactccatatccatgtag

SEQ ID NO: 177909 - DNA, 2094 bp, Artificial Sequence
  Description of Artificial Sequence: Synthetic coding sequence
atgcagacccaggagatcctgcggatcctgcggctgcccgagctgggagacttgggccagttcttccgctcactgtcagcaactacactggtgtccatgggcgccctagcggcaatcctagcttattggtttacccaccgacccaaggccctccagccgccctgtaatctgctcatgcagtcggaagaggtcgaggacagcggaggagcccgtaggtcagttatcgggtctggcccccagttattgacgcattactatgacgatgccaggactatgtaccaggtctttcgccgtggcctgagcatcagtgggaacggtccttgtctggggttcaggaagcccaagcagccataccaatggctgagctaccaggaagtcgccgaccgggcagagtttctgggttcaggacttttacagcataattgcaaagcgtgtaccgatcagtttatcggtgtgtttgcccagaatcgcccagagtggatcatagtagagctggcctgctatacttattctatggtcgttgttccactctacgacacccttggaccaggagccattcgatatatcattaacacagcagatatcagcactgtaatcgttgataagccccaaaaagccgtcttgctcctggagcacgtcgaaaggaaggagactcccgggctgaagctcataatcttgatggacccattcgaagaggccctaaaagagagaggacaaaaatgcggcgtggttatcaaatcgatgcaggccgtcgaagactgcggacaggaaaaccaccaggcacctgtccccccccagcctgacgacctcagcatcgtatgttttaccagcggaaccacgggaaacccaaagggggccatgctgacccatggcaacgtagtcgcggactttagtggatttctgaaggtaacagagtcccagtgggccccaacctgtgccgatgtgcacatctcataccttcctctggcccacatgttcgagcggatggtgcagagcgtggtgtactgtcatggcggaagggtgggctttttccagggtgacatccggttattgtcggatgatatgaaggcgctgtgccctacgattttccctgtggtgccaaggctgctcaacagaatgtatgacaagatcttctcccaggccaatacaccattgaagcggtggttgctggagtttgcggccaagagaaagcaagcagaggtgcgctccggcatcattcggaacgattcaatttgggacgaactgtttttcaacaaaatccaggcctccctgggtgggtgtgtccgaatgatcgttaccggagcagctcccgctagtcctacagtcctgggcttcctgagagctgctctggggtgccaggtgtacgagggctatgggcagacggagtgcaccgccgggtgtacgtttaccacgcctggggattggacaagcggccatgtgggcgctccactcccctgcaatcacattaaattggtggacgtcgaggagctcaactactgggcctgtaaaggggaaggagagatctgcgtgagagggcctaatgtgtttaagggttacctgaaggaccccgatcgaactaaggaagctctcgatagcgatggttggctgcatactggagatataggaaagtggctcccagcaggcactcttaaaattattgacagaaaaaaacatattttcaagctcgcccaaggagaatacgtggctcctgaaaaaatcgagaacatctacattagatctcagcccgttgctcagatctacgtgcacggcgatagtcttaaggccttcctggttgggatcgtcgtgcctgatcctgaggttatgccctcttgggcacagaaacgcggcatagaaggcacttacgcagacctctgcacgaacaaggacctcaaaaaggcaatactggaggacatggtgcgactgggcaaggaatctggactacattccttcgagcaggtgaaagcaatccatatccatagtgatatgttttcggtgcagaacggactcctgacccctacgttgaaagctaagaggcctgagctgagggagtactttaagaagcaaatagaggagctgtactccatctcaatgtag

SEQ ID NO: 177910 - DNA, 1821 bp, Artificial Sequence
  Description of Artificial Sequence: Synthetic coding sequence
atgtaccaggtgttccggcggggcctgagcatcagcggcaacggcccttgtctgggctttaggaaaccgaaacagccctaccagtggctgtcatatcaggaagtggcagaccgagctgagtttctggggagtggcctcctgcaacacaactgcaaagcttgtaccgaccagtttataggagtgttcgcccaaaacaggcccgaatggattattgtggaattggcatgctacacctactccatggtggttgtccccttgtatgacacgctgggtcctggtgccattaggtatattataaatacggccgacatctccacagtgattgtagacaagcctcaaaaagctgtgctgctgctcgagcacgttgaacgcaaagagacacccggactgaagctgataatacttatggatccgttcgaggaggctttaaaggaacggggccaaaaatgtggcgtagtgatcaagtcgatgcaggccgttgaggactgcggccaagagaatcaccaagcacctgtgccaccgcagcctgatgacttgtcaatcgtctgcttcacaagcggaacgactggcaaccctaaaggtgcaatgctgactcacggcaatgtcgttgcagatttttcgggctttttaaaagtgacagagaaagtcatttttccaaggcaagacgacgttctcatctcatttctcccccttgcacacatgttcgagcgggtcatccagagcgtcgtttattgccacggcggccgggttggcttctttcagggcgatattaggctgctgagcgatgatatgaaagcactctgcccaacaatcttccccgtagttcctcgtctgctcaatcggatgtatgacaaaattttttcccaagcaaatacgcccctgaagcgatggctcctggaattcgcggccaagcgcaagcaggcagaagttcgttcggggattattaggaatgactcaatatgggacgaactgttctttaataagatccaggcatccctgggtggatgtgttcggatgatcgtaacaggcgcagcgccagcatctccaacagtgctcggctttctgagggccgcccttggatgtcaagtttatgaaggatatgggcagactgagtgtacagccggctgtactttcacgacgcctggtgattggacttctggtcatgtgggcgcacccctaccctgtaaccacatcaaactcgtggatgtggaggagcttaactactgggcttgtaagggggagggagaaatatgcgtcagggggccaaacgtgttcaagggttacctgaaagatccagatcgtaccaaggaggcactcgatagcgatgggtggcttcacaccggggatattggtaaatggctccccgccggaaccctcaagattatcgatcggaagaagcacatctttaagctcgcgcagggcgagtatgtggcccccgaaaagattgagaacatttatatccgatctcaacctgtcgcccaaatctacgtccatggtgatagcctgaaggctttcttagtaggaatcgttgtcccggacccagaggttatgcctagctgggcacagaaaagaggcattgagggtacttacgcagacctctgcacaaataaagacctgaagaaagctatcctcgaggacatggtgagactggggaaggagtcaggtctccatagtttcgaacaggttaaagcgatccacatccacagcgatatgttctccgtacagaacggattgcttacaccgacccttaaggccaaaagaccagagctccgggagtactttaagaagcagatcgaggagttgtacagtatctctatgtag

SEQ ID NO: 177911 - DNA, 1386 bp, Artificial Sequence
  Description of Artificial Sequence: Synthetic coding sequence
atgagccggcaggtggtgcggagcagcaagttccggcacgtgttcggccagcctgcaaaggccgatcagtgctatgaagacgtccgcgtaagccaaacaacctgggacagcggtttctgcgccgtgaaccctaagtttgtggccctgatctgtgaagcctctggcggaggcgcatttctcgtgctaccgttaggcaaaacagggagagtcgacaagaacgcaccgactgtgtgtgggcacactgcccccgttctcgacattgcatggtgcccccataatgacaatgtcatagctagcggctcggaagactgtacagtaatggtatgggaaatacctgatggtggccttatgctccctctccgggagccggttgttactctggaagggcacacaaagcgggtcgggatcgtcgcctggcacacgaccgctcagaatgttctgctgagtgccggatgcgataatgtaattatggtctgggatgtggggacaggggcagcgatgctgacacttggccccgaagtgcacccggacaccatatattctgtggattggtctagggacggcggactgatttgtacttcctgtagagataaaagggtgagaatcatcgagcctagaaaaggcacagtggttgctgaaaaggacagaccacatgaagggacgagacctgtcagggccgtcttcgtatccgaaggcaaaatcctcactacaggtttcagccgaatgtctgagcggcaggtggcactttgggacactaagcatctggaggagcctctctctctccaggagttggatacatcctccggggtgctcctccctttctttgatcccgatactaacatcgtgtacctctgcggaaagggtgactcttcgatcagatatttcgaaatcacttctgaagcacctttcctgcactacctaagcatgttttcctctaaggagagccaacgcggaatggggtatatgcccaaacgcggcctggaggtaaataagtgtgaaatcgctcggttctacaagctgcatgaaagacggtgcgagcccattgccatgaccgtgcctcgcaaatccgatctgttccaagaggacctgtatcccccaactgcaggccccgatcccgctctgaccgccgaggagtggctgggtggccgtgatgcaggtccactgcttatcagtctaaaggacggctatgtcccccccaaatctagagagctgagagttaaccgtggactcgacactgggcggagaagagctgccccagaagctagtggcaccccctcttcggacgccgtcagtaggctcgaggaggaaatgaggaaactgcaagctacggtacaggagctacagaaacggcttgatcggctggaggagaccgtgcaggcgaagtag

SEQ ID NO: 177912 - DNA, 1734 bp, Artificial Sequence
  Description of Artificial Sequence: Synthetic coding sequence
atgcagtggctgatgcggttccggaccctgtggggcatccacaagtcattccacaacattcatcccgcaccgtctcaactgcgatgtaggtctttatcagagtttggcgcccctcgctggaatgactatgaggttcccgaggaatttaactttgcgtcttatgttttggactattgggcccagaaggagaaggagggtaaaagagggccaaatcctgcattctggtgggtgaatggacagggggacgaggtaaagtggagctttcgagagatgggtgatcttactcgcagggtggccaatgtgttcactcaaacctgcggcctgcagcagggcgaccacttggctctgatgctgccccgcgtccctgagtggtggctcgtcgccgtcggatgtatgcgtacaggcatcatttttatcccagctacaatcctgttaaaggcaaaggatatattgtacagactgcagctaagcaaggccaaaggcatcgtgactattgacgctcttgcttccgaagtcgatagcattgcctctcagtgtccttcactcaaaacgaagttgcttgtttccgaccatagcagagaggggtggctggacttccgatctctggtcaagagtgcctcaccggagcatacctgcgtgaaatccaaaaccttggatccaatggtcattttttttacctcgggaactaccggattcccaaagatggctaaacactcacatggactcgccctacagcccagctttccagggagcaggaagcttcgtagcctaaagacatcagacgtttcctggtgcctctccgattccggctggattgttgccacaatctggactttggttgagccatggaccgctggctgcacggtgtttattcaccacctgccgcagtttgatacaaaagtaataatccagactctgctaaaataccccattaatcacttttggggcgtttctagtatttatcgcatgatacttcagcaggacttcacttcaatacgcttccctgctctggagcactgctacacagggggagaggtggtgctcccaaaggatcaagaggagtggaaacgccggacggggttactactgtacgagaattatgggcaaagcgagactggactgatttgcgctacgtattggggcatgaaaattaagcctggcttcatgggcaaggctacacccccttatgatgtacaagttatagacgataaaggatccattctacctccaaataccgagggtaatattggaatcaggatcaaacccgtacgccccgtgagcctgtttatgtgttatgagggcgaccccgagaaaaccgccaaggtggagtgcggcgatttttataataccggtgaccgaggtaagatggacgaagaaggatacatctgctttctcggccggagtgatgacattattaacgcttctggataccgtattggtcctgctgaagtggaatccgcattggtggagcatccagccgtggccgaatccgctgttgtcggatctcctgatccgatccgtggagaagtggtgaaggcatttatagtcctcaccccacagtttttatcccatgataaggatcagctgactaaagaattacagcagcatgtgaaaagcgtgactgcaccttacaagtatcccaggaaggtggagttcgtctccgagctgccaaaaacaatcacaggtaaaattgaacgaaaggaactgaggaagaaggagaccgggcagatgtag

SEQ ID NO: 177913 - DNA, 1734 bp, Artificial Sequence
  Description of Artificial Sequence: Synthetic coding sequence
atgcagtggctgatgcggttccggaccctgtggggcatccacaagagctttcacaatatacaccctgcaccaagtcagctacggtgtcggagcctgagcgaattcggggcacctcggtggaacgattatgaagtgcccgaagaatttaactttgccagctatgttctggattactgggcccaaaaagagaaggagggcaaaagaggacctaaccccgccttctggtgggtcaatggacagggggatgaggtcaaatggtcatttagagagatgggagaccttactcgacgggtggctaatgtgttcactcaaacctgtggcttgcagcaaggtgaccacttggcactcatgctgccacgagtgccggagtggtggctggtcgccgtcggctgtatgcgcactggcatcatcttcatcccggccaccatcttattgaaagctaaggacatcctgtacagactgcagctctccaaagctaaaggaattgtgacaatcgatgctctggccagcgaggttgattccatcgcctctcagtgcccctccctcaaaacgaaactcctggtgtcggatcacagtcgtgaaggatggctcgacttcagatctctcgtgaaaagtgccagccccgaacacacatgtgtaaagagtaagacacttgatcctatggttatcttctttacatccgggacaaccggatttcccaaaatggctaaacacagccacggattagccttgcagccctctttccctggctccaggaaacttcgatcactcaagacaagcgatgtcagttggtgcctgagcgactccggctggatagtggcaaccatatggactctcgtagagccatggacggctggctgtacagtattcattcatcacctgccccaatttgatactaaggtcatcattcaaacgctgctcaagtacccaatcaaccacttttggggcgtgtcctccatttaccgcatgatcctgcaacaggattttacatccatccggtttccggccctcgagcactgctacactgggggagaagtggtgctccctaaagaccaagaggaatggaagcgccgcactgggctgctgttgtacgaaaattacggacagtccgaaacaggcctgatttgtgctacttattggggtatgaaaattaagcccggatttatgggcaaggcaacacccccttacgatgtccaagttatcgatgataaggggtctatactgccccctaacacggagggaaacataggcatacgaatcaagccggtgagaccagttagcctctttatgtgctacgagggagatccagaaaagactgcaaaggtcgagtgcggagatttttacaacaccggagatcgcggaaaaatggatgaggagggttacatctgctttttgggtcgctcagacgacattatcaatgcttctggctataggatcggacccgcagaggtcgagagcgcactcgttgagcacccagctgtggcggagtccgccgtggttgggtctcccgatccgatcagaggagaggttgttaaggcttttattgtcttgaccccgcagttcctgagccatgataaggatcagctgaccaaagagctacagcagcatgtaaagagcgtaacagccccttataagtatccccgcaaagtggagttcgtgtccgagctgcccaaaactattaccggcaaaattgagcgcaaagaactacgcaagaaagaaaccggtcagatgtag

SEQ ID NO: 177914 - DNA, 465 bp, Artificial Sequence
  Description of Artificial Sequence: Synthetic coding sequence
atgcagtggctgatgcggttccggaccctgtggggcatccacaagtcattccacaatattcacccagccccctcccagctgaggtgtcgaagcctgtctgagtttggcgcccccagatggaacgactatgaagtgccagaggaattcaatttcgccagctacgtactggattattgggctcagaaggagaaggaggggaaacgggggccaaatcccgctttctggtgggttaatggccagggcgatgaggtgaaatggagtttcagagagatgggcgatttaacgaggcgggtggccaacgtattcactcagacttgtggtttgcagcagggtgaccatctcgctttgatgctgccaagggtcccagagtggtggcttgtggccgtgggttgcatgaggactgggataattttcatcccagcaacaatactattgaaagctaaagacatcctgtatagattgtag

SEQ ID NO: 177915 - DNA, 1533 bp, Artificial Sequence
  Description of Artificial Sequence: Synthetic coding sequence
atgcggcccggcctgagcttcctgctggccctgctgttcttcctgggtcaagcggcgggcgacctgggggatgtgggtccacctatcccatctccaggcttttcatctttcccaggcgtggacagttcctcttcattttcctcgtccagtcgatcagggagctcctctagcaggtcgctggggtctggcggtagcgtgtcacagctttttagcaatttcaccggctccgtagacgatagaggaacttgccagtgttctgtcagtctccccgatacaacttttcctgtcgacagggtagaacgccttgaatttaccgcacacgttctatcccagaagtttgagaaggagctgagtaaagtgcgggagtatgtacagcttatctctgtttatgaaaaaaagctgttaaatctgactgtacgaattgatatcatggagaaagatactattagctatactgaactagacttcgagctcatcaaggtggaggtgaaagaaatggagaagttggtcatacagctcaaagagtcattcggcgggagctctgagatcgtcgaccagctggaagtcgagattcggaatatgacccttttagtggaaaagctggaaacccttgacaagaacaacgtgctggctatccgaagagagattgtggcattgaagactaagctgaaggagtgcgaagcctctaaagaccagaatactcccgtcgtgcatcctccaccaacaccaggatcctgcggtcacggtggcgtggtcaatatcagcaaaccatccgttgttcaactgaactggagagggtttagttacctgtacggcgcttggggcagagactactcgccccagcacccaaataaaggcctgtactgggtggcacccttaaataccgatgggaggctgctggaatattacagactgtacaacacactcgatgatctgctgctctacatcaatgctagagaactccggattacttacggtcaaggcagcggaactgccgtttacaacaacaatatgtatgttaatatgtataacacaggcaacatcgcacgcgtcaatctgaccacaaatactattgccgtgactcaaacattacccaatgcagcgtacaataaccgcttttcctatgccaacgttgcctggcaggatatcgattttgccgtcgatgaaaacggcctgtgggtgatctatagtacggaagcttctacagggaatatggtcattagcaaacttaatgacacaaccctacaagtgctgaatacatggtatacgaagcagtacaagccttcggcttccaacgcctttatggtgtgtggcgttctctacgcaacccggacaatgaacaccagaactgaggaaattttctactactacgatactaacactgggaaggaaggaaaacttgacattgtgatgcataagatgcaggaaaaggtacaatcgatcaactacaacccatttgatcagaaactgtacgtttataatgacggttacctcctgaactatgacctaagcgtattgcagaaacctcaatag

SEQ ID NO: 177916 - DNA, 1734 bp, Artificial Sequence
  Description of Artificial Sequence: Synthetic coding sequence
atgcactggctgcggaaggtgcagggcctgtgcaccctgtggggcactcagatgtcatcaaggaccttgtacattaattcccgacaactggtgagtcttcagtggggccatcaggaggttcccgcgaaatttaactttgcctccgacgtgttggaccactgggctgatatggaaaaagcaggcaaaagactgcccagtcctgcactctggtgggtgaatggcaagggcaaggaattgatgtggaacttccgcgaattgtcagagaattcccagcaggctgcgaacgtgctcagtggtgcatgcggtcttcagaggggagatcgggtggccgtcgtcctccctagagttcccgaatggtggctagtgatcttgggctgtatccgagcaggcctgatctttatgcccggaaccatccaaatgaagagtaccgacatactgtatagactgcagatgtcaaaagctaaagccattgtagcgggcgacgaagttatccaggaagtcgacaccgtggctagcgagtgtcccagcctaagaattaaactcctggtctctgagaagtcctgtgacggttggctgaattttaagaaattactcaatgaggcctccaccacgcatcactgtgtggagacaggatctcaggaggcctccgctatctactttacgagcggtacctcagggcttcccaagatggcagagcatagctactcctcactgggcctcaaggccaaaatggacgccggatggacagggctccaggcctcagacataatgtggacaattagcgacaccggttggatcctcaatattttgtgttcactgatggagccctgggctctcggagcctgtacattcgtccacctattgcccaaattcgatccactagtcattcttaagaccctgagttcctaccctatcaagtccatgatgggagctccaattgtctacaggatgctactccagcaagatctttctagctacaagtttccccacctgcagaattgtgtgaccgtgggtgagagcctgctgccggaaaccttggagaattggagagcgcagaccggcctggacatcagggagtcctatggccagacagaaaccggcctgacctgcatggtaagcaagaccatgaaaattaagcctggttatatgggtaccgccgcctcatgctacgatgtacagatcatcgacgataagggaaacgtcctccctccaggaactgaaggggacataggcattcgtgtcaaacccatccgacctatcgggatcttctctggttacgttgataatcccgacaaaactgctgccaatatccgaggagatttctggctgctcggggacaggggaattaaagacgaggatgggtatttccagtttatgggcagagcgaatgatatcatcaatagcagcggctaccgcatcggcccttctgaagtggagaacgcccttatggagcatccggccgtggtggagaccgcagttatttcctctccagatccagtgcgcggggaggtagtaaaagctttcgtggtgttagcctcccagtttctttcccacgaccccgagcagctgactaaagaactccagcagcatgtgaaaagcgtgactgccccatacaagtatccgcgcaaaattgagtttgtgctgaacctcccgaaaacagtcaccggaaagattcaacgcgcaaagctccgagataaagaatggaaaatgtctggcaaagcccgggcacagtag

SEQ ID NO: 177917 - DNA, 1497 bp, Artificial Sequence
  Description of Artificial Sequence: Synthetic coding sequence
atgtggaacttccgggagctgagcgagaacagccagcaggccgccaacgtactgagcggtgcctgcggacttcagcgaggtgacagagtggcagttgtactgccgcgagtgcccgagtggtggttggtaatcttgggttgtattagagcagggctcattttcatgcctggtaccattcagatgaagtcaaccgacatcctgtataggttgcagatgtctaaggccaaggcgattgtggccggcgacgaggtgatacaggaggtagacaccgttgcatctgagtgtccatccttgaggatcaagctgctggttagcgaaaaaagctgcgatggctggctgaacttcaagaaactgcttaatgaagcttcaaccacacaccattgcgtcgaaacaggttcgcaggaagcgtctgccatatactttaccagcggaacaagcgggctcccaaaaatggccgagcattcgtacagctccctggggttaaaagcaaagatggacgctggctggaccgggctgcaagcttctgacattatgtggaccatcagcgatacgggttggatattgaacattctgtgctccttaatggagccatgggcacttggagcatgcacatttgtgcatttactgcccaaattcgaccccctagttatactgaagactttatcctcctatccaatcaaaagtatgatgggggcgccaattgtgtacagaatgctgcttcagcaagatctgagttcctataagttccctcacttgcagaattgcgtcacagtcggcgaatccttgctgccggaaacactcgaaaattggagagcccagactggcctggatatccgggaaagttacgggcagacagaaaccgggctgacctgcatggtgagcaagacaatgaagattaaaccggggtacatggggactgccgccagttgttatgatgtgcaaataatcgacgataaaggtaatgtgctgccacccgggactgaaggggacattggtattcgagtaaaacctatccgaccaattggcattttttccggttatgtggacaacccagacaaaacagcagctaatatcagaggtgatttttggcttctgggcgatagagggatcaaggacgaggacggctattttcaattcatgggccgggctaacgatataattaattctagcggctataggatagggccatctgaagtcgaaaatgccctgatggagcaccccgccgtagtggagacggcagtaatcagctcacctgaccctgtcaggggggaagtggtgaaggcttttgtggtactcgcctcccagttcctgtctcatgatccagaacaactgaccaaggagctccagcagcacgtgaaatcagtgactgctccttataagtacccccgcaagattgagtttgtgctcaacctacccaagacagttactggcaagatacagagggccaagctcagggataaggagtggaagatgtcaggcaaggcgagggctcagtag

SEQ ID NO: 177918 - DNA, 627 bp, Artificial Sequence
  Description of Artificial Sequence: Synthetic coding sequence
atgcactggctgcggaaggtgcagggcctgtgcaccctgtggggcactcagatgagtagccggaccctctacataaactccaggcaacttgtgtcattacagtggggccaccaggaggttcctgccaagtttaacttcgcgtcggacgtgctagaccactgggccgatatggaaaaagcaggcaaaaggcttccctctccagcattgtggtgggtgaatggaaagggaaaggaactcatgtggaattttcgtgagctgagtgagaattcccaacaagcggctaatgtgttgagcggggcatgtgggctacagaggggggatagggtcgccgtggtgctgccccgagtcccagagtggtggctcgttatacttggatgcatacgcgccggactgatattcatgcctggaacaatacaaatgaagtctaccgatatcctatacaggcttcagatgtctaaagctaaagcaatagtcgccggcgacgaggtcattcaggaggtggataccgtggcaagtgaatgcccatccctccggattaagctactcgtctcggagaagtcctgtgacggctggcttaacttcaaaaaactgctcaaatataaggttcgacatcgggacgttaagtag

SEQ ID NO: 177919 - DNA, 1050 bp, Artificial Sequence
  Description of Artificial Sequence: Synthetic coding sequence
atgcggcacccccccctgatcaccgtgtggcggctggaggccaagatggatgctggctggactggcctccaagcctctgacattatgtggactatctctgacacagggtggatcttaaatatcctatgtagtctcatggagccatgggctctgggcgcttgcacattcgttcatctgctcccaaagttcgatcccctggtgatcctcaaaactctgtcttcttacccaattaaaagcatgatgggcgccccgatcgtgtatcgaatgcttctgcaacaggacctgtcgagctataagtttccgcacctacaaaactgtgtcacggtgggagagagcctcttgcccgaaaccctagagaactggcgggcccagaccgggttggacatacgcgagagttacggccagaccgagaccgggctcacttgtatggtctctaaaactatgaagatcaagcccggatatatgggtaccgcagccagttgctacgacgtgcagatcattgatgacaaaggaaacgtgctaccccccggaactgagggcgacatcggtattcgggttaagcccatccggcctattgggatcttttcaggctatgtcgataacccggataagaccgctgctaatatccggggcgacttctggttgttgggagatcgagggatcaaggacgaggacggttatttccagttcatgggccgggctaacgatattatcaacagttccgggtaccggatcggaccttcagaagtagaaaacgccctcatggaacacccagccgtggttgaaaccgcagtgatcagcagtccggatcccgtgagaggtgaggtcgttaaggctttcgttgtgctggctagccagtttttgtcccatgatcccgagcaacttaccaaggaactccagcaacatgtaaagtctgtaaccgccccctacaaatacccgagaaagatcgaattcgtgctcaacttacctaaaacagtgacaggtaaaatacaaagggcgaaactacgcgataaagagtggaaaatgagcggcaaggcacgagcccagtag

SEQ ID NO: 177920 - DNA, 1734 bp, Artificial Sequence
  Description of Artificial Sequence: Synthetic coding sequence
atgcactggctgcggaaggtgcagggcctgtgcaccctgtggggcacccagatgtcatctaggacactttatattaattctaggcagttagtgagtttgcagtggggccaccaagaggtgccagcaaaatttaattttgcatccgacgtgttggaccattgggctgatatggagaaagccggaaagaggcttccctctcccgcactgtggtgggtaaacgggaaaggtaaggaacttatgtggaacttccgcgaattatcagaaaattctcagcaggcagctaacgtactgagtggcgcttgtggcctgcagagaggcgaccgagttgctgtggttctgcctcgagtccccgagtggtggctggttatcttgggatgtatacgcgccggcttgatattcatgcccggtactattcaaatgaagtctactgatatcctgtaccgtctgcagatgtcaaaggcaaaggcaatcgtggcaggagacgaggtgatacaagaggtggacacagttgcctcagagtgccctagcttgaggatcaagctgctggtatctgagaagagctgcgatggctggttgaactttaagaagctattaaatgaggccagcacgacacatcactgtgtggaaaccggctctcaggaagctagtgcgatctactttacatctggcacttctggcttgccaaaaatggcagaacatagttacagcagcctgggtctcaaggcgaagatggacgccggctggacaggactgcaggcaagcgacatcatgtggaccatctccgatactgggtggatactgaacatcttgtgttccctgatggagccttgggccctaggggcctgcacgttcgttcacttactccctaagttcgatccgcttgtgatactgaagacactgtctagctacccaattaagtccatgatgggggcaccgatagtatatcggatgctgcttcagcaggatctcagctcctacaagtttccacatttacagaactgcgtgacagtaggtgaaagtctgctccccgaaacgctcgaaaactggagagcccagaccgggctggacatacgcgagtcttatggccaaacagagaccggcctgacttgcatggtctctaaaactatgaagatcaaaccgggctacatgggtacagccgctagttgttatgacgtacagatcatcgacgataaagggaatgtgctgccaccgggtacagaaggtgatattggcattcgagtcaagcctatccgcccaattggtatcttctccggatacgtcgacaaccctgacaagaccgccgccaacatacgcggtgatttttggctcctgggggatagaggcattaaggatgaggacgggtacttccagtttatgggacgcgccaacgatataatcaattcttcaggctacaggattggtcccagcgaagtggaaaatgcgctcatggagcatccggcagtggtggaaactgcagtcatctctagtcctgatcccgtgcgaggggaagtcgtgaaggctttcgtggttcttgcgagccagtttctgtctcacgaccctgagcagttaaccaaggagctgcagcagcacgtcaagtcagtcaccgcaccttataagtatcccaggaaaattgaattcgttttgaatctcccgaaaaccgtcacagggaaaattcaaagagccaagctcagagataaggagtggaaaatgagcgggaaagcacgggcccagtag

SEQ ID NO: 177921 - DNA, 1734 bp, Artificial Sequence
  Description of Artificial Sequence: Synthetic coding sequence
atgcactggctgcggaaggtgcagggcctgtgcaccctgtggggcacacagatgtctagccggactctgtacataaactcccgccagctagtgtctctgcagtggggccatcaggaagtgcccgccaaattcaatttcgcttccgatgtgctagatcactgggccgacatggagaaagcaggaaagaggctgcccagcccggcactttggtgggtgaatggcaaaggtaaggagctcatgtggaacttccgggagctttccgagaacagtcaacaagctgcgaacattctctctggggcttgcggtttacagaggggggaccgcgttgcggtgatgttaccccgagtgcccgagtggtggctagtcattctgggttgtattcgagccggcctgatctttatgccaggtactattcaaatgaagtcgaccgatattctgtaccgtctgcagatgtccaaggcgaaagcaatcgtggctggcgatgaggttatccaggaagtggataccgttgcctccgaatgcccttcactgaggatcaagctattggtctccgagaagtcatgcgacggttggcttaatttcaagaagctgttgaatgaggcctcgaccacacaccattgtgtcgagaccggatcccaagaagcctccgccatctactttaccagcggtacgagtggtttgcctaaaatggcagagcactcatattcttccttgggactaaaggccaaaatggatgcgggctggacaggactgcaggcctccgacataatgtggaccatctctgatacagggtggattttaaatatcctgggctccctgctcgaatcctggaccttaggcgcatgtaccttcgtgcacttgctgccgaaatttgatcctctggtaattttgaaaacactcagtagctaccccatcaagagtatgatgggtgcccctatcgtttaccgaatgttgttgcaacaggatctctcttcgtacaaatttccacatttacaaaactgtttagccggtggggaatccctccttcccgaaactctggaaaattggcgtgcccagacaggactagatatcagagagttctacggccagacagaaaccggccttacctgcatggtcagtaagaccatgaagatcaaaccgggttatatgggaacggccgccagctgttacgacgtccaggtaatagatgataaaggcaatgtgctgccgccgggcaccgaaggagacatcggaatacgggtaaagccaatccgacccattgggatctttagcgggtacgtcgaaaaccccgataagaccgccgccaatatcagaggcgacttctggctcctgggcgatagaggcatcaaagacgaggacggctattttcagtttatgggccgtgcagacgatataattaacagctctggctatcgcattggccctagcgaggtagaaaacgctctcatgaagcaccccgccgtcgtggaaacagctgtcatatccagtcccgaccctgtaaggggtgaggtagtcaaagctttcgtgatacttgctagccagttcctgtcccatgatcctgagcaactcacaaaagagctgcagcagcatgtcaaatctgtcacagcaccatataagtatcccagaaaaattgagtttgtgctgaatcttcccaaaaccgtgaccggcaagatacagcggacaaagctccgcgataaggagtggaagatgtccggcaaagcgagagcccaatag

SEQ ID NO: 177922 - DNA, 627 bp, Artificial Sequence
  Description of Artificial Sequence: Synthetic coding sequence
atgcactggctgcggaaggtgcagggcctgtgcaccctgtggggcacgcagatgagttctcgcacattatacatcaattctagacaactagtctctttacaatggggccaccaagaagtgcctgccaagtttaatttcgcctccgacgtgcttgaccattgggctgacatggagaaagcagggaaacgactgccatccccagccctgtggtgggtcaacggaaagggcaaagaattgatgtggaatttcagagagctatcagagaattctcaacaggcagccaacatcctgagtggtgcctgcggtctgcaacggggggatcgcgtcgcagtcatgctgcccagagtccccgagtggtggctggtgatccttggatgtattagggccggtctaatcttcatgccaggaacaattcagatgaagtcaactgatatcttgtaccgacttcagatgtccaaagccaaagcaattgttgcaggcgatgaggtgatccaggaagtggacaccgttgcaagcgaatgtccctcattgcgcatcaagttgctggtgtctgagaaaagttgtgatggctggctgaacttcaagaaactactgaagtataaggttagacaccgggaagtgaagtag

SEQ ID NO: 177923 - DNA, 1761 bp, Artificial Sequence
  Description of Artificial Sequence: Synthetic coding sequence
atgctggcccgggtgacccggaagatgctgcggcacgccaagtgctttcagcggcttgccatattcggctcagtcagagctttgcataaggacaataggaccgccaccccgcaaaacttcagtaactatgaatctatgaaacaagactttaaattggggataccggaatatttcaattttgctaaagacgttctagaccaatggactgataaagaaaaggccggcaagaaacccagtaaccccgctttctggtggatcaataggaatggagaggaaatgagatggtctttcgaggagttaggctctcttagccgtaagttcgccaacatcctgtccgaggcctgctccttgcagcgcggagacagagtgattttaatcttaccccgggtgccagagtggtggcttgccaatgtggcctgccttagaactgggaccgtgttgatacccgggaccacacagttgacccagaaggacatcctgtaccgtttgcagagcagcaaagccaactgtattattaccaatgatgtactggcccctgccgtcgatgcagttgcttcgaagtgcgagaacctgcacagtaagctgatcgtgtccgaaaacagccgggagggctggggcaacctgaaagaactgatgaagcatgcaagcgattcccacacatgtgtgaagaccaagcacaatgagatcatggctatcttcttcacctccggcactagtggttaccctaagatgaccgctcatacgcacagctcttttggcttaggtctgtctgtcaacggtaggttttggctcgacctgacgcctagcgacgtgatgtggaacacaagcgacactggatgggccaaatccgcttggagttccgtgttcagcccctggatccaaggcgcctgcgtctttacacaccacctccctcgattcgaacctacctcaatactgcagactctgagtaagtaccccattacagttttctgtagtgccccgacggtttatcggatgttagttcagaatgacattacctcttacaaatttaagagtttaaagcactgtgtgtcagcgggagaaccaattacgcccgatgtgactgagaaatggcggaacaaaaccggcttggatatatatgagggctatggccagaccgaaaccgtgctgatttgcgggaacttcaagggaatgaagatcaagcccggaagcatgggcaagcccagcccagcctttgatgttaagatagtcgacgtaaatggtaacgtgttgccaccagggcaggagggggatatagggatccaggtattgccaaaccggcctttcggccttttcacccattatgtggacaaccctagcaagactgcctccacactgagagggaacttttacatcacaggcgataggggctatatggataaggacggttatttctggtttgttgcgcgcgccgatgacgtgattctgagttcagggtacagaattggaccttttgaagtcgagaacgcactgaacgaacacccatccgtcgctgagtccgctgtggtcagctcccctgatcccatcaggggggaagtcgtgaaggcatttgtggttctcaaccctgattataaatcccacgatcaggagcagcttataaaagaaattcaggagcacgtgaagaagacgacggcaccatataagtacccccgcaaggtggagttcatccaggagctgccaaagacaataagcggaaagacaaaacgcaacgagctgcgcaagaaagagtggaaaacaatatag

SEQ ID NO: 177924 - DNA, 1317 bp, Artificial Sequence
  Description of Artificial Sequence: Synthetic coding sequence
atgctggcccgggtgacccggaagatgctgcggcacgccaagtgctttcagcggctggccatctttggctcagtccgggccctccacaaagacaaccgcactgcgactccgcaaaactttagcaattatgagagcatgaagcaggacttcaagctgggaatacctgagtactttaattttgctaaagacgttctcgaccaatggactgataaagagaaggccgggaaaaaaccatcaaatccagctttttggtggattaaccgaaatggtgaggagatgagatggtcttttgaagagttgggcagtctttcccgcaaatttgctaacatcctgtcagaagcttgctcccttcaaaggggagatagagtgatcctcatactcccccgagttcctgaatggtggctagccaatgtggcttgtctccggaccggcaccgtgcttatcccggggacgacccagctaacccaaaaggatatcctgtatcgtttgcagtccagtaaggccaattgcataatcactaacgatgtcttggctcctgccgtcgatgccgtcgccagtaaatgcgagaatcttcactccaagctgatcgtgtctgagaacagccgagaagggtggggcaatctcaaagagttgatgaaacatgcctcggactctcacacatgcgtgaagaccaagcacaacgaaatcatggccatttttttcacctccggaacatcagggtaccccaagatgactgcgcacactcacagctcctttggtttgggactgtccgttaacgggagattttggttggacctgacgccctcagacgtcatgtggaatacatcagataccggatgggcgaagagtgcctggtcatccgtcttttctccgtggattcaaggtgcctgcgtgttcacacaccacttacctcgctttgaaccaaccagcatactgcagactctgtcaaaatacccgatcacagttttttgcagcgctcccactgtgtatcgcatgcttgtacagaacgacataacttcctacaagttcaaatctctgaaacattgtgtgtcggcgggcgagccaatcacacccgatgtgacagagaagtggaggaacaagacaggcctggatatctacgaaggctacgggcaaacagaaaccgtgttaatatgcggcaatttcaaaggaatgaaaattaagcctggttccatgggaaagcctagccccgccttcgacgtgaaggtgtgcacttcccccagcaggcggatgtttaacaaccccatctgcaccttgcccacttataggctgcctccgtacaagctcagcctgctttag

SEQ ID NO: 177925 - DNA, 1737 bp, Artificial Sequence
  Description of Artificial Sequence: Synthetic coding sequence
atgaagcaggacttcaagctgggcatccccgagtacttcaacttcgctaaagacgtccttgaccagtggaccgataaggaaaaggcaggcaagaaacctagcaatccagcattttggtggatcaataggaatggggaagagatgcgctggtcattcgaagagcttggcagtctatcgagaaagttcgcaaatatcctgagcgaggcatgtagcctccaaaggggagatagagtcattctcatcctgcccagagtcccggagtggtggctcgcaaatgttgcttgcctgcgtaccgggacagtgctcatccctggaacaacgcaattaacccagaaagacatcctatatagattgcagagtagcaaggcaaactgcatcattaccaatgatgttctggctccagcagtcgacgccgtggcgtcaaaatgtgagaacctccattccaagctgattgtgagtgaaaactctagggaaggatggggaaatttgaaagaactgatgaaagtttttctgtgtcatcctggatggtctactgtggcccggtcctggctcaccgccacatcaacctcactggtccaggcaatcctgtcactgttgagtagctgggactatcgccatgcaagcgattcccacacatgtgtcaagacaaagcacaatgagattatggctatatttttcacaagcggcacctctggttacccaaaaatgacagcgcacactcactccagcttcgggttggggctgagtgtgaacggaaggttttggttggacctgaccccgtcagacgtgatgtggaacacatcagacaccggttgggctaaatctgcatggtcttccgtattcagtccatggattcagggcgcgtgcgtgtttacccatcatctgccccggttcgaaccaacgtccattctgcagacattgtcaaaataccctatcaccgtgttctgctccgcccctactgtgtacaggatgttggtgcagaatgacattacatcgtacaagttcaaatcgctgaaacactgtgtctcagcaggcgaaccaattacgccggacgtcacggaaaagtggcgcaacaagacaggactggatatctacgagggttacggccagacagaaaccgtgctgatctgcgggaacttcaaggggatgaaaatcaagccaggctccatgggtaagccttcaccagcctttgacgtgaagatcgtagatgtgaacggcaacgtccttccacctggacaggagggtgacattggcatccaagtgctgcccaaccggccttttgggctgttcacccattacgtggacaatcctagtaagactgccagtaccctgagaggaaacttctatattacaggagaccgggggtatatggacaaggacgggtacttttggttcgttgctcgagccgacgacgttatcctttctagtggatacaggataggtccttttgaagtggagaatgcattgaatgagcatccaagcgtcgccgaatccgctgtggtctcctcacctgatcccatccggggtgaagttgtgaaggctttcgttgtgcttaaccctgactataaatctcatgaccaggagcaactgatcaaggaaattcaggagcacgtgaagaaaacaacagcaccctacaaataccccaggaaggtggagtttatccaggagctgcctaagaccatcagcggcaaaactaaaagaaatgagctcaggaaaaaggagtggaaaacaatttag

SEQ ID NO: 177926 - DNA, 1740 bp, Artificial Sequence
  Description of Artificial Sequence: Synthetic coding sequence
atgcggccctggctgcggcacctggtgctgcaggccctgcggaactctcgcgcattttgcgggagtcacggaaaacccgcacctttacctgttccccaaaaaattgtggcaacatgggaggcaatcagcttgggacgccagctcgttcccgaatacttcaactttgcccatgacgttttagatgtttggtctcgacttgaggaggccggccatagacctcctaaccccgccttctggtgggtcaacgggactggggctgaaatcaaatggtctttcgaggagctgggaaaacaatcaaggaaggccgccaacgtacttggcggcgcttgtggactccaaccaggagataggatgatgctggtgctcccacgcctacctgagtggtggttggtaagtgtggcctgtatgagaactggaacagtgatgatccctggcgtgacccagctcacagagaaagatctgaagtatcgactgcaggcatccagggctaagagtatcatcacatccgactccctagctccacgggttgatgcaatctccgccgaatgcccttctctgcagaccaaactgctcgtgtctgatagcagcaggcctggatggctgaatttccgagagctgcttcgggaggcctccacagagcacaactgcatgcgcacaaagagtagggaccccctggcgatttactttaccagtggtaccacaggtgcaccaaagatggtggagcatagtcaaagcagctatggtctcgggttcgtggccagcggtcgccgctgggttgctctcacggagagcgacatattctggaacacgactgacacagggtgggtaaaggccgcttggacgctattttccgcgtggcctaatgggagctgtatttttgtgcatgaactccctagggttgacgctaaggttatcctgaacactttatccaagttccctattaccaccttgtgctgcgtcccaactattttccggctcctcgttcaggaagatctcacgcggtaccagtttcagtctctgcggcattgtttaacgggcggtgaggctctcaacccagatgtacgcgaaaaatggaagcaccagacaggtgtcgagctgtacgagggctatgggcagagtgagaccgtggtcatctgcgccaacccgaaggggatgaaaatcaagtctggatccatgggcaaagcctcaccaccgtacgacgtgcagattgtagatgatgaggggaacgtattgcctccgggggaggaaggcaacgtggccgtcaggatacggcccactcgcccattctgcttttttaattgctacttggacaaccccgagaaaactgcagcctcggagcagggcgacttttacattaccggcgacagggcaagaatggataaggatggctacttttggtttatgggcagaaacgacgacgtgataaacagctcgtcataccgcataggtcccgttgaagtggagagcgctcttgctgaacaccccgctgttctggagagtgcagtagtctccagccctgatcccatcagaggggaagttgttaaggcatttatcgttcttacccccgcttatagtagccatgatcccgaggccttgactagggaactccaggagcatgtcaaacgcgttacggccccctacaagtatccgcgcaaagtggctttcgtatcggagttacccaagaccgtgagcggcaagatccagagatctaaactgaggtcgcaagagtggggtaagtag

SEQ ID NO: 177927 - DNA, 2070 bp, Artificial Sequence
  Description of Artificial Sequence: Synthetic coding sequence
atggccgcccggaccctgggccggggcgtgggccggctgctgggctcacttcgtgggttatctgggcagccagcgagacccccctgcggcgtaagcgccccccggagggccgcaagtgggccctctggatccgcacccgctgtggccgctgccgcagcccagcctggtagctacccggcattgagcgcgcaggccgcccgtgagcctgcagctttctggggacccctcgccagagatacactggtgtgggataccccgtaccacacagtttgggattgcgatttcagtactggcaaaataggatggttccttggtggtcagctgaacgtatccgtcaactgcctggatcagcacgttagaaaatcccctgagtctgtggctctcatctgggaacgagatgaacccggaaccgaggtgcggatcacatatagagagctcctagaaactacatgtcgcttggctaacaccctgaagcgccacggggtacatcgcggtgatagagtggcaatttatatgcccgttagcccattggccgtggcagccatgctggcctgtgccagaatcggagcagtgcatactgtgatttttgctgggttttcagctgaaagtttggccggacgcatcaatgatgccaagtgcaaagtggtcatcacttttaaccagggccttagagggggccgtgttgtcgaactgaaaaagatcgttgacgaggctgtcaaacactgccctactgtccaacatgttctggttgctcaccggaccgataacaaggttcacatgggggacctggacgttcctctggagcaagagatggcgaaagaggatccggtttgtgctcccgaatcaatgggttctgaggatatgctgtttatgctgtatacttccgggtctacaggaatgccaaagggcatcgtacacacacaggctggatacttactctacgcagccctgacccacaaactggtattcgatcaccaacctggtgacatctttggttgcgtggctgatatcggatggatcacagggcacagttacgtcgtttatggcccactctgcaacggcgccacctcagtcctatttgagagtactcctgtatatcctaatgccggtaggtattgggagacagtggaacggctcaaaattaatcagttttacggtgcgcctacagccgtccgattgctcctcaaatatggagacgcatgggttaaaaaatacgaccgcagtagtttgagaacactcggaagcgtgggagagccaataaactgtgaggcctgggagtggctgcaccgcgtagttggcgactctcgatgcactctggtggatacctggtggcagacagagactggcggtatctgtatcgctcctcggccgtccgaggaaggggcagaaattctccccgcaatggccatgaggccttttttcggcattgtccctgtgctcatggatgagaagggtagcgttgtcgaaggaagcaacgtctctggcgccctatgcatatcgcaggcttggccaggcatggcccgcaccatctacggggaccaccagaggtttgtggatgcctacttcaaagcgtatcccgggtactactttaccggggatggggcgtacagaacagaaggaggttactatcagattacaggcaggatggacgacgtaataaacatatccgggcaccgcttggggaccgctgagatcgaggatgccattgccgaccatcctgccgttcctgaatcggccgttataggttacccccatgatattaaaggggaggcagcctttgccttcattgtggttaaagacagcgccggtgactccgacgtggtcgtccaggagctcaagtctatggttgctaccaaaatagctaagtacgccgtcccagacgaaatacttgtggtcaagcggctgcccaagacccgaagcgggaaagtaatgaggaggctgttgcggaagataatcacctccgaagctcaggaacttggagatacaactacactggaggatccatccataattgccgaaattctgtccgtttaccagaaatgcaaagacaagcaggccgccgcaaagtag

SEQ ID NO: 177928 - DNA, 462 bp, Artificial Sequence
  Description of Artificial Sequence: Synthetic coding sequence
atggccgcccggaccctgggccggggcgtgggccggctgctgggcagccttcggggacttagtgggcagcccgcccgacccccctgcggggtctccgctcctcgccgtgccgccagtggcccttctgggtctgctccggctgtggcagcagcggctgcacaacctggcagctaccccgccctcagcgcacaggcggcccgtgaacccgctgcattttggggccctttagcgcgtgacacactcgtatgggacacaccgtaccacactgtgtgggattgcgatttcagtacgggcaaaatcgggtggttcctaggagggcaacttaacgtctctgtgaattgtctcgaccagcacgtgcggaagagcccggagagtgtcgcgttgatttgggaaagggacgagccgggaaccgaagtgagaatcacttactctccctggctccaaatgccttgtggaccatag

SEQ ID NO: 177929 - DNA, 1455 bp, Artificial Sequence
  Description of Artificial Sequence: Synthetic coding sequence
atggccgcccggaccctgggccggggcgtgggccggctgctgggctcccttcgtggattgagcggacagcccgctcggcccccatgcggagtgagcgcgcctcgccgcgcggcaagcggaccatccggatctgcccccgctgtggcagccgcagcagcacaaccaggcagttaccccgcattgtctgcccaggcagccagagaacccgctgccttttgggggcctcttgccagagatacactggtatgggataccccctaccacactgtctgggactgtgactttagtacaggcaagattgggtggttccttggtgggcagctgaacgtctccgtgaattgccttgatcaacacgtgaggaagagtcccgaaagcgtggccctcatctgggaacgggatgaacctgggaccgaggtacgaattacttaccgcgaactgctggaaacaacctgtagattagccaacactctcaagcgccatggggtgcaccgcggggatagagtagccatatatatgcccgtgtcccctctggccgttgccgctatgctggcatgtgcaagaatcggcgctgtgcacacagtcatatttgccgggtttagtgctgagagcctggctggaaggatcaacgacgtgggcgagcctatcaattgtgaggcttgggaatggctgcacagggtggtgggggatagtcggtgcacactggtggacacatggtggcagacggagaccggggggatctgcatagctccgcgcccctccgaagaaggagcagaaatattacctgctatggccatgcgtcctttctttgggatcgtgcccgtcctcatggacgagaagggaagcgttgtggaagggagcaacgtttccggagctctgtgtatcagccaggcttggcccgggatggcacgcaccatctatggggaccatcaacgttttgtagatgcctatttcaaggcttacccaggatactatttcacgggtgacggggcctaccgcacagaaggtgggtactaccagattaccggtagaatggacgacgtgatcaatatctcaggccaccgcttgggaactgctgagatcgaagacgctattgccgatcatcccgcagtacctgaaagcgccgtgattgggtacccccacgacattaagggggaggccgcatttgctttcatcgtcgtcaaggactctgctggcgactcagatgtggtggtgcaggagctgaaatccatggttgccacaaaaatcgctaagtacgcggtgcccgatgagattctggtcgtcaaacgacttcctaaaactcggagtggtaaagttatgcgacgtctgttacgaaagatcatcacttcagaagcgcaggagctgggggacactaccactttggaggacccttccattatcgcggaaattctctctgtttaccaaaagtgcaaggacaagcaggctgccgctaaatag

SEQ ID NO: 177930 - DNA, 1728 bp, Artificial Sequence
  Description of Artificial Sequence: Synthetic coding sequence
atggccgcccggaccctgggccggggcgtgggccggctgctgggctccctgcgaggtcttagtggtcagccagctcgcccgccttgtggcgtcagcgcacctagacgggccgcaagcggccccagcggctccgctccagcagttgccgctgccgcagcacaacccggaagctaccccgctctgagcgcccaggctgcccgggagccagcagccttttggggcccactggccagagatactttagtgtgggacacaccttatcacacagtttgggactgcgatttctcaacaggtaagattgggtggttcttgggcgggcaactaaacgtcagcgtcaactgtttggatcagcacgtccgaaaatccccagagtctgtagcactgatatgggaaagggatgagcccggtaccgaagtcagaattacatacagagagctcctggagaccacctgccggctggcgaatacattaaaaagacatggggttcataggggcgatagggtggctatctacatgccagtctcccctctggcagtggctgccatgctggcttgcgctaggatcggcgccgttcataccgtgatatttgccggcttttctgcggagagcttggccggtcgcatcaacgacgccaaatgtaaggtggtcatcaccttcaaccagggcctgagggggggcagggtggtcgagctgaaaaagatcgtcgatgaagcagtgaaacactgccctacagtccaacatgtccttgtggctcaccggaccgacaacaaggtgcatatgggtgacctagatgtacctcttgaacaggagatggcaaaagaggacccagtgtgcgcacccgagtctatgggaagtgaggatatgctgtttatgctatatacaagcgggtcaacagggatgcctaaggggattgtccacacacaggccggataccttctctatgctgccttaacccataagttggtgttcgatcaccagccaggcgatattttcggctgcgtagcggacataggctggatcacaggccattcttacgtggtatatgggcctctatgcaacggtgctaccagcgtcttgtttgaaagcacccccgtctatcccaatgctggaagatattgggaaacggttgagcgccttaagattaatcaattctatggggctcctacagcagtcaggcttctccttaaatacggcgatgcttgggtgaaaaaatatgatcgcagctcgctgcgtaccctggggagtgtgggtgaacctatcaactgcgaggcctgggagtggctgcacagggtggtgggcgacagtagatgtaccctggtagatacgtggtggcagaccgaaacgggaggcatctgtatcgcaccaaggccttccgaggagggcgcagagattctgcctgccatggccatgaggccgttctttggcattgtgcccgttcttatggatgagaagggctcagttgtcgaaggaagtaacgtctccggagccctgtgtatctcacaggcctggccgggaatggctcgtacaatttacggtgatcaccagcgttttgtcgatgcctactttaaggcttaccctggttactattttaccggagatggggcctaccgtaccgaaggcgggtactaccagattaccggcaggatggacgacgtgataaatatacttcagatcgtgggcttctttcgggaagcaatccggaatagtggagacctcctcgagcattag

SEQ ID NO: 177931 - DNA, 1821 bp, Artificial Sequence
  Description of Artificial Sequence: Synthetic coding sequence
atgctgaagaccttcctgttcctggagaagtacttcccctgcatcaagtacagctccgcttgcttcccaggcactggcttggacgtgtatgacatcaagtttgcagtcctattgcaccctcaaactgcactgcactttggacctcccccctcactcatggcctttagcagtctgtgctgccgggagctgcttgaaaccacctgccgcctagcaaatacattgaagagacacggggttcatcggggggatcgagttgccatctacatgcctgtgagtcccctcgccgttgcggcaatgttagcttgcgcccgcattggtgctgtgcatactgtgatcttcgccggattttcagcagagtcattagccggtcgcatcaatgatgcaaaatgcaaggtcgtcatcactttcaaccagggactgcgcggcggtagggtggtcgaattaaagaagatagttgacgaggcggtgaagcattgtccaacagttcagcatgttctagtggcacaccggacagacaataaagtccatatgggagatctggatgtccctttggagcaggagatggcaaaagaagatcccgtctgtgctcccgagtcaatgggcagcgaggatatgctcttcatgctttataccagcggctccactgggatgcctaagggaattgtgcatacgcaggcaggatatcttttatatgcagctctcacacataagctggtatttgaccaccagcctggagacatttttggatgtgtcgctgacattggctggattaccggtcattcatacgttgtgtacggccccttgtgtaatggtgcgacctccgtgctgtttgagagcaccccagtgtaccctaacgcagggcggtattgggagaccgtagaacggttgaagattaatcagttttacggagctcccactgcggttcggttgctactgaagtacggcgatgcttgggtcaagaagtatgacaggtcaagcttacggacgctgggttcagtcggagaaccaatcaattgcgaggcttgggaatggctccatagagtcgttggagactctcgctgtactctggtcgacacttggtggcagacagagaccgggggcatctgcattgcccccaggccatctgaagagggagctgaaatcttgcccgctatggccatgaggcccttcttcggtatcgtccctgtcctgatggacgagaaaggaagtgtggtagagggatcaaacgtcagtggggccctgtgcatcagccaggcctggcccgggatggcacggactatttacggcgaccatcagaggttcgtagacgcatatttcaaggcatatccgggctactactttaccggcgatggcgcctataggactgaggggggctattatcagatcacagggcgcatggacgatgtgatcaatatctccggtcaccgattgggcaccgccgagattgaggatgctattgctgatcatcccgctgtcccggaaagtgctgtcataggctacccgcatgatatcaaaggggaagccgcgtttgcattcatcgttgttaaggattcagctggggacagcgatgttgtggtccaggaactcaaatccatggtggcaacaaagattgccaagtacgccgttcctgacgaaatcctcgttgttaagcgactgcccaagacaagaagtggcaaggttatgcgccgactcctcaggaagatcatcacctctgaagcccaggaactaggggatactacaaccctggaggatccttcaatcattgcagagattctgtcagtttaccagaaatgcaaagataagcaagccgcagccaagtag

SEQ ID NO: 177932 - DNA, 1707 bp, Artificial Sequence
  Description of Artificial Sequence: Synthetic coding sequence
atgcggcggcggaaggagcggcagccctgggaccggttccacttccttcactttgctcctcacggcagagaattactggaaactacctgcaggctggctaacaccctcaagaggcacggagtgcatagaggagacagagtcgccatctatatgcccgtttcccctcttgctgttgcagccatgctggcttgcgcacgcattggagctgtacacaccgtgatttttgcagggttcagcgccgagagtctcgcaggcaggattaacgacgcgaagtgtaaggtcgtgatcacattcaatcaaggcttgaggggaggtcgagtggttgaactgaaaaagattgtggatgaggccgtcaaacattgccccaccgtgcagcacgtgctggtggctcatcgcacagacaacaaagtccatatgggtgatctggacgtgccactggaacaggagatggccaaagaagatccggtgtgtgctcctgaatctatggggtctgaggatatgcttttcatgctgtatactagcggatcaactggtatgccaaaaggcattgtgcatacccaagcgggatacctgctttatgcagcgctgacacacaaacttgtgtttgaccatcagcccggagacatcttcgggtgtgttgccgacatcggctggattacgggccactcgtacgtggtgtatggtcccctgtgcaacggcgctaccagcgtcctgttcgagagtactcccgtctatcctaacgccggacggtactgggagactgttgagcgcctgaaaattaatcagttctatggggctcctacagccgtgcgcctgctgctcaaatacggagatgcttgggtcaaaaaatatgaccggtcaagcctgcgcaccttgggctccgtaggagagcccattaactgcgaggcttgggagtggctgcacagagtggtgggagactcacgatgcactctggtcgacacttggtggcagactgaaaccggaggaatttgcatcgcacctaggccctcagaggaaggggccgagatcctgccagccatggcgatgcgaccatttttcggtattgtcccagttttgatggatgaaaaggggtcagtcgttgagggatcgaacgtatctggggcgctttgcattagccaagcctggcccggtatggcacgcaccatatatggagaccatcagcggttcgtcgacgcctacttcaaagcatatcctggatactactttactggggacggagcttataggacagagggcggctactaccagatcaccggaaggatggatgatgtgatcaacattagcgggcaccgcttgggtaccgccgagatagaggacgccatagctgatcatccagcagtgccagaaagcgctgtcatcggatacccccacgatattaaaggcgaagccgctttcgccttcatcgtggtaaaggatagcgctggagactctgacgtcgtggtccaggaattgaaatcaatggtcgctaccaaaatcgccaagtatgctgtaccagacgaaatcttagtcgtgaagcggctcccgaaaacccgctccgggaaggtgatgaggcgactgttacgcaaaatcataacatcagaggcccaggagctgggcgataccactacactagaggatcctagtattattgctgaaatcctgtctgtgtaccaaaaatgcaaagacaagcaagctgcagctaaatag

SEQ ID NO: 177933 - DNA, 2145 bp, Artificial Sequence
  Description of Artificial Sequence: Synthetic coding sequence
atgggcctgcccgaggagcgggtgcggagcggcagcggcagccggggccaggaggaggccggagccggagggcgggccagatcttggagcccacctccagaagtgtcccgaagcgcacatgtgccctcactccagcggtacagggagctgcaccgtcgatctgtggaggagccccgagaattctggggtgatatcgcaaaagaattttactggaaaaccccctgccccggaccatttctgcgttacaactttgatgtgacaaagggtaagatattcatcgaatggatgaaaggagctacaacgaacatttgctataacgtgctggaccgtaacgtgcacgagaagaaactgggagacaaggttgccttctactgggagggaaacgaacccggggaaaccacccagattacttatcatcagttgctcgtacaggtgtgtcaattctcgaacgtgttgcggaagcagggaatccagaagggagaccgtgtagccatctacatgccaatgattcctgagttggtggttgcaatgttggcttgtgcgcgaattggggccctgcactccatcgtcttcgccgggttctcctccgaatcgctgtgtgagaggatcctcgactccagctgctctcttcttatcactaccgacgccttctatcggggcgagaaactcgtgaatctcaaagagctcgctgacgaggccctccaaaagtgccaggagaagggctttcctgtcagatgctgcatcgtggttaaacacctcgggagagccgaactgggcatgggcgattccacgagccagtcccctccgattaaaagaagctgccctgacgttcaaggtaagctgaaagagaagtctaaaagggtgcagccgcagatatcttggaaccagggtatagacctatggtggcatgaattgatgcaggaggctggcgacgaatgcgagcccgagtggtgcgacgcggaagatcccctttttatactttacacttccggatcaacaggcaaaccgaaaggagtggtccacactgtgggcgggtatatgctgtacgtggctaccaccttcaagtatgtttttgactttcacgctgaagacgtgttctggtgcaccgcagatatcggctggatcaccgggcactcctatgtcacatacggccccttggctaatggggctactagcgtcctgtttgagggaatccctacgtacccagatgtaaatcgcctgtggtcaattgtggacaagtacaaggttaccaagttctacacggcccctaccgccataaggctgctgatgaagtttggggacgagccggtgaccaaacattctagggccagcctgcaggtcctgggaaccgtcggcgagccgattaatcccgaggcctggttatggtaccacagagtggtgggtgctcagcgctgtcctattgtggacacattctggcagaccgagactgggggacacatgctgactcccctccccggcgcgacgcccatgaagcccggctccgccacattcccctttttcggtgtggcccctgcaatcctcaacgaaagtggtgaggagttagaaggcgaggcggaaggctatctggtgtttaaacagccctggccaggaatcatgcggacagtctatggcaaccatgagcggttcgaaaccacatattttaagaagtttcctggttactacgttactggagatggctgtcagcgggatcaggatggatactactggatcaccggcaggatcgacgatatgctgaacgtaagcggccacctgctgtcaaccgccgaagtcgagtctgccctggtggagcacgaggcagtagctgaggcagccgttgtagggcaccctcatcctgtgaaaggcgaatgcctctattgttttgtgacactatgtgatggccatacgtttagccctaaactcaccgaagaactcaagaagcagattcgcgaaaagattgggcccatcgctacgcctgactacattcagaatgccccgggcctgccaaagacccgctccggcaagattatgcgtcgagtgctccggaaaatcgcccagaacgatcacgatctcggcgatatgtctacagttgctgacccatctgtgatctctcacctcttttcgcaccgctgccttactatacagtag

SEQ ID NO: 177934 - DNA, 1956 bp, Artificial Sequence
  Description of Artificial Sequence: Synthetic coding sequence
atgatggtgcggtgggccctgctgtgcgagttctggggcgacatcgctaaggaattttattggaaaactccgtgtcccgggccttttctgcgttacaacttcgacgtcaccaagggcaaaatctttattgaatggatgaagggagccactactaatatctgctataatgtcctcgacaggaacgtgcacgaaaaaaagcttggtgacaaggtcgctttttactgggagggcaacgagccaggagagactacacagatcacgtaccaccagctgctggtgcaggtttgccagttctccaatgttttgcggaagcagggcatccagaaaggagatcgggtcgccatctacatgccaatgatacctgagctggtggttgccatgcttgcctgtgccagaataggagctctacactccattgtctttgccggattttctagcgagagtttatgcgaaagaatcctggacagctcatgctctctgcttattacaaccgacgccttttaccgtggggagaaactggttaacctgaaagaattagcagacgaagctctccagaaatgccaggagaaggggttccctgtgcgctgctgtatcgtggtaaagcaccttggtcgcgccgaactagggatgggcgactccacttcgcagtcgccaccgatcaagcgttcttgcccggatgtacagatctcttggaaccaggggatagatctctggtggcatgagctgatgcaggaggctggtgatgagtgtgagccagagtggtgtgacgctgaagaccctctttttatcctgtatacaagtggttctacagggaagccgaaaggcgtcgtacatacagtcgggggttacatgctgtatgtcgctacaacttttaaatacgtgttcgatttccacgcagaggatgtcttttggtgtaccgccgatataggctggatcacaggtcactcctacgtgacatacgggccgctggctaacggcgctaccagtgtgttgttcgaagggataccaacatatccagacgtgaataggctgtggagcattgtggacaaatataaggtgacaaagttctatactgcccctactgccattcgactgctcatgaagttcggcgatgaaccagtcaccaaacattctcgcgcctcattacaggttttaggtacagtgggtgagccgatcaaccccgaggcctggctttggtaccaccgggtagtcggggcccagcgctgtcccatcgtcgacaccttttggcagacagagaccgggggccacatgctgacccccctcccaggggctacacctatgaaacctggtagtgccaccttccctttcttcggagtggcgcccgcaattttgaatgagtccggagaggagctggagggggaagctgagggttacctggtttttaagcagccttggcccggcatcatgaggactgtgtatggaaatcacgagcgatttgaaacaacctactttaagaaattccccggatattatgtgaccggcgacggatgtcaaagagaccaggatgggtattattggatcacaggaagaatcgatgacatgctgaatgtgtccgggcacctcctgagcacggctgaggttgagagcgccctggtggagcatgaggctgtcgctgaggcggcagttgtggggcacccccacccggttaagggtgaatgtctgtattgctttgtgacactttgtgacgggcacacattctcaccgaaacttacagaggaactcaagaagcagatcagagagaagatcggcccaatcgccacgcccgattacattcaaaatgctcctggcttgccaaaaaccagatctggtaaaatcatgaggcgagtgcttcggaagatcgcccagaatgaccatgatttgggcgatatgtctacagttgccgacccttccgtaataagtcaccttttttcccaccgctgcctgaccatccagtag

SEQ ID NO: 177935 - DNA, 2106 bp, Artificial Sequence
  Description of Artificial Sequence: Synthetic coding sequence
atgggcctgcccgaggagcgggtgcggagcggcagcggcagccggggccaagaagaggcaggcgccggagggagggccaggagctggagtccaccccctgaagtgtcacgctccgcccacgtgccatcgcttcagcggtaccgcgagctccaccggaggtccgtcgaagagcctcgggaattctggggcgatatcgccaaggagttctactggaagaccccctgccctgggcctttcctgcggtataacttcgacgtcactaaaggcaaaatcttcattgagtggatgaagggagccacaactaacatctgttacaatgtgcttgatagaaatgtgcacgagaagaagctgggcgataaagtggctttctactgggaggggaacgaacctggagagactacccaaatcacttatcaccagttactggtacaggtgtgtcagttttccaacgtcctgaggaagcaggggatacagaaaggcgatcgggtggctatttacatgcccatgatccccgagttagttgtggccatgctggcttgtgcccggatcggtgctctgcacagtattgtgttcgccgggttcagtagtgagtctctgtgtgaacggatcctggattcaagctgtagcctgcttattacaacagacgcattttacagaggggagaaattagtgaacttaaaggaactggcagatgaggcccttcagaagtgtcaggaaaaaggatttcccgtcagatgttgcatagtcgttaaacacttagggcgggctgagctgggcatgggagacagtacatctcagtcacctcccattaagagaagctgtccagacgtacagattagttggaaccaggggatcgacctttggtggcatgagctgatgcaggaagccggtgacgagtgcgagccggaatggtgtgatgctgaggaccccctgtttatactgtatacatctggttcaacagggaagccgaaaggggtcgttcacactgtgggtggctatatgctctatgtggcaacaacgtttaagtacgtattcgacttccatgctgaagacgtcttttggtgcaccgctgacattggttggataactgggcatagctacgtcacatatgggcctcttgctaacggcgcaacaagcgtgctcttcgagggcatccccacgtatccagacgttaacaggctctggtctattgtggacaaatataaagtaacaaagttttacaccgcgccaacagctatacggctgctgatgaaatttggcgacgaaccagtcactaaacactccagagcaagcctacaggtcctgggtaccgtcggcgaacctatcaaccccgaagcctggctttggtatcatcgcgtggtgggggcacagagatgtccgattgtggacaccttttggcaaacagagacaggtggccacatgctgacaccattgcctggcgcgacaccgatgaagcctggatcggcaaccttcccattctttggcgttgccccagccatcctaaatgagagcggtgaagagctggaaggcgaggccgaaggctatctcgtctttaaacaaccatggcccgggatcatgagaaccgtttatggcaatcatgagcggttcgagaccacgtattttaagaaattccccggctactacgttacaggagacggatgtcagagagaccaagacggctactattggatcaccggtaggatcgatgacatgctgaacgtttccggtcatttgctctccaccgccgaggtcgagtccgccttggttgagcacgaggccgtcgctgaagcagcagtggtgggccatcctcaccccgtaaagggcgagtgcctgtactgttttgtgacactatgcgacggccataccttcagcccgaaactcactgaagaactcaaaaagcaaatacgggagaagattgggccaattgccacgcccgattatattcagaacgctcctgggctccctaaaaccagatcggggaaaatcatgcgacgggttctgagaaagattgcccagaacgatcacgatctgggcgatatgtccaccgtggctgatcctagcgtgattagccacctgtttagccacagatgtctgaccattcagtag

SEQ ID NO: 177936 - DNA, 2100 bp, Artificial Sequence
  Description of Artificial Sequence: Synthetic coding sequence
atgggcctgcccgaggagcgggtgcggagcggcagcggcagccggggccaggaagaagcaggcgctggcggacgggctcgcagctggtctccaccgccagaagtttccagaagcgcacatgtgcctagcctgcagcgctatagagagcttcataggcgtagtgtcgaggagccacgcgagttttggggagatatcgcgaaagaattttattggaagaccccatgtccaggtccatttctgaggtacaactttgacgttacaaaaggcaaaatattcattgagtggatgaaaggggccactaccaatatatgctataacgtgctagatagaaatgttcacgagaaaaaactgggagacaaggtcgccttctattgggaaggaaatgagccgggtgaaacgacccagatcacataccaccagctgttggtccaggtgtgtcagtttagtaacgtgctgcgcaagcagggcatccagaaaggcgaccgagtggcaatttacatgcccatgatacctgagctggtcgtggccatgctggcttgcgctcgcattggggccttacactctatcgtgttcgccggctttagctcagaaagcctttgcgagagaattcttgattcctcctgctctctccttataactaccgatgcattttatcgcggcgagaagctcgtgaatctcaaggaactggccgatgaggccctgcagaagtgtcaggagaaaggcttccccgtgagatgttgcatagtggtgaagcacttgggacgggcggagttaggaatgggcgactcaacttcacaatcacctccgatcaaaaggtcatgccccgatgtgcaaatcagctggaatcagggcatcgatctatggtggcacgaactcatgcaggaggccggagacgagtgcgagccggaatggtgtgatgccgaacattcaagtagctgcacgcctgtagcgccgcaggctaacccgcgtgtgtggtttacccaactgggtgccacttgttatgtggccaccacctttaaatacgttttcgactttcacgccgaagatgtgttctggtgcacagctgatatcggttggataacgggccactcatacgtcacatacggccctctggctaatggagcaacctccgttctcttcgaaggtatcccgacatacccagacgtcaatcggctgtggagcatcgtggataagtacaaggtaaccaagttttatacagcaccgacagccatacggctcctgatgaagttcggggatgagcctgtaaccaaacattcccgcgctagtttacaagtgctgggaacggtgggagagccgataaaccccgaggcatggctctggtaccatcgggtcgtgggggcacagagatgccccattgtggacactttctggcagaccgagacgggtggtcacatgctcaccccccttcctggcgccacccctatgaagcctgggagcgccactttcccgttttttggtgtcgccccagccattctgaacgagtctggggaagaactagagggggaggccgaaggatatctggtctttaagcagccatggccagggattatgcgcaccgtgtatggcaatcacgagagatttgagactacttattttaagaagttcccgggatactacgtcacgggagacggttgccagagagatcaagatgggtactactggatcaccggccgtattgatgacatgctcaatgtttcagggcaccttctctccactgctgaggtggaatctgctctggtggaacacgaggcggtcgccgaagcggccgtggtaggacacccacatcctgtcaagggtgagtgtttgtattgttttgtgactctgtgcgatggccacaccttctcacccaaactcaccgaggagctgaaaaagcagatacgcgagaagattggccctattgctacccccgattatatccaaaacgctcctggcctgccaaaaactagatcaggcaagatcatgagaagagtgctgcggaagatcgcacaaaacgatcacgatctcggagatatgagtacagtggccgacccatccgtaatctcccacctctttagccacaggtgcctgaccattcagtag

SEQ ID NO: 177937 - DNA, 1230 bp, Artificial Sequence
  Description of Artificial Sequence: Synthetic coding sequence
atgcaggaggccggcgacgagtgcgagcccgagtggtgcgacgccgaagatcccttgttcatattgtacacaagcgggtctaccggcaagcccaaaggcgttgtgcacacagtgggggggtacatgctctacgtggcaaccactttcaagtacgttttcgattttcacgcggaagatgttttctggtgcaccgctgatattggatggataaccggccactcttacgttacctacggacccctggcaaacggcgcaacaagtgtactcttcgagggcatcccaacctatccagacgtcaacaggctttggtcgatcgtggataagtataaggtgaccaagttttatactgccccaacggcgatccggttgctcatgaagttcggggacgaaccagtcaccaagcattcacgcgctagtctccaggttctcggtacagtgggtgaacctataaacccagaagcatggttgtggtaccatcgggtggttggagctcagagatgtcctatagttgatacattttggcagaccgaaacaggcgggcacatgctgactccactgcccggggcgacgccaatgaagcccggttcagcgactttcccattcttcggtgtggccccagcaatccttaacgagtccggcgaagagcttgagggtgaagctgagggctacctagtgtttaagcagccttggcctggcatcatgaggacagtgtatggaaatcacgagcggttcgagacaacctatttcaagaagtttcccgggtattacgtgacaggtgacggctgccagagagatcaggacggctactattggattaccggtcgcattgatgacatgttaaacgtgtcagggcatctcttgagcactgccgaggttgaaagcgccctggtggaacatgaggcagtcgccgaagccgctgtagtcggtcacccacatccagtgaaaggggaatgcctgtactgcttcgtgacgttgtgcgatggccacaccttttcccctaaattgacagaagaactgaagaaacaaatccgggagaagatagggcccattgctacaccagactacatccagaacgccccaggtttgccaaaaacaagaagtggaaaaatcatgagaagggtcctcagaaaaattgctcagaatgaccatgacctgggagacatgtctactgtggccgacccatccgtcatttctcacctcttttcccatcgttgcttaaccatacagtag

SEQ ID NO: 177938 - DNA, 114 bp, Artificial Sequence
  Description of Artificial Sequence: Synthetic coding sequence
atgatggtgcggtgggccctgctgtgcggcgagtgccggatcctgggaaggcactgccagggtatactgctggaggattccatgccttggcccatcccctcggtacagctctag

SEQ ID NO: 177939 - DNA, 2061 bp, Artificial Sequence
  Description of Artificial Sequence: Synthetic coding sequence
atgaagcccagctggctgcagtgccggaaggtgaccagcgccggcggactgggcgggccccttcccgggagcagccccgcccgaggtgctggcgcagccctacgcgccctggtggtgcctggcccccggggaggcctgggaggccgcggttgccgggctctgagtagcggatctggcagtgagtacaaaactcatttcgcagccagcgtcacggaccccgaaaggttctggggtaaggctgctgaacagatttcctggtacaaaccttggacaaagactctggaaaataagcactccccatccactaggtggtttgtagaagggatgttaaacatatgctataacgcagtggacaggcatatcgagaacggcaaaggtgataaaatcgcaattatctacgattcgcctgtgaccaacacaaaagccacgtttacttacaaggaggtgctggaacaggtgtcgaagctggccggagtccttgtcaagcatggaattaaaaagggggatacagtggtgatatatatgcctatgatcccgcaggcaatgtacacgatgcttgcctgcgcacgcataggcgctatccactccctgatattcgggggatttgcgtctaaggagttgagcagccgcattgatcacgtgaagccaaaggtggtggtgacggcatcattcggtatcgaacctgggcggcgcgtcgaatatgtgccccttgtcgaggaagccttaaaaattggccaacataagcctgataagatccttatctataaccggccaaatatggaagccgtcccattagctccgggtcgagaccttgactgggatgaagaaatggctaaagctcagtctcacgattgcgtccccgtgttgagcgaacaccccctttacatcctctacacttccgggacaaccgggctgcctaaaggcgtgatacggccaactgggggctacgccgtcatgctgcattggtctatgtctagcatctacgggctgcaacctggcgaggtttggtgggccgcatccgatttaggttgggtcgtcggccattcttatatctgctacggccccttgctgcatggtaacactaccgtgctctacgaaggcaagcctgtcgggacccccgacgctggggcgtactttcgggtccttgccgaacacggggtcgccgctctgtttaccgctccaaccgccattcgggccattcgacaacaagatcccggggccgccctgggcaagcagtatagcctaacccgcttcaagaccttattcgtagccggtgaacgctgcgacgtcgagacactcgagtggtccaaaaatgtgttcagggtaccggtgctggaccactggtggcaaacagaaacgggcagtccaatcaccgcctcctgcgtgggcttgggcaatagcaaaaccccccctccaggccaggccgggaagagtgttcccggttataatgtaatgattcttgacgataacatgcagaaactcaaggctcggtgcctcggcaacatcgtagtaaaactcccattacccccaggagcctttagtggtctttggaagaatcaggaagcttttaaacacctgtacttcgagaaattccccggatattacgacactatggacgctggctacatggacgaggaggggtacctgtatgtgatgtcacgcgtggatgatgtgatcaatgtagccggacaccggatctcagccggggccatcgaagagagcatcctgagtcacggtactgtggcggattgcgcagttgtcggcaaagaggacccacttaaaggtcatgtgcccctggcgctatgcgtcctcagaaaggacatcaatgcaactgaggagcaggtgctggaggaaattgtgaaacacgtgcgtcaaaatatcggccccgtcgccgctttccgcaatgcagtgtttgtaaagcagctgccaaaaaccagatccggaaagattcctagaagcgctctgtccgcgatcgtcaacggtaagccatacaaaattacatcaactattgaggatccttcaattttcgggcacgtggaagaaatgctcaagcaggcctag

SEQ ID NO: 177940 - DNA, 1107 bp, Artificial Sequence
  Description of Artificial Sequence: Synthetic coding sequence
atgctgcactggagcatgagcagcatctacggcctgcagcccggcgaggtctggtgggccgcaagtgatctgggatgggtagtgggacacagttacatctgttacggcccgctgttacacggaaacaccacagtgctctacgagggcaagcccgtagggaccccggacgccggagcctatttccgagtgctggccgaacatggcgttgccgcgttgtttacagctcccactgcgatcagagccatccgacagcaagaccccggagccgccttaggcaagcagtactccctgacaaggttcaagaccctgtttgtcgctggcgagcgctgcgatgttgagacacttgagtggtctaaaaacgtttttcgagtgccagttctggaccattggtggcagacagaaactgggtcaccgattaccgctagctgcgtaggtctgggaaatagtaagacccccccccctggccaagccgggaagtccgtgccaggatataacgtgatgatactggacgataacatgcagaagcttaaggcccgatgcttaggaaacattgtggtgaagctgcccctcccacctggagcattcagcggactctggaagaatcaagaggccttcaaacacctttactttgagaagtttcccggatattatgacactatggacgccggatatatggacgaggagggctacttgtacgtgatgtcaagggtcgacgacgtcattaacgtggcaggccatagaataagtgctggggctattgaagagtccatcctatcccacgggactgtggcagactgcgctgtggtagggaaggaagatccactgaaggggcacgtcccccttgccctttgtgtattgagaaaagacattaatgccaccgaggagcaggtcctggaagaaatagttaagcacgtgagacagaacataggaccagtggcggcttttcgcaacgctgtgttcgtaaaacagctgccgaaaacccgctctggaaaaattccccggagcgctctgagcgccatcgtcaacggcaagccttacaaaatcacttcaaccattgaagatccatcaatctttggccacgtggaggaaatgctaaagcaggcatag

SEQ ID NO: 177941 - DNA, 1266 bp, Artificial Sequence
  Description of Artificial Sequence: Synthetic coding sequence
atggccgccaccctgatcctggagcccgccggccggtgctgctgggatgagcccgtacgaatcgccgttcgcgggttggctccagagcagcctgtgactctgcgggcttctctgagagatgagaaaggcgccctgtttcaggcccatgcccgataccgagccgatactctcggtgagctggacttggagcgtgccccagctctggggggctcattcgctggactggagcccatggggttgctgtgggctttggagccagagaagcctcttgtgagattggttaagcgagatgtcagaaccccactggctgtcgagctggaagtccttgacgggcacgacccagaccctggacggctgctatgccgcgtcaggcatgagagatactttctcccacctggcgtgcgcagggagcctgtgagagccggccgtgtcagaggtaccttattcctcccccccgagcctggaccatttcccggaattgtagatatgttcggcacaggcgggggccttctcgagtatcgagcatcccttctcgcaggaaaaggatttgccgtgatggccttggcctattacaattatgaagatctccccaaaaccatggagacgttgcacctggagtacttcgaagaggctgtgaattacctcctgtcacaccctgaagtgaaaggacccggggtcggactgctggggattagtaaaggaggtgaactctgtttgtctatggcatcattcctcaaaggaattaccgcagcagtggtgatcaatggctcagttgccaatgtcggaggaacccttcgttacaagggggaaaccttgccccctgttggagtgaatcgtaacaggattaaggttactaaggacggatatgcagatattgtcgatgtccttaactccccactcgaaggaccagatcaaaaatcctttattcccgtggaaagagccgaatctacattcttgtttttggtgggccaggacgatcacaactggaaaagtgaattttacgccaacgaggcttgtaagaggttacaggcccatggtcgaagaaagcctcaaatcatttgctacccagagactggtcactacatagaaccaccttactttccattgtgccgcgcatcgttgcacgctcttgtgggatctcctatcatatgggggggggagccgagagcccacgctatggcacaggtggacgcgtggaagcagctccaaacgttcttccacaaacacctgggagggcacgaggggactattccctctaaggtttag

SEQ ID NO: 177942 - DNA, 1785 bp, Artificial Sequence
  Description of Artificial Sequence: Synthetic coding sequence
atgatccagaacgtgggcaaccacctgcggcggggcctggccagcgtcttctctaaccgaactagtaggaaatcagctcttcgggctgggaacgacagcgccatggctgacggggagggatatcgtaaccctactgaggttcagatgtcacagctcgtgcttccatgccacacgaaccagaggggtgaactgtccgtgggacagctgctgaagtggatcgacaccacggcctgtcttagtgctgagcggcacgcaggctgcccttgcgtgactgcaagtatggatgacatttactttgagcacactatttccgtaggacaagtggtcaatatcaaggccaaggtaaatcgcgcctttaacagtagtatggaggtcgggatccaggtcgcttctgaggatctttgcagcgaaaaacagtggaacgtgtgcaaggctctggccactttcgtcgcaaggcgcgaaatcaccaaggtgaaattaaagcagattacccctcgaacagaggaagagaagatggaacacagtgttgctgcagaacggcgaagaatgaggttagtatatgctgataccattaaggaccttctcgccaattgtgcaatacagggtgacctcgagtcaagagattgcagccgtatggtgcctgcggagaaaacgagagtagaatccgtggaactcgtactccctccacacgccaaccatcagggcaataccttcggtggacagattatggcctggatggagaatgtagcaaccattgcagctagtcgtctgtgcagggcacatcccaccttgaaggcaatcgagatgttccatttccgtggaccctcccaagttggcgatcggctggtgctgaaggccatcgtgaataacgcatttaaacactccatggaggtaggggtctgcgtagaggcatatcggcaggaagcagagacacacaggcggcacatcaattcagcgtttatgacctttgtggtgctggatgctgacgaccaaccccagctacttccttggattagaccccagcctggcgatggcgaacggagatacagagaagcttcggccagaaagaagatccgcctggatcggaagtacatcgtctcctgtaagcagacagaagtcccactgtccgtgccatgggatccaagcaaccaagtttacctgtcttataacaacgtcagctctctgaagatgctcgtggccaaagacaattgggtgttgtcatcagaaatcagccaggtgagactttacacattagaagatgataaatttctgtccttccatatggaaatggtggtgcatgttgacgctgcccaggctttcctgttacttagcgatcttcggcagcgcccagagtgggacaaacactaccgctctgtggagctggtccagcaagtggacgaagacgatgcgatataccacgttacatcgccggcccttggtggccacaccaagccacaggatttcgtaatactcgcctcgcgcaggaaaccttgcgataatggagatccttatgtcatagcgctcagaagcgtgactttacctacccatcgggaaactcccgagtaccgacgtggggagactctctgcagcggtttctgtctgtggagggagggcgatcaactcactaaagtgtcttactacaaccaggctactccaggtgtgctgaactatgtaacaaccaatgtggccgggctatccagcgagttttacacgaccttcaaggcatgtgagcagtttttgcttgataatcgaaacgatctcgccccctcgctacaaaccctctag

SEQ ID NO: 177943 - DNA, 1824 bp, Artificial Sequence
  Description of Artificial Sequence: Synthetic coding sequence
atgatccagaacgtgggcaaccacctgcggcggggcctggccagcgtttttagtaaccggacctctcgcaaaagtgccttgagggccggcaatgactcagccatggccgatggggagggttacaggaaccccaccgaagtgcagatgtcacagctagttctgccctgccatacgaatcagcgcggggagcttagcgtgggccagctgttgaaatggatcgacactacagcctgcctctcagcggaaaggcacgcaggttgcccatgcgttacggcatctatggatgatatttactttgagcacaccatcagtgtagggcaagtcgtgaatatcaaagcaaaggtcaaccgggctttcaattcctcaatggaagtcggtatccaggtggcctccgaagatctctgctcagagaagcagtggaatgtgtgtaaggccctggctacatttgttgcacgaagagagattaccaaagtgaagctgaagcagatcacccctaggacagaggaggagaagatggaacactctgtagccgcagaacgcagaaggatgcgcttagtttacgctgataccatcaaagatctccttgctaactgcgctatccaaggggatctggagtccagggactgttcccgtatggtgcctgcagagaagaccagggtggagtctgtagagttagtactcccaccgcacgcaaatcaccagggaaacactttcggggggcaaattatggcttggatggagaacgtggccaccatagccgcgtcacggctatgccgggcccaccctacactcaaagcgatagagatgtttcacttccgggggccaagccaggtgggagataggctcgtactcaaggccattgtaaataacgcttttaagcatagcatggaagtcggagtgtgcgtggaggcttacaggcaggaggccgaaacgcacaggcgacatatcaacagtgcatttatgacttttgtcgtactggatgccgacgaccaacctcagctgctgccgtggataagaccacagccaggggatggggaaagaagatatcgggaggcgtcagcaagaaaaaaaatacggctggatcgcaagtatattgtgtcatgtaagcagaccgaagtgccgctctctgtcccctgggatccaagtaatcaggtatacctgtcctacaataacgtcagtagcctaaagatgctggtggctaaggataattgggttttgagctcagaaatttcccaagtgcgcttatacacactggaggatgataagttcctctcttttcatatggaaatggtggttcatgtagatgccgcgcaggcgttcctgctcctgtcagaccttcgtcaacggcctgagtgggacaaacactacagatcagtcgaactcgtacagcaggtggacgaagacgatgcaatttatcatgtaacaagtccggctctgggcggtcacacaaagcctcaggattttgtgattctcgcatcccgccggaagccatgtgacaacggcgacccttacgtgattgctttaaggtcagtgactctgccaactcatagagaaacccctgaatatcggcgtggagagaccttgtgttccggcttttgcctctggagagagggagatcagctgactaagtgctgttgggtcagagtgtctctcacggaactggtgtctgcctcagggttctactcctggggtctggagtctcgctcaaaaggcagaagaagtgacgggtggaacgggaagctcgcaggcggtcacctatcaacacttaaagccatcccagtcgccaaaatcaattcccgctttgggtatctgcaagacacctag

SEQ ID NO: 177944 - DNA, 1668 bp, Artificial Sequence
  Description of Artificial Sequence: Synthetic coding sequence
atggagcggcccgcccccggcgaggtggtgatgagccaggccatccagcccgctcatgctactgcacgcggcgaattgagcgccggacaactcctaaagtggattgatactaccgcctgcctggcagccgagaagcatgccggtgttagctgcgtgaccgcctcagtcgatgacatccagtttgaagagacagcaagggtggggcaggtgatcacaatcaaagctaaggtcaccagggccttctctacttctatggaaatcagcataaaagtgatggtgcaggatatgttaacaggtattgagaagctggtcagcgtcgccttttcgacttttgtggcaaagccagtggggaaggaaaagatccacctgaaacccgtgacccttctcaccgagcaagatcatgtggaacataatctggctgcagagagacggaaggtgcgcctgcaacacgaagacactttcaataacctgatgaaagagtcttctaaatttgacgacctgatcttcgacgaagaagagggggctgtgtccaccagaggcacttctgtgcagtctattgagttggtcctgcctccccatgcaaatcaccacggaaacactttcgggggacagatcatggcctggatggaaacagttgcaactatctccgctagcaggttgtgctgggcccacccattccttaagtcggtggatatgtttaagtttaggggcccatcaaccgtgggcgacaggttagtatttactgcgatcgtcaataacactttccagacttgtgtggaagtgggcgtgcgcgtggaagcatttgactgccaagaatgggcggagggaaggggtcgacacattaattctgcatttctcatttataacgcagctgacgacaaagaaaacttaatcacgttcccgcgcattcaacccatctctaaggatgacttcagacggtatcggggggccatagccaggaagcggattcggcttggccgaaagtatgtaatctctcacaaggaagaggtcccattatgtatccattgggatatttcaaagcaggcctcgttgtctgattctaatgtagaggccctgaaaaaactggccgcaaagcgaggctgggaagtgaccagcactgttgaaaagatcaagatatatacacttgaagagcatgacgtgctttctgtttgggtagagaagcacgtcggatcccctgctcacctcgcctaccgtctgctgtcggattttactaaaaggcccctctgggatccccattttgtcagttgcgaagtgatcgattgggtttcagaggacgatcagctttatcatatcacatgccccatattaaatgacgataagccaaaggacttagtagtgcttgtaagcaggaggaagcccctgaaggatggaaacacatacacagtggcggttaagtcagttatcctaccctccgtccctcctagtcctcaatacatccggagcgaaatcatttgcgccggcttcctaattcacgcgatcgatagcaatagctgtatagtgtcatattttaatcatatgagtgcttccatcctaccatactttgccggcaatctaggcgggtggtctaaatcaatagaggagaccgctgctagttgcattcagtttttagaaaatccccctgatgatggatttgtaagcactttttag

SEQ ID NO: 177945 - DNA, 1452 bp, Artificial Sequence
  Description of Artificial Sequence: Synthetic coding sequence
atgagcaacaagctgctgagcccccacccccacagcgtggtgctgcggagcgaattcaagatggcctcttctcctgctgtgctccgagctagcagactttatcagtggtctctgaaatcatccgctcagtttttgggctctcctcagctccggcaggtgggacagatcatcagagttccagcacgaatggctgccaccttgattcttgagcctgctgggcggtgttgctgggacgaacctgtgcggatcgccgtccgcggcctggcccctgagcaaccagttacactgcgcgccagcctccgggatgagaaaggggctctgtttcaagcccacgccagatatcgtgccgacacactgggcgagctagatttagagcgggcaccagccctgggaggaagctttgccggacttgagccgatgggactgctgtgggcacttgaaccagagaaacctctggtgcggctcgttaagcgcgacgttcggactcctttagccgttgagttggaggtcctagatggtcacgacccggacccgggtcgactattatgccagactcgtcacgagcggtacttcttgccacccggagtaaggcgggaaccggtgagagtcggccgcgtccggggcaccttatttcttccacccgagccaggcccatttcctggcattgtagatatgtttggcactggaggtggtctactggaatacagagcatctctgctcgccggaaaaggcttcgcggtgatggcgcttgcctactacaactacgaagacctcccgaaaactatggagacgctgcatctggaatactttgaagaagcaatgaattatctgctgtctcacccggaggttaagggacctggagtgggtctactggggatatcaaagggaggcgagctgtgtttatccatggccagctttttaaagggtatcactgctgcagttgtgatcaacggatctgtggccaacgttggtggtacactgcattataaaggagagacgctgccaccagtaggagttaatcgaaaccggataaaagtgaccaaagacggatacgcggacatagttgatgtgttgaatagtcctctggaaggccctgaccaaaaaagttttattccagtggagagggcggaatcaacattcttgttccttgtgggtcaagacgatcacaactggaaatctgagttttatgccaatgaggcctgcaagagactgcaggcccatggaagaagaaagccccagatcatttgttaccctgagacaggacactacattgaacccccatacttccccctatgcagggcttctcttcatgctctagtggggtcacccataatctgggggggtgaacctcgtgcacatgccatggcgcaggtggacgcctggaagcagctgcagacattctttcataaacatctggggggtcacgaaggaactataccttccaaggtttag

SEQ ID NO: 177946 - DNA, 1266 bp, Artificial Sequence
  Description of Artificial Sequence: Synthetic coding sequence
atgagcgccaccctgatcctggagccccccggccggtgctgctggaacgagcccgtgcggattgccgtgcgagggctagcaccagaacagagggtcacactcagagcctcattacgcgatgaaaagggtgcccttttccgcgcccatgccaggtattgcgcagacgcaagaggggagctggacctggagagagctccagcacttggcggcagttttgcagggctagaacctatggggttactgtgggcccttgagcccgagaaaccattttggcggtttctgaagcgggacgtgcagatcccctttgtcgtggaattggaggtgctggatggccacgacccagagccagggaggctgctgtgccaggctcaacacgaacggcatttcctgcccccaggcgtgcgcaggcagagcgttcgtgcaggcagagtgcgggccacactctttctgcctccaggacccggccccttcccgggcattatcgacatttttggtataggtggcggattgttagagtacagagctagcctgctcgccggacacggttttgcaacactggcactggcctactacaattttgaggatctgcccaataatatggacaatatcagcctggaatacttcgaggaagccgtgtgctacatgctccagcatcctcaggtcaaaggtccgggcatagggctgcttggcataagcttaggcgcggatatctgcttgagtatggcctcatttttgaaaaatgtttctgccacagtcagtatcaatggctccggcatatctgggaacaccgcgattaactataagcactcctcaatcccccccctgggctacgacctgcgtaggattaaagtggctttttcggggttggtggacatagtggacatcaggaatgcgctagtcgggggctataagaatccctcgatgattcctatcgaaaaagcccagggacccattcttttaatcgtcggccaagatgaccataactggaggtctgaactatatgcccagactgtgagcgaaagactgcaggctcacggcaaagagaaacctcagatcatttgttaccctgggaccggacactacattgagcccccctacttccccctatgcccagctagcctccatcggctcttgaacaagcatgtgatctggggcggcgagccaagggcgcactccaaagctcaagaggacgcctggaaacagatcttggcatttttttgtaaacacctgggtggaactcagaaaaccgcagtgcccaagctgtag

SEQ ID NO: 177947 - DNA, 624 bp, Artificial Sequence
  Description of Artificial Sequence: Synthetic coding sequence
atgctgcagcaccccaaggtgaagggccccagcatcgccctgctgggattttctaagggcggcgacctttgcttgtcaatggcttccttcctcaaggggatcactgccacagtgctgatcaatgcctgtgtggcaaacacagttgccccacttcactacaaggacatgattatacccaaactggtggatgacctagggaaagtgaaaatcaccaaatcaggatttctgaccttcatggatacatggtcgaaccctctcgaggaacacaaccatcagtcactggtgccgttagaaaaagcccaagttccctttctgttcatcgtgggcatggatgaccagtcatggaagtctgaattttatgctcagatcgcaagcgaacgccttcaagcacatggcaaggaacgcccgcaaatcatttgttaccctgaaactgggcactgcattgaccctccctattttcccccctcaagagcctcagtccatgcagtccttggggaagcaattttttatgggggagaaccaaaagctcattcaaaggctcaggtagatgcatggcagcagatccagacattctttcacaagcacttaaatggaaagaagagtgtgaaacactcaaagatatag

SEQ ID NO: 177948 - DNA, 507 bp, Artificial Sequence
  Description of Artificial Sequence: Synthetic coding sequence
atgctgcagcaccccaaggtgaagggccccagcatcgccctgctggggtttagcaagggcggggatctgtgcctgagcatggccagcttcctgaagggaatcacggccactgtgttaatcaacgcatgcgtagccaataccgtggcccccctccactacaaagatatgattattcctaagttagtggacgatctgggtaaagtgaagattacaaagagtggcttcctcacgttcatggacacatggagtaatcctttggaagagcacaaccatcagagccttgtacccctcgagaaggcgcaagtgccatttttgttcatagttgggatggatgaccagtcctggaagtctgagttttacgcccagatcgcttctgaacgcctgcaagcccacggtaaagagcgaccacagattatctgctatcccgaaaccggccactgtattgatccgccttactttccgcccagccgagcctctgtgcacgcagtactaggggaagctatctag

SEQ ID NO: 177949 - DNA, 1113 bp, Artificial Sequence
  Description of Artificial Sequence: Synthetic coding sequence
atggcccggcccggcctgatccacagcgcccccggcctgcccgacacttgcgccctcctgcagccgccagccgcaagcgccgcagccgccccgtctatgagcggacctgacgtggagactccatccgccatccagatctgcaggatcatgagaccagatgatgctaacgttgccggtaatgtgcacggaggcactattctgaaaatgatcgaggaagccggtgcaatcatctcgacgaggcactgcaactctcagaatggcgagaggtgcgtggcagctctggccagagtggagcgcaccgactttctgtcccctatgtgcattggggaggtggctcacgtgagtgctgaaatcacctacacttccaagcacagcgttgaagttcaagtgaacgtgatgagcgagaacatactcaccggagctaaaaagctgactaacaaagccacgctttggtatgtcccgttgtctttgaaaaacgtggataaggtgctcgaagttccccctgtggtctactcacggcaggagcaagaggaagaagggaggaaacggtacgaagcccagaagcttgaaagaatggaaaccaagtggagaaacggtgacatcgtacagcctgtactgaaccctgaacccaatactgtgtcttactcacagtcctctctgattcatcttgtcggcccaagcgattgtaccctccatggctttgttcatgggggggtgaccatgaagctcatggacgaggtggcagggattgtggccgcacgccactgtaaaaccaacatcgttacagctagtgtagacgccattaatttccacgacaaaatcaggaaggggtgcgttattacgatctcaggccgcatgacatttaccagcaacaagagcatggagattgaggtcctggtggacgcagaccccgttgtagatagcagccagaagcgctaccgggccgcaagcgcattcttcacatacgttagtttaagtcaggaaggaagaagcctgcctgtaccccagctggtgccagagaccgaagacgaaaagaagcgatttgaggagggtaaggggcgctacctccagatgaaggctaaaaggcagggacatgccgagccacaaccatag

SEQ ID NO: 177950 - DNA, 990 bp, Artificial Sequence
  Description of Artificial Sequence: Synthetic coding sequence
atggccttccagctgagccggatcatgcggcccgacgacgccaacgttgcaggaaacgtacacggtgggaccattctcaaaatgattgaagaggccggagcaataatttccacacgccattgcaatagccagaacggcgagcggtgcgtggccgcgctcgcccgtgtagagcgtactgacttcctgagccccatgtgcatcggtgaagtagcccatgtttctgccgaaatcacctacacatccaaacatagcgtcgaggtgcaggtcaacgtgatgtccgagaacatccttacaggcgcaaagaaattaactaacaaggccaccctttggtatgttccactctccctgaagaatgtagataaggttctggaagtgccccctgttgtctactccagacaggaacaggaggaggagggccggaagagatatgaagctcagaagcttgagcgcatggagaccaaatggcgcaatggggatatcgtacagcccgttctgaacccagaacccaatactgtgtcttattcacagtcgtccttaatccacctggtggggccttctgattgtacgcttcacggctttgtgcacggaggcgtgactatgaaattgatggatgaagtggccggcattgtagctgctagacactgtaaaaccaatatagttactgcctcagtcgacgctatcaatttccacgacaaaatcagaaaagggtgtgtaattacgatttccgggcggatgacgtttacaagtaataagtcgatggagatagaggtgttggttgatgccgatccagtggtggacagctcacagaaaaggtatcgggccgccagcgcattctttacctacgtgtctctaagccaagagggaagaagcttacccgtcccccaactggtccccgagactgaagacgagaagaaaaggttcgaggagggaaagggcagatacctccaaatgaaggcaaaacgccagggacacgccgagcctcagccgtag

SEQ ID NO: 177951 - DNA, 1053 bp, Artificial Sequence
  Description of Artificial Sequence: Synthetic coding sequence
atgctgctgctgcggcggagcctgagcctgaacgtgctgcggaaggaggtcgatcgggcttgcttcggcgaaaaagccaagcagatcatgcgaccggacgatgctaacgtagctggtaatgtccacggcggcacgatactaaagatgattgaggaggccggtgcgatcattagcacgcgtcattgcaacagccagaatggggagcggtgcgtggcagctctggcacgcgtggaaaggaccgacttcctcagccctatgtgcatcggtgaggtcgcccacgtttcggcagagattacatacacttcgaagcatagtgtagaggtgcaggtgaacgtgatgtctgaaaatatcctgacgggcgccaagaaactcacaaacaaagccaccctgtggtacgtgcccctgtcactaaagaacgttgataaggtcctggaggtgccccctgttgtttatagtaggcaggagcaggaggaagagggcaggaagcgatacgaggcccagaagctggagcggatggagaccaagtggcgcaacggcgatattgtccagccggtcctgaatcccgagcccaacaccgtgagttattcacaaagctcacttatacatctggtgggtccaagcgattgcaccctgcatggatttgttcatgggggcgtcaccatgaagctgatggacgaggtcgctggcattgtcgcagccagacactgtaaaacaaatatcgttacggcatcagtcgacgcgattaactttcacgacaagatcagaaagggatgcgttatcaccatttccggtcgcatgacatttacatcaaacaagagtatggaaatagaggtgttagttgacgccgatccagtagtcgactcaagtcagaaacggtacagagcggcctcagctttctttacctacgtgagtctatctcaagaggggaggtctctcccggttccccagctggttccggagactgaggacgagaagaagcgctttgaggaggggaagggcaggtacctgcagatgaaagccaagagacagggccacgccgagccacagccctag

SEQ ID NO: 177952 - DNA, 1143 bp, Artificial Sequence
  Description of Artificial Sequence: Synthetic coding sequence
atgaagctgctggcccgggccctgcggctgtgcgagttcggccggcaagcaagcagcagacgcttggtggcaggccaaggatgcgtggggccgagaagaggatgctgtgctcctgtccaggtcgttggccctcgcgcagatttgcctccctgcggggcttgtataactggcaggattatgcgaccagatgatgcaaacgtggctggaaacgtacacggcggcacaatcctgaaaatgattgaggaggccggggccattattagcaccaggcactgcaattcacagaacggcgaaaggtgcgtagccgctttggccagagtagagaggacagatttcctgtcccccatgtgtattggggaagtcgcccatgttagcgcagagattacatacacctctaaacatagcgtcgaagtgcaggtaaatgtgatgtcagagaacatcctgaccggagctaagaagctgaccaataaggctaccctgtggtatgtccccctgtccctgaagaacgtcgacaaggtccttgaggtcccaccggttgtgtacagtcgccaggaacaagaggaagaggggaggaagaggtatgaagcccaaaagttagagagaatggagacaaagtggaggaacggggacatcgtgcagccagtcctaaaccccgagccaaacactgtcagttattcacagagcagtctgatccatctggtaggaccttcagactgcacactgcacggctttgtgcacggaggggttaccatgaaacttatggacgaggtggccggtatcgtcgcagcaaggcattgcaaaacgaatattgtgacagcttctgttgacgccatcaattttcacgataagattagaaaggggtgtgtaattacaatatcaggacggatgacttttacatctaataaatctatggagatcgaagtgctggtggacgctgaccccgtggtggatagtagtcagaaacgatacagagccgctagtgcgttctttacttatgtgtctctttctcaggagggccgatcactccctgtgccgcagctggtgcccgaaacagaagacgaaaagaaacgctttgaagagggaaaaggacgatacctgcagatgaaagctaaacgtcaggggcacgcggaaccccagccatag

SEQ ID NO: 177953 - DNA, 672 bp, Artificial Sequence
  Description of Artificial Sequence: Synthetic coding sequence
atgctgctgctgcggcggagcctgagcctgaacgtgctgcggaaggaagtcgaccgagcttgtttcggagaaaaagctaaacagataatgaggcccgacgatgcaaacgttgctggaaacgtgcatggaggaaccattctgaagatgattgaggaggcaggcgcaatcatatccacaagacattgtaactcacagaacggtgaacggtgcgtcgctgccctggcccgtgttgaacggactgatttcctgagtccgatgtgtataggcgaggtggcacacgttagtgctgagataacgtacacatccaagcacagcgtggaagttcaggtcaacgtgatgtccgagaacattcttacaggcgccaagaagctgactaataaagcgacgctgtggtacgtgcccttgtctcttaagaacgtggataaagtgttagaggttcctcccgtcgtctatagccgccaggagcaggaggaggagggaaggaaaaggtacgaagctcagaaacttgagcggatggagactaagtggcggaacggagacatcgttcaacccgttttgaatccggagccaaatacagtgtcctactcgcagtcatctttaatccatcttgtgggaccaagcgattgcaccttgcacggattcgtccacggcgggggagtggatttccactag

SEQ ID NO: 177954 - DNA, 798 bp, Artificial Sequence
  Description of Artificial Sequence: Synthetic coding sequence
atgtgcatcggcgaggtggcccacgtgagcgccgagatcacctacacatccaaacacagcgtggaggtgcaggtgaacgtgatgtcagagaacatcctgaccggggccaaaaaattgactaataaagccaccttgtggtatgtgcctttaagcttaaaaaacgtggacaaagttctggaggttccccccgtcgtgtactccaggcaggagcaagaagaagaaggccgcaaacggtatgaggcgcagaaactcgagcgcatggagaccaaatggaggaatggtgacatcgtgcaacccgttctgaacccagaaccaaataccgtatcatactcacagtcatctctgatccacctggtgggtccctcggattgcaccctccacgggttcgtccatggcggggtgaccatgaagttgatggatgaagtggctggcattgtggcggcccgccactgcaaaacaaacatagttacagctagtgtggacgccatcaactttcatgataaaatcaggaaaggatgcgtcatcacaatcagcggccgaatgacattcacttcaaataagtctatggaaatcgaagttctagtcgacgccgatccggttgtagatagctcacaaaaacgatatagagccgccagtgctttcttcacctatgtgtcccttagtcaagaaggtcggtctttaccagtgccccagttagtgcctgagaccgaggacgagaaaaagaggttcgaggaaggaaaggggcgctatcttcaaatgaaggcgaaacgtcagggccacgcagaaccccagccctag

SEQ ID NO: 177955 - DNA, 1308 bp, Artificial Sequence
  Description of Artificial Sequence: Synthetic coding sequence
atggccgcccccctggtgctggtgctggtggtggccgtgaccgtgcgggctgcactgtttcgctcttccctggccgaattcatctccgaaagagtggaagtggtttccccactgtcttcttggaaaagggtcgtagaaggcctcagtctgttagaccttggagtatcgccttacagtggcgccgtcttccatgaaacaccgctcataatctacctatttcacttcctgatcgactacgccgaactggtgtttatgatcaccgatgctctgacggccattgcgctttatttcgccatacaggacttcaataaagtggtttttaagaaacagaaactcctcctcgagctcgaccagtacgctcctgatgttgccgagctcattcgcacccctatggaaatgcggtatattcccttgaaggtcgcactgttctacctgttgaacccctacactattttatcctgcgtggcaaagtctacatgcgctataaataatacccttatcgcctttttcatcctgacaaccattaaaggtagcgccttcttatctgccattttccttgccctcgcaacctatcagagcttgtatcctctcactctgttcgtgccggggctgctctacttactgcagcgtcagtatataccagtgaagatgaagtctaaagcgttttggattttttcctgggagtatgcaatgatgtacgtcggatcgcttgtggtgattatctgcctttctttcttcctgctgagctcctgggattttatcccagcggtgtacggctttatcctgagcgtgcctgacctgactccgaacatcgggctgttttggtatttcttcgccgaaatgtttgagcacttctctctcttcttcgtgtgcgtgttccagattaacgtgttcttctacacaatcccactggccatcaagcttaaggagcatccgatattctttatgttcatccagatcgccgttattgccattttcaaaagttaccccacagtgggcgatgtggctctctacatggcctttttccctgtatggaatcatctataccgatttttgaggaacatcttcgtgttgacttgtatcattattgtttgctccctccttttccccgtgctgtggcacctgtggatctacgcagggtccgccaactcgaatttcttctacgccattacattaacttttaacgtgggacaaatcctgctgatttctgactatttctacgcgttcttgaggagagagtattacttgacacatgggctctacctgacggctaaagatggaacggaggctatgctggttctcaagtag

SEQ ID NO: 177956 - DNA, 342 bp, Artificial Sequence
  Description of Artificial Sequence: Synthetic coding sequence
atgagcagcccccaggcccccgaggacggccagggctgcggcgacaggggagaccctccaggggacctcaggagcgtcctcgttaccacagtccttaatctggagccactggacgaggacctgttcaggggacgccattactgggtccctgcaaagagactgttcggcgggcagatcgtcggccaggcgttagtcgcggcagccaagtccgtgtctgaggatgtgcatgtgcacagcctacactgttatttcgtgcgggccgaacagatgccttcttgtgtgttgcgaagatctcccgcggagaaatctctctggactttcactgtgtgtgacctctactag

SEQ ID NO: 177957 - DNA, 1320 bp, Artificial Sequence
  Description of Artificial Sequence: Synthetic coding sequence
atgcggcgggccgccctgcggctgtgcgccctgggcaagggccagctgacaccaggcagggggctgacccaggggccacagaacccaaagaaacagggcatttttcacatccacgaagtgcgcgataagctgagggaaatcgttggggccagcaccaattggcgggaccatgtgaaagctatggaggagaggaagctcttgcattcatttttagcaaaatcccaagacgggctccccccacgtagaatgaaagattcttatatcgaagtcctgctcccccttggttccgagccagaactgcgcgaaaagtacttaaccgtgcagaacacagttcggttcggcagaattctggaggacctggattctctgggggtcctgatatgttatatgcacaacaagatacattctgcgaagatgtctcccctaagcattgtaactgcactggttgataagattgatatgtgtaagaaatccttgtctcccgaacaagacatcaagttttccgggcacgtcagttgggtcggtaagacctccatggaggtgaagatgcagatgtttcagcttcatggcgacgaattctgccccgtgctggacgccaccttcgtcatggtcgctagggactcggaaaacaagggccccgcctttgtcaatcctctcatcccggagtccccagaggaggaggagttgttcaggcagggtgaattgaataagggcagacgcatcgcattctcctcaacatccctgctgaagatggcgccctcggcggaagagcggactactattcacgagatgttcctgagcacgttggacccaaaaacaatttccttcaggtccagagtactgccatcgaatgccgtttggatggaaaactcaaaactgaagtctctggaaatctgtcatccgcaggagcgaaacatctttaatcgcattttcggaggattcctaatgcgcaaggcttacgagctggcctgggccacagcctgctccttcgggggtagtagaccgtttgtggtggctgtggatgatatcatgttccagaagccagtggaagtgggcagcttgctcttccttagttctcaagtgtgctttacgcagaataactacatccaagtgcgggtgcacagcgaagtggcgtcgttgcaggagaaacaacacaccacaactaatgtgtttcacttcaccttcatgtccgagaaggaggtgcccctggtgttccccaagacatacggagaaagcatgctatacctggacgggcaacggcatttcaattcgatgtccggtccagcgaccttgaggaaagattatcttgttgagccatag

SEQ ID NO: 177958 - DNA, 1140 bp, Artificial Sequence
  Description of Artificial Sequence: Synthetic coding sequence
atggaggagcggaagctgctgcacagcttcctggccaagagccaggatggtttgccccccaggcgaatgaaggacagctacattgaagtgctcctaccactgggaagtgagcccgaactgcgcgaaaagtacttgacggtacagaataccgttcgcttcggtcgcatacttgaagatctggacagcctgggtgtgctcatctgctacatgcataataagatccactcagcaaagatgtctcctctgtcaatagtgaccgcattggtcgataagatcgacatgtgcaagaaatctttgagccccgagcaggacatcaaattttcaggccacgtatcttgggtaggaaaaactagtatggaggttaagatgcagatgtttcagctccatggtgacgaattttgccctgtactggacgcgactttcgtgatggtggctcgagactcggagaataagggtccggcgtttgttaaccccttaataccggagagtcccgaagaggaggaactcttcagacaaggagagctgaacaagggcagacgcatcgccttctcatccacgagcctcctcaaaatggctccttccgccgaagaaagaacaacaatacatgagatgtttctaagcaccctggatcctaaaacaatctcctttcggtccagagtgctgccatctaacgccgtttggatggaaaatagcaaattgaagtcacttgagatctgtcaccctcaggagcggaatatctttaaccggattttcgggggttttctgatgcggaaggcatatgaacttgcgtgggccacagcatgtagtttcggggggagtaggcccttcgttgtcgctgtcgatgatattatgtttcaaaagcccgtggaagttggcagtcttctcttccttagttcacaggtttgttttacccagaataactacatccaagttcgagtgcattctgaggtcgcatccttacaggaaaaacagcacaccacaactaacgtattccattttacattcatgtccgaaaaagaagtgcccttggtgttcccaaagacttatggcgagagtatgctgtatctggatggccagcggcactttaatagcatgtccgggccagctaccctccgaaaggactacctagtggagccatag

SEQ ID NO: 177959 - DNA, 1347 bp, Artificial Sequence
  Description of Artificial Sequence: Synthetic coding sequence
atgcggcgggccgccctgcggctgtgcgccctgggcaagggccagctcacacctgggagaggcctgacacaagggccacaaaatcccaagaaacagggtattttccatatacatgaagcatgtagttcaattcacgtgaaccatgtccgggacaagctccgggaaatcgttggtgcttccacaaactggcgtgaccacgtcaaggcgatggaagagcgcaagctgctgcactctttcctcgccaagtcacaggatggtctgccacctcggaggatgaaggacagctacatcgaggtcctgctccccttaggctctgagccggagctgagagagaagtacctgaccgtccaaaataccgtcagattcggtcggatcttagaagacttagactccctaggtgtgcttatctgctatatgcacaacaaaatccattccgccaagatgtctcccctgtccatcgtaacggcgttggttgacaaaatcgacatgtgcaagaagagtctgtctcccgaacaggacattaaattcagtggccacgtgagttgggttgggaagacatctatggaggtcaagatgcagatgttccaactgcacggagacgaattttgccctgtgctggacgccacgttcgtgatggtcgcccgcgactctgagaacaaaggcccagcttttgtaaacccactgatcccagaatcccccgaggaagaagaactctttcgccagggagagctgaataaaggcagacggattgctttttctagtacgagcttattgaagatggctccatccgctgaagaacgcacgacgatacatgagatgttcctgtccactctcgatcctaaaaccatctcctttcgcagtcgcgtgctgccgagtaacgctgtttggatggagaacagcaaattaaaaagcctggaaatctgtcatccacaggaacggaacatttttaatagaatatttgggggctttctcatgcggaaagcctacgagctggcctgggctaccgcctgtagcttcgggggaagtaggccatttgtcgtggccgtggatgacatcatgttccagaaaccagtcgaagttggatctttgctgtttctgtcatcccaggtgtgtttcactcaaaataactacattcaggtgagagtgcattctgaggtggcaagcctccaggaaaagcaacacacgactactaatgtctttcacttcaccttcatgtccgagaaagaggtaccactggtctttccgaaaacatacggggagagtatgttatacctggacgggcagaggcactttaattcaatgtccggacctgcaactctccggaaggattacctggtcgagccttag

SEQ ID NO: 177960 - DNA, 1269 bp, Artificial Sequence
  Description of Artificial Sequence: Synthetic coding sequence
atgaccgtgttcttcaagaccctgcggaaccactggaagaagaccacagccggcctgtgcttgctgacctggggaggtcactggctatacggtaagcactgtgacaacctgctgaggcgagcggcctgccaagaagcccaggtcttcggcaaccagctgatcccaccgaacgctcaggtgaaaaaggccaccgtgtttctgaaccccgcagcctgtaagggaaaggcaagaaccctgttcgagaagaatgccgcaccaatactccacctgtcggggatggatgttacaattgtcaagacagattatgagggacaggccaagaagcttctggaactcatggagaatacggatgttataatagttgcgggcggcgatgggacattgcaagaagtagtcaccggcgtgctgaggcgaacggacgaggctacattttcaaagataccaatcgggtttatcccactcggagagacctcatcactgtctcacacattgtttgctgagagtggaaacaaggttcagcacattaccgacgcgactctggccatcgtcaaaggagaaacagttcctctggatgtcctgcagatcaagggagaaaaagaacagcctgtatttgccatgacagggctgcgatggggcagcttcagagatgcaggggtgaaggtgagtaagtactggtacctcggtcccctcaagataaaggctgcgcatttcttctccacccttaaggagtggccacagactcaccaagcctccatatcatacaccggtcccactgagagacccccgaacgagccagaggaaacccctgtgcaaaggccttccctctatagaaggattctgcgtaggcttgcaagctactgggcacagcctcaagatgccctctcacaagaagtgagtccggaggtgtggaaggatgtccagctaagcaccatcgagctgagtattaccaccagaaacaaccagctcgatcccacctccaaagaggacttcctgaatatctgtatcgagccggacaccatctcgaaaggagacttcataactattggcagtagaaaggtcagaaatcccaagctccacgtggaggggactgagtgcctgcaggcatctcagtgcaccctacttatccctgaaggggctgggggttccttcagtattgactcggaggagtacgaagccatgccagtggaggtcaagttacttccacggaagttgcagtttttctgtgaccctaggaaacgcgagcagatgttaacatctccgacgcagtag

SEQ ID NO: 177961 - DNA, 198 bp, Artificial Sequence
  Description of Artificial Sequence: Synthetic coding sequence
atgaccgtgttcttcaagaccctgcggaaccactggaagaagaccaccgcgggcctgtgcctcctcacctggggtgggcattggctttatggcaaacactgtgataatctgcttagaagagctgcctgtcaggaagcacaacattaccaggatgaatctcggtgggagcccactttgagccgaactcccggatcctag

SEQ ID NO: 177962 - DNA, 198 bp, Artificial Sequence
  Description of Artificial Sequence: Synthetic coding sequence
atgaccgtgttcttcaagaccctgcggaaccactggaagaagaccactgctgggctgtgcttattgacctggggagggcattggctgtatgggaaacactgtgataaccttctgaggcgggctgcttgtcaggaggcacagcactaccaggacgagagccgatgggaacccactctctcccggactccaggaagttag

SEQ ID NO: 177963 - DNA, 735 bp, Artificial Sequence
  Description of Artificial Sequence: Synthetic coding sequence
atgaccgtgttcttcaagaccctgcggaaccactggaagaagaccacagccggtctctgcctgctaacctggggtggtcactggctgtacggtaaacattgcgataacctccttcgcagggctgcctgccaggaggcacaggttttcggcaaccaactgatccctcccaacgcccaggtaaaaaaggcaaccgtattcttgaatccagcagcctgtaaaggcacactgttcgaaaagaatgccgcccccatcttgcatttatcagggatggacgtgacaattgttaagaccgactatgagggtcaggccaagaagctgttggagctgatggagaatactgacgttatcatagtcgccggaggagatgggaccctgcaggaagtggtgacaggcgtccttaggagaaccgacgaggcaacgttcagtaagatacccatcggtttcatccccttaggcgaaactagtagcttgagccacacgctgtttgctgagtctggaaacaaagtacaacacataacggatgcaaccctggccatcgttaagggcgagacagtcccactggacgtgctgcagattaagggtgagaaagaacagcctgtttttgcaatgaccgggctgcgatggggcagttttcgagatgccggtgttaaggtttctaagtactggtatctgggcccactgaagatcaaagcggcccacttttttagtacactcaaacccttcccgaaacgctag

SEQ ID NO: 177964 - DNA, 1728 bp, Artificial Sequence
  Description of Artificial Sequence: Synthetic coding sequence
atgcagagcccctggaagatcctgaccgtggcccccctgttcctgctgcttagcctgcagagctcagcgtccccagccaatgacgatcagagccgcccatccctgtccaatggccacacctgtgtgggttgtgtgctcgtggtgtccgtgattgagcagttagcccaggttcataattccaccgtccaagccagcatggaacgactgtgctcgtatctgcccgaaaagctgtttctcaaaacaacgtgctacttagtcattgacaagtttggttctgatatcataaagctcctctctgccgacatgaatgctgacgtcgtttgtcacacattggagttctgcaaacagaacaccggccagcctctctgccacttgtatccacttccaaaagagacctggaagttcactcttcagaaggcccgccaaattgtcaagaagagccccattctgaaatactcccgaagcggtagcgatatatgctcccttcctgtgctagcaaaaatctgccagaagattaaactggccatggagcagtctgtgccatttaaagacgtcgatagcgacaagtactcagtgttcccaacactgcgcggttaccactggcgagggagagattgtaatgacagcgacgaatcagtgtatcctggaagacgaccaaacaattgggacgtccaccaggattccaattgcaatggaatttggggcgttgaccccaaagacggggtgccctatgaaaagaagttctgtgaggggagccagcctcgtggcattatcttgcttggagatagcgcaggcgcacacttccatatctcccctgagtggataacagcatcacagatgagccttaattctttcatcaaccttcctaccgccttaactaatgagctggactggcctcagttatcaggggccaccggctttttggattcaaccgtggggatcaaggagaagagtatatacttaagactgtggaaacgtaaccactgcaatcatcgcgattaccaaaatatctcacgtaacggtgcttcttcccgcaacctaaagaagttcattgagtcactttcgcgcaataaagtcctggattatccggctatcgtgatttacgccatgataggaaacgatgtgtgttctggcaaaagcgacccagtgccagccatgactacgccagaaaagctttactcgaacgtcatgcagacgctcaagcaccttaactcccatctgcccaatggcagccatgtgatcttgtacggtctgccagacggaacgttcctatgggataatttacacaaccgttaccatcctctgggacagcttaataaggatatgacttacgcacaactgtacagcttcctgaattgtctacaggtaagtccctgtcacggttggatgtcgagcaataagacactgcgcaccttgacttcggaaagggcagaacagctatcaaacacactgaagaagatcgcagctagcgagaaatttactaattttaatctcttctatatggactttgcatttcacgaaatcatacaggagtggcaaaagagaggtggtcagccgtggcagctcatcgagcccgtggatggattccatccaaatgaagtggcacttctgttgctcgccgaccacttctggaagaaggtacagctgcagtggcctcagattttaggcaaggagaatccctttaaccctcaaatcaaacaggtgttcggagaccagggtggtcattag

SEQ ID NO: 177965 - DNA, 1632 bp, Artificial Sequence
  Description of Artificial Sequence: Synthetic coding sequence
atgcagagcccctggaagatcctgaccgtggcccccctgttcctgctgctgtcactccaaagctctgcctcccctgctaacgatgaccagagtcgccctagtttatcaaatggacatacttgcgtggagaagctatttcttaagaccacctgctacctggtaatcgacaaatttggctctgatattataaagctcttgagtgccgatatgaatgccgacgtggtgtgccacaccctggaattctgcaagcagaataccggccagcccttgtgccacctgtatccactaccgaaggagacttggaaatttacgctccagaaagcccgccagatagttaagaaaagccctatcctgaagtatagtagatcaggctccgacatctgctctttgcctgtgttggcgaagatttgtcagaagattaagctggctatggagcaatctgtccccttcaaagatgtggattcggacaaatacagtgtgttccccactctccggggctaccattggcgcggaagagattgcaacgactcagacgagagtgtgtacccggggcgtagacccaacaactgggacgttcaccaggatagcaattgtaacggtatttggggagtcgaccccaaagatggcgtgccatatgaaaagaagttttgcgaggggtcccaaccgcgtggaattattttactgggggattccgcaggagcgcacttccatattagccctgaatggataaccgcaagccagatgagtcttaatagcttcatcaatctgcccacagcactcacaaatgagcttgactggcctcagctctcgggagccacaggatttcttgactctactgttggcattaaggagaaaagcatttacctgaggttgtggaagcgcaaccactgcaaccacagagattatcagaatatctcaagaaacggcgcctccagtaggaacctgaagaagtttattgaaagcctcagtagaaataaggtactggattatcccgccattgtaatatatgctatgattgggaacgatgtctgcagtgggaagagcgatccagtccccgccatgacgacacctgagaagctctactcaaacgtgatgcagactctcaagcacctgaacagccatcttcccaacgggtcccatgttatcctctatggcctgcccgatggtacgttcttgtgggataacttgcacaatcgctatcaccctttggggcaactgaacaaggatatgacatacgcccagctttacagtttcttgaattgcttgcaggtgagtccttgccatggctggatgtctagcaataaaacgctcagaaccctcacttcagaaagagctgaacagcttagtaatacactgaaaaaaatcgcggcctcagagaaattcacaaatttcaacctcttctatatggacttcgcattccatgagatcatccaggagtggcaaaagcggggtggacagccgtggcagctaattgagcctgtggatgggttccaccctaacgaggtggccctgttgcttctcgccgatcatttttggaagaaggttcagcttcagtggccacagatactgggcaaggagaatccattcaaccctcagattaaacaggtgttcggggatcaagggggacactag

SEQ ID NO: 177966 - DNA, 894 bp, Artificial Sequence
  Description of Artificial Sequence: Synthetic coding sequence
atgaagctgaagaacagcttcatcaacctgcccaccgccctgaccaatgagcttgactggcctcagctctccggcgcgacaggtttccttgatagcaccgtcggcataaaagaaaagtctatttatttgcggctgtggaaacgtaatcactgcaaccatagggactatcagaacatcagccgcaacggtgcctccagtagaaacctaaaaaaatttatcgaaagtctttccagaaacaaggtacttgactacccagcgatcgtgatttacgcaatgatcggaaacgacgtatgctccggtaagagcgatcctgtaccagcgatgacaacgccagagaaattgtacagcaacgttatgcaaaccctgaaacatctcaactctcatctcccgaacggctcgcatgtgatcctgtatggattacccgatggtacatttctgtgggataatctccacaacaggtatcatcctctcggacaactgaataaagacatgacctacgcccagctgtacagttttctcaactgcctgcaggtttccccttgccacggttggatgagctccaataagactttgaggaccttgacctctgagcgtgctgagcagctgagtaatacactgaagaaaatcgctgccagcgagaaatttacaaatttcaatcttttctacatggacttcgcattccacgaaattatccaggaatggcaaaaacggggtgggcaaccgtggcagttgatcgaaccagttgatgggttccatccgaacgaagtggcattgttgctgcttgcggatcacttttggaaaaaagtccagctgcagtggccacagattctaggcaaagagaaccctttcaatccacaaatcaagcaggtgttcggcgatcagggcggtcactag

SEQ ID NO: 177967 - DNA, 2061 bp, Artificial Sequence
  Description of Artificial Sequence: Synthetic coding sequence
atgcagagcccctggaagatcctgaccgtggcccccctgttcctgctgctgtctctgcaatccagtgcgtcccctgccaatgatgaccagtctaggccgtcacttagcaatggacatacctgtgtcggttgtgtgctcgtggtgtctgtcattgaacagctagctcaggtgcataactccacggtgcaggcctctatggagcggctatgcagctacctgcccgaaaagctgtttctgaaaaccacatgctatctcgtgatagataaatttggatccgatatcatcaaacttttgagcgctgatatgaatgcagatgttgtgtgccacaccttggaattctgtaagcaaaatacaggtcagcctctgtgtcacctgtatcccctgcccaaggaaacatggaaattcacactgcaaaaagcccggcagatcgtgaaaaaaagccctatccttaagtattctagatctggtagcgacatatgcagcttgcccgtgctcgctaagatctgccaaaagattaagctcgccatggaacaatcagtaccttttaaagatgtcgacagcgataagtactccgtatttcccactctcagaggatatcattggagggggagggattgcaacgactccgatgaatcggtctaccctggacggcgccccaataattgggacgtgcatcaggatagcaattgtaatggcatttggggggtggatccgaaggacggagtcccctatgaaaaaaagttttgcgaagggtctcagccgagaggaataatcttgctcggagactcagccggcgcccacttccacatttcaccagaatggattactgcttcacaaatgtcgctaaactctttcataaatttgcctactgccctcacaaatgagctggattggcctcagctgtctggggctactgggttccttgattctactgtcgggattaaggagaaatccatttacctcagactttggaaacgtaatcactgcaatcatagggattaccaaaatatctcaaggaacggcgccagctcccgcaacctgaagaagttcatagagtccctgagtaggaacaaagtgctcgattatcctgcaattgtgatttacgcaatgattggtaacgacgtgtgcagtgggaagtcagatcccgtgccagctatgaccacccccgagaagctttactctaatgtgatgcagacactgaaacacttaaattcacacctcccgaatgggagccacgttatcctgtacggcctgcccgacgggacattcttatgggacaatctccataatcgctaccatcccctaggccagctgaacaaagacatgacatatgcacagctgtactcattcctgaattgccttcaggtttcaccttgccatggatggatgtcctcaaataaaactctgcgaacgctgacatctgagcgggccgagcaactgagcaataccttaaagaaaatcgcagccagcgaaaagttcaccaatttcaacttgttctacatggattttgctttccatgagattatacaggaatggcaaaagaggggaggacagccatggcagctcatcgagccagttgatggctttcatccaaacgaacgtaagtctattcttctcaagggcatcctgatgaccagccagaccctggacaaccaggagtggactcagttaacctcatggatcaaggggaaccttacgtgtgactccaggactcgtgaatggttatgttgttgttggaggattattagtggtaaaagatgctcctcatcaggcccaaagagctgggaaaggagaatacggtcgactcctcgcctgaaccgctgcctagaaaccaaggccggaactgaacctctgaggagcatgcacccctggggggcccagggtgggcgtgggttaggcaaacttattccccaactgtggggtctaccgcgccaccgtcccaagggtctcttcttttctagtatatttaagtgcctgagccttaatgaagagcacatttggaccactgtccagtgttgcgtactgcccgggagtgtgacccttcccctctttttaaagtag

SEQ ID NO: 177968 - DNA, 1992 bp, Artificial Sequence
  Description of Artificial Sequence: Synthetic coding sequence
atgcagagcccctggaagatcctgaccgtggcccccctgttcctgcttctgagtcttcagagtagtgcaagccctgccaatgatgaccagtcaaggcctagcctctccaacggacacacctgtgtcgggtgcgtgctggtagtatcggtgattgagcagctggctcaggtccacaactcgacagtgcaggcttctatggaacggctctgcagttatttacccgagaaactgtttctgaagaccacttgttacctggtcatcgacaagttcggtagtgatataataaagttattgtcagcggatatgaatgccgacgtagtgtgccatactcttgaattctgcaaacagaatactggccagcctttgtgccacctgtaccccctgccaaaggaaacgtggaagtttacactacaaaaggcgcggcagattgtgaaaaagtcaccgattctgaaatactcacgctctggctcagacatttgttcccttccggtgctggctaagatctgccaaaagataaagctcgccatggagcagtctgtacccttcaaggatgtagactctgacaaatactccgtgttccctacccttcgtggctaccattggcgggggagggactgtaacgatagcgatgagtctgtgtaccctgggcgccggcctaacaattgggacgtccaccaagattctaattgtaacggcatatggggagtggaccccaaagacggcgtgccctacgagaagaaattctgtgagggaagccaaccgcgggggatcatccttctcggggattcagctggcgcccactttcacatcagccctgaatggattacagcctcccagatgagtctaaatagcttcatcaatcttcctactgctttaacaaacgagcttgactggccacagctctctggagccacagggtttctcgactctaccgtgggcatcaaggagaagagcatctacctcaggctatggaaaagaaatcactgcaaccaccgtgattaccagaacatcagtaggaacggagcctccagccgcaatctgaaaaagttcatcgagagtctgtcaaggaacaaggttttagactacccagccatcgtcatctacgcaatgataggcaacgacgtgtgctcaggcaagtcagaccctgtgccggccatgaccactcccgagaagctttattcaaacgtgatgcaaaccctgaaacatttgaactctcacctgcctaacgggagccacgtgatactctatggcctccccgacggtactttcttgtgggataaccttcacaaccgctatcatccactgggtcaactgaataaggacatgacatacgcgcaactgtactcatttctgaattgcttgcaggtgtcaccatgccatgggtggatgagcagtaataaaactctgagaaccttaaccagtgaacgtgccgagcagcttagcaatactctcaaaaagattgccgcttccgagaagttcacaaactttaacttgttctatatggacttcgcttttcatgaaatcattcaggagtggcaaaagaggggcggacaaccctggcagctcatagagccagtggatggctttcatcctaacgagcgcaagagtatcctcttgaaaggcatactgatgacttcccagactctggataaccaggagtggacgcagctgacaagttggattaagggaaatcttacctgcgatagccgtacaagagaatggctttgctgttgctggcgtattatttccggaaagcggtgcagctcttccgggccaaagagttgggaaaggcgcatacggagcacaccaagactcaaccgttgcttagaaactaaggctgggacagagccactgaggtccatgcacccctggggcgcccaagggggtcggggcctggggaaattgatcccccagccctacggcggatgccatgtcacaggtcccaaagactccagcagcgctgcctcactgcagatgtctttcagtcaatag

SEQ ID NO: 177969 - DNA, 300 bp, Artificial Sequence
  Description of Artificial Sequence: Synthetic coding sequence
atggccgagggcaacaccctgatcagcgtggactacgagatcttcggcaaagtccaaggagttttttttagaaagcatacacaagcagaaggaaaaaaactggggcttgtagggtgggtgcagaataccgatagaggaactgtccagggacagctccaggggcccatctcaaaagtccggcacatgcaggaatggctggagacaagaggttcacctaaaagccacattgacaaagccaactttaataatgagaaagtcattctgaagctcgattactccgatttccaaattgtcaagtag

SEQ ID NO: 177970 - DNA, 168 bp, Artificial Sequence
  Description of Artificial Sequence: Synthetic coding sequence
atggccgagggcaacaccctgatcagcgtggactacgagatcttcgggaaagtgcaaggcgtattttttcgcaaacatacacaagaaatgacagtggagaatcgtatagccgaaacgcacagcaagagctgcgttcctgtcagcttcgcaacttcctacgcgggatag

SEQ ID NO: 177971 - DNA, 300 bp, Artificial Sequence
  Description of Artificial Sequence: Synthetic coding sequence
atggccgagggcaacaccctgatcagcgtggactacgagatcttcggcaaagtccagggcgtgtttttcaggaagcacacacaggctgaagggaaaaagcttggactagtggggtgggtacagaataccgatcgggggaccgtgcagggccagctgcaaggcccgatctcaaaggtgagacacatgcaagagtggctcgagactaggggcagtccaaaatcccacatcgataaagcgaatttcaacaacgagaaagtgattttgaagctggactacagtgacttccagatcgtcaaatag

SEQ ID NO: 177972 - DNA, 300 bp, Artificial Sequence
  Description of Artificial Sequence: Synthetic coding sequence
atgagcaccgcccagagcctgaagagcgtggactacgaggtgttcggacgggtccaaggggtgtgtttccggatgtatacagaagacgaggctcgaaaaattggcgtcgtgggatgggtgaagaacacctcaaagggaacagtaaccggtcaggtccagggtccggaggacaaagtcaatagtatgaagtcatggctgtctaaagttggttcccctagctccagaattgacaggacaaatttttccaacgagaagactatttccaaattggagtactcgaatttctcaattcggtattag

SEQ ID NO: 177973 - DNA, 294 bp, Artificial Sequence
  Description of Artificial Sequence: Synthetic coding sequence
atgtgccccctgcccctggccgccgccgccgtggccgccccccgggcccccttgagacttctaaaccgcgggttagcagcagcaatgtccaccgctcagagtctaaaaagcgtcgattatgaggtttttggacgcgttcagggcgtctgtttcaggatgtacaccgaggacgaggctcgcaagattggggtcgtgggctgggttaagaatacgagcaaggggacagtcacagggcaggtgcagggccccgaggacaaggtgaacagcatgctcgagtgtagcggcctgatctag

SEQ ID NO: 177974 - DNA, 2247 bp, Artificial Sequence
  Description of Artificial Sequence: Synthetic coding sequence
atggtgctgctgcgggtgctgatcctgctgctgagctgggccgccgggatgggcggccagtacgggaatccccttaataaatatatccggcattacgaaggcctatcctacaatgtggattctttgcaccagaagcaccagcgcgcgaagcgcgcggtctcacacgaggatcagtttctgagacttgactttcacgcccacggtcgccactttaatctgcgcatgaagcgcgacacctcacttttctccgacgaatttaaggtggagacaagcaataaagttcttgactatgacacctctcatatctacaccgggcatatctatggggaggagggatctttttcccatgggtctgtgattgatggaagatttgaggggttcattcaaactagaggaggcactttctatgtagaacctgctgagcgatatattaaggacagaacactgccattccacagcgtgatctaccacgaggacgatatcaactaccctcacaaatacggcccacagggagggtgcgcggatcattcagtattcgaaaggatgcgcaagtaccaaatgacgggagtcgaagaggtcactcagatccctcaggaagagcacgctgctaacggccccgagctcctgcgaaagaagagaactacctctgcggagaaaaacacctgccagctctacatacagactgaccacctatttttcaagtactacggtacccgggaggccgtgattgcacagatcagctcacacgtgaaagcaattgatacgatctaccaaacgaccgacttctccggcatcagaaatattagtttcatggttaaacggatccgaattaacactacagctgatgagaaggaccctacgaatcccttccgatttccaaatattggcgtggagaagttcttggaactgaattccgagcagaatcatgacgattactgtctagcttacgtgttcaccgacagagacttcgatgacggggtccttgggctggcgtgggtcggggccccaagcggttcttcgggagggatctgtgaaaaatccaaactgtattccgatggaaagaaaaaaagtctgaatacagggatcatcaccgtgcaaaattatgggagccatgtgcctcccaaggtcagtcacatcacctttgcacacgaggtgggtcacaattttggaagcccccacgacagcggcaccgaatgtactcccggcgagagcaaaaacttaggtcaaaaagagaacgggaattacattatgtacgctcgagctacatcaggggataaactgaacaacaataagtttagcctgtgctccatcaggaatattagccaggttctggaaaaaaagagaaacaattgtttcgttgaaagcggacagcccatatgtgggaatggtatggttgagcagggggaagaatgcgactgcggttattcggatcagtgtaaagatgaatgttgtttcgacgctaaccaacccgaggggcgtaagtgtaaacttaagcccgggaagcagtgttcaccgtcccaggggccctgctgcactgcacaatgtgcattcaagagtaaaagcgagaagtgtcgggatgactctgactgcgcaagggaggggatttgcaacggattcacagctctctgtcccgccagtgatccaaaaccaaacttcacggattgtaataggcatacgcaagtttgcatcaacgggcagtgtgccggaagcatctgcgagaagtatggactagaagagtgcacttgtgcttcatcggacgggaaggacgataaagagttgtgccatgtgtgctgtatgaaaaagatggaccccagcacatgtgcttccaccggttccgtccagtggagcagacacttttccgggcgaaccatcactctgcaacccggctcgccctgcaatgatttcaggggctactgcgacgtatttatgcgctgccggctcgtggatgccgatggcccactagcaagactcaagaaggctattttttcccctgagctgtacgagaatattgctgaatggattgtcgcacattggtgggccgttctattgatgggcatcgccctaatcatgctgatggctggatttattaagatatgttcagtccatacaccttcttcaaatcccaaactgcctccacctaaacccctgcctgggacacttaagcgccgccgtcctcctcagcccattcagcaaccccagcggcagagaccacgggagagctatcaaatgggacacatgagacggtag

SEQ ID NO: 177975 - DNA, 1344 bp, Artificial Sequence
  Description of Artificial Sequence: Synthetic coding sequence
atggtgctgctgcgggtgctgatcctgctgctgagctgggccgccggcatgggagacagggattttgatgatggggtccttgggctggcctgggtcggcgctcctagcggctctagcggcgggatttgcgaaaagtctaaactatatagcgacggcaagaaaaagagtctcaatactggtatcataacagtgcagaattacggctcacatgtccccccaaaggtcagccatattacttttgcccacgaagtcggccataatttcgggagtccacacgacagtggcacagagtgtacaccaggagagtcgaagaatctgggccagaaagagaacggcaactacatcatgtatgcccgtgccacttcaggggataagctgaataacaataagttcagcctatgcagcatccgcaacatctcccaagttctggagaaaaagcgaaacaactgcttcgtcgaatcgggacagcctatatgtggaaacggcatggtggagcagggcgaggaatgtgattgtggatactccgatcaatgcaaggacgaatgctgttttgatgcaaaccagcccgaaggcaggaagtgtaagcttaaacctgggaagcaatgcagcccttcacaggggccctgctgcactgcccagtgtgcgttcaagtctaaatcagaaaagtgccgggacgatagtgactgcgcacgggaaggaatttgtaatggatttacagcgctgtgccccgcgtccgatcctaaaccaaattttacagactgtaataggcacactcaggtgtgtatcaacgggcagtgtgccggttccatctgcgagaaatacggcctggaagagtgtacatgtgcctctagcgacggcaaagacgacaaagagctctgtcatgtgtgctgtatgaagaaaatggatccatctacgtgtgcttccacggggagtgtgcaatggtcacgtcacttcagcggccgcacaatcactctacagcctggttccccgtgtaacgatttcaggggctactgtgatgtgttcatgcgttgccgtctggtcgatgccgacgggccactggcgcgattgaaaaaagccatttttagtccagagctgtatgagaacatagctgaatggatcgtggcccactggtgggctgttcttcttatgggcatcgctctgatcatgctgatggctggtttcattaaaatatgcagtgtgcatacccctagctccaatcccaagctccctccccctaaaccactgccgggaactctgaaacgtcgcagaccaccacagcctattcagcagccccagcgtcagagacctagggagagctatcagatgggtcatatgcgccgctag

SEQ ID NO: 177976 - DNA, 2310 bp, Artificial Sequence
  Description of Artificial Sequence: Synthetic coding sequence
atgcggctgctgcggcggtgggccttcgccgccctgctgctgagccttctgcctacacccggattgggcacgcaaggtccagctggagcactgcgctggggaggcctgcctcagctcgggggcccaggtgctcccgaggtcacggagccatcacggctcgtgcgcgaaagtagcggcggagaggtgcggaaacagcagctcgatactagagtgcgccaggagcctcccggcgggcctcccgtccacttggctcaagtgtcctttgtcattcctgcattcaatagcaattttaccctggacctggaactgaaccaccacctccttagtagccagtatgtagaaagacatttctcaagggagggaactacccagcacagcactggggccggagatcattgttattaccagggaaaattgcggggcaatccacacagttttgccgccttaagcacgtgtcagggcttgcatggagtgttcagcgatggcaatcttacctacattgttgagccccaggaggtcgccggtccttggggtgccccacaagggcccctaccgcatttgatctatcgcacacctctgcttcccgaccccctggggtgtcgggaaccgggatgcttgtttgcggtcccagcccaatcagccccacccaatcggcccaggctgcggagaaaacgccaggtaagacgggggcaccctaccgttcattcagagactaagtacgtggagttgatcgtcatcaacgaccatcagctgtttgaacagatgaggcagtccgtcgttctgacaagcaactttgccaaaagcgtggtcaatctcgcagacgtgatctacaaagagcagctgaacaccaggatcgtgctagtagccatggagacgtgggccgacggtgacaaaattcaggttcaggacgacctgttagaaaccttagctaggcttatggtctacaggcgggaaggcctacctgaaccttccgatgccacccacctcttctctgggcggacattccagagcactagctccggggcagcctatgtgggcggtatctgcagcctctcccacgggggcggggttaacgagtacggtaacatgggggccatggctgttacattggcccaaacactaggacagaatctgggtatgatgtggaacaagcaccgctcttcggcgggcgattgcaagtgcccagatatatggctcggatgtatcatggaagataccggattctacttgccacggaaatttagcagatgctcgattgatgaatacaatcagtttctccaggaaggtggcggaagctgcctgtttaacaagcccctgaaactgctggacccccccgaatgtggtaatggcttcgtggaagccggagaggagtgtgattgcggcagcgtacaggaatgttcgcgtgcaggcggtaactgttgtaagaagtgtactctgacgcatgacgcaatgtgctcagacgggctctgctgccgtaggtgcaagtatgaacctaggggcgtctcatgtcgcgaggccgtgaatgaatgcgacatcgcagagacatgtaccggtgacagttctcagtgcccacccaatctgcacaagctcgatggctattactgcgatcacgagcaggggcggtgttacgggggtcggtgcaaaacacgggacaggcagtgccaggtcctgtggggtcacgctgccgcagacaggttctgttacgagaagttgaacgttgagggtactgaacgaggcagctgcggtcggaaggggagtggttgggtccagtgttccaagcaggacgtgctgtgtggtttcctgctctgcgttaacatctctggcgccccccggctgggggatctggtaggagatatatcttcagttactttttatcatcaggggaaggagcttgactgtagaggaggacatgtccagttggcagacggttctgatctgtcctacgtagaggatgggactgcttgcggtccaaatatgctttgtctggatcaccgctgcctgccagccagcgcattcaattttagcacctgtcctggatccggtgaacggagaatctgcagtcatcatggggtatgcagcaatgaaggcaaatgtatttgtcagccggactggaccggaaaagactgcagcatccataaccctctccctacatctcccccgaccggtgagacggagcgctacaagggtccctcggggactaatattattatcggctcaattgccggggccgtgcttgtcgcagcaatcgtgctagggggcactgggtgggggtttaaaaacattcggaggggcagaagcggcggcgcgtag

SEQ ID NO: 177977 - DNA, 1572 bp, Artificial Sequence
  Description of Artificial Sequence: Synthetic coding sequence
tgctggggcagcggccacctgctgagcagccagtacgtggagcggcatttttctagagaaggaacaacgcagcacagtacaggggcaggagatcattgctactatcagggaaagctcaggggcaacccacactcttttgccgcactttccacctgtcagggtttacacggggtgttttccgatggcaacctgacatatatcgtcgaaccccaggaggtggccgggccatggggggcgccccaaggccccctcccacatttgatatacagaactcccctgctgcccgatccccttgggtgccgggagccaggttgcctgttcgctgttcctgcccagtcagcacctcccaaccgtcctagactgagaagaaaaagacaggtccggaggggccatccaaccgtccactctgagacgaagtacgtagagctgatcgtgattaatgaccaccaactgtttgagcagatgcgacaaagcgtggtcctcacatccaacttcgctaagtccgtggtaaacctggctgacgttatttataaagaacagttaaacacccgcattgttctggttgccatggagacgtgggccgatggcgacaaaatccaggtccaagacgatctcttagagaccctggcgaggttgatggtgtacaggagggagggactgccagaaccgtctgacgcaacccaccttttctccgggagaacgttccagtcgacttccagtggggcagcttatgtgggtggaatttgctccctgtctcacggaggcggtgtaaacgagtacgggaatatgggcgccatggcggtcacactcgcccaaacgctggggcagaaccttggtatgatgtggaacaagcatcgctcatccgctggcgactgtaagtgtcctgacatttggctgggctgcattatggaagataccggattctacctcccccgcaagttcagccgctgcagcattgacgagtataaccagtttcttcaggaaggtgggggatcatgtctcttcaacaaaccattaaaacttcttgatccccctgaatgcggaaatggctttgttgaggccggtgaggagtgtgactgtgggtcagtgcaggaatgctcacgagcgggagggaactgctgcaagaagtgcacactgacccatgacgccatgtgttccgatgggctttgctgccgtcggtgtaaatacgaaccccgcggagtgtcctgtcgggaagctgtaaacgagtgcgacatcgccgagacctgtactggagatagctcccaatgcccccccaatctccacaagctggacggttactactgcgatcatgaacagggtcgatgctatggtgggaggtgcaagacccgagaccggcagtgtcaagtactctggggacacgccgctgccgatcgattttgctatgagaagttgaacgtggagggcaccgagaggggatcctgtgggcggaaaggatctggctgggtccagtgctccaaacaaccccaacagggtcgggccgtgtggcttcccccgctgtgccagcatctatggagtagcagtgcacgagggccaggcggaaggcaccagtag

SEQ ID NO: 177978 - DNA, 1710 bp, Artificial Sequence
  Description of Artificial Sequence: Synthetic coding sequence
atgcagggcacccggctgcccgtgtgctgcgcctgccccgtgggcagctccaaaccagcagaggccgagaaagaaaaggtccgacgtggccaccctactgtgcacagcgagacgaagtatgtcgaactcattgtaataaatgaccatcaacttttcgagcagatgagacagagcgtggtgttgacatccaactttgctaagtccgtcgtgaaccttgcagacgtcatctacaaagagcagctgaacacccgcatagtgctggtggctatggagacttgggccgacggcgacaaaatccaggtgcaggacgatcttcttgagacactcgcacgcctgatggtctatcgtcgggaaggattgcctgagcccagtgatgcaacgcacctatttagcggcaggactttccagagtacttcatcgggcgctgcctatgtgggagggatttgcagcctgtcccatggcggcggcgtcaacgagtatggcaacatgggcgcaatggctgttactcttgcccagacacttggacagaacctgggcatgatgtggaataagcatcgctcctcggccggcgactgcaaatgtcctgacatttggctgggatgcatcatggaagacacaggcttttatctcccccgcaagtttagtaggtgctctatcgatgaatacaatcagttcctccaagagggaggaggcagttgcctgtttaacaaaccactaaagttgctggaccctccagagtgtgggaatggatttgtggaggccggtgaagagtgcgactgcgggtcggttcaggagtgtagccgtgccggcggtaattgctgcaagaagtgtacactcacacacgacgccatgtgttccgacggcttgtgttgcaggcgctgtaaatacgagccccgcggggtatcatgtcgcgaagctgtcaacgagtgtgatatcgctgagacctgtactggcgacagcagccaatgccctcccaatctgcacaagttggacggctattactgtgatcatgagcagggacggtgttacggaggacgttgcaagacccgagatcgtcaatgccaggtgctctggggacatgccgcagccgaccggttctgttatgaaaaactgaacgtcgagggcaccgagcgcggaagctgtggcagaaaaggatctggatgggttcagtgttcgaagcaagatgtgctatgtggattcctcctctgcgtaaatattagtggcgctccgagacttggcgatcttgtgggagatatctcaagcgtgaccttctaccaccaggggaaagagctggattgccgtggtggtcacgtgcaactcgcagatggaagcgacctgagctatgtggaggacggcacagcctgtgggcccaacatgctctgcttggaccaccgctgtttacccgcttcagctttcaacttcagtacatgccccgggtctggggagcgtagaatctgttcccaccacggcgtgtgttcgaacgaagggaagtgcatttgccagcccgactggaccgggaaggactgttcaatccacaaccccctccctactagtcctcctactggagaaactgagaggtacaaggggccttccgggacaaatatcattatcggaagcattgcgggagccgtgctagtcgccgctatagtgctgggaggtaccgggtgggggttcaaaaacataaggagagggcggtccggcggtgcctag

SEQ ID NO: 177979 - DNA, 2217 bp, Artificial Sequence
  Description of Artificial Sequence: Synthetic coding sequence
atggccgcccggcccctgcccgtgagccccgcccgggccctgctgctggccctcgccggggcccttctcgccccttgtgaggccaggggggtgagtctgtggaatcaagggagggctgacgaagtggtgagtgcctcagtgggtagtggtgatttgtggattcccgtgaaatccttcgattctaagaatcatcctgaggttctcaatatccggctgcaaagagagagtaaggagcttattattaacctggagcgtaatgagggtctgattgcgtcttccttcactgagacgcattacctgcaggatgggactgacgttagcttagcccgcaattacaccgtgatcctagggcactgttactaccacggccacgtgcggggttatagtgactctgcagtctccctctctacctgctctggacttcgtggcttaatcgtgtttgaaaatgaatcctacgtcctcgagccaatgaaatccgccaccaatcgttacaagctgtttcctgcgaaaaagttaaagtccgtgaggggctcctgtggcagccaccataacacacccaatctggcagccaaaaatgtgtttcctccaccctcccagacctgggcccgtcggcataagagagaaacgctcaaggctacaaaatacgttgaactcgtcatagttgcggacaaccgagagttccagcggcagggtaaggaccttgaaaaggttaaacagaggttgatcgaaatagctaaccacgtggacaagttctaccgacccctgaacatacgcatcgtactggttggggtggaggtctggaatgatatggacaagtgctcggtcagtcaggatcctttcacatctcttcacgaattcctggattggagaaaaatgaaactgctcccccggaagagccatgataatgcccagctggtttcaggggtatattttcagggcacaactatcggcatggcacctatcatgtcaatgtgcacggctgaccaatctggcggaatcgtcatggatcactcagataacccactgggggcagctgtcactctggcccatgagctcggccacaacttcggtatgaatcacgatacactagatcgggggtgttcttgtcagatggccgttgaaaaggggggttgtattatgaacgcctctactggatatccattccccatggtattctctagttgttcccggaaagacctggagacctccctggaaaaaggtatgggcgtctgcttattcaacttgcctgaggtccgagaatctttcgggggccagaaatgcggcaatcgttttgtggaggagggggaggaatgcgactgtggagaacccgaggaatgtatgaaccgttgttgtaacgccaccacctgtaccctgaagcccgacgccgtttgcgcacacggcctgtgttgcgaggactgtcaactgaagcccgccggaactgcttgtagagactccagtaattcctgtgaccttcctgagttctgtaccggtgcgagcccgcactgccctgcgaacgtctatctgcatgacggtcacagctgccaggacgtggatgggtactgctataatgggatctgccaaacacacgaacaacagtgcgtgacattgtggggtcccggagctaagcccgcccccgggatctgcttcgagcgagtcaattccgcaggggacccctacggcaattgtgggaaagtttcaaaatccagctttgcaaaatgcgagatgcgggacgccaagtgcggtaaaatccagtgtcaaggcggtgctagcaggcctgtgatcggaaccaacgccgtatccatcgagaccaacattcccctacaacagggaggccgcatcctgtgtcgcggcacacacgtatacctgggggacgatatgcctgatcccggtctcgtgttggcgggtacgaagtgtgctgatgggaagatctgtctcaaccggcagtgccagaacatctcggtcttcggcgtacatgagtgtgccatgcagtgtcacggacggggcgtgtgtaacaaccggaaaaactgccattgcgaagcacactgggcacctccgttctgcgataagttcggatttggggggagtactgattccggacctataaggcaggccgaagcccgccaggaagccgctgaaagtaacagggaaagaggacaggggcaggaacctgtcggcagccaggagcacgcgtctacagccagcctgacccttatctag

SEQ ID NO: 177980 - DNA, 2730 bp, Artificial Sequence
  Description of Artificial Sequence: Synthetic coding sequence
atggccgcccggcccctgcccgtgagccccgcccgggccctgctgcttgcactggctggagccttgctggctccctgcgaagctcggggcgtgtcgctctggaatcagggacgggcggacgaggtcgtgagcgcttccgtgggaagtggagatctctggatcccagtgaagagttttgactcaaaaaaccatcccgaagtgctgaatattaggctgcaacgcgaatctaaggagctaatcattaatctggaaagaaatgagggtcttatcgcctcaagtttcacagagactcactacctgcaagatggcacggacgtgtctctggcacgaaattacaccgtcattctcggtcattgttattaccacggacacgtgcgggggtattctgattctgccgtgtctctgagtacctgctcaggcctgcgaggcctgattgtgttcgagaatgaaagctatgtgctggagccaatgaaatccgcgaccaaccgatacaaactgttccccgctaagaaactgaagagcgtgaggggcagctgcggctctcaccataatacaccaaacttagccgcaaaaaacgtgttcccccctcccagtcagacttgggctagacggcataaacgggagaccctcaaggctaccaagtacgtggagctagtgatagtcgccgacaaccgtgagtttcaacggcaaggtaaagacctggaaaaagttaagcagagactgattgaaattgccaatcacgttgataaattctacagaccactgaatattcgtattgtcttggtgggtgtcgaagtgtggaatgatatggacaagtgtagtgtgtctcaggatccctttacttccttgcatgagtttcttgactggcggaaaatgaagctgctgccgcgcaagtctcatgacaatgcccaacttgtgagcggcgtttacttccaaggcactactatcggcatggcaccaatcatgtctatgtgtactgccgatcagtctgggggtattgtaatggatcacagcgacaaccctttgggcgcagccgtgaccttggcgcacgaattggggcacaactttggtatgaatcacgatacccttgaccgcggctgctcttgtcagatggccgtagagaagggaggctgcattatgaatgcttccacagggtaccccttccccatggtgttctctagctgtagcagaaaagacctcgagacttccctcgaaaaggggatgggcgtctgcctgttcaatctccctgaagtgagagagtcattcggcggacagaaatgcgggaatagatttgtggaagagggcgaagagtgtgattgtggcgaacccgaggagtgcatgaatcgttgctgcaatgcaacgacctgtacattgaaacctgatgctgtgtgtgcccacggattatgctgcgaggactgccagctcaagccagcagggaccgcatgccgggatagctccaacagctgtgatctccctgagttttgcactggggcctcaccccactgccctgcaaatgtttatctccacgacggacattcctgccaggacgtggatggctactgttataacggtatttgccagacgcacgaacagcagtgtgtcacactctggggaccgggggccaaacccgcccccgggatttgctttgagagggtgaattccgcaggagatccttatgggaactgtggtaaagtatcaaagtcctctttcgccaagtgtgaaatgcgtgacgcaaagtgcggaaaaattcagtgccaaggcggtgctagcaggccggtgatcgggacaaacgcagtgagcatcgaaaccaatattccactgcaacaaggtggccgcatcctttgtcgggggacccacgtgtatctgggcgatgatatgcctgaccccggcttggttctggccgggactaaatgtgccgacgggaagatttgcctgaacagacagtgccagaacatttccgtgttcggcgtgcatgagtgcgctatgcagtgtcacgggaggggggtttgcaataataggaaaaattgccattgcgaggcccattgggctcctcctttctgtgataagttcggttttggaggatcgactgactccggtcctatccgacaggctgataatcaggggctgactattggtattctggttactattctgtgcctgttggctgcaggcttcgtggtgtatctcaagcgaaaaactctgattagactgctgttcactaacaagaaaactacaattgagaaattacgctgtgtgcgcccaagtaggcctcccaggggcttccagccctgccaggcccatttgggacacctcggtaaaggtcttatgcgaaagccacctgacagctatccccctaaggataacccacgcagattattgcagtgccaaaatgttgacatttccaggcctttgaacgggctaaatgtcccccagcctcaaagcacacagcgtgtcctgcccccattacaccgggcccccagagcacccagtgtgccggcccgacctttgcccgcaaaaccggcattacggcaggcccaaggtacctgcaagccaaatcccccacaaaaaccgttgccggcagaccctcttgcgcgcaccacccgattgacacatgccctggcccggacccccggacagtgggagactggtctgcggctagccccgctgcgacccgcaccacaatacccccaccaagttcctcgctccacccacacagcctatatcaagtag

SEQ ID NO: 177981 - DNA, 837 bp, Artificial Sequence
  Description of Artificial Sequence: Synthetic coding sequence
atggccgcccggcccctgcccgtgagccccgcccgggccctgctgttggccttagcgggggccttgcttgccccctgtgaagcgaggggagtctccctgtggaaccagggtagagccgatgaagtggtgtctgcaagtgttgggtcaggagacctgtggataccagtcaaaagctttgactctaaaaaccatccggaagtgctgaacatccggttacagcgggaatcaaaggaactgatcatcaacctcgaacgcaatgagggtttaattgccagcagtttcactgaaacacactacctgcaggatggcacagatgtatcattggcacggaactatactgggcattgttactatcacgggcacgttagggggtactccgactcagctgtgagtctcagcacttgttctggcctgcgaggcctcatcgtctttgaaaacgagtcatatgttctggaacctatgaagtccgccacaaaccggtacaagctgttccctgccaagaaactgaagtccgtgcgcgggtcttgcgggagtcaccacaatacgccaaatctggccgctaaaaatgtctttcctccgcccagccaaacttgggcccgcagacacaaacgggaaaccctcaaggccactaagtatgtagagctcgtgatcgtcgccgataatcgggagtttcaaaggcagggaaaggatcttgagaaggtgaaacagagactgatagagatcgctaaccacgtggacaagttttaccgtccactgaatattaggattgtgttagtgggtgtagaggtgtggaacgacatggataaatgctctgtgtctcaggaccccttcacttag

SEQ ID NO: 177982 - DNA, 2445 bp, Artificial Sequence
  Description of Artificial Sequence: Synthetic coding sequence
atgcggctggccctgctgtgggccctgggcctgctgggcgccggctcgccgctcccctcttggcctctcccaaacatcggcgggacagaggaacagcaggcggaatccgagaaggcccccagagagcccctcgagccccaggtgctgcaagatgatctccctatctctttaaaaaaggtcctgcagactagcctccctgaacccctgcgcatcaaacttgaattagatggtgatagccacattctcgagctgcttcagaaccgggaactcgttcctggtaggcctactttggtttggtatcaacccgatggcaccagggttgtgtctgaagggcatacactggagaactgctgctatcagggcagggtgcggggatatgccgggtcctgggtgagtatctgtacctgtagtggcctaagggggctcgtggtcctgactcctgagcgatcttataccctcgaacagggccctggggaccttcaaggacccccaattattagtagaatccaagatctgcacttaccgggacacacatgtgcactgtcatggagagagtccgtacacacacaaaagcctcccgagcatccactcgggcagcgccacatccgccgtcgccgcgacgtggttaccgagaccaaaaccgtggagttagtgatcgtcgcagaccacagcgaggcccaaaagtatagggacttccagcatctgctgaacaggaccctcgaggtcgctctgctgctggacacattcttcagacctctcaatgttcgagtagcattagtgggcctggaggcctggactcagcgggacttggttgagatttcacccaaccccgcagtgactctcgagaacttcctccattggcgcagagcccatttactgcccaggctgccgcacgatagcgctcagctggttacgggcaccagtttctcggggcctactgtgggcatggccattcagaactccatctgttctccagacttttctggaggagtcaacatggaccacagcacttcaatcctgggggtcgctagcagcatcgcccatgagctcggtcatagtctgggattagatcatgacctcccaggtaactcttgcccctgcccaggcccagcccccgccaagacctgtatcatggaggccagcacagacttccttccgggtcttaacttctcaaattgcagtagacgtgccctcgagaaagcccttctggacggcatgggatcctgcctttttgagcgcctgccgagcctgcccccaatggctgctttttgcggcaatatgttcgttgaaccaggcgagcagtgtgattgcggtttcctggacgattgtgttgatccatgctgcgactcactaacctgtcagctgaggccaggggcgcagtgtgccagcgatggcccctgctgccagaactgccagctgaggccctctgggtggcagtgtaggcctacgaggggtgattgcgacttgccagagttttgccctggcgacagttcccagtgcccccccgacgtgagcttgggcgatggagagccatgcgcaggagggcaggcagtttgcatgcatggccgctgtgcgtcttacgcacagcagtgccagagcctgtgggggccaggtgcccagccggccgctcctctctgtctacaaaccgcgaacacaagagggaatgcattcggttcctgtggcaggaatccctcagggtcttatgtgagctgcacgcccagagacgctatttgcggccagctgcagtgccagaccggccggacacagcccctgctgggaagcatccgcgacctactgtgggagacaattgatgtgaatggaacggagttgaattgcagttgggtgcacttggatctgggatcagatgtagcccaacccttgctcaccttgccgggcactgcctgtgggcccggactggtgtgcattgaccaccggtgtcagagagtcgacttgctgggcgcacaggagtgtcggagtaagtgtcacggtcatggagtctgcgattcaaatcgtcattgttactgtgaggaaggctgggcaccccctgactgcaccacgcaactgaaggcaacctcctctctcaccacgggcctgctgctgagtcttctcgtgctgttggtactggtcatgctcggagcctcatattggtaccgagccaggctacatcaacggctgtgtcagctaaaaggtcccacttgccagtaccgtgcggcgcagagtggccccagcgagcggcccggcccacctcagcgtgcgctgctcgccaggggaaccaaatcacagggacccgctaaaccccccccccctcgcaagcccttgcccgccgacccccaggggcggtgtccctcgggtgatttgcctggacctggggctgggataccaccccttgtagtgcctagtagaccagccccaccgccaccgacagtgtcttcattgtacctgtag

SEQ ID NO: 177983 - DNA, 2520 bp, Artificial Sequence
  Description of Artificial Sequence: Synthetic coding sequence
atgcggctggccctgctgtgggccctgggcctgctgggcgccggctctcccctgccttcttggcccttgcccaatattggtgggaccgaagaacagcaggctgaatctgagaaggctcctcgtgaacctctagaaccccaggtgttgcaggatgatctccctatttccttgaagaaggtgctgcagacatcccttcctgagccactgcgcatcaaacttgaactggacggggacagccatattttggaattgcttcagaaccgagagttagttcccggacggcctaccctcgtctggtatcagcctgatggaacgcgtgttgtttccgaaggccacacgctagagaactgctgttatcaggggagggtcaggggctacgcagggtcttgggtgtcaatttgcacatgctcaggcctgagaggactggtagttttgacccccgaacgctcttataccctggagcaaggcccaggggacctgcaggggccccctataatctcccgtatccaggatcttcacttgcctggacacacctgtgcactaagctggcgcgagtccgttcatacccagaagccgcctgagcaccccctcggacagcgccacatcaggcggcgccgggacgttgtcaccgagacaaaaactgtggagctcgtgatcgttgcagaccattctgaggctcaaaaatatagagactttcaacaccttctgaatagaaccttggaggtcgcgctcctcttagacactttcttccgtccgctcaacgtgagggtggcgctggtaggattggaggcttggacacaacgcgacctcgtcgaaatttcgccaaatcccgcagtgacattggagaacttcctgcattggcgccgtgcccacctacttccccggcttcctcatgactccgcacaactagtcaccgggacatcattctccgggcccacggtgggaatggccatccagaatagcatctgctcacccgacttcagcgggggcgtgaatatggaccactcgacctccatcctgggcgtggcttcttctatcgcccacgaactaggtcactctttaggcctggaccacgatctgccagggaactcttgcccatgccccggaccggcccccgccaagacctgcatcatggaagcatctactgatttcctccctgggctgaactttagcaactgtagcagacgcgcactggagaaggcactgctggacggtatgggatcttgccttttcgaaaggctgcctagccttccccccatggctgcattctgcggtaatatgttcgtcgaacccggggagcagtgcgattgtggtttccttgatgattgcgttgacccctgttgtgactcacttacctgtcagctcagacccggggctcagtgcgcgagcgacggtccctgttgccaaaattgccagctccgacccagcggctggcagtgccggcctacgcggggtgactgcgatctgccagagttctgtccaggcgactcttctcagtgcccccccgacgtgagcctcggagacggggagccttgtgccggtggtcaggccgtgtgcatgcatggccgctgcgccagctacgcgcagcagtgtcagtcactctggggaccaggagcgcagcccgctgcccccttgtgtctgcagacggccaacaccaggggaaacgcttttggttcctgcgggaggaatcctagcggctcttacgtgtcctgcacacctcgagacgccatatgtggtcaactgcagtgccagactggcagaactcagcccctgctgggcagcatccgcgatctgctgtgggagacgatcgacgtgaacggaaccgaactcaactgcagctgggtgcacttggacctgggatccgacgtggcacagccattacttaccctgcctggaactgcctgtggccccggcctggtttgcattgaccaccgatgtcagcgagtggatttgcttggcgcacaggagtgtaggagtaaatgccatggacatggagtgtgcgatagtaatcgacactgctattgcgaggaagggtgggcacctccggattgcacaacgcagctaaaggctacatcgagtctgaccacagggctgcttctctcacttttggtgctgctggttcttgtgatgctcggcgctagttattggtaccgcgctagacttcaccaacggctatgtcaactgaaaggccccacatgtcagtatcgagccgcccagagcggcccttcagagagaccaggtcccccacaacgcgccctgctggccaggggtaccaagcaagccagcgcactgtctttccctgcacctcccagcagacccctgccgccggatccagtaagcaagcgtctgcagagccagggtcccgctaaacctccaccaccacggaagccgttaccagccgatccacagggacgctgcccttcaggcgacctgcccgggccaggggccggtattcctccattggtcgtaccatctagacccgctcctcctcctcccaccgtgagcagtttgtatctctag

SEQ ID NO: 177984 - DNA, 2592 bp, Artificial Sequence
  Description of Artificial Sequence: Synthetic coding sequence
atgcggctggccctgctgtgggccctgggcctgctgggcgccggcagtccccttccgtcctggccattgccaaatattggcggcaccgaagaacagcaggcagaatctgaaaaggcccccagggaacctttagagccgcaagtgttacaggatgatctccctatctccctcaagaaagtgcttcaaacaagtctacctgagccactccggataaaactggagctcgatggagacagtcacattctcgaactattgcaaaaccgcgaactcgtgccgggtcggccaaccctcgtgtggtatcagcccgatggcacgagggtcgtgtccgagggtcataccctcgagaattgctgctatcaggggcgggttcgcggctatgctggtagctgggtgtccatctgcacttgtagcggcctcaggggtttagtcgtgctcactcctgaacgtagctacaccctggaacaagggcccggtgatttgcaaggccctccgatcatatcccggatccaggacctccacttacctggccacacttgcgccctgagctggcgagagtccgtgcacactcaaaaaccacctgaacatccactcgggcagcgtcatattaggcgccgaagagacgtcgtgactgagaccaagacggtggaactagtgatcgtcgccgaccatagtgaagctcaaaagtatcgggattttcaacatctgttgaatagaaccctggaggtggctctcctccttgacacatttttccgccctctcaatgtccgggtcgcactggtgggactcgaagcctggactcagcgggacctggtagagatctctcccaatccggctgtgacactcgaaaatttcctccattggaggcgggcacacctgctgcctagactccctcatgattctgcccagctggtaaccggaacttctttcagcggaccaactgtcggaatggctatccagaactctatctgttcacctgatttctctgggggtgtaaacatggatcactctacgtccatattgggagtcgcgtcctccattgctcatgagctcggtcatagcctcgggctcgaccacgaccttcctggaaacagctgtccttgtcctggaccggcacctgcaaagacttgcattatggaggcctccactgatttcctgcctggccttaattttagtaattgcagcagaagggcactcgaaaaggctctgctggacggtatggggagctgtttgtttgaaaggctacccagcttacctcctatggccgctttctgtggaaatatgttcgtcgagccgggcgaacagtgtgattgtggcttccttgacgattgcgtggacccttgctgtgactccctcacatgccaactgcgccccggggcccaatgtgcctcagatggaccgtgctgccaaaattgccagctcaggccttcagggtggcagtgtaggcccactcggggcgattgtgacctgccagagttctgcccaggcgactccagtcagtgccctcccgatgtgagcttgggagacggcgaaccctgcgccggaggccaggccgtctgcatgcacggacgttgcgcatcctatgctcagcagtgtcagtcgctttggggcccaggagcccagcctgctgctcccctgtgcctgcaaactgcaaatacccgcggtaacgcatttgggtcctgtggtaggaatccctcaggctcctatgtctcttgcacacctagggacgccatttgtggccaactgcagtgccagaccggccggacccagcccctgctcgggagcatacgcgacctgctctgggaaacaatcgatgtgaatggtactgaactgaattgtagttgggtgcacctggacctcggaagcgacgtggcccagcccttgctgacgctcccagggacggcttgcggcccaggactggtctgcatcgaccaccgctgccaaagagttgacttactgggagcgcaggagtgtaggagcaagtgtcacggccatggggtatgcgattcaaataggcattgttactgcgaagaggggtgggctcccccagattgcacgacccagttgaaggccacctcctcgctgaccacgggactgctactatctctcctagtgctgcttgtattggtcatgctgggggcaagctattggtatcgggcgaggctgcatcagcgcctgtgtcagctgaagggaccgacgtgccagtatcgggctgcccagtcggggccctccgagcgacctggccccccacagcgggccctcctggctcgagggactaagcaggccagcgccctgtcattcccagctccaccttcacgccctctgccccctgatccagtctcaaagcgattgcaggctgaactggctgaccgccccaacccccctacccgcccactgcctgctgatcctgttgtaagaagccctaagtctcaaggtccggccaagcctccgcctcccaggaaaccactgccggccgatcctcaaggaaggtgtccctcaggagatttgccagggcccggggcaggtatcccccccctcgtggtgccaagtcggcccgcacctcctcctcctaccgtgtcctctctatatttgtag

SEQ ID NO: 177985 - DNA, 2517 bp, Artificial Sequence
  Description of Artificial Sequence: Synthetic coding sequence
atgcggctggccctgctgtgggccctgggcctgctgggcgccggctctcctctcccttcatggccactcccgaatattggtggaactgaagagcaacaggctgagtctgagaaggcgcctagagaacctctggagccacaagtgttgcaggatgaccttccaattagtctgaagaaggtattgcagacctctcttcctgaaccactccgcatcaaacttgagctggatggtgattctcacatccttgagcttcttcagaacagagagctggtgccagggagaccaacgcttgtatggtatcagcccgacggcacgagggtcgtaagcgagggccatactttggagaactgctgttatcaaggtcgtgtcagggggtacgcagggagctgggtcagtatatgtacttgcagcggactccgcggactggtcgtgctcacaccagagcggagttacaccctagagcaagggcccggggacctccaggggccacccatcatttcacgcatccaggatctccatcttccggggcatacctgtgctctttcctggcgggaatccgtccacacccaaaagcctcctgagcatcctttgggacagcgacacatcaggcgtaggagagacgttgtgaccgagactaaaaccgttgagttggtaattgtggccgatcactccgaagctcagaagtaccgcgacttccaacaccttcttaaccggacattagaggtggctctcctcctggatacctttttcaggcccctgaacgtgcgggtggccttagtaggcctggaagcgtggacccagagagacttagtagagattagccccaatcccgccgtgacactggagaacttcctgcattggaggagagctcacctactgccgcgcctcccacacgatagcgcacagttagtgaccggtacatctttctctggcccaacggtgggcatggccattcagaactccatctgctctcctgacttctcaggtggggtgaacatggaccattcgacctctatccttggcgtggcaagttccatcgcccatgagctgggtcactcgcttggccttgaccacgatctgcccggcaattcatgcccttgccctgggcccgcacccgcaaagacatgtatcatggaggcaagcaccgattttctaccagggctcaattttagcaactgctcacgaagggcattggagaaggctcttctagacgggatgggatcctgcctgtttgaaagactcccgtccttgcctcccatggccgccttttgtgggaacatgttcgtggagccaggcgagcagtgcgattgtgggttcctggatgactgtgtggatccatgctgcgatagtctgacctgtcaactaaggccaggcgcacaatgcgccagtgatggtccctgctgccagaactgtcagctgcgccctagtggttggcagtgtcgtcccaccagaggggactgcgatttgcctgaattttgtcccggtgattcatcccagtgcccccccgacgtgagccttggggacggcgaaccctgtgcagggggtcaggctgtgtgtatgcacggacggtgcgcctcctacgcccaacagtgccaatctctgtggggtcccggagcccagcctgccgcaccactgtgcctgcagacggccaacacgcggggcaatgctttcggaagttgcggcagaaatccttctggcagctatgtttcttgtacccccagagacgctatctgtggccagctccaatgtcagacaggtagaacccagcccctgctgggcagcatcagggatttactgtgggagaccatcgacgttaacggaacagagttaaactgtagctgggtacatctcgacctgggttctgacgttgcccagccactgcttaccctacctggaactgcctgcgggcctggattagtgtgtattgatcatcgctgccagcgtgtggacctgctcggcgctcaggaatgtcgtagtaagtgccatggacatggcgtctgtgattccaatcgacactgctactgcgaagaaggatgggcacccccggactgcacaacacaacttaaagctacttcatctttgaccaccggattgctgcttagtctgctggtgctattggtgcttgtgatgttgggtgccagttactggtaccgtgccagactccaccaacggctttgccagctcaagggcccaacttgtcagtaccgggcagcccagtccggaccgtctgaacggccaggtccaccccagcgcgcccttctcgctcggggcaccaaagccgagctggccgaccggccaaacccacctaccaggcctctgcctgctgaccccgtcgtacggtctccaaaatctcagggccccgcaaaaccacctccgccgaggaagcctcttcccgctgacccccaggggcggtgcccaagcggtgatctaccggggcctggcgccggcatccctccgctggtggttcccagccggcccgcacctcccccacccaccgtcagttctctgtacctgtag

SEQ ID NO: 177986 - DNA, 2319 bp, Artificial Sequence
  Description of Artificial Sequence: Synthetic coding sequence
atgcggctggccctgctgtgggccctgggcctgctgggcgccggctccccactgcctagttggccccttcctaatatcgggggcacggaggagcagcaggccgagtcagagaaagcaccccgcgaacctctcgagccacaggtgctgcaggacgaccttcccatcagcctgaagaaagtcttgcagacgagcctccctgaaccactcagaattaagctggagctggacggcgactcccatattctcgagctgctgcagaaccgtgaactagtccctggacggccgaccctggtatggtatcagcctgacggcacaagagtcgtctccgaaggacacacccttgagaactgctgttaccaaggacgtgtgcggggatacgctggttcatgggtgagcatctgtacttgctccggtctgaggggcctggtagttctgacgccagaaagatcctacacactggaacagggtcccggcgacctgcaaggtccacccatcatctctcgtattcaggatctgcacctccccgggcacacctgcgccctgtcctggagagaatccgtgcatacccagaaacctccggaacaccctttgggccaacgccatatccgtcggcgtagggatgtcgtcaccgagactaagaccgtggagctggtgatcgtagccgatcatagtgaggcgcagaagtacagagacttccagcatctcctgaaccgaaccctggaggtcgcattactcttggatacattttttaggcccttaaacgttcgagtggctctggtcggtttggaagcctggacacagagggatttagtcgagatctcgccaaacccggccgtgaccctcgaaaatttcctgcattggaggagagcccacctcttacctagactgccccacgacagcgcccagctggtcactggcacgtctttctcaggacccacggtaggaatggccatccaaaatagtatctgtagtccagatttcagcggcggagtgaacatggaccactccactagcatcctaggcgtggcatcctccattgcgcatgagttaggtcattctctcggtttagaccatgatcttccagggaacagttgcccctgccccggtccggctccagcgaagacatgcatcatggaggctagcactgactttctcccaggactcaatttctctaattgctcccgacgtgcgctggagaaagcactcctggatggaatggggtcgtgcttgttcgaaagactgccgtccctgccccccatggcagctttctgtggcaatatgttcgtggagcccggagagcagtgcgattgcggcttccttgatgattgcgttgacccgtgctgtgacagtctcacttgccagctgcggcctggtgcccagtgcgcttcagacggcccctgttgtcaaaattgtcaactccggccatccggatggcaatgtagaccaactcgcggggattgcgacctgcccgagttttgtccgggcgactcatcacaatgccctcctgacgtgtccttaggagatggcgagccttgcgcgggcggacaggcagtgtgtatgcatggacgatgcgcctcctatgctcaacaatgccagtccctgtggggccctggcgcacagcctgcggctccattatgcctgcaaactgcgaacacgcgggggaatgcgttcggaagctgcgggaggaacccctcggggagttacgtgtcctgtacccctcgggatgccatttgcggccagctccagtgccagactggtagaacccaacctctcctaggctccatcagggatctactatgggaaaccatcgacgtgaacgggacagagctaaactgcagttgggtccatctggacctggggtctgacgtcgcccagccactgctgactttgcccggtaccgcttgcggacctggactggtgtgcattgaccaccgctgtcagcgagtggacttgctgggcgctcaagaatgtcggagcaagtgtcacggccacggtgtttgtgactccaacagacactgttattgtgaagagggctgggcaccacccgactgcacaacccagctcaaagccacgagctcattaaccaccggcctgctactgagcctcctagtcctgctggtccttgtcatgttgggtgccagctattggtaccgagccagactgcatcaaagactttgtcagctgaagggccccacgtgtcagtacagtctgcgtggacaaccctcaccacacccgcagggatctcattgcctgccaactcctagagctggtgcccatagggtgacctgcccagcgcagggtctcgaaagcagaccctag

SEQ ID NO: 177987 - DNA, 1563 bp, Artificial Sequence
  Description of Artificial Sequence: Synthetic coding sequence
atgcggctggccctgctgtgggccctgggcctgctgggcgccggctcccctctcccttcttggcctttgcctaatattggtggaactgaggagcagcaggcggaatcagaaaaagcccccagagagccgctagaacctcaagtgcttcaggacgaccttcccatatcattaaaaaaggttctgcagacatcattaccggaaccacttcggatcaaactggagctggacggggacagccacattctggagctgctgcagaataggagtttcctgccaggtctgaatttctccaactgcagtcggagggcactcgagaaagccctgttggatggaatgggtagctgcctattcgaaagactcccatcactgccccctatggctgccttctgtggtaacatgttcgtagagccaggggagcagtgtgattgcggattcttggacgactgcgtcgacccatgttgtgactcactgacatgccagctcagacccggcgcccaatgtgcctcagacggcccatgttgccaaaattgtcagctgcggccatccggctggcaatgtcgaccgacgaggggcgattgcgatctgccagagttctgccctggagactcgagccagtgtccaccagatgtgtcgctgggcgacggcgagccatgcgccggcggccaagcagtgtgtatgcacgggagatgtgcctcttatgcacagcagtgtcagagcctgtggggacctggagcacagccagccgcccccttatgccttcagaccgcaaatacacgaggaaacgcatttgggtcctgtgggcggaatccttccggttcctatgtgagctgtacaccaagagatgccatatgtggacagctccagtgtcagacgggcagaacccaacccctcctgggttcaataagagacctcctgtgggaaaccatagatgtgaatggaaccgaattgaactgtagctgggtccacctggatcttggcagtgatgtcgcacaacccctgctcaccctaccaggcaccgcctgtggtcccggtttagtttgcatcgatcatcgctgtcagagagttgatcttctgggggctcaggaatgtcgttccaaatgtcatgggcacggagtatgcgactctaatcggcactgttactgtgaggaaggctgggcgccccctgattgcacaacacagctgaaggccacctctagccttacaaccggcctgctgttgagcttactggttctgttggttctggtaatgctcggagcctcgtactggtatcgcgcaaggctgcatcagagactgtgtcagttgaaaggccccacctgccaatacagagcagctcaaagcggcccctccgagcgacccgggcccccacagcgggcactgctagcacgcggcaccaagtcccaggggcctgcaaagccccccccgccaaggaaacctctacctgctgacccacagggacggtgcccgagtggcgatctgcccggtccaggagcgggcatccccccactggtggtgccatcacggccggcccctccccccccgaccgtgagttctttgtacttgtag

SEQ ID NO: 177988 - DNA, 2589 bp, Artificial Sequence
  Description of Artificial Sequence: Synthetic coding sequence
atgcggctggccctgctgtgggccctgggcctgctgggcgccggcagccccttgcccagctggccgctcccaaacatcgggggcactgaggagcagcaagctgagagtgagaaagccccccgagagccactcgagcctcaggttctccaggacgatttaccaattagtttgaaaaaagtgctgcagacttccctgcccgagcctctacggattaaactggaattagacggcgatagtcatatcctggagctgctccagaaccgggaattagttcctggacgccccactttggtgtggtatcaaccagatggtaccagggtcgtgtctgaaggccacaccttagaaaactgctgttatcaaggacgagttcgagggtacgccggctcatgggtgtccatctgcacctgttccgggctccggggccttgtggtcctgaccccagaacggagctatacactcgaacaagggccaggcgatctccaggggccccccattattagcagaatacaggacttacacttgcctggccatacctgcgccctgagttggagagaatccgtgcatacccagaagcctcccgaacacccactgggccagcggcatatccgtcgtcgcagagatgtagtgactgaaaccaagaccgtcgagctcgttatcgttgccgatcatagtgaagctcagaaataccgagattttcaacacctactcaaccgtaccctggaggtcgctctgctgttagacactttcttccgtccactgaatgttagggttgccttagtaggtctggaagcctggactcagcgtgacctggttgaaatatccccaaacccagccgttaccctcgagaactttctccattggaggagagcccacctacttccgagactgccccacgatagcgctcagctagtcacaggcacaagttttagcgggccaacggtcggcatggctatacagaatagcatttgctcccctgactttagcggcggtgtgaacatggatcacagtacatctattctgggcgttgccagttctatagcccacgagctggggcactcgctggggctggaccacgacctgccagggaattcttgcccctgtccgggcccagcgccagccaaaacatgcatcatggaggcctcgactgactttctgccgggactgaatttttctaattgcagccggcgggccctggaaaaagccctgcttgacgggatgggatcttgcctctttgagaggctaccttcactgccaccgatggctgccttttgtggcaatatgtttgtggagcctggtgaacagtgtgattgcggattcctcgacgactgtgttgatccctgttgcgactccttgacttgtcagctcagacctggtgcccagtgcgcttctgacggcccttgttgtcagaactgtcagcttaggccaagtggatggcagtgtaggcctacccgcggagactgcgacctgcctgagttctgcccgggtgatagcagtcagtgtccaccggatgtgtccctaggtgacggcgaaccctgtgcaggaggtcaagctgtgtgtatgcacggtcggtgtgcctcatacgctcagcagtgccagagcctctggggaccgggcgcgcagcctgcagccccactctgccttcagacggcgaacacacgcgggaatgcctttggctcctgcggcaggaaccctagtggttcttatgtgagctgtacgcctcgagatgccatttgtggacagctgcaatgtcagacaggaagaactcagcccctgctgggctccatcagggacctgctgtgggagacaatagatgtgaacggtacggaactaaactgctcttgggtgcatctagacttaggcagtgatgtggcgcagccattactcacactccctggaaccgcctgtggcccaggactcgtgtgtatcgatcatcggtgtcagagggtggacctgctcggcgcccaagagtgccggtccaagtgtcacgggcacggggtatgcgattccaatcgccactgttattgcgaggagggatgggctcccccggattgcaccactcaactgaaggctacctcgtccttaacaaccggcctgctgctatccctcctggtcctgttagttctggtaatgctgggggcatcgtattggtatcgcgccagattgcaccagcgcctgtgtcagcttaagggaccaacatgccagtaccgagcagcgcagtccggaccaagcgagaggcctgggccaccccagcgagcactgttagccagaggaactaaagcctcggctctgagcttcccagcccccccctctcgccctctcccccctgatccggtgtccaagagactgcaggcagagttagccgaccgcccaaacccgcccacacggcccctgcccgccgatccggtcgtgagaagtccaaagtcgcagggtcccgcaaaacctcctccacctcgtaaaccactgcctgccgatcctcagggccgttgtccatccggcgatttacccggccctggggccggaatcccccccttggtggtgccctccagacccgcgccacctccaccgaccgtgtcaagtctgtacttatag

SEQ ID NO: 177989 - DNA, 2391 bp, Artificial Sequence
  Description of Artificial Sequence: Synthetic coding sequence
atgcggctggccctgctgtgggccctgggcctgctgggcgccggcagcccattgccttcatggccactgcccaatatcggcggcactgaagagcagcaggctgaaagtgagaaagctcctcgggaacctctggagccccaggttctgcaagatgacctgcctatctctctgaaaaaggtcctgcagacctctctcccagaacctcttagaattaaattggagctcgatggggactcccatatcttggaacttcttcagaatagagaactggtgcccggtaggcccaccctggtgtggtaccaacctgacggcacccgggttgtcagtgaaggacatacactggaaaactgctgctatcagggcagagtgagaggttacgctggctcctgggtgagcatttgcacatgttccggcctgcgggggctggtagttttgacccccgagcgtagctatacactggagcagggccctggcgatctgcagggaccccccatcatctcaaggatccaagacctgcacctgcctggacatacttgcgcactgtcatggagggagtcagtgcatactcagaagcctcccgaacaccccttgggacagcgtcacattaggcgcagaagggacgtagtcacagagacaaaaacggtagagttggttattgttgctgatcatagcgaggcacagaaatatcgggactttcaacatctgctgaatagaactctagaagttgctttgcttttggacacattctttcgccccctcaacgttcgggttgccctcgttggcttagaagcatggacgcaacgagatctcgttgagattagcccaaatcctgccgtcacgcttgaaaacttccttcactggaggcgggcccacctcttgccacgattgcctcacgacagcgcgcagctcgtcaccggaacttccttcagcgggccaactgttggcatggcaatccagaattccatctgcagtcccgatttcagtggaggggtcaatatggaccatagcacaagtattctgggcgtagccagcagcattgcgcatgagctgggacactccctcgggctcgatcatgatctgccagggaactcctgcccctgccctggcccagcacctgccaagacttgtatcatggaagcttctactgatttccttccagggctgaacttcagtaactgcagcagaagggcactcgaaaaagccttgctggacgggatgggctcatgcttatttgagcgtctgcccagtcttcctcctatggctgcgttctgtgggaacatgttcgtggagcccggggaacagtgtgactgcggttttctagatgactgcgtggacccttgttgcgattctctgacttgtcaactgagaccaggagcccagtgtgccagcgacggaccttgctgccaaaactgccagctgagaccaagtggctggcagtgtaggccaacacgaggggattgcgacctgcccgagttctgtcctggcgactccagtcagtgtccacctgacgttagcttgggagatggcgagccttgtgcagggggacaggctgtttgcatgcatggacgctgtgcatcctatgcgcaacagtgtcagagcttgtgggggcccggagcgcagcctgcagcacccttgtgcctgcaaaccgctaacactcgaggaaatgcatttggctcatgtggccggaacccaagcggatcctatgtcagttgtacgccgagagacgcaatctgtggtcagctgcagtgccagacgggaagaacgcagcccctgctgggatctatccgcgatctgctttgggagacaatcgatgtcaatggaacagagctgaactgtagctgggtccatctcgatctgggcagcgatgtggcgcagcccctgttgacattgcccggcacggcctgtggacccggcttggtgtgcattgaccaccgctgtcagagggttgacctgctcggagctcaggagtgtcggagcaagtgccacggccacggcgtgtgcgattccaaccggcactgctactgtgaagaagggtgggcccctccggactgtacaacccaactgaaagctaccagctcgctcaccaccggccttctcctgagtttactggttctgctggttttagtgatgttgggggcgtcatactggtatagagctcggttacatcagagactgtgtcagcttaagggacctacttgccagtacaggctggtgctgtctgcctcacggccccccctgcctggccgatgcaggttaacactgtgtccaagggattcctccctccgaggtcagcctagtccccacccgcagggatcccattgcttgccaacacctagagccggggcccatagggtaacttgtcctgcccaaggcctggaatcccggccctag

SEQ ID NO: 177990 - DNA, 2475 bp, Artificial Sequence
  Description of Artificial Sequence: Synthetic coding sequence
atgcggctggccctgctgtgggccctgggcctgctgggcgccggctcccctcttccttcctggccactgccaaatatcgtcctctcctggggggtgctcggacctgctggcgggactgaggaacagcaggcggaaagcgaaaaagccccgcgggagcctctcgagccccaggtgctgcaggacgacctgccaatctcactcaagaaggtgctgcaaaccagcctgccagagccccttagaataaaattagaattagacggtgatagtcatatcctggagttgctccagaaccgtgagcttgttccagggagaccaaccctcgtgtggtaccagccggacgggacgcgcgtcgtgtctgaaggtcacactcttgaaaactgctgctaccaggggagggttcgcggatacgcgggaagctgggtgtcgatctgcacttgtagtgggctgcgggggttagtggtcctgacaccagaacgttcctatacgctcgaacagggaccaggtgatttgcaaggaccaccaattatctctcgaattcaagatttgcacttaccgggccacacctgcgcattgagctggcgtgagtccgtgcacacgcaaaaacctcctgagcaccctctgggccagcgtcacattcgccgtcgaagggatgtcgttactgagactaaaactgtggaactggtgattgtcgccgaccactccgaggcacagaaatatcgggacttccaacatctgctgaatagaacccttgaagtggctctgctcctggacaccttttttcggcctctcaacgtgcgtgtcgcgcttgtcggccttgaagcatggacacaacgagacctggtggagatctcacctaaccctgccgttaccttagaaaactttctccattggcgcagagcccacctcctgccccggttgcctcacgatagcgcccagctggtgactggaacttcattttccggccctacagtcggaatggctatccaaaacagtatttgcagtcccgatttttcaggcggggtgaatatggaccattccaccagcatcctgggagtcgcctcaagcatcgcccatgaactagggcacagcctgggcttggaccatgacttgcctgggaacagctgtccatgtcctgggccagcgcccgctaaaacttgcatcatggaggccagcactgatttcctgcccgggttgaactttagcaactgttcaagaagggccttagagaaagccctgctcgacggtatgggctcttgtctgtttgagcgcctgcccagtcttccacctatggccgccttttgcggcaacatgttcgtggaacctggggaacaatgcgattgcggattccttgacgactgcgtggatccatgttgcgattcccttacgtgtcagctccggcccggcgcacagtgtgccagcgacgggccatgctgtcagaattgtcagctccgcccttctggctggcagtgtcgacctacgaggggggactgcgatcttcctgaattctgccccggcgactcctctcaatgccctcccgacgtgagcctgggcgacggagagccttgtgccggtggccaggctgtgtgcatgcatgggcgatgtgcctcttatgcccagcaatgccagtctttgtggggccccggggcccagcctgccgcccccctgtgccttcagacagcgaacaccagaggcaatgccttcgggtcttgtggaagaaaccctagtggttcatacgtcagctgcacgcctcgcgatgctatctgcgggcagttacaatgccagacggggcgaacccagccattgttaggctccatcagggacttactgtgggaaactatcgacgtgaacgggaccgagctgaactgttcctgggtgcatctggatttagggtccgacgttgcccagcctctcctcaccctgccaggcaccgcttgtggccccggtctggtctgcatcgatcatcgttgccaaagggtggacttactaggagctcaagagtgccggtccaagtgccatggtcacggggtttgtgatagcaatcgtcattgttattgtgaggaaggctgggctcctcctgactgtacaactcagctcaaggccacctcctctcttaccacaggtcttctactctctctgctggtactactggttctggtgatgttgggggcctcttactggtatcgtgccagactacaccaacggctttgccagctgaaaggcccaacgtgccaatatagggcagcccagtcaggacctagcgaaagacccggaccgccccagagggctctgctagctcggggcaccaagtcccaggggcctgcaaaacccccccccccacgcaaacccttgcccgccgatccccagggaaggtgtccatctggtgacttacccgggcccggagcggggatcccaccactggtcgtcccaagccggcccgcacccccccctccaacagttagtagtctttacttatag

SEQ ID NO: 177991 - DNA, 2757 bp, Artificial Sequence
  Description of Artificial Sequence: Synthetic coding sequence
atgcccggcggcgccggcgccgcccggctgtgcctgctggccttcgcactgcaaccactgcgccctagggccgcccgggagcccggatggacgaggggtagcgaggagggatctcctaagttgcagcatgagctcatcattccccagtggaagacttcagagtcacctgtgcgggaaaagcatccactgaaggcggagctccgggtcatggcagagggtcgtgagctgattctggaccttgagaagaacgaacagctgttcgcaccaagctataccgaaacgcattacacttcttcaggcaatcctcagacaacgacccgcaaactggaggaccattgcttctaccatggaaccgtgcgcgagacagagctctcatcggtgaccctcagcacatgtagaggtataagggggctcatcactgtgtcatcaaacctgtcatacgtgatcgagcccttgccagatagtaaaggccagcacctgatataccggtcagaacacttaaaaccaccaccggggaattgcggcttcgagcattccaagcctactactcgcgattgggctctgcagttcacacagcaaacaaagaaacggccaagacgaatgaaacgggaggaccttaacagcatgaaatacgtggagctgtatcttgtggcagactatttggaatttcaaaagaaccgacgggatcaggatgctaccaaacacaaacttattgaaattgccaattatgtggataaattctaccgctcactgaacattcggatagcgctcgtggggctggaagtatggacacatggaaacatgtgcgaggtgtccgaaaacccatactccaccctctggagctttctttcctggaggcgaaaactgctcgcgcagaagtaccacgacaacgcccaactcattaccggcatgagctttcacggaaccaccatcggcctggcccctctgatggccatgtgttctgtctatcagtcgggcggggtgaacatggatcactcagagaatgctatcggagttgccgctaccatggcacatgagatgggccataatttcggtatgactcacgattcggcagattgttgctccgcttccgcagccgacggcggttgcatcatggcggccgcaaccgggcaccctttccctaaggtattcaacggctgtaatcgtagggagctagatcgctacttacagtctggcggcggaatgtgcctgagcaacatgcctgacacgcgtatgctgtatggcggccgacgatgcggaaacggatacctggaggatggggaggaatgtgattgcggagaggaggaggagtgtaacaatccatgttgcaatgcatcaaattgcacattacgccccggggcagaatgcgctcacggctcatgctgtcatcagtgcaaacttttggcccccgggacgctgtgtagggagcaggctaggcaatgcgacctgcccgagttctgcacaggcaagtctcctcattgtccaacaaacttctatcagatggacggaacaccctgcgaaggaggccaggcatattgttataacggtatgtgtctaacttaccaggagcagtgccaacagctgtgggggccaggtgctcgcccagctcccgatctctgctttgagaaggtgaacgttgctggtgatacttttggaaactgtggcaaggatatgaacggcgaacatagaaagtgcaacatgcgggatgccaaatgcggcaagattcaatgtcagagctcggaagccagaccactggagtcaaacgccgtaccgattgacacaacaatcatcatgaacggcaggcagatccagtgccgtggcacccatgtgtacagggggcccgaggaggagggggatatgctagaccccggactggtgatgaccgggacaaaatgcggatataaccacatttgcttcgagggtcagtgcagaaataccagcttctttgaaaccgagggttgtggaaagaagtgcaacgggcacggagtgtgtaataataatcagaactgccactgcttgccaggctgggctcccccgttctgtaacacacctggtcatggagggtccatagacagtgggccaatgccccccgagtctgtaggcccagtcgttgccggcgtcctggtcgccatcttagtcttagctgtgctcatgttaatgtattattgctgtagacagaataacaagctgggacaactgaagccctcagccctcccatcaaaactgagacagcagttcagttgtccatttcgggtgtcccaaaactctggcacggggcacgctaacccaacattcaagctgcaaaccccgcagggcaagagaaaggttatcaacacccccgagatccttcggaagcctagtcagcctccacctcgccctcctccggattatctgaggggaggatcccccccagcgcccctgccagcccatctgtctcgagcagcaaggaatagccctgggccagggtcccaaatcgaaaggaccgagtcttcgagaaggccccccccttccagacctattccacccgcccctaattgcattgtaagccaagacttctcccgtccccggccaccacagaaagcccttccagcgaaccccgtgccaggacggagatcgctgccccgcccagggggggcttcccctctgagacctccgggggctggaccacagcagtctaggcccctggccgccctagccccaaaatttcctgagtatagatcccagagagccggtgggatgatcagtagcaagatatag

SEQ ID NO: 177992 - DNA, 2763 bp, Artificial Sequence
  Description of Artificial Sequence: Synthetic coding sequence
atgcccggcggcgccggcgccgcccggctgtgcctgctggccttcgccctccagcctctgaggccacgggcggcccgagaaccggggtggacaattagcaggggttccgaggagggcagccccaaacttcagcacgagctcattatcccacagtggaagacaagcgagagtccggtgcgggaaaaacatcccttgaaggccgagctgcgggttatggcagaaggacgagagcttatcctagacctagagaaaaacgagcagttgttcgcaccttcatataccgagactcactacacatcatctgggaatcctcagacgacaactaggaaactcgaagatcattgcttctaccacggaacagtccgcgagacagaactgagcagcgttacgctgtcgacctgccgcgggatacgaggtctgatcacagtgtcttccaacctctcctatgtgatcgagccattgccggacagcaagggccaacacctgatctacaggtctgagcacttaaagccaccccctggcaattgcggcttcgaacactcaaagccaacaacacgtgattgggctctccagttcacccagcagaccaagaagcggccgcgacgaatgaagcgagaggacctcaattcaatgaaatacgttgaactttatctcgtagctgactacctagagtttcaaaaaaacagacgtgatcaggatgctaccaaacacaagctcatagagatcgcaaactatgtcgataaattctataggtctctgaatatccgaatcgctctagtaggactcgaggtatggacacatggcaatatgtgcgaggtgagtgaaaacccttatagcacattatggagctttctgagctggagacggaagctgctggcgcaaaaatatcacgacaatgcacagctcatcaccgggatgagttttcatggcacgaccatcggactggctcccctcatggcgatgtgttcggtctaccagtctggcggggtaaatatggatcattccgagaatgccattggagtagctgcaacgatggctcacgagatgggtcacaactttggcatgacacacgactccgctgattgttgcagtgcatctgccgccgacggcggatgcataatggctgcggctaccgggcatcccttcccaaaagtattcaatggctgcaaccggcgggagctcgatcgctaccttcagtccggtggcgggatgtgtctctcgaatatgccagatacacggatgttatatggcgggaggagatgtggtaatggctacctggaggatggcgaggaatgcgactgtggtgaggaggaggagtgcaataacccatgttgcaacgccagcaactgtactttacgacccggtgctgaatgcgcccatggctcctgctgccaccaatgcaagttgctggcacctggaaccctatgccgtgagcaagcccgccagtgtgatttgccagaattctgtacgggtaaatcaccccactgtcctacaaacttctaccagatggatggtaccccctgcgagggcggtcaggcctattgctacaatggaatgtgcctgacataccaggagcaatgccagcagctttggggccccggggccaggcccgctcctgacctgtgttttgagaaagtgaacgtggccggagacacatttggaaactgcggcaaggatatgaacggggaacatcgaaaatgtaatatgagagacgccaaatgtggaaagattcaatgtcagtcctctgaagcccggcccctcgagtcaaatgccgtaccaatcgatacaacaattatcatgaacgggcgccagatacaatgtcgtggcacccacgtatacaggggacctgaggaggaaggagatatgctggatcctggactcgttatgacaggaacaaagtgtggatataatcacatttgttttgaaggacagtgtaggaacacaagcttctttgaaaccgagggatgcggtaagaagtgtaacggccatggggtgtgcaataataaccagaattgtcactgtctgccaggctgggccccccccttctgcaatacgcctgggcacggcggttccattgactctggacctatgccaccagagtccgtgggccccgtggtggccggagtcctagtcgccatacttgtcctggccgtcctgatgctgatgtattattgttgccggcagaacaacaagctgggccagctaaaacccagcgcactaccctcaaagcttagacaacagttctcatgccctttccgcgtatctcaaaattccgggaccgggcacgctaacccaacttttaaattgcagactcctcagggcaagcgaaaagtcatcaatacaccagaaatactgcgaaagccaagtcaaccccctccacggcctccccccgattacctgaggggcggctccccgccagctccgctgcctgctcatctcagccgggcggcacgcaacagcccagggccagggagtcagattgagcgcactgagagctcacgcagacccccaccgtctcgacccattccaccagcaccaaattgcattgtgagccaggatttcagccgtccaaggcccccccagaaagcactgccagccaatcccgtaccagggcggcgcagtctgccacgtcctgggggagctagcccactgaggccccctggcgctggacctcaacagtctcgccctctagccgccctcgccccgaagttccccgagtaccgtagtcagagggcaggagggatgattagctctaaaatctag

SEQ ID NO: 177993 - DNA, 1917 bp, Artificial Sequence
  Description of Artificial Sequence: Synthetic coding sequence
atgtgcgaggtgagcgagaacccctacagcaccctgtggagcttcctctcatggaggagaaagctgctggctcagaaataccatgataacgcccagttgatcacaggtatgtctttccatggtacaacaattgggttggctccactcatggccatgtgctccgtgtaccagtctgggggggtgaacatggatcattccgagaatgcaatcggggtggctgcgaccatggctcacgaaatgggccataatttcggtatgacacatgacagtgccgactgctgttcagcttcagccgcggatggagggtgtatcatggccgcagccacaggacacccgttccccaaggttttcaacggatgtaatcgcagggaattggataggtatctgcagtctggaggcggtatgtgtcttagtaatatgcccgacacgcgaatgctgtatgggggccggcggtgcggtaacggctacttggaagatggcgaagagtgcgactgtggtgaagaggaggagtgtaataacccctgctgcaatgccagcaattgcaccctcagacccggcgccgagtgtgcacatggtagctgttgccatcagtgcaaactgttggcgcctggcacactgtgtcgtgagcaggcacgacaatgtgatctgcctgagttctgcactggaaagagcccccattgtcccactaatttttaccagatggacggaacgccatgtgaggggggacaagcctattgttataatgggatgtgcctgacttaccaggaacagtgccagcagctgtggggacccggcgcccgcccggctcccgacctatgcttcgagaaggtcaatgtcgccggcgacacgtttggaaattgcgggaaggacatgaacggggaacaccgtaaatgtaacatgcgcgatgcgaagtgtggaaagatccagtgccagagctcagaagcgcgaccactcgagtcaaacgcggtgccaattgatacaacaataatcatgaacggtagacagatccagtgcagaggcacccatgtctaccgcggccctgaggaggagggagatatgctggacccgggcctggtgatgaccggaaccaagtgcggatataaccatatctgctttgaggggcaatgtcgcaatactagtttcttcgaaactgagggatgcggtaaaaaatgtaatggccatggtgtctgcaacaataaccagaactgccactgcctgcctggttgggctcccccattctgtaatactcccgggcacgggggaagcatcgattcagggcccatgcctcccgaatctgtgggtccagtggtcgccggggttttagtagccattctcgtgcttgccgtgctgatgctaatgtattattgctgtcgccagaacaataagttgggacagcttaaaccaagcgccttgccctccaaattacggcaacagttctcttgtcccttccgggtcagccagaattccggcactggccatgctaatccgactttcaaacttcaaacaccgcagggtaagcgaaaagtcataaacactcccgagattctgcgaaagccttcacagccacctccaaggcctccgccagattatctacggggcggtagtccgcctgcgcctctgccagcccacctttcccgggcagcccgtaactccccagggcctggttcccagatagaacgaacagagtcatctcgacgcccacctccctccaggcccatccccccagcgcccaattgcatcgtttctcagaaatgtctacttccgcctgccatgatcctccgggctccccaacctagcggcactgtggtctgccttgtaataagcttcaacatggccttttataggtcgatgaggatccggatagagcccggtattaaaaccaaacttctggtgctcctcgtgtggaaacagttttag

SEQ ID NO: 177994 - DNA, 2868 bp, Artificial Sequence
  Description of Artificial Sequence: Synthetic coding sequence
atgcccggcggcgccggcgccgcccggctgtgcctgctggccttcgcacttcagcctttgcgacctagagcggcgcgcgaacccggctggactagaggttccgaggaggggtctccgaagctgcaacacgagttgataatcccacagtggaaaactagcgagtctcccgtccgcgagaagcaccccttgaaggccgagctccgcgtgatggcagagggtcgggagttgattctcgaccttgaaaagaacgaacagctgtttgcgccctcttacaccgagacacattacaccagtagcggtaatcctcaaactaccacacggaagctggaggatcactgcttttaccacggcacggttcgggagactgaacttagctccgtgaccctgtccacttgccgcggaattcgcgggctgatcacagtctcgtcgaatctgtcctacgtgatcgaaccactccctgactccaagggtcagcacctgatataccggtccgagcacctcaagcccccacctgggaattgcgggtttgagcactccaaacccacaaccagagactgggcacttcagttcactcagcagacaaagaaacggccacgtcgcatgaaaagagaagatctcaactctatgaagtacgtggaactgtatctggtcgccgattatctcgaattccagaaaaaccgtagagaccaggacgctacaaagcacaaactgatagaaatcgcaaattacgtcgataaattttatcgctcactaaatattagaattgccctagtgggcctggaagtatggacgcatgggaatatgtgcgaggtgtctgagaacccctactctacactttggtcgtttttatcctggaggcgaaagttgctggctcagaaataccacgataatgctcaacttatcacaggtatgagttttcacggaacgactataggcctggctcctcttatggccatgtgttcagtttaccagtcagggggagtgaatatggaccattccgagaatgcaatcggggttgccgccacaatggcccacgagatgggacacaatttcggcatgacccacgatagcgctgactgctgttctgccagcgctgcagacggtgggtgcattatggctgcagccacaggccatccatttcccaaagtttttaacggatgtaacaggcgtgaactggaccgatacttgcagtctggtgggggtatgtgtcttagtaacatgcccgacactcgcatgttgtatggtggccgcagatgtggcaatggctatctggaggatggcgaggaatgcgattgcggcgaagaggaagaatgcaataacccttgttgtaatgcctcaaactgcacactccgcccaggggcagagtgtgcccacggctcatgctgccaccagtgcaagcttctcgcaccgggaactctctgtagggagcaggcccgccaatgtgatctgccggaattctgcaccggcaagagcccccattgtcctactaacttttatcagatggacgggacaccatgcgaagggggccaggcgtattgttacaatggcatgtgtttaacctaccaggagcagtgtcaacagctgtggggaccaggcgcgcgtccggccccagatctttgtttcgagaaggttaatgtggcaggcgataccttcggaaattgcgggaaagacatgaatggcgaacaccggaagtgtaatatgcgcgatgccaagtgtggaaagatccagtgccaatcatctgaggctaggcctctggagtcgaacgccgtccctatcgataccaccattatcatgaacggtagacaaatccagtgccgcggtacccacgtctataggggccctgaagaggagggtgacatgctcgaccctggcttagtgatgacaggcaccaaatgcggatacaatcacatctgcttcgagggccagtgcagaaacacttctttcttcgagacagaggggtgcggaaagaagtgcaatggacacggagtctgcaacaataaccaaaactgccactgtcttcccgggtgggcccccccattctgtaacacccctggccacggcggatctatcgatagtgggcccatgcccccagagtctgtgggccccgtagtcgccggcgtacttgtggccattctagtgctggctgtcctaatgctgatgtactactgttgtcgccagaataacaaactgggccagctcaaaccaagcgcccttccctccaagctgaggcagcaattttcatgcccattccgcgtgtctcagaattcaggaacaggccatgctaaccctaccttcaagctgcaaaccccacagggtaagaggaaggtcattaatacacccgagattcttagaaagcctagccagccaccccctcgacccccaccagattaccttcgagggggatcccctcccgcccctcttcccgcccatttgagcagggcagcccggaacagcccgggccccggatctcagatagaaagaacggagagttccagaagacccccaccaagtagacctatccctccagcccctaactgtattgttagccaggacttttctcggccacgcccacctcagaaggctctgcctgctaatccggtacccggccggagatccctgccccggcccgggggagcctcccctctccgcccgcctggcgcaggaccacagcagtcccggcctttggctgctcttgccccaaaggtgtccccccgcgaggccctgaaggtgaaggctggaacaagagggctccaaggcgggcgttgtcgggtagagaaaaccaagcaattcatgctgctggtggtgtggacagaactaccggagcagaaaccccgagccaagcactcttgctttctggtacccgcgtag

SEQ ID NO: 177995 - DNA, 2208 bp, Artificial Sequence
  Description of Artificial Sequence: Synthetic coding sequence
atgtggcgggtgctgttcctgctgagcggcctgggcggcctgcggatggactcaaattttgattccctacccgtgcagatcaccgtaccggagaagatccggagtattattaaagaggggattgagtcccaggccagctacaagatcgtaattgaaggtaagccatacaccgtgaatctgatgcagaagaactttcttccacataatttccgcgtatattcctactctggaaccgggataatgaagccactcgaccaggactttcagaacttctgtcactaccaggggtatatcgaaggctacccaaaaagcgttgtgatggtgagtacctgcacaggactccggggagtgctccagtttgaaaacgtgtcctatggaatagaacccttggaatcttccgtaggattcgagcacgtgatttaccaagtgaaacacaaaaaagccgatgtgtcgctttacaacgagaaagatatagagagcagagatctgtccttcaagctccagtctgttgaaccccagcaagactttgcgaagtacatcgagatgcacgttatagtcgagaagcagctatacaatcatatggggtcggacaccaccgttgtggcacagaaagtgttccaactcattggcctcaccaacgccatttttgtctcctttaatattacaataatcctgagctctctggagctatggatagacgaaaataaaattgctactacaggtgaggcaaatgagctcctccataccttcctgaggtggaaaactagctatcttgttttgcggccacatgatgtcgccttcctcctagtataccgggagaaaagtaattacgtcggagccacttttcagggcaagatgtgcgatgccaactatgccggtggagtggtcctccatccacggaccatctctcttgagtctctagctgttatcctggctcagctcctgagcctgagtatgggcataacttacgatgacataaataagtgtcagtgttcaggcgccgtctgtatcatgaatcccgaggccattcattttagcggcgtgaagattttctcaaattgtagttttgaagactttgcgcacttcatttctaagcagaaaagccagtgtctgcacaaccaaccaaggctagacccgttcttcaagcaacaggctgtgtgcgggaacgccaagctagaggctggggaagaatgcgattgcggaactgagcaggactgtgcacttattggcgagacctgctgcgacattgccacctgccggttcaaggccggttctaactgcgccgaagggccctgctgtgagaattgcctgttcatgtccaaggagagaatgtgcagaccatcttttgaggagtgtgatttaccagagtactgcaatggcagttccgctagttgtcccgagaaccattacgtgcagaccggacatccgtgcggccttaatcagtggatatgcatcgatggggtgtgtatgagcggggacaagcaatgtactgacacctttgggaaagaagtggagtttggcccatccgagtgctatagtcacctgaactcaaagaccgatgtctccgggaactgcggaatctccgattccggctacactcagtgtgaggctgacaatctccaatgcggcaagttgatctgcaagtatgtcggcaagttcttactacaaatacccagagctacaatcatttacgctaatatctccggccacctgtgtattgctgttgagttcgcatcagaccatgccgattcccaaaagatgtggattaaagatggcacatcctgcggatctaataaggtgtgtcgcaaccagcggtgcgttagtagttcctacctcggctacgattgtacaacagacaagtgtaatgacaggggagtgtgtaacaataaaaagcactgccactgttccgccagctacttgccaccagattgtagcgtgcaaagcgacctgtggcccggcggctctatcgattcggggaacttcccccctgtggcaatccctgcccggctgccggagcggagatatatcgaaaacatataccatagcaagcccatgcgttggccctttttcctattcattccgttttttatcattttctgcgtgctgatcgctataatggtaaaggtgaactttcagaggaaaaaatggcgcacggaggattacagcagcgacgaacagccagaatctgaaagcgaaccaaagggatag

SEQ ID NO: 177996 - DNA, 2151 bp, Artificial Sequence
  Description of Artificial Sequence: Synthetic coding sequence
atgtggcgggtgctgttcctgctgagcggcctgggcggcctgcggatggacagcaatttcgatagtctgccggtgcagattactgtgcctgaaaagatccgatctatcataaaggaaggcatcgagagccaagcatcatataaaatcgtgatagaaggaaagccctatacagtgaatctaatgcagaagaatttcctgccacacaactttcgggtctacagctattccggcaccggaatcatgaagcccctggaccaagactttcagaatttctgccactaccagggttacatcgaaggatatcccaagtccgtggtgatggtctcaacttgcactggtctgcgtggcgtactgcagttcgagaatgtttcttacgggatagaaccactggagtcctccgtgggatttgaacacgtgatctaccaggtgaaacataaaaaagctgatgtgtctctgtacaacgagaaggacattgagtccagggatctcagcttcaagctgcagtccgtcgagtacaatcatatgggcagcgataccacagtggttgctcaaaaagtgtttcagctgatagggcttacgaatgctatctttgtttcctttaacataacaatcatcttgagtagcttagagctgtggatcgacgaaaacaagatcgccacaactggggaagctaacgaactgttgcatacgttcttgcgctggaagacgtcctacctcgtcctccgtccacatgacgtggcttttttgctggtgtaccgcgaaaagagcaactatgtcggcgcaactttccagggaaagatgtgcgacgccaactatgctgggggtgtggtcttgcaccctcgcacaatctccctggaaagtcttgctgttattctggcccagttactgtccctgagcatgggaataacctatgacgatataaacaagtgtcagtgcagtggtgccgtttgtattatgaacccagaagccatccacttttcaggcgtgaagatcttttccaattgctcctttgaagacttcgctcacttcatctctaaacagaagtcgcagtgtctgcataaccagcctagacttgaccccttcttcaagcagcaagcagtatgcggcaatgccaaattagaggctggagaggaatgcgattgtggcacagagcaagactgcgccttgattggcgagacatgctgcgatatagctacctgtagattcaaggctgggtctaactgcgccgagggaccttgctgtgaaaactgcctgttcatgtctaaggagcgcatgtgccggcccagttttgaggaatgcgacctccccgagtactgtaacggctccagtgcttcctgtcctgagaaccattatgtgcagacaggacatccttgcggcttgaaccaatggatttgtatcgacggagtgtgtatgagtggggataagcagtgcaccgacacctttggcaaggaagtggagtttggtcccagtgagtgctactcacatctgaatagtaaaacggatgtctccggtaattgcgggatctccgatagtgggtacacccaatgtgaagcagataatcttcagtgtggcaagctgatctgtaaatatgtggggaagttcttgctgcagattccgcgcgccactataatctacgccaatatctccgggcatttgtgcatcgccgtggagtttgcttcagaccacgctgacagtcagaagatgtggattaaagatggcactagctgtggaagcaataaggtgtgtagaaatcaacggtgcgtgtcttccagctacctggggtatgactgcaccacagataagtgtaatgataggggggtctgcaataacaagaagcactgtcattgcagtgcctcctatctccctccagactgttccgttcagtccgacctttggccaggaggatcgattgactctggtaattttccaccagtcgccatcccagcaagactgccagagcggcggtatatcgagaacatctaccattctaagcccatgaggtggcctttcttcctcttcatcccattttttattatattctgcgtcttgattgctattatggttaaggtgaatttccagagaaagaaatggagaacggaagactattcctccgatgagcagccggaatccgaaagcgagcccaagggctag

SEQ ID NO: 177997 - DNA, 2331 bp, Artificial Sequence
  Description of Artificial Sequence: Synthetic coding sequence
atggtgcagctgcaccaggacaccgacccccagatccccaagggccagccatgtaccttaaatagttcagaaggaggggccaggcccgccgtccctcacaccctcttctcaagtgccttagaccgctggctgcataatgacagcttcattatggccgttggagagcccctggtgcacatcagagtaactttactgttattgtggttcgggatgtttctgtctataagtggacactcccaggctagacccagccagtactttacaagtcccgaggtggtgatccctctgaaagtcatcagtcgcggacgcggagccaaggcacccggatggttaagttatagcctcagatttggggggcagagatacatcgtccacatgcgagtgaataagcttctgtttgctgcacatcttcccgtctttacttacaccgagcaacacgctctcttacaggaccagccattcatccaagatgattgctactaccatgggtacgtagaaggcgtgcccgaaagcctggtggcattatcaacatgttcgggtgggttcctgggcatgctccagattaacgatctggtatatgagataaaacctataagcgttagcgcaaccttcgagcacctggtgtacaagatcgactccgacgatactcaattcccgcccatgaggtgcggccttaccgaagaaaagatcgcccatcagatggagttgcagctatcctataatttcaccttgaagcagtcatcctttgtgggttggtggacacatcagcggtttgtggagcttgtcgtcgtagttgataacatcaggtacctgttcagccagtcaaacgccaccacagttcagcacgaggttttcaacgtggtcaatattgttgattcattttatcatcccctcgaagtggacgtgatcttgactggaattgacatctggaccgcatctaatccccttccaacatccggcgatcttgacaacgtgctggaggatttcagtatctggaaaaattacaacctcaataacagactgcagcacgatgtggctcacctattcattaaggatactcaaggaatgaaactgggcgttgcctatgttaagggcatttgccagaatcctttcaacactggcgtggatgtgtttgaggataatcgtctcgtagtgtttgctataacactcgggcacgaattgggccataatttaggtatgcagcacgatacacagtggtgcgtttgtgagctgcagtggtgtatcatgcatgcatatagaaaggtgacaacaaaattcagtaactgctcttatgcccagtattgggattccacgatatcaagtggtttatgtatacaaccacccccctatcccggaaacatattccggcttaaatactgtggcaacctggtcgtcgaagagggcgaagaatgcgactgcggcactattaggcaatgtgcaaaagacccctgttgtctcctcaattgtaccctgcatcccggagctgcgtgcgcctttggcatttgttgtaaggattgcaagttcctgccgtccgggactctctgtcgacagcaagtcggcgagtgcgaccttccagagtggtgtaatggcacctctcaccagtgtcccgatgacgtttacgttcaggatggtatctcatgtaatgtgaacgccttttgctatgaaaaaacatgtaataatcacgacattcagtgtaaggagatatttggtcaggatgccagaagcgcctcccagagctgttatcaggagatcaacactcaaggcaatcgcttcggccattgcggcatcgtcggcacaacatatgtgaaatgctggactccagacattatgtgcggcagagtgcaatgtgagaatgtgggcgtgatccctaacctgattgagcattccacagtgcagcagtttcatttaaacgacaccacctgttggggtaccgattatcatctgggcatggctattccggatatcggcgaggtaaaagacggaaccgtttgcggcccagaaaaaatctgcatcaggaagaaatgcgccagcatggtccatctgtctcaggcatgtcaacccaaaacatgcaacatgcgagggatatgcaacaataaacagcactgccattgcaatcacgagtgggctcctccttactgtaaagacaaaggctacggaggttctgccgacagcggtccaccccccaagaacaatatggagggacttaacgtgatggggaagctccgctatctatccctactgtgcctgctgccactcgttgcatttcttttgttctgcctgcacgtgttgttcaagaagcgcacgaagtcaaaagaggacgaagaagggtag

SEQ ID NO: 177998 - DNA, 2169 bp, Artificial Sequence
  Description of Artificial Sequence: Synthetic coding sequence
atggccgtggacggcaccctggtgtacatccgggtgaccctgctgctgctctggcttggcgtgttccttagcatttccggttactgccaggcgggtccaagccagcattttacttctcctgaagtcgtgattccgctgaaagttatctctcgtgggagaagcgccaaggctcccggctggctctcttactcactgcgatttggagggcagaaacacgtggtgcatatgagggtgaaaaaactgttggtctcaagacatctgcctgtttttacttacaccgacgatcgagcgcttctggaagatcagctgttcataccagacgattgctattaccacgggtacgtggaggcagcccccgagtcgctggtggtgttttcggcatgctttggaggctttcggggggtgctgaagatctccggattgacttacgagatcgaaccaatccggcatagcgcaacttttgagcaccttgtgtacaaaatcaattctaatgagacacagtttcccgctatgcgctgcggcctaaccgagaaggaggttgcgcggcagcaactggaatttgaggaagcggaaaattccgctttggagcccaaaagtgcaggggactggtggactcatgcgtggttcctagagctggtggtcgtggtgaaccacgactttttcatctactcgcagagcaacattagcaaggttcaggaggatgtttttctggtggtgaatattgttgattcaatgtacaaacagctgggaacgtatatcattttaataggcattgaaatctggaaccagggcaacgtctttccgatgacatccattgagcaagttctgaatgatttctctcagtggaagcagataagcctatcacaactgcagcacgacgcagctcatatgtttattaaaaattcccttatctcaatccttggcctagcatacgttgctggaatttgtaggcccccaattgactgcggcgtggataatttccagggcgatacgtggtcactttttgcaaatacagttgctcatgaactcggacacacgctggggatgcagcacgacgaagagttctgcttttgtggagaacgtggctgtattatgaatacattccgcgtccccgcagagaagttcacgaactgttcatacgctgatttcatgaagactacgttgaatcaaggttcttgccttcacaatccgccacggttgggcgagatatttatgctgaaaagatgtggaaatggcgttgtggagcgtgaagagcaatgcgattgtggatctgtgcagcagtgtgaacaagatgcttgctgcttacttaactgcactctcagacctggcgccgcatgtgcatttggtctgtgctgcaaggattgtaaatttatgccgtcaggcgagctgtgtcgacaagaagtcaacgagtgcgacttaccggagtggtgtaatggcacgtctcaccagtgccccgaggacagatatgtgcaagatgggattccttgcagcgacagtgcttactgctaccagaaacgttgcaacaaccacgatcagcactgtcgggaaatttttggcaaggacgctaagagcgctagccagaactgttacaaggagattaattcccaaggaaaccgttttggacattgcggtataaacgggactacatacctgaagtgtcatatctctgacgtgttttgtgggcgagtccagtgcgagaatgtgcgcgatattcctctgctgcaagaccacttcacgcttcaacatacccatataaacggcgtcacttgttggggcatcgactaccacctgcgcatgaacatttcagacattggggaggtcaaagacggaacagtgtgtggccctggtaagatctgcatacacaagaaatgcgtgtccctgtccgttttgtcccacgtatgtctgcccgagacctgtaatatgaagggaatttgcaacaataaacatcattgtcactgtgggtatggctggtctcccccttactgccagcaccgcggatatggtggatccatcgatagtggccctgcgtccgctaagcgcggcgttttcttgcccctcattgtgataccaagcttaagcgtcctcactttcttattcaccgttggcctgctgatgtaccttcggcaatgcagcggacctaaggagacgaaagctcattcctctggctag

SEQ ID NO: 177999 - DNA, 2721 bp, Artificial Sequence
  Description of Artificial Sequence: Synthetic coding sequence
atgcaggccgccgtggccgtgagcgtgcccttcctgctgctgtgcgtgctggggacttgcccacccgcacggtgtgggcaagccggggacgcttccctgatggagctggaaaaacggaaagagaaccgattcgtggagaggcaaagcatcgtccccctgaggttgatctaccgaagtggcggagaagacgagtcgcgccatgacgccctcgacacaagagtaagaggcgacctgggcggtccccagctgacacacgtcgaccaagcatcatttcaagttgacgccttcgggacatcttttatcctggatgtggtccttaatcatgatctgctcagttcagagtacatcgaacggcacattgagcacggcgggaagacggtggaggtgaaagggggagaacattgctactaccagggccacattcgcgggaatccagattctttcgttgctctgtcgacgtgccacggcttacatggtatgttttatgacggcaaccacacttacttaattgaacctgaagagaatgacacgacacaggaagacttccactttcactctgtctacaaatccagactcttcgagttctctcttgatgacttaccctctgaattccaacaggtgaacattaccccctcaaagttcatcttgaagcccaggccaaaacgcagcaaacgacagttgcgaaggtatccacggaacgtggaggaagaaaccaagtacattgagcttatgatcgtgaatgatcacctcatgttcaagaagcatcgcctgtccgtcgtacatactaatacttacgccaagtcagttgtgaacatggcagacttgatatataaagaccagcttaagactcgtatagtactggttgccatggagacatgggccacagacaacaaattcgcaatcagtgagaacccactcatcacccttagagaattcatgaagtaccggagggatttcatcaaggagaagtccgatgccgtccatttgtttagtggctcgcaatttgagtcatcgagatctggcgccgcatacatcggcggcatatgctcgctgctgaaggggggcggagttaatgagttcggtaaaacagacctgatggccgtcacacttgcccagagtctggcccataatattggtattatctccgataagcggaagcttgcgtctggcgagtgcaagtgtgaagatacgtggtcaggatgtatcatgggtgacaccggatactatctgcccaaaaaattcactcaatgcaacatcgaggagtatcacgacttcctgaacagcggcggtggcgcctgcctgtttaataaaccctcgaagttacttgacccaccagagtgtggtaatggatttatcgagaccggcgaagagtgcgattgcggcaccccggcagaatgcgtgttagagggagccgagtgctgtaaaaaatgcaccctcactcaggacagccaatgctccgatggactgtgttgcaaaaaatgtaagttccagccaatgggcacggtctgtcgtgaagccgttaatgactgcgatatccgggagacctgttctggcaacagcagccagtgcgctccaaacatccacaagatggatggctacagttgcgatggtgtacaggggatctgctttgggggtaggtgtaaaacacgtgatagacagtgcaaatacatttgggggcagaaggtgacagcttcggacaagtactgctacgaaaaacttaatatcgaaggcacagaaaagggcaactgcggaaaagacaaggacacgtggatccagtgcaataaacgggacgtgttatgtggctacttactttgcacaaatatcggaaatattccccgactgggtgagctggacggggaaatcacgagtaccctggtcgtccagcagggacgtacgctcaactgctccggtggccacgttaaactggaggaagatgtggacttaggatacgtcgaggacggcacgccatgtgggccgcagatgatgtgccttgagcaccgatgcctcccggttgcaagcttcaatttcagcacctgcctgagtagcaaagagggaacaatctgtagtgggaacggcgtatgttccaacgaactgaaatgtgtctgcaataggcattggatcggttcggattgcaatacctacttccctcacaacgacgatgccaagaccggaattaccctttccggaaacggtgtggccgggaccaatattatcatcggcatcatcgccggtactatcctcgtgctggctctgatccttggcataaccgcctggggatacaaaaattaccgcgagcagcggcagctgcctcagggagattatgttaaaaaacctggagacggcgactctttttactcagacataccaccaggtgtatctacaaatagtgcaagctccagtaaaaagcgttcaaatggcttaagccatagctggagcgagcgcatccccgatacaaaacatatcagtgacatctgcgaaaacggacggcccagatccaattcctggcagggcaacttgggaggtaataagaagaaaatacggggcaagcgattcagaccgcgaagcaactcaacagaaacccttagtcccgccaaatcaccctcctctagtacaggctccatcgccagcagccgtaaatacccttatcccatgccccctctgccagacgaagacaaaaaagtgaataggcagtctgctcggctgtgggagaccagtatttag

SEQ ID NO: 178000 - DNA, 2700 bp, Artificial Sequence
  Description of Artificial Sequence: Synthetic coding sequence
atgcaggccgccgtggccgtgagcgtgcccttcctgctgctgtgcgtcctgggaacctgtccccccgccaggtgcgggcaagccggtgacgccagcctgatggaattggaaaaacgcaaggagaatcgattcgtcgaaagacagtccatcgtccccctgcgtctcatctaccggagcgggggagaagacgaatcgcggcacgatgccctcgatacacgagtacgaggcgatctgggggggccacaattgacacatgtcgatcaggcaagtttccaggtggatgcttttggaacctcattcatcctggacgtagtgctgaatcacgaccttctcagctccgaatacattgagcgtcatatagaacacgggggcaagactgttgaggtgaagggaggagagcattgttactaccagggacatattaggggcaaccccgacagctttgtggctcttagcacttgccacggattgcacggaatgttctacgatggtaatcatacgtacctgattgagccagaagaaaatgatacaacacaggaggacttccacttccattccgtgtacaagtctagattgtttgagttttccttggacgacctccctagcgagtttcagcaggttaacatcactccttctaaatttatcctgaagccacgacccaagaggtcgaaaagacaactgagaaggtacccacggaacgttgaggaagagaccaagtatatcgaactgatgatcgtaaatgaccatctcatgttcaaaaagcaccgcctgagcgttgttcacacaaatacctacgctaagtccgtcgtgaacatggccgacttaatctataaggaccaactgaagacccgtatagtgctagttgccatggaaacttgggccactgacaacaaatttgccattagtgagaatcctctgatcacgttgcgcgagtttatgaagtaccggcgtgatttcatcaaagaaaaaagcgatgcagtacatttattctctggcagccagttcgagtctagccgctctggcgccgcctatatcggtgggatctgctctctgctcaaaggagggggcgtcaacgaatttggcaagactgatctgatggcagttaccctggcgcaatccctggcccacaacattgggatcataagtgacaaacgaaagctagcctcaggagagtgtaaatgcgaggatacttggagtggttgcataatgggggatacaggatactatctcccgaaaaagttcacccagtgcaacattgaggaatatcacgactttcttaacagcgggggcggtgcctgcctgttcaacaaaccctctaaactgttggatcctccagagtgcggaaatggtttcatcgagacaggcgaggaatgcgactgcgggacccccgcagagtgtgtccttgagggcgctgagtgttgcaaaaagtgtaccctgacccaggactcccagtgctcagatggcctgtgctgcaaaaagtgtaagtttcaacccatgggcactgtgtgccgggaggccgttaatgattgcgacatcagggaaacatgctcaggcaattcgagccagtgcgcgccgaacatccataagatggacggatactcctgcgacggagtgcagggaatctgctttggcggccgttgcaaaacccgtgacaggcagtgtaagtacatttggggacagaaggtgactgccagcgacaaatactgttatgaaaagctgaatatcgaggggaccgagaaaggaaattgtgggaaggataaagatacctggattcaatgtaacaagcgagatgtcctttgcggctatttgctgtgtactaatattggaaatatccccagactgggcgagttagacggcgagatcacctctactcttgtcgtgcaacaggggcgtaccttgaattgcagtgggggccacgtgaaactggaggaggatgtggatctagggtatgtagaagatgggactccgtgtggcccccagatgatgtgcctggagcataggtgccttcccgtggcttcttttaacttttctacgtgcttgtcaagcaaggaaggcactatatgctctggaaatggagtttgcagtaacgaactgaagtgcgtatgtaacagacactggatcggcagtgattgcaatacatacttcccccacaacgatgatgccaaaacaggcatcaccctgtcaggcaatggagtagctggcacaaatattatcattgggataatcgctggcacaattctggttttagctctgatcctagggattactgcttgggggtacaacaatatcttcaattttagaagtaatggtctttcccatagctggtccgagagaattccagatacaaagcacattagtgacatttgtgagaatgggcgtccccgcagtaattcttggcagggcaacctgggcggtaacaaaaagaagatccgggggaaacgatttcggccaaggtcaaattccaccgaatacctgaatccgtggttcaaaagagattataatgtagctaaatgggtggaggatgtgaacaagaatactgaaggcccctattttagaaccttatcgcccgcaaagagtccgtcctccagcaccggcagtatcgcaagttcaaggaagtatccctaccctatgccaccactgcccgacgaagataaaaaggtcaatcgccagtcagccagactctgggagacatctatatag

SEQ ID NO: 178001 - DNA, 2580 bp, Artificial Sequence
  Description of Artificial Sequence: Synthetic coding sequence
atgcaggccgccgtggccgtgagcgtgcccttcctgctgctgtgcgtactcggaacatgcccaccggcgcgatgcggccaagccggtgacgcatctttgatggaactggagaagcgcaaagaaaaccgatttgtggagcgacagagcatcgtgcctctccggcttatatatcgcagcggcggagaggacgaatctaggcacgacgctctggacacccgggtgagaggagatctgggaggtccacagctgacccacgtcgaccaggcctcttttcaagtggatgcgtttggaacctccttcattctggacgtggtgctcaaccacgatctgctcagcagcgaatacatagagcgacatatagaacatggcggaaaaacagtggaagtcaaaggcggcgaacactgctactatcaggggcatatccgaggcaaccctgatagcttcgtggcactgagcacttgccatgggttacacggcatgttttatgatggtaatcacacttatctgatagagcctgaggagaacgacactacgcaggaagacttccattttcattcagtttacaagagtcgcctattcgagtttagtttagatgacctgccgagtgagtttcagcaagtgaatatcacaccttccaaatttatacttaaaccacggcccaagagatccaaacgtcagctgcggcgatatccccggaacgtagaggaggagacaaaatatatcgagctcatgatcgtcaatgaccatttgatgttcaagaagcaccgcctgagtgtcgttcacacgaatacttatgcaaaaagtgtcgtcaacatggctgatctgatatacaaggaccagctgaaaacccggattgttctggtggccatggaaacatgggccacagataataagttcgctatcagcgagaatcctctgatcaccctgagagaatttatgaaataccgccgtgacttcatcaaagagaaatctgatgcagttcacctattctcagggagccagttcgaatcatcaagaagcggagcagcctatatagggggcatctgtagtctgctcaaaggaggaggggtcaatgagttcggcaaaacggacttgatggccgtaacgctggctcagagtctggcccataacattgggattattagcgataaacgaaagctcgcctccggcgagtgcaaatgtgaggatacgtggtctggttgcatcatgggtgatacgggttattacctgcccaagaagtttacacaatgtaatatcgaggagtatcacgacttcctgaattcaggaggaggcgcttgcctattcaataagccgagtaaattgcttgaccccccagagtgtggcaatggttttatagaaacaggagaagagtgcgattgcggaactcctgctgaatgtgtcctggagggagcagagtgttgcaaaaagtgcaccctgacgcaggattcacagtgttctgacggcctgtgttgcaagaagtgcaaattccagcctatgggtaccgtgtgtagagaagccgtgaacgactgcgatattcgggagacttgcagcggtaattcatcgcagtgcgcccccaacattcacaaaatggacggttactcatgcgatggagtccagggtatctgcttcggtggcaggtgcaaaactcgcgaccgacaatgcaagtacatctggggacagaaagtgaccgcttcagataagtactgctatgaaaagctcaacattgaaggcactgagaagggcaattgtggaaaagacaaagatacctggattcagtgcaacaaaagggatgtgttatgtgggtacctgctctgtacgaatatcgggaatattcctcggctcggagagctggatggcgagatcactagcactttagtggtgcagcagggccgaaccctcaactgcagcggcgggcatgtaaaattggaagaagacgtcgatctgggttacgtcgaggatggtacgccctgcggaccacaaatgatgtgcctcgaacaccggtgcttgcccgtagcctccttcaacttcagtacatgcctctccagcaaggagggcacaatttgttctggcaacggcgtgtgtagtaacgaattaaagtgtgtctgcaatcggcattggattgggagtgactgtaacacatacttcccacacaatgatgacgctaaaacaggcatcacgctgagtggaaatggcgtcgccggcactaacattatcataggtatcatcgctggcacgatcctcgtgctcgcccttattctgggaattactgcatggggctacaagaactatagagaacagaggcagcttccgcagggggactacgtgaagaagccaggggacggcgattccttttattccgacatccctccaggcgtctctaccaactctgcatcctctagcaaaaaacgctccaacggcctgtctcactcttggtcagagcggattcccgatactaagcatatcagcgatatttgcgagaatggaaggccacggtccaatagctggcagggtaatctcggtgggaacaagaaaaagatccgtggtaagcgcttccggcccaggtccaattccaccgagtag

SEQ ID NO: 178002 - DNA, 2613 bp, Artificial Sequence
  Description of Artificial Sequence: Synthetic coding sequence
atgcaggccgccgtggccgtgagcgtgcccttcctgctgctgtgcgtgctgggcacgtgccctccagctaggtgtgggcaggcaggggatgccagcctcatggaactggagaagcgcaaagagaatcgatttgtggaacggcagagcatcgtgcctctgcggctgatatacagatcagggggggaggacgagtcccgccacgacgccctagacacgcgggtgcggggggacctgggtggcccccagctcacacacgtagatcaggctagctttcaggtggacgcatttggaactagctttattctcgacgtggtgctgaaccatgatttgttaagcagcgaatacatcgagagacatatcgagcatggggggaaaacagttgaagtgaagggtggcgagcactgttactaccagggtcatatccggggaaatccagattcctttgtggctctgagtacatgtcatggacttcacgggatgttctatgatggaaatcatacatatctgatcgaaccagaggagaacgacacaacccaggaagatttccacttccattctgtgtacaagtctagactgttcgagttttcactggatgacctccctagtgaatttcagcaggtaaatattacaccttcaaagttcattctgaagccacgaccaaagcggagtaagagacagttaaggcggtacccgaggaacgtagaggaggaaacgaagtatatcgaattaatgattgtgaacgaccatctcatgttcaagaaacacaggttgtcagtggtgcacacaaacacgtacgctaagagtgtggtgaacatggccgatcttatctacaaagatcagctgaaaactcgaattgtcttagtggcaatggagacatgggccaccgataacaagtttgctatatcagaaaaccctcttattaccctgcgcgagtttatgaaataccggagggatttcataaaggagaagtccgatgcggtccacctgttcagcgggagccagttcgaaagctcccggagcggggctgcttacatcggcgggatttgttccttgctgaagggaggaggagtgaatgaatttggtaagaccgatctgatggccgttaccctggctcagagcctagctcataacatcggcatcattagcgataagaggaagctggccagtggcgagtgtaagtgcgaagacacttggtctggatgcattatgggtgatactgggtattatctgcctaagaagtttacccaatgtaatatcgaggagtatcacgactttttgaatagcggagggggcgcttgcttgtttaacaagccatccaagttgctggatcccccagaatgcggtaacggatttatcgagactggcgaagaatgcgattgcggcacgcctgcggaatgcgtgctggaaggcgcagagtgttgcaaaaagtgcactctaactcaggactcacagtgttcagatggactgtgttgcaaaaagtgtaagtttcagcctatggggactgtgtgtagagaagcagtaaatgactgtgatattcgtgaaacctgtagtggaaactcatcgcagtgcgccccaaacatccacaaaatggatggttactcgtgtgacggagtacagggtatttgctttggagggcggtgcaaaactcgtgatcgccagtgcaagtacatctgggggcaaaaggtgacagcgtctgataagtactgttacgagaaactgaacattgagggtaccgaaaaaggcaattgcgggaaggataaggacacctggattcagtgcaacaagagggatgtgctatgcgggtatctcttgtgcactaatattggaaacatcccccgcctcggcgagctcgatggggaaatcacaagtactttagtggtccagcagggccgcacccttaactgttccggcgggcacgttaaacttgaggaagacgttgacctgggatatgttgaggatggaacaccatgcggccctcagatgatgtgcctcgaacatcgttgtctgcccgtggcctcattcaatttctctacctgtctctcctctaaggaagggaccatatgctccggtaacggcgtttgcagtaatgaactgaaatgcgtctgcaacaggcactggattggctctgattgcaatacctatttcccccataatgacgatgccaagacaggtatcaccctctcaggaaacggagtggctggcaccaacatcatcatcggcattattgctgggaccatcttggtgctcgccctgatcctcgggatcactgcttggggctacaaaaactacagggaacaaaggtcaaacggactctcacattcttggtcagagcgaatcccagacaccaagcacattagtgacatttgcgaaaacgggaggccacgatccaacagttggcagggaaatctcggcggaaacaagaaaaagatcaggggaaaaagatttagaccccggtccaactcaacagaaacactctcacccgcaaaaagtccgtcttccagtaccgggtctatcgctagcagcaggaagtacccttaccccatgccccccctacccgatgaggacaagaaggtgaataggcagtctgccagactatgggaaacgtctatttag

SEQ ID NO: 178003 - DNA, 2700 bp, Artificial Sequence
  Description of Artificial Sequence: Synthetic coding sequence
atgcaggccgccgtggccgtgagcgtgcccttcctgctgctgtgcgtcctaggaacctgcccccccgccagatgtgggcaggcaggtgacgcgagcctcatggagctggagaagcgtaaggaaaaccgctttgttgaacgccagagcatagttcctctccgcctgatctacaggtcagggggggaggatgaatcaaggcacgacgcattagacacgagagttcgaggggacctgggtggaccacagctgacgcacgtggaccaggctagctttcaggtggatgcatttgggacgtcttttatcttggacgttgtgctgaatcatgacctactctcctccgagtacatcgagcgccacatagagcacggtggcaaaactgtcgaggtcaaaggaggagaacactgctattatcagggtcacatcagggggaacccagatagtttcgttgccctgtctacatgtcacgggctgcacggtatgttttacgacgggaaccacacctacctgatagagcctgaagagaatgatactacacaggaggactttcactttcactccgtgtataagtctaggttattcgaattttctttagacgatctgcccagtgaatttcaacaggtgaacataactccatccaagtttattctgaaacctaggcccaagagaagcaagcgtcagttgcgcagataccctaggaacgttgaggaagagaccaagtacattgagctcatgatcgtgaacgaccatcttatgtttaagaaacatcggctttctgtggtgcacacaaacacttacgccaaatcagtggttaatatggcagacctcatttacaaagaccagctcaagacccgcatcgtgctcgtggccatggagacatgggcgaccgataacaaatttgctatttccgaaaaccctctcatcactctccgtgaattcatgaagtaccgcagggattttatcaaggaaaagtccgatgctgtccacttattctctgggtcacagttcgaaagcagccgctctggagcagcctacattgggggaatctgtagtcttctcaagggcggtggcgtcaacgaattcggaaagaccgatcttatggccgtcacgctcgctcaatctctggcccacaatattgggattatttccgataagaggaaactcgcttccggggagtgcaaatgtgaggacacctggagtggatgcataatgggtgacactggctactacttgccaaaaaagtttacccagtgtaacatcgaggaataccatgattttctgaacagtggcgggggtgcgtgcctgttcaataagccttctaaactgcttgaccccccagagtgcggcaatggattcatagagacaggagaggaatgtgactgcggtaccccagcggaatgtgttttagaaggggcggaatgctgcaaaaaatgtacactgacacaagattcccaatgctccgacggactgtgttgcaagaagtgtaagtttcaacccatgggcacagtctgcagagaggccgtaaacgactgcgatattcgcgaaacttgctcaggaaattcgtcacagtgcgcccctaacatccacaagatggacggttattcctgcgacggggttcaaggtatctgcttcggtggtaggtgtaaaacaagggatagacagtgtaaatacatctggggccaaaaagtcaccgccagcgataaatactgctacgaaaagctcaacattgaggggactgaaaagggcaattgtgggaaggacaaggacacctggatacaatgcaacaagcgcgacgtgctctgtggctatctgttatgtacaaatataggtaatatcccgcgtctaggggagctggatggcgagattacatccaccctggtggtacagcaaggccgcacactcaactgctctgggggacacgttaagctcgaagaggatgtggacctcggatatgtcgaggatggtaccccttgcggaccccagatgatgtgcctcgaacatagatgtctccccgtagctagcttcaatttttccacctgtctgagctctaaggaagggacaatttgcagtggcaatggcgtttgttcaaacgagctcaagtgcgtgtgcaacagacactggataggttcagactgcaatacttattttccgcacaatgacgatgccaaaaccgggattaccttgtctgggaacggcgtggccgggacaaacatcatcattggaatcatcgccggcactattctggttttggccctcattctggggatcacagcttggggttacaagaactatcgggaacaaagaagtaacgggctgtcccattcctggtcggagcgcattcccgataccaagcatattagcgacatatgtgaaaacggtagaccacgcagcaactcttggcagggcaacctcggtgggaataaaaaaaagattaggggaaaacgatttagacctcgttcaaactctacagaatacctaaacccatggtttaagcgagattataatgtggcaaagtgggtggaggacgtgaataagaataccgagggaccgtatttcagaaccctcagcccggccaagtctccatcatccagcactggcagtatcgcttcatccagaaagtatccttaccctatgccccccctgcccgacgaggataaaaaggtcaacagacagtctgccaggctctgggagacctctatctag

SEQ ID NO: 178004 - DNA, 2328 bp, Artificial Sequence
  Description of Artificial Sequence: Synthetic coding sequence
atgctgcagggcctgctgcccgtgagcctgctgctgagcgtggccgtcagtgccattaaggagctgcctggggtcaaaaaatatgaagtcgtgtatccaatccggctgcaccctctgcacaagagagaagccaaagaaccagagcagcaggaacaattcgaaactgagctgaagtacaagatgacgatcaacgggaaaattgccgtcctttaccttaagaaaaataaaaatctcctggctcctggatatacggagacttattacaattctacagggaaagagattaccacgagcccccaaattatggatgactgttattaccagggccacattttgaacgaaaaggtgtcagatgcttcaatcagcacatgccggggactgcgcggctactttagccagggcgaccagaggtactttattgaacctttgagccccatacaccgcgacggacaggagcacgccctgtttaaatataacccggacgagaaaaactacgacagcacctgtggtatggatggcgtcttatgggcgcacgatctgcagcagaatatagcccttccggccacgaaactggtgaagttgaaggacagaaaggtacaagagcatgaaaagtacattgaatactacttggttctcgataacggggagtttaagcggtataacgaaaatcaggacgaaatccggaagagagtgtttgaaatggccaattatgtaaacatgttgtacaagaagctaaatacccacgtggccttggtggggatggagatatggactgataaggataaaataaagatcactcctaatgcatccttcaccctcgaaaacttctcgaagtggcgggggtctgtgctgagcaggcgaaagcgacatgacattgcccagctcataaccgccacagagttagcaggcacgaccgtgggcctcgccttcatgtctacaatgtgtagcccctatagtgtcggagtcgtccaggaccacagcgacaacttactacgcgtggctgggacaatggcccacgaaatgggccacaacttcggcatgtttcacgatgattactcttgcaagtgccctagcacaatctgcgtcatggacaaggctctcagtttttatatccccaccgacttctcttcctgctcccgcttgtcctatgataaatttttcgaagataaactttctaactgcttatttaacgcccccttgcccactgatatcatttccactcctatttgcgggaaccagctggttgagatgggcgaagattgcgactgcgggacaagtgaagaatgtacaaacatttgttgcgatgccaagacttgtaagatcaaagcaacctttcaatgcgcgcttggagagtgttgtgagaagtgtcagtttaaaaaggctggcatggtctgtcgtcccgcgaaagacgagtgcgacctgcccgaaatgtgcaatggtaagtctggaaattgcccggacgatcgcttccaggtcaatggcttcccctgtcatcatggcaaaggacactgcctgatgggcacgtgcccaaccctacaagagcaatgcaccgagctttggggcccggggactgaagtcgcggacaagagctgttacaatcgcaacgagggcggcagtaagtatgggtattgccgcagagtggatgacacgctgatcccctgcaaggctaatgatactatgtgtggaaagctgttttgccaaggcggcagtgacaacttaccctggaagggacgcatcgtgacattccttacatgtaaaacctttgatccggaggatactagccaagagatcggcatggtcgcaaatgggacgaagtgcggcgacaataaagtttgcattaatgccgagtgcgtggatatagagaaggcttacaaatccacaaactgctcttccaagtgtaaggggcacgccgtctgcgaccacgagttacagtgtcagtgcgaggagggctggatccccccggactgtgacgatagttcagttgtttttcactttagcattgtggtgggggtgctgtttcctatggccgtgatattcgtcgtcgtggccatggtaattagacatcagagcagtcgtgagaaacagaagaaggatcaacgtcccctttccacaacaggcacaagacctcacaaacagaagaggaagccccaaatggtcaaggcagtgcagccgcaggaaatgagccagatgaagcctcacgtatacgatctacctgtcgaaggtaacgaacctccagcaagctttcataaagacacaaacgccttacctcctaccgtgtttaaggacaatcccgtatctactcctaaggattccaaccccaaagcgtag

SEQ ID NO: 178005 - DNA, 1452 bp, Artificial Sequence
  Description of Artificial Sequence: Synthetic coding sequence
atggagatctggaccgacaaggacaagatcaagatcacccccaacgcatcttttacccttgaaaacttttccaagtggcgcgggagcgtcctctcacggaggaaaaggcatgacatcgctcaattgatcaccgcaaccgagctcgccggcaccaccgtggggcttgctttcatgagtacaatgtgtagcccatattcggtgggcgtcgttcaggatcattccgacaatctcctgcgtgttgcaggaaccatggcccatgaaatgggtcacaacttcggaatgtttcatgacgactactcatgtaagtgtccgagcaccatctgtgtgatggacaaggcactgagtttttacatacccacagatttcagttcatgttctagactttcatatgacaagttctttgaggacaaactcagtaattgtctcttcaatgcgcctctgcctaccgacatcatatcgacacccatttgtggcaatcagctggtagagatgggggaggactgtgactgcggaacctcagaggagtgtaccaatatttgttgcgacgccaaaacctgcaagataaaggcgaccttccagtgcgcacttggtgaatgttgcgaaaagtgccaattcaaaaaggccggtatggtgtgccgccccgctaaggatgagtgtgatctcccggagatgtgcaacgggaagtccggcaattgcccggatgaccgattccaggtcaatggattcccgtgtcaccacggcaaaggtcactgtctcatgggtacatgtcctacactccaggagcagtgcactgaattgtgggggccgggtacagaggtggccgacaaatcttgttataatagaaacgaggggggaagcaaatacggatactgtaggcgagtggatgatacattgattccttgtaaagcaaatgatactatgtgtggcaaactgttttgccagggcggctcggataatctgccctggaaggggcgcatcgtaactttcctcacatgcaagaccttcgaccctgaggatacctcacaggagattggcatggtagctaatggcaccaagtgcggcgataacaaggtgtgtataaatgcagagtgtgtcgatatcgagaaagcatacaaatctacaaactgtagctctaagtgtaagggccacgctgtgtgcgatcacgaactgcagtgccagtgtgaggaaggttggattcctccggactgtgacgactcgagcgtggttttccggcgactgcttcactgtggttggggagccgtgccaaacggtgggcatttctgtgggggctgttatgggaatcctgcccccgaactgcagagaaaggccgaggaaaggagcgaagctactatctaccactggcatcaagctacccagaccgaagaggagacccccgacggcaaaggttgctcaactccaagagacgagagtgatgaggcgccatgtgtatag

SEQ ID NO: 178006 - DNA, 1623 bp, Artificial Sequence
  Description of Artificial Sequence: Synthetic coding sequence
atgctgcagggcctgctgcccgtgagcctgctgctgagcgtggccgtgtcagctataaaggagctccccggtgtcaagaagtacgaggtcgtttatcccatcagactccaccctctgcacaaacgcgaggccaaagaacccgaacaacaggagcagtttgagaccgaactgaaatacaagatgaccatcaacggaaaaatcgctgtgttgtacttgaagaagaataagaacttgcttgcacctgggtacacagagacctactacaattccacggggaaagaaattaccacaagcccgcagattatggatgactgctactatcagggacatatcctgaacgaaaaagtctcggacgcctctattagcacttgccgcggcctgagagggtacttcagccagggtgatcagcgctatttcatcgagcctctgtcccctatccatcgagacgggcaggaacacgctctcttcaagtacaatccagacgaaaagaactacgacagcacatgcgggatggatggagtgctctgggcacacgacctacaacagaatattgctctcccggcgaccaaacttgtgaagttgaaggataggaaggtccaagagcatgagaaatacattgaatattacttagtacttgacaacggggaattcaaacgctataacgagaaccaagatgaaatccggaagcgggtgtttgaaatggctaattacgttaacatgctgtataagaagctgaacacacacgtggccctggtcggaatggagatctggaccgacaaggacaaaattaagataactcctaacgcctcctttaccctggaaaacttcagcaagtggagaggaagcgtgctttcgagacgcaaaagacacgacatagcacagctgattacggccacagagcttgctggcaccaccgtgggactagcgtttatgagcaccatgtgttctccttattccgtgggggtggtgcaggaccatagcgataatctgctgcgggtcgccggcacaatggctcacgagatgggtcataatttcggtatgttccacgacgattattcctgcaaatgcccatcaacaatctgtgtgatggacaaggccctgtcattctatatccctacggatttctcctcttgttcccgattaagttacgacaaattttttgaagacaagttgtccaattgtctgtttaatgcccccctaccgaccgacatcatctccacacctatttgtgggaatcagttggtggagatgggggaagactgtgactgcggaacaagcgaagagtgcacaaacatctgttgtgacgctaaaacgtgtaagatcaaggctacatttcagtgcgccctgggagaatgctgtgagaagtgtcagtttaaaaaggccggaatggtttgtcgcccagctaaagacgaatgcgatctgcccgaaatgtgtaacggtaagagcggcaattgtccagatgatcgctttcaggtgaatgggttcccctgccaccatggcaaggggcactgcctgatggggacatgtccaaccctgcaggaacaatgcacagagctctggggtcccgggcgacgcacgaatcctttcccctgcgcttgtgctaaggagaaccactttaggtag

SEQ ID NO: 178007 - DNA, 924 bp, Artificial Sequence
  Description of Artificial Sequence: Synthetic coding sequence
atggccaactacgtgaacatgctgtacaagaagctgaacacccacgtggcccttgtcggtatggagatttggacagataaagataagatcaaaattacccccaatgcgagtttcaccctggaaaattttagtaagtggcggggatctgtactgtcccggcgcaagagacacgatatcgctcagctgatcaccgccacagagctggcagggaccaccgtcggcctggcatttatgagtactatgtgctcaccatactcggtgggcgtggtccaggaccatagcgacaacctcctgagagtcgctgggacaatggctcacgagatgggacacaactttggaatgttccatgatgactattcgtgtaaatgtccatcaactatatgcgtgatggacaaggctctgtcattctacattccaaccgactttagcagttgttcaaggctctcttatgataagttcttcgaggacaagctgtcaaactgtttgttcaacgcgcccttgccaacggatataatatccaccccaatctgcggaaaccaattagtggaaatgggggaggattgtgattgtgggacgtctgaggaatgcacaaatatctgttgtgacgccaaaacttgcaagatcaaggcgacattccaatgcgcgttgggggaatgctgcgagaaatgtcagtttaagaaagcaggaatggtctgccggcccgccaaggacgagtgcgatctgcctgagatgtgcaatgggaagagcggaaattgtccagacgaccgattccaggtcaatggatttccatgccatcacggaaagggccactgtctgatggggacgtgcccgacactccaagagcaatgcaccgagctctggggacctgggaggaggacaaatcctttcccatgtgcctgcgcgaaagagaatcactttcggtag

SEQ ID NO: 178008 - DNA, 2463 bp, Artificial Sequence
  Description of Artificial Sequence: Synthetic coding sequence
atgaagatgctgctgctgctgcactgcctgggcgtgttcctgagctgcagtggccacatccaggatgaacacccccagtatcacagtccaccagatgtggtcatcccagtgagaataactggcactactcgtggcatgacgccaccaggctggttatcttatatcctgccttttggtggtcagaagcacatcatccatataaaggtgaaaaagcttctcttcagtaagcatcttcccgtttttacctacacagatcaaggagctatccttgaggatcaaccattcgttcagaacaattgttactaccacggctacgtcgagggagaccctgaatctctggtgagtttgagcacgtgtttcgggggattccaaggcattttacagataaacgatttcgcctacgagatcaaaccgcttgctttctctacaacattcgagcacttagtgtataaaatggatagcgaggagaaacagttttcaacaatgagaagtgggtttatgcagaatgagataacctgccgcatggaatttgaggaaattgacaattcaacccagaagcagtccagctacgtgggctggtggattcacttccgaatcgtcgaaattgtagtagtgatagacaactacttatatataaggtatgaaaggaatgattctaagcttttggaagacctgtacgtgatcgtgaacattgttgattcaatactcgatgttatcggtgtgaaggtccttctcttcggacttgagatctggaccaataaaaatcttattgtcgtggacgatgttcgcaaatccgtgcacttatactgtaagtggaagtctgaaaatattactccgcgaatgcagcatgacaccagccacttgtttaccacactcggactccgtggactgagcggaattggggctttcagggggatgtgcaccccacatcggtcttgcgccatcgtgacatttatgaacaagaccttaggaacctttagcatcgcagtggcacaccacctgggtcacaatcttggaatgaaccatgatgaggatacttgccggtgctcacagccgcgttgtattatgcatgaaggtaatcctcctatcactaagttttctaactgctcatacggggacttctgggagtacaccgtggagcggaccaaatgtctgctagagactgtgcacaccaaagacattttcaatgtgaaaaggtgcggtaatggagtggtcgaggagggagaagagtgcgactgcggccctcttaagcattgtgccaaagacccatgttgtctctctaattgcactctcaccgacggctctacctgtgcattcggtctttgctgcaaggattgcaaatttctacctagcggcaaagtgtgccgaaaagaggttaatgagtgtgacctgccagagtggtgtaatgggacttcccacaaatgtcccgacgatttttatgttgaggatggtattccttgcaaagaaagaggctattgttacgaaaagtcttgccatgacagaaacgaacagtgtcgaagaattttcggagccggtgccaatactgcgtccgagacgtgctacaaagaattgaataccctgggcgatagggttggccattgcggcatcaagaacgccacatatatcaagtgtaacatcagtgacgtgcagtgcggtcgcatccagtgtgaaaatgtgacagagatccccaacatgagcgaccacacgacagtccattgggcccgattcaatgacatcatgtgttggtcgaccgactaccatctgggcatgaaggggcctgacattggcgaggttaaggatgggactgaatgcggcattgaccatatctgtatccaccgacactgtgtccacataaccatcctgaatagtaattgctcccctgctttttgtaacaaacgggggatctgtaataataaacaccactgccactgcaactacctgtgggacccacctaactgtctgatcaaggggtacggtggtagtgtggattcaggaccgcctcctaaaaggaagaagaaaaaaaagttttgctatctgtgcattctgcttctgatcgtcctcttcatattgctgtgctgtctctaccgtctctgtaagaagtccaaacccatcaagaagcagcaggatgtgcagactccctccgccaaagaggaggagaagattcagcggcggccacacgaattgccaccccagtcacagccctgggtcatgccatcccagtcacaacctcctgtcactccatctcagagccatccgcaggtcatgcccagccagagccagccccctgttacaccctctcagtctcagcccagagtgatgcccagccagtctcaaccaccagtgatgccttctcagagccacccacagctaacaccatcacagtctcagccccctgtgacaccgagccagcggcaaccccaacttatgccatcgcagtctcagccaccagtaaccccttcttag

SEQ ID NO: 178009 - DNA, 2463 bp, Artificial Sequence
  Description of Artificial Sequence: Synthetic coding sequence
atgaagatgctgctgctgctgcactgcctgggcgtgttcctgagctgctctggccatattcaggatgagcatccacagtaccactcaccgcccgacgtcgtcattcccgtacggattaccggcacgaccagaggtatgacacctccagggtggctgtcatatatactgccttttggggggcagaagcacatcattcatatcaaagttaaaaagctcctatttagtaaacacctgcccgtgttcacatacaccgatcagggtgcgattttagaggatcaaccattcgtgcagaataactgttactatcatgggtacgtagagggggatcccgagagcctcgtttcattgagcacgtgttttggaggcttccaggggatccttcaaattaatgacttcgcctacgaaattaaacctctggccttctcaacaacatttgaacatctcgtctataaaatggatagtgaggagaagcagttctctacgatgagatctggctttatgcagaacgagataacctgcaggatggaatttgaagaaatcgataattctacccagaaacagtcatcctacgtaggatggtggatacacttccgcatcgtggagatcgtggtggttattgataactacttgtacatacggtacgaacggaatgactcaaaacttcttgaagacctgtacgttatcgttaatatcgtcgatagtatccttgacgtcataggggtgaaggtgctcctgttcggtctcgagatctggactaataaaaatctcatcgttgtggatgacgtgaggaagtcggtgcacctgtactgtaaatggaagagcgaaaacatcacccccaggatgcaacatgacacctctcacttgtttactacccttggtctcagagggttgtccggaatcggagcctttcgtggcatgtgcactcctcaccggtcttgcgcgattgttacgttcatgaataaaacccttggtacattttctatcgctgtggcgcatcatttaggacataatctggggatgaaccacgacgaagacacctgcaggtgcagccagccgcgctgtatcatgcatgaagggaacccgccgataactaagttctccaattgctcctacggcgatttttgggagtatacagtcgagcgcactaagtgcttgcttgagacggttcatacgaaggatattttcaacgtgaagcgatgcggaaacggagttgtcgaggagggagaagaatgcgattgtggaccattgaaacactgtgctaaggatccctgctgcctctccaactgcactctcactgacgggagcacctgcgctttcggtctgtgttgcaaagactgtaagtttctcccctctggtaaagtgtgcagaaaagaggtgaacgagtgcgacctgccagaatggtgcaacggtacctcccacaagtgtccagatgatttttacgtggaggacgggataccctgtaaagagcgcgggtattgctatgaaaagtcatgtcacgacagaaacgagcaatgcaggcgaatcttcggcgcaggtgccaacaccgcaagcgaaacctgctataaagaactaaacacattgggggaccgggtggggcactgcggaattaaaaatgccacatatataaaatgtaacatatctgatgttcagtgtggacggatccagtgcgaaaatgtcaccgagatacctaatatgagcgatcatactactgtgcattgggcaagattcaacgacattatgtgctggagtacggattaccatcttggtatgaaggggccagacattggggaggtaaaagatggaactgaatgcggaatagatcatatctgcatccatcgccactgtgtgcatattactattcttaactcaaattgcagtcccgctttttgcaacaagagggggatttgcaataacaagcatcactgtcactgcaattatctgtgggaccccccgaactgtttaatcaagggatacgggggatctgtggacagtggaccacctcccaaacggaagaagaaaaaaaagttctgttatctgtgtattcttttgctcatcgtgctatttatccttttgtgttgtctgtatcgtctatgtaagaaatccaaacccattaagaaacagcaagatgtccaaacaccatccgccaaggaggaggagaaaatccagcgtcgcccacacgagctgcccccccagagccagccctgggtcatgccttcacagagccagccccctgtcacacctagccagagccatccacaggtgatgcctagccagtcccagcctcccgtgactccatcacaaagtcaacctcgcgtaatgccctcccaaagtcaacccccggtgatgcctagccagagtcatcctcagttgactccatcacagagccagccacccgtcacgccctctcaaaggcaacctcagctcatgcctagccagtcacagccacctgttactccctcctag

SEQ ID NO: 178010 - DNA, 2463 bp, Artificial Sequence
  Description of Artificial Sequence: Synthetic coding sequence
atgaagatgctgctgctgctgcactgcctgggcgtgttcctgagctgctcgggccacatccaagacgaacacccacagtaccattctccacctgacgttgtgattccagtgcggattacaggaacaacccggggcatgacccccccaggctggctgtcatatattctcccctttggtgggcaaaaacatatcattcacatcaaagtcaaaaaattgctcttcagtaagcacctgcccgtgttcacgtatactgaccaaggggccattctcgaggatcagccctttgtgcagaacaactgctactaccatggctatgtggaaggagacccagagagtctcgtttccctatccacctgctttggcggattccagggcattcttcagatcaatgattttgcatatgaaatcaagcctttagcattttctactactttcgagcacttagtgtataaaatggactctgaggagaaacaattctctacaatgcgtagcggctttatgcaaaatgaaatcacttgtaggatggagtttgaggagatagataacagcacacagaagcagagcagttatgttggatggtggatccattttagaatagtcgagatcgttgtggtcattgataactacctctacattagatacgagcgtaatgacagtaagcttctggaagacctgtacgtgatcgtgaacatcgtggactcaattctcgatgtgatcggggtcaaggtgcttctgttcgggctggaaatctggacaaacaagaatctgatagtcgtggacgacgtgcggaagagtgtacacctatattgcaaatggaagagcgagaacattacacctcgcatgcaacacgatacgagccacctgttcaccacgctgggtttaagaggattgagcggcatcggcgcattccgaggcatgtgtacaccccatagatcttgtgctatcgtgacgttcatgaataagacactcggaaccttttcaattgccgtggcacatcacctcggtcataatttaggtatgaatcacgatgaggatacatgtcgctgttcccagccccggtgcatcatgcacgagggcaacccccccattactaagttttccaactgttcctacggtgacttttgggagtatacagtggagaggacgaaatgtctcctcgagacggtccacaccaaagatatattcaatgtaaaaaggtgcgggaatggggtggtggaggaaggcgaagagtgtgactgtggcccactgaagcattgtgccaaggatccctgctgcttatccaactgcacgctaactgacggtagcacctgcgcattcggcttgtgttgcaaagactgcaagttcctaccaagtggcaaagtgtgtcgcaaggaggttaacgagtgcgacctgccagagtggtgtaatgggacctcccacaaatgtcctgatgacttttatgtggaggacgggattccctgcaaagagcgggggtactgctacgagaagagctgtcacgaccggaacgagcagtgtcggagaatattcggtgctggcgctaataccgctagtgagacctgctacaaggagctaaatacattgggggacagagtaggccattgtggtattaagaatgcgacttatatcaaatgtaatatcagcgatgtccaatgcggacgaattcagtgcgagaacgtcactgagattccgaacatgagcgaccatacaaccgtccactgggcgagattcaacgacatcatgtgttggtctactgattaccatctaggaatgaagggtccagacatcggcgaagttaaagacgggaccgaatgtgggatcgatcacatctgtatccacaggcactgtgtccatataactatcctcaacagtaactgcagccctgcattctgcaacaagcgtggaatatgtaacaataagcaccactgccactgtaactacctttgggatcctcctaactgcctcattaaagggtacgggggatcagttgattcaggtccacctccaaagcgtaaaaagaaaaaaaaattttgttacctctgcatcctcctgctgattgtattattcattctcctgtgttgtctttatcgactgtgcaaaaaaagtaaaccgattaagaagcagcaggatgtacagacaccgtccgccaaggaggaagaaaagattcaaaggcggccccatgagctacccccacagtcccagccctgggtgatgccaagccagtcccagccgcctgtgacccccagccaatctcatccacaggtgatgccctctcagagccagccacccgttacaccttctcagagccagcctagagttatgcccagtcagtcacaaccccccgtcatgccatctcagtcccatccccagttgacaccctcccagagtcagccaccagtaacccctagccagcggcagcctcaactgatgccatcccaaagtcagcctccagtaaccccctcatag

SEQ ID NO: 178011 - DNA, 135 bp, Artificial Sequence
  Description of Artificial Sequence: Synthetic coding sequence
atgaagatgctgctgctgctgcactgcctgggcgtgttcctgagctgttccggacatatccaggatgaacatccgcaatatcactctccccccgatgtggtgatcccagtaagaatcacagggaccacaaggtag

SEQ ID NO: 178012 - DNA, 273 bp, Artificial Sequence
  Description of Artificial Sequence: Synthetic coding sequence
atgaagatgctgctgctgctgcactgcctgggcgtgttcctgagctgttcgggccacatccaggacgagcacccgcagtaccactctccacctgacgtcgtcatacctgtcagaatcaccggtaccacgcgaggtatgacacccccaggatggttgtcatatattttacccttcggtggccagaagcatatcatacacataaaggtgaaaaaattgttgtttagcaagcacctgcccgtttttacctacacagatcagggtgcgattctttag

SEQ ID NO: 178013 - DNA, 45 bp, Artificial Sequence; identical to SEQ ID NO: 71819
  Description of Artificial Sequence: Synthetic coding sequence

SEQ ID NO: 178014 - DNA, 2463 bp, Artificial Sequence
  Description of Artificial Sequence: Synthetic coding sequence
atgaagatgctgctgctgctgcactgcctgggcgtgttcctgagctgctccggacacatccaggatgaacacccacagtatcacagccctcccgatgtagtcattccagtgaggattacaggtacgacgaggggcatgaccccacctgggtggcttagctacattctgcccttcggggggcagaagcatattatacacattaaagtgaagaaattactgttctctaaacatttgccagtgtttacctacaccgaccagggagccatccttgaggaccagccgttcgttcagaataactgttattatcatggctacgtggaaggggaccctgagagtttggtttcattatccacctgcttcggagggttccagggaattctgcaaataaacgattttgcttatgaaatcaaaccactcgctttctctaccaccttcgagcatctggtgtacaagatggactcggaagagaagcagttctctaccatgagatccggttttatgcaaaatgaaataacgtgcaggatggaatttgaagaaattgataacagtacccagaagcagagctcctatgtcggttggtggatccatttccgcatcgtggagatcgtcgtcgtgatcgacaactatctctacattaggtacgaacgcaacgattccaaactgctcgaagatctgtatgttatagtcaatatagttgattcaatcctggatgtgataggcgtcaaggtgctcctgtttggactggagatttggacgaataaaaacttaattgtcgtcgatgatgtccgcaagtcggttcacctgtattgtaagtggaagtcggagaacatcacacccaggatgcagcacgacacatcgcacctgtttacgacactgggcctgcggggtctgagcggtatcggcgccttccgggggatgtgcacccctcataggtcttgtgctatcgtgaccttcatgaataaaacactggggacattttccattgccgtggctcatcaccttgggcataacctggggatgaaccacgacgaagatacctgccgctgcagtcagcccagatgtatcatgcatgaagggaacccgcctattaccaagttctccaactgcagctacggggatttctgggagtatactgtggagagaacaaagtgcctgttggaaaccgtgcacaccaaagacatctttaacgtgaagcgatgcggaaacggagttgtcgaagaaggggaggagtgtgattgtggcccactgaagcactgtgccaaggatccctgttgtctttccaactgtacactcaccgatggctcgacttgtgcgttcggtctgtgctgcaaagattgtaaatttctgccttccgggaaggtatgccgaaaggaggttaatgagtgtgacctgcccgaatggtgcaacgggacatcccataagtgtcccgacgacttctatgtggaagacggcatcccctgcaaggagcggggttactgctatgagaagtcgtgtcacgaccgtaacgagcagtgtagaagaattttcggagccggagcaaatacagccagcgaaacctgctacaaagagctgaatactctcggcgatcgggttggtcactgtggcatcaagaatgccacatatattaagtgtaacatatctgatgtccagtgcggccgaatccagtgcgagaatgtgaccgagattcccaatatgtcagatcataccaccgttcactgggctcgatttaacgacatcatgtgctggtcaaccgactatcatcttgggatgaaggggcccgacattggcgaagtgaaagatggaacagagtgcgggatcgatcacatttgcatacaccgccactgcgtgcacattacaattctgaacagtaattgtagccctgccttttgcaacaagcggggaatttgcaataacaaacaccattgccactgcaattatctgtgggatcccccaaattgcctcattaagggatacggcgggtctgtcgattctggcccccctccaaaacgaaagaaaaaaaagaaattttgctatttgtgtatcctactgttgatagttctctttattctgctgtgctgcctatacaggttgtgcaaaaaaagtaagcctattaagaagcagcaggatgtccagacaccttcagccaaagaggaggagaaaatccaacggagaccccacgaattgccacctcagtcacaaccttgggtgatgccttctcagtcccagccaccagtcaccccatcgcaaagccatcctcaggtgatgccctcccaaagtcagccccccgtgacacctagccagtcacaacctcgggtcatgccaagtcagtcacaacccccggtcatgccgtcccagtcccacccgcagcttaccccatctcaaagtcagccacccgtgaccccatctcagcggcagcctcagttgatgccaagccagtctcagcctcccgtgactccctcttag

SEQ ID NO: 178015 - DNA, 2373 bp, Artificial Sequence
  Description of Artificial Sequence: Synthetic coding sequence
atgcggagcgtgcagatcttcctgagccagtgccggctgctgctgctgctggtccctacaatgctgctgaaatcactgggggaggatgttatattccaccctgaaggtgagtttgactcctacgaagtgaccatccccgagaagctttcattcagaggggaagtccagggagttgtcagtccggttagctatcttctgcagcttaagggaaagaaacatgtgctgcacctctggcctaagcgcctcttgctgcccaggcatctccgggtgttctccttcacggaacacggagagctgttagaggaccacccctacatccctaaggattgcaactatatgggtagcgtgaaggagagtcttgattccaaggccaccatctccacctgtatggggggcctgcgcggagtctttaacatagatgcaaaacattatcagattgaaccccttaaagcctcaccatcattcgagcacgtcgtttacctcctgaaaaaggagcaatttgggaaccaggtgtgtggtttgagtgatgacgaaatagagtggcagatggccccctacgaaaacaaagcccggttaagggatttccccggcagctataagcaccccaagtatctggaactcatcctgctgtttgaccagtctcgatatcgcttcgtgaacaacaacctgtcccaggtgatccacgatgccatcttactgactgggatcatggatacttatttccaggacgttaggatgaggatccatcttaaagcgctcgaggtctggacagacttcaataagatccgcgttggctatccagagctggccgaagtgctgggcaggttcgtgatttataaaaagtccgtgttgaatgcccggctgtctagcgattgggcacatctctacctgcagaggaaatacaatgacgcgctcgcctggtcattcggcaaggtatgttccttagagtatgccggttctgtgtcaaccctcctggacactaacattctagctccagccacatggtcagcccacgagctcggtcacgctgtgggcatgagtcatgatgaacagtattgccagtgtagagggaggctgaactgtatcatgggatccggaagaaccggattcagcaattgttcctacattagtttctttaaacatattagcagtggagcaacatgcttaaataatatacccggcttgggttacgttctgaagaggtgcggaaacaaaatcgtggaggacaatgaagaatgcgactgtggcagcacagaagagtgtcagaaggatcgatgctgtcagtctaattgtaaactgcagcctggggccaactgcagcatcggcctgtgttgccatgactgtcgatttcgtccatcggggtacgtgtgtcgtcaggagggtaacgagtgtgacctggccgagtactgtgacgggaactcttcaagctgcccaaatgacgtgtataaacaggacggcacaccctgcaagtacgaggggcggtgctttagaaaggggtgcaggtcgagatacatgcaatgtcaatcaatcttcggtcctgatgcaatggaagccccaagtgagtgctatgatgcagtgaacttgatcggcgaccagttcggaaattgtgagattacaggaattcggaattttaaaaagtgcgagtcggcaaattcgatctgtggaaggctccagtgcattaacgtcgaaacgatccccgaccttccggagcacaccacaattatctccactcatttacaggccgagaatttaatgtgttggggaacaggttatcacttgtctatgaagcctatgggaatccccgacctgggtatgatcaacgatggtacctcctgcggcgaagggcgagtgtgcttcaaaaagaattgtgtcaattcttcagtcctgcagtttgattgtctgcctgagaagtgcaacaccaggggagtttgcaacaacaggaagaactgccactgtatgtacggatgggccccccctttctgcgaggaagtggggtacggcggctccattgactctggtcctcccggcctgctacgcggcgccattccttcaagtatatgggtcgtctccatcattatgttcaggctaatactactcattctctcagtggtgtttgtgttttttaggcaggtgatcgggaaccatctgaaaccgaagcaagagaagatgcctttgtcaaaggcaaaaacagagcaggaagaaagcaagacgaagactgtccaagaggagagtaaaaccaaaaccgggcaggaagagagcgaagccaaaacaggacaagaggagtctaaggccaagaccggacaagaggaatccaaggccaacattgaatctaagaggcccaaagctaagtcagtcaagaaacagaaaaaatag

SEQ ID NO: 178016 - DNA, 2346 bp, Artificial Sequence
  Description of Artificial Sequence: Synthetic coding sequence
atgcggagcgtgcagatcttcctgagccagtgccggctgctgctgttactggttcctactatgctgctgaaatcattgggagaggatgtgatattccaccccgagggcgaatttgattcttacgaggtgactatccccgagaagctgagctttcgaggagaggtgcagggggtggtgtctcccgtttcatatctcttgcagcttaaagggaaaaagcatgttctgcatctatggccgaagagactgttactgccccgtcacctacgcgtattctcctttaccgaacatggcgagctgctggaggaccatccttacatccctaaagactgcaattatatgggttccgtgaaggaaagtcttgattctaaagcgacgatctctacatgtatgggtggattgcgcggcgtgttcaacatagacgcaaaacattatcagatagaaccacttaaggcgtccccatctttcgaacacgtcgtgtacttactcaaaaaggaacagttcggcaaccaggtctgcggactttccgacgatgaaattgagtggcagatggctccgtatgaaaacaaagcgagacttagagacttcccaggtagctataagcaccccaagtacctggagctcattctactgtttgatcagtcacggtacaggttcgttaataacaaccttagccaggtcattcatgatgcaattctgttaacaggaatcatggacacttatttccaggacgtgaggatgcgaattcatctgaaggctctcgaagtgtggactgacttcaacaaaatcagggttggctatccggagctggctgaggtgctaggcagattcgtgatctataagaaatcggtcctgaatgcacgcctctcatccgattgggctcatttatacctacagcgcaaatacaacgatgccctggcttggagcttcggcaaagtttgttcactcgagtatgccggctctgtctcaacacttctggataccaatatccttgctccagccacctggtcagctcacgagctgggacacgctgtaggaatgagccacgacgagcagtattgccagtgtcggggacgactgaactgcattatgggttctgggagaactggtttttcaaattgctcctatataagtttcttcaaacacatctctagtggtgccacctgccttaataatatccctgggttgggatatgttctcaaacggtgtgggaacaagatagtggaggataacgaggagtgtgactgtggtagtaccgaagagtgtcagaaggacaggtgttgtcaatctaactgcaagctccaacccggcgcgaattgcagtattggcctgtgctgtcacgactgtcgctttcgaccctcgggttatgtgtgccggcaagaaggaaatgaatgcgacctcgccgagtattgtgacggtaactccagcagttgtccaaatgatgtttataaacaggatgggaccccctgcaagtacgaaggacggtgctttaggaagggatgtcgcagcagatatatgcagtgtcagagtatatttggtccggacgccatggaggccccttccgagtgttatgatgcagtgaacctgatcggtgaccagtttggaaactgcgaaatcaccgggattcgaaactttaagaaatgtgagagcgccaatagtatctgtggcagactgcaatgcatcaacgtcgaaaccatccccgatttgcctgaacataccacgatcatttccacacacttgcaggccgaaaatcttatgtgctgggggactgggtaccacctctccatgaaacccatgggtatacctgacctgggcatgatcaatgatggaacatcttgcggggagggaagagtatgttttaagaaaaactgcgtcaattcgagtgtgctccagttcgattgcctccccgaaaagtgcaatacccgcggagtgtgtaataatcgcaaaaactgccattgcatgtatggctgggccccacccttttgcgaagaggttggctacggtggatccatcgacagtggccccccaggtctgctacgcggggccattccaagctcaatctgggtcgtttctatcattatgtttcggctgattttgttgatcctttctgtggtcttcgtgttttttcggcaggtcattggaaatcacctaaagcccaagcaagaaaagatgcctctatctaaggctaagaccgaacaggaggaaagcaagaccaagactgtgcaggaagagtccaagaccaagacagggcaggaagagtcggaggcaaaaaccggtcaggaggagtcaaaagctaacatcgagtctaaaagacctaaggctaagagtgttaagaaacaaaaaaaatag

SEQ ID NO: 178017 - DNA, 540 bp, Artificial Sequence
  Description of Artificial Sequence: Synthetic coding sequence
atgggctggcggccccggcgggcccggggcacccccctgctgctgctcctcttgctcttgttgctgtggcccgttccaggcgccggggtcctccagggacacatacccggacagcccgtgacaccccactgggtgctcgacggccagccttggcggacagtcagtctggaggaaccagtcagcaagcctgacatgggcctggtcgctttagaggctgagggccaggagctgctgttggaactcgagaaaaaccagctgctggcaccgggctatattgagacccactacgggcctgacggacagcctgtggtgctcgcccccaaccataccgttcgctgctttcacggtctgtgggatgcacctcccgagggcagacgtgaggcccgtcgcactcgtaagtatctggagctctacattgtagcagatcatacactatttctcacaaggcatcggaatctgaaccacaccaagcagagattattggaagtagcaaactacgtcgaccaggtggtgaactctgctggggacgcccacggttag

SEQ ID NO: 178018 - DNA, 336 bp, Artificial Sequence
  Description of Artificial Sequence: Synthetic coding sequence
atgggctggcggccccggcgggcccggggcacccccctgctgctgctgctgctgttactgttgttgtggcccgtgcctggagccggcgtgcttcagggacatatacccggccaacctgtgacacctcactgggttctggatggtcagccttggagaacagttagtttggaggaaccggtctcaaagcccgacatgggactcgtggcactagaagcggagggccaggaactgctgctggaactcgaaaagaaccagctgcttgctccagggtacatagaaacccattacggccccgcacaggagtgccgcgatctctgctgttttgcccataactag

SEQ ID NO: 178019 - DNA, 2364 bp, Artificial Sequence
  Description of Artificial Sequence: Synthetic coding sequence
atgggctggcggccccggcgggcccggggcacccccctgctgctgctgctgctccttcttcttttatggcctgtgccgggggccggggtgctccagggtcacattcctggtcaacccgtgactccccactgggtactggatgggcagccgtggcgcacagtttcactagaagagcctgtatccaagccggatatgggcctggtggcgctagaggccgaaggacaggaactcttacttgagttggagaagaaccatagacttcttgcccccggatatatcgagacacactacggccccgacggccaacccgtcgtgctggcccccaatcacacggatcactgtcactatcaaggaagagtccgcggcttcccagactcttgggtagtgctctgtacctgttccggcatgtctggcctcattacgctttcgagaaatgcatcatattatctcagaccctggccccctagaggaagcaaggactttagtactcacgagattttccgcatggagcaactgctgacttggaagggaacctgcgggcaccgggacccggggaataaggcaggcatgaccagcctgccaggcggtccacaatccaggggaaggcgggaggctcgccgcacaagaaaatacctggagctttacattgttgctgatcacacgctgtttttaacccggcacagaaacctcaaccatacaaagcaacgccttctcgaggtcgctaattacgttgatcagctactaaggacactggatatacaggtcgcactgactggactcgaggtctggacagagcgggatcgcagcagagttacccaagatgctaatgcaacgttgtgggcattcttgcagtggagaaggggactgtgggcacaacgtccgcatgattctgcccaactgcttaccggccgggcatttcagggggccactgtgggattggcgccagttgagggcatgtgtagggcggaatcatctggcggcgtgagtacggatcattctgagcttccaattggagctgcagctacaatggcacacgaaattggacattcgttgggtttatctcacgatcctgatggctgctgtgtcgaagctgctgcagagagcggcggttgcgtcatggccgccgccacaggacatccatttcctagggttttctcagcctgctcacgccgccaactgcgggccttttttaggaaagggggtggagcctgtttgagcaacgcacctgatcccggcctgcccgtgcctcctgctttgtgtggcaacggtttcgtagaggccggtgaggagtgtgattgcggcccggggcaggagtgtcgtgatctttgctgtttcgcacacaactgttcgctgcggccaggcgcacagtgcgctcacggagattgctgtgtgcggtgcctgttaaaacccgccggggcactttgcagacaggctatgggggactgcgatttgcccgaattctgtacagggaccagttcgcactgtcctccggacgtttatctactggacggctcaccatgcgcccgcggaagcgggtattgctgggatggggcatgcccaaccctggagcagcaatgtcagcagctgtgggggccaggcagccatcccgcaccagaagcgtgtttccaggtggtcaacagtgctggagacgcacatggcaattgcggacaggattcagagggacatttcctaccatgcgctggtagagatgctctctgcgggaaacttcagtgccagggcggtaagccaagtctgctggcgccccacatggtgcccgttgatagtacggtgcatcttgacggccaggaggttacttgccggggtgcattagccctgcccagtgcacaactggacttacttggacttggtctcgtggagccggggactcagtgtggacctaggatggtttgcaattcaaaccataattgtcactgtgcacctggctgggcccctccattttgtgacaaacccggtttcggagggtctatggattctgggccggtgcaggctgaaaaccacgacaccttcctccttgctatgctgttgtccgttcttctgcccctcctgcctggcgcagggcttgcttggtgctgctaccgactccccggagcccacttacagcgttgttcctggggctgccgtcgagaccccgcgtgctcgggccccaaggacgggccccatcgggaccaccccctgggcggcgtgcaccccatggaactgggcccaacagcgacgggacagccctggcctttggaccctgaaaatagtcacgaaccttcttcccaccccgagaaacccctccccgcagtgagtcccgatccacaagccgatcaggtccagatgccgcgcagttgcctgtggtag

SEQ ID NO: 178020 - DNA, 2442 bp, Artificial Sequence
  Description of Artificial Sequence: Synthetic coding sequence
atgggctggcggccccggcgggcccggggcacccccctgctgctgctgctgttgttgcttctgctttggccagtgccaggcgccggtgtgctccagggacatattcccggtcagccagtgacccctcattgggtgcttgatggccagccatggaggaccgtgtcgctggaagaacccgtgtcgaagcctgacatggggcttgtggctcttgaggccgagggacaggaacttctgctggaactggagaaaaaccatcgtcttctcgcacccggatacatagagacccactatggacccgatggacagcctgtggtgctcgcgcccaaccatacagaccattgtcattaccaaggccgcgtgagaggttttcccgattcctgggtggtgctctgtacatgtagcgggatgtctggtctgattactctgagccgtaacgcctcttactacctgcgcccttggcctccaaggggcagcaaggacttttcaacgcacgagatctttcgcatggaacaactgctgacttggaaagggacctgtggccacagggaccccgggaacaaagccgggatgacatcactaccaggaggtcctcaaagtaggggccgccgcgaagcccggcgcacacgtaagtatttagagctctacatcgtggccgatcacaccttatttttgacacgacatcgtaacctaaaccacacaaagcagagactgctcgaagtggccaactatgttgaccagctgctccgaactttggatatacaggtggctttgactggcctggaggtgtggacagagagggatcgaagccgggtgactcaggacgctaatgctaccctctgggcgtttttacagtggaggcggggcctgtgggctcagcggccacacgattctgcacagcttctgactggtagggcctttcagggcgccactgttgggttggcaccagtggagggcatgtgccgggctgagtcaagtgggggcgtgagcacagaccattccgaactgcccatcggggctgctgccacaatggcccacgagatcggccactccttagggctgtcccacgaccccgacggctgttgtgtggaggccgccgccgagtccggaggctgcgttatggcagcggccaccggccatcctttcccgcgggtgtttagcgcctgcagcagacgacagttacgagccttcttccgtaaaggcggcggagcctgtctgtccaatgcccccgaccccggcctgcccgtgcctccagcactgtgtgggaacggatttgttgaggccggggaagaatgtgactgtggtcctggacaggaatgcagagatctatgctgctttgctcacaactgctccctgagaccaggagcacaatgcgcccacggagactgttgcgtaaggtgtcttctgaagcctgcaggggccctgtgccgtcaggccatgggagattgtgatctaccggagttttgcaccgggacgtcctcccactgcccaccagatgtgtatctgctggacggttccccatgtgcacgcggaagtggttactgttgggacggcgcctgcccgacccttgaacagcagtgccagcagctctggggaccaggaagccaccctgcgccagaagcctgcttccaggtagtaaatagcgcgggagacgcacacggcaattgtgggcaggactccgagggacacttcctgccctgcgcaggcagggatgccctatgcggaaagttgcaatgtcaaggtgggaaaccttcactgttggcccctcatatggtcccggttgattctactgtgcacctcgacggacaggaggtgacctgccgaggtgctctggctctaccctccgcgcaactggatctgttaggacttggattggttgaacccgggacacaatgtggcccacggatggtgtgccaatccaggaggtgtcggaagaatgcattccaggaacttcagcggtgtcttacagcttgtcattctcacggagtgtgtaattccaatcacaactgccactgtgccccaggatgggctcccccattttgcgataagcccgggttcggtggaagtatggacagtggtccagtccaggctgagaaccatgataccttcttactggccatgctcttatccgtgctgctgcctttgctccctggagcaggattggcatggtgctgttatcggctgcccggagcccacctccagagatgctcttggggttgccgccgtgaccctgcctgttccggacctaaggatggacctcatcgggaccaccctttaggaggggttcatcctatggagctaggccctactgccacgggtcagccatggcccttagacccagaaaacagtcacgaaccctctagccatccagagaaacctctgcccgccgtctcaccagatccccaggctgaccaggtacagatgccacgcagctgtctatggtag

SEQ ID NO: 178021 - DNA, 417 bp, Artificial Sequence
  Description of Artificial Sequence: Synthetic coding sequence
atgggctggcggccccggcgggcccggggcacccccctgctgctgctgctccttctcttgctgctgtggccagttccaggagctggcgtgctgcagggacacattccggggcagcctgttaccccccactgggtacttgacggccaaccctggcgaaccgtctcactggaagagcctgtttctaagccagacatgggcctcgtggctctggaggctgagggacaggagctcctactcgagttagaaaagaatcatagactgctggcacccgggtatatcgaaacacactatggtcctgacggccagccagtggtgttggctccaaatcacactgtccgatgtttccacggactctgggatgcacccccagaagtgccgccgcatcattcatacccgtactcgtcgctgcattcctag

SEQ ID NO: 178022 - DNA, 543 bp, Artificial Sequence
  Description of Artificial Sequence: Synthetic coding sequence
atgggctggcggccccggcgggcccggggcacccccctgctgctgctgttgttacttctcttgttgtggccagtccctggagccggagtcctgcaggggcacataccaggacaacctgtcacgccccactgggtactcgacgggcagccctggcgtactgtcagccttgaagaacccgtgagcaaaccagatatggggctggtcgctctagaggccgaagggcaggagttgctactagagctagaaaagaaccaactgctggcacccggatacatcgagacacactacggcccagacggccaacctgtggttcttgccccaaaccacaccgtccgctgtttccatggcctgtgggacgcgccccctgaggggagacgtgaggcacgacggacacggaagtatttggagctctacatagttgccgaccatacactcttcctgactagacaccgaaatctgaaccataccaagcagcgcctattggaggttgcaaattacgtggatcaggaatgccgggatctgtgttgcttcgcccataattag

SEQ ID NO: 178023 - DNA, 2439 bp, Artificial Sequence
  Description of Artificial Sequence: Synthetic coding sequence
atgggctggcggccccggcgggcccggggcacccccctgctgctgcttcttcttctcctactgctgtggccagttcccggcgccggagtgctccagggacatattccaggacagcccgttacaccacattgggttctagacggccagccctggcggacggtttcactcgaagaaccagtcagcaaaccagatatggggttggtcgccctggaggcagagggccaggaacttctcttggaactggagaaaaaccataggttgttggccccagggtatatcgagacacactatggccctgacggacaacccgttgtcctggccccgaatcacactgaccattgtcactatcagggccgcgtgagaggttttcccgattcatgggtagtcctgtgtacatgttccggaatgagcgggttgatcactttgagtcgaaacgcttcgtactatttgagaccatggcctccccgaggctctaaagacttctcaacccacgaaatattccgcatggaacaattgctcacttggaaggggacctgtggacatagggaccctggcaataaggccggcatgacctcccttccagggggtccccagtcgcgagggaggagggaagcccgccgtacaagaaagtatctggaactctatatagtggccgaccacaccctgttcctgacccggcatcgcaacctgaaccacaccaagcagaggttgcttgaggtagccaattacgttgatcagcttctgagaacattagatatacaggtggctttgaccggcttagaagtgtggacagaaagagaccggagcagggtgacccaggatgccaatgctaccctctgggcattcttgcagtggcggcggggactgtgggcgcaaagaccgcacgattccgcacagcttctgactggaagggcgttccagggagctacagtgggcctcgcccctgtggagggcatgtgtagggcggaaagcagcggaggagttagtaccgaccacagtgagctacctattggggctgcggccaccatggcacatgagatcggtcattctctgggcctgtctcatgatcctgatggctgttgcgtggaggcggcagcggagtcaggaggctgtgttatggcagccgcaactggccaccccttccccagagttttctcagcatgctcaagacgccaactaagagccttctttcggaagggaggcggtgcctgcctttccaatgcacccgaccccggcctcccagtgcctcccgcactctgcgggaatgggtttgtcgaagccggagaggagtgtgattgtggtcccgggcaggagtgccgggatctgtgctgcttcgcacacaattgcagtttaaggcctggagcacagtgcgcacatggggactgctgtgtccgctgccttcttaaacccgctggggcgctatgccgccaggcaatgggggattgtgatcttccggaattctgcacaggaactagctcacactgcccacccgatgtctaccttctggacggctccccctgcgcacgcggcagcgggtattgttgggatggcgcttgccctacgctggaacaacaatgccagcagctgtggggccctggtagccatcccgcaccagaggcgtgcttccaggtggtgaactccgccggagacgctcatgggaattgcggccaagacagcgaggggcactttctgccctgcgctgggcgggacgccctctgtggaaagctacagtgtcaaggggggaagccttcgctcctcgcgccccacatggtgcccgtagactccacagtgcatttagacggccaggaagtgacatgtcggggggccctggcactgcccagcgctcaacttgatctactgggcttagggctagtagagcccggcacccaatgcgggccaaggatggtatgtcagtcaaggaggtgcagaaaaaacgcattccaggagctgcagagatgccttaccgcttgccactcccacggcgtttgtaattccaaccacaactgtcactgtgcacccggatgggcccctccattttgtgacaaacccggctttggcggatctatggactccggcccagtgcaggccgaaaatcacgacacattcctcttggccatgctgctgagcgttctactgccactgcttcccggcgccggcctcgcctggtgctgctataggttgcctggagcccaccttcaacgctgctcttggggctgtaggagggacccagcatgttctggtccaaaagatggaccacacagagaccatccacttggcggagtgcatcccatggaattgggtcccacagccacagggcagccatggcctctggatccggagaattcacacgagcctagttctcacccggagaagccgctcccagccgtatccccggatccacaggaccaggtccagatgcctcgctcctgtctctggtag

SEQ ID NO: 178024 - DNA, 456 bp, Artificial Sequence
  Description of Artificial Sequence: Synthetic coding sequence
atgggctggcggccccggcgggcccggggcacccccctgctgctgctcctactgttgctcctactgtggcccgtaccaggtgccggggttttgcaggggcacatcccaggccagcctgtgaccccccattgggtcctcgatggacagccctggcggacagtgagtctcgaagaacccgtgagtaagcccgatatggggctagtggctctggaggccgaagggcaggaacttctgctggaactcgaaaagaatcaggacgctctctgcggtaagttgcaatgccagggtgggaaaccgagtctactggcgcctcatatggttcctgttgactccaccgtgcatctggacgggcaagaagtgacttgccgaggagccttggctctccctagtgctcagctggatctgttggggctaggtctggtggaacccggtactcagtgcggtccacggatgtag

SEQ ID NO: 178025 - DNA, 2079 bp, Artificial Sequence
  Description of Artificial Sequence: Synthetic coding sequence
atgggctggcggccccggcgggcccggggcacccccctgctgctgttgttgctgctgctgctattatggccagtccccggggccggcgtcctgcagggtcatattcccggccaaccagtgaccccccattgggtgctcgatgggcagccctggagaactgtgtcactggaggaacccgtgtccaagcctgacatgggcttggttgcactagaagccgagggtcaagagctgttgctggagctcgagaagaaccatcgcttgctcgctccaggctatatcgagacacactatgggcctgatggtcaacccgtagttttagcacccaatcataccgaccactgtcactaccagggcagggtgcgcgggttcccggattcctgggtggtcctctgtacctgtagcggcatgtccgggcttattacactgagcagaaatgcttcttattatctgaggccctggcccccacggggctccaaggatttcagtacccacgagatctttcggatggagcagctcttaacgtggaaaggaacttgtggccatcgcgacccaggcaacaaggctggcatgacgtccctgccaggcggtccgcaatcccgcggccggcgagaagctcgaagaacaagaaaatacctcgagctgtacatcgtggccgatcacactctgtttctcaccaggcatcgcaatttaaaccacaccaaacagcgtttgcttgaagttgcaaactacgtcgaccagctgctgaggactctagatatccaagtcgcccttactgggctggaagtgtggacagaacgggacagatctaggcgccagctgagagcattctttcgcaagggtggtggtgcctgtctgtcgaatgcccctgacccagggctgcccgtgccaccagcactctgcggtaacggcttcgtggaagccggtgaggagtgtgactgtggccccgggcaagagtgccgagatctctgttgttttgcacataactgttctcttagaccgggcgcccagtgtgcgcacggtgactgttgcgtgagatgcctgctgaaacccgcaggtgccctctgtcgccaagctatgggtgactgcgacttgccggagttctgtactggaactagctctcactgtcctccagatgtgtacctattggatggctccccgtgcgcccgcggaagcggctattgttgggatggtgcctgtccaacgctcgaacagcagtgccaacaactttggggacccggttcacaccccgcccctgaagcatgcttccaggtcgtcaactctgccggtgacgcccatggtaattgcgggcaggacagtgaaggacacttcctcccttgcgccggtcgcgatgcactctgcgggaagctccaatgccagggcggcaagccatccttgctcgctccacacatggttcctgtggactcaaccgttcacctcgatgggcaagaggtcacgtgccgcggtgcactagccctcccatcagcccagcttgatctcctgggactggggcttgtcgagccagggactcaatgcggcccgaggatggtgtgccaaagtcgtaggtgcagaaagaatgcatttcaggagctgcagagatgtttaaccgcctgccatagccatggggtatgtaactctaaccacaattgccattgcgccccggggtgggctccccccttttgcgataagccaggctttgggggttccatggattctggtcccgtccaggccgaaaatcacgatacattcctcttagcaatgctgctgagcgtgcttctgccactcctgcctggggctggactggcttggtgttgctaccggctgcccggggcgcaccttcagcgctgttcttggggatgcaggagagacccagcatgcagtggtccaaaagacggcccacaccgtgaccaccccctgggcggggtacaccccatggaattaggccctaccgccactggccagccatggcccttggacccagagaattcccatgaaccatctagtcaccccgagaaacccctgccagcggtgagcccagacccacaggatcaagttcaaatgcccagaagctgtctttggtag

SEQ ID NO: 178026 - DNA, 522 bp, Artificial Sequence
  Description of Artificial Sequence: Synthetic coding sequence
atgggctggcggccccggcgggcccggggcacccccctgctgctgcttctccttctgcttctactttggccagtccccggcgccggcgttctacagggccacatccccgggcagccagtgacacctcactgggtgttagacggtcaaccctggcggaccgtgtcgcttgaggaacccgtatccaagcccgatatggggttggtcgccttggaggccgaggggcaagaactgttgctggagctcgaaaagaatcaccgcctgctggctcctggttacatcgagactcactacggcccagacggccagcccgtggtcctcgcccccaaccacaccgtgcgatgcttccacggcctgtgggatgctcctcccgaggaccactgccattatcagggccgagtgcgtggctttcccgattcttgggtggtgctatgtacctgcagcggcatgagagccggggaaaaacgagcaggtcctggttccacatggaattgcaccttgtggcaaaccacaccctgcagctag

SEQ ID NO: 178027 - DNA, 291 bp, Artificial Sequence
  Description of Artificial Sequence: Synthetic coding sequence
atgggctggcggccccggcgggcccggggcacccccctgctgctgctcctgctgttgttactgctctggccagtacctggggcaggagtgctgcaaggacatatcccaggccagccagtgacacctcactgggtgctggatggccaaccgtggcgaaccgtctcgttggaggagcctgttagtaagccggacatgggcctggttgctttggaagccgagggacaggaattgttgctggagctggaaaaaaatcagttcgccatcgcaacgattactgctaccgttctctag

SEQ ID NO: 178028 - DNA, 2265 bp, Artificial Sequence
  Description of Artificial Sequence: Synthetic coding sequence
atgctgcccggctgcatcttcctgatgatcctgctgatcccccaggtgaaggaaaagtttattttgggcgtggagggtcagcaactcgtccggcccaagaagttgcccttgattcagaaaagagataccggccacactcacgatgacgatatcctgaagacatatgaagaggagctactgtatgaaatcaagctgaacaggaagaccctcgttctccacctgctgaggagccgtgaatttttgggctctaactatagcgagactttctactccatgaagggcgaggccttcacccgccacccccagatcatggatcattgtttttatcagggctcaatagtgcacgagtatgattctgcggcatcgattagcacatgcaacgggctcagggggttctttaggattaacgatcaaaggtacctgatcgagccggtgaagtactctgatgaaggtgaacatttggtttttaagtacaacctgagagtgccctatggcgctaattattcctgcaccgaactgaacttcacacgaaaaactgtaccaggcgacaatgaaagtgaggaggattcaaaaataaaggggatacacgatgagaagtatgtagaactttttattgtggccgatgacaccgtgtacagaaggaatgggcatccacataataaattgagaaaccgcatttgggggatggtcaactttgtcaacatgatatataagacgcttaacatccacgtaacattagtgggcattgagatctggacacatgaggacaagattgaactatactccaacattgagacaactctgctgcgctttagtttctggcaggagaagatcctgaagacccgcaaagattttgatcacgtggtgttgttatccggtaagtggctgtattcacacgtccaaggcatcagttatcccgggggaatgtgtctcccctattactccacgagcataataaaggacttactgccagacacaaatattattgcgaatcgcatggctcatcagctgggacacaacctagggatgcagcacgatgagttcccttgcacttgccccagtgggaaatgcgtaatggactcggatggaagcatccccgcccttaagttttccaagtgcagccagaatcagtaccaccagtacttaaaggactacaagcccacatgcatgctgaacatcccatttccgtacaactttcacgattttcagttctgtgggaataaaaagctggatgaaggagaggagtgtgactgtgggcccgcacaggagtgtacaaacccgtgttgcgacgcccatacatgcgtgctgaagcctggatttacttgtgccgagggcgaatgctgcgaatcctgccaaattaagaaggcgggcagtatttgccggccggctaaggatgagtgcgattttcccgaaatgtgcaccggccactcacctgcctgccccaaggaccagtttcgggtgaatgggtttccttgtaagaactctgaaggttactgtttcatgggtaagtgtcccacacgagaggaccagtgttccgaactgtttgatgacgaggccatcgagtcacatgacatctgttacaagatgaacacaaaggggaacaagttcggatactgcaagaataaggagaaccgatttctgccatgcgaagaaaaggacgtcagatgcggaaagatctactgcacaggcggtgagttatctagtctgctgggggaggataagacctatcatctgaaagatccacagaaaaacgcaaccgtaaaatgtaagacaatctttttgtaccacgacagtactgatatcgggctggtggcttccgggactaaatgcggggaaggcatggtgtgtaacaatggggagtgccttaacatggagaaagtttatatttctacaaattgtcctagccaatgcaatgagaatcccgtcgatggccacgggctgcagtgccattgtgaagaaggccaggcgccggtcgcctgcgaagagaccctgcacgtgacgaacattacaattttggtcgtggtcctggtgctggtgattgtgggaatcggcgtgctaatcctgcttgtccggtaccgtaaatgtatcaagctgaaacaggtgcaatccccacctacggaaacgttgggcgttgagaacaagggttactttggggatgagcagcagataaggacagagcccattctcccagaaattcatttcctgaacaagcctgctagcaaggactcccgtgggatagccgaccccaatcagtcagctaagtag

SEQ ID NO: 178029 - DNA, 1656 bp, Artificial Sequence
  Description of Artificial Sequence: Synthetic coding sequence
gtgtgcccccggagctacttcctggagggccggggcagctacagctttctctctctcttctccacgagccctgctccttatcgtaggaacgggcatccccacaataagttaagaaatagaatttggggtatggtcaacttcgtcaatatgatatataagacccttaacattcatgtcaccctcgtgggcatagaaatctggacacatgaagacaagattgagctgtactccaatatcgagaccaccctcttaaggttttccttctggcaggagaagattctcaaaacccggaaggatttcgatcacgtggtcctcctcagcggcaaatggctgtatagtcacgttcaaggcatatcttaccccgggggcatgtgtctcccatactattctacgtctataattaaagacctgctaccggacacgaatatcatagccaatagaatggcccaccagctcgggcataacctgggtatgcaacatgacgaattcccatgtacctgtccgtccggtaaatgcgtgatggattcagatggctctattccagccttgaagtttagcaaatgttcccagaatcaataccaccaataccttaaggattataagcctacttgcatgctcaacatccccttcccttataacttccacgactttcagttttgtgggaacaaaaaattagatgaaggcgaggaatgcgactgcggtcccgcccaggagtgtaccaatccttgctgtgatgctcatacttgtgttctgaaacccgggttcacatgtgccgaaggagaatgttgcgagagttgccagatcaaaaaggccggttcaatctgtcgacctgccaaggacgaatgtgacttcccggaaatgtgcacagggcacagtcccgcttgtcccaaagaccaattccgggtcaacgggtttccatgcaagaacagtgaaggctattgctttatgggaaagtgtccaactcgcgaagaccagtgtagcgagctgttcgatgacgaggccatcgaaagtcacgacatctgctataagatgaatacgaagggaaacaaattcggctactgtaagaataaagaaaatcggttcctaccatgcgaggagaaggacgtgagatgcggaaagatctactgcacaggcggcgaactctccagcttgctgggtgaggacaagacataccacctcaaagatcctcagaaaaacgccacagtaaaatgcaagactatctttctctaccacgattctaccgatattggactggttgcctcgggaactaaatgcggagaggggatggtgtgcaataacggtgagtgtctgaacatggaaaaagtgtatatttctacgaattgtccgtcccaatgtaatgagaaccctgttgatggacatgggttgcagtgccattgcgaagaagggcaggctcctgtcgcctgtgaggagactttgcatgtgacgaatatcaccatcctggtcgtggtccttgtgctggtcatagtcggcatcggagtgctcattctgcttgtgagatatcggaaatgcatcaagttaaagcaggttcagtctccaccaaccgagaccctgggtgttgaaaataagggctattttggggatgagcagcagatcaggacagagcctattctacccgagatccactttctgaattag

SEQ ID NO: 178030 - DNA, 2475 bp, Artificial Sequence
  Description of Artificial Sequence: Synthetic coding sequence
atgcggggcctgggcctgtggctgctgggcgccatgatgctgcccgctatcgcccccagccggccttgggccttgatggaacagtacgaagtggtgttgccttggcgcctgcctggacctcgggtcaggagggccttaccaagccacttgggactgcacccagagcgagtaagctatgtgctgggagcaaccggacacaattttacgttgcacctccggaaaaatcgtgacctgcttggttctggctatacagaaacatatactgctgcaaacggcagtgaggtgactgaacagccaagaggccaggaccactgcttttatcagggccatgtcgaaggataccctgattctgccgctagtctctcgacttgcgcgggtctaaggggcttctttcaggtcggcagcgatcttcacttgattgagccgctcgatgagggcggagaaggcggccgtcatgctgtgtaccaggccgaacatctcctgcaaaccgcgggtacatgtggcgtgtccgacgacagccttggatccctgctgggaccacgcaccgccgctgtgttcagacccagaccaggggattctcttccgtcaagggagacaaggtacgtggagctttatgtcgtggttgacaatgccgagttccagatgttgggcagcgaggcggcagtgcgtcaccgcgttctggaggtggtcaatcacgtcgacaaattgtaccaaaagctgaatttccgggtcgtgctagttgggctcgagatttggaatagccaggatcgtttccacgtgtcacccgatccctccgttaccctggaaaacctgttgacctggcaagcacggcagcgcacccgcagacacctgcatgacaacgtgcaattaataacaggggtcgacttcacaggaactacagtcggattcgccagggtgagtgctatgtgctcacacagctctggcgccgtgaaccaggatcattcaaagaatccagtgggggtcgcttgtacaatggctcacgaaatgggccacaacctgggcatggaccatgacgagaatgtgcagggctgtcggtgccaggagcgttttgaagcgggcaggtgtattatggcagggtccataggcagctctttcccaagaatgttctcagattgcagccaagcttatctagaatcatttctggaacggccccagtctgtatgcttggcgaacgcccctgatctctcccacctggtggggggccccgtctgtggtaatctctttgtggaaagaggcgaacagtgcgactgtgggccacctgaggactgcaggaaccgttgttgcaatagcaccacctgccagctggccgagggggcccagtgtgcacacggtacgtgttgccaagaatgtaaagttaagcctgccggagaattgtgcaggcccaagaaggacatgtgtgacctagaagagttctgcgacggccggcaccccgaatgtcctgaggacgcctttcaggagaacggcaccccatgcagcggcggctactgctacaatggcgcatgccctaccttagcccagcagtgccaggccttttggggtcctggagggcaggccgccgaggaatcgtgtttttcttacgacatccttcccggttgcaaggcatcccgatacagggcagacatgtgcggtgtactacagtgtaaggggggccaacagccactcgggcgggccatctgtatcgtggacgtgtgccatgcactcacgactgaagatggaaccgcctacgagccggtacccgaagggactcgttgcggacccgaaaaggtttgttggaaaggcaggtgtcaggacttgcatgtatatcggtctagcaactgttctgcacaatgtcacaaccatggcgtctgcaatcataaacaggaatgtcactgccacgctgggtgggcgcctccacattgcgcaaaactgctcacggaggtgcacgccgcatcgggcagcctcccggtattcgtggtggtggtgctcgtgctgcttgcagtggtcttggtaacactcgcaggcataatcgtgtaccgtaaagcccgctcaagaatacttagccgcaacgtcgcgcccaaaaccacgatgggtcgtagtaacccgctctttcatcaggccgcctcccgcgtccccgccaaaggaggcgcacccgcaccctcaagaggaccccaagaactggtgcccacaacccaccccgggcagcctgcccgccatcccgcctcctcagttgcgcttaagcggcctccccccgccccaccagtgactgtgtcatccccaccattcccggttcccgtatatactaggcaggccccaaagcaagttatcaagccgacgttcgccccacctgtgccacccgtgaaaccaggcgcgggcgccgctaatccaggccctgcggaaggagccgttggcccaaaggtcgctctgaaaccccccattcagagaaaacagggcgccggcgcacctacagcgccttag

SEQ ID NO: 178031 - DNA, 2202 bp, Artificial Sequence
  Description of Artificial Sequence: Synthetic coding sequence
atgcggggcctgggcctgtggctgctgggcgccatgatgctgcccgggcccgcccctcgggagggcgagctgagaccttggggtcaccgggcacagctgcacccacctcctgctgaagaacagggaccggccggcttgcgcctacatcgggacctgtacgggtgtcaatggcttcgtggagacggagcagcctcccgtgccggcccgctgctcctgccaggtccacgacgtggcgtcccaggcctgagccgacagccccagcacctgtgccggcctcaggtcggcagtgacctccaccttatcgagcctttggacgagggtggcgagggagggaggcatgcggtgtaccaggccgagcacctgctgcagaccgcaggcacttgtggggtgtccgacgacagtttggggtcacttttgggacctcgcactgctgccgtgtttaggcctcgtcccggagacagcctgccatcaagggaaacaaggtacgttgagctatacgtcgtcgtggataacgctgaatttcagatgctgggcagcgaggctgctgtgagacacagagtcctggaggttgttaatcacgtggacaaattataccagaaactgaattttcgtgtcgtgcttgtgggtctcgaaatttggaattcccaggaccgctttcatgtttctcctgacccctccgtcactcttgagaatctgcttacctggcaagctcgccaacgcactcgtagacaccttcacgataacgtccagctaataaccggcgtggactttaccggcactaccgtaggctttgcaagagtgtccgccatgtgcagccacagcagtggagcagtcaaccaagaccactccaagaatcctgtgggggtggcttgcacaatggctcatgaaatgggtcacaacctggggatggatcacgacgagaacgtacagggctgccggtgtcaggagcggttcgaggccgggaggtgcatcatggcaggctccattggaagctcctttccacggatgttctccgactgctcacaggcgtacctcgagagtttcttggaacgcccgcagtcggtgtgccttgccaatgcacccgatctaagccatctcgtgggagggcccgtatgcggcaatctgttcgtcgaacgcggggaacagtgtgactgtggacctccggaggattgccgtaatcgctgttgcaatagtacaacatgccaactggcagagggggcacagtgcgctcacgggacatgttgtcaggaatgtaaagtgaagcctgccggtgaattgtgccgccccaagaaggacatgtgtgacctggaagaattctgcgatggacgccatcctgagtgtcccgaggatgcttttcaggagaacggcactccttgttccggcggatactgctacaacggtgcttgccctacactcgcacagcagtgtcaggctttttgggggcctggtggtcaagcggccgaagaatcttgtttttcatacgatattttacctggctgtaaggcttcaagatacagagctgatatgtgtggcgtgttacagtgcaagggaggccagcagcctttggggagagctatatgcatcgtagatgtgtgccacgcactcactactgaagatgggacagcatatgagcctgtacctgaggggacgagatgtggccccgaaaaagtctgcaaccacaaacaagagtgccactgtcacgccgggtgggctcccccacactgtgcaaaactgctcacagaggtgcacgcggcatccgggtcactgcctgttttcgtagtggtggtgctggtgctccttgccgtggtcctggttactctcgccgggatcatagtttatcggaaagctcggagcaggatcctcagcaggaacgtcgcccctaagacaactatgggtagatctaatcctctattccaccaggcagcctcacgtgtgccagccaagggaggcgcgcccgcaccgagcaggggcccacaggagctggtgccaacaacgcaccctggccagccagcccggcacccggccagtagcgtggccctcaagaggccacctcccgcacctcccgtaacagtgtcttccccgcccttccctgtgcccgtatacactcggcaggctcccaagcagggcgccgtcggccccaaggtggccttgaagcctccaattcaacggaaacagggcgccggggctcccaccgcgccatag

SEQ ID NO: 178032 - DNA, 2229 bp, Artificial Sequence
  Description of Artificial Sequence: Synthetic coding sequence
atgcggggcctgggcctgtggctgctgggcgccatgatgctgcccgctatcgccccctccagaccgtgggcgttgatggagcagtacgaggtggttctgccatggcggctccctgggccaagagtccgcagagccctgccgtcccacctgggcctgcatcctgaacgcgtcagttacgttcttggagctaccggtcacaattttacactgcacctgcgcaagaacagagacctgctggggtcaggatacaccgagacatacacagcagccaacgggtccgaggtcaccgaacagccccgaggtcaggaccactgcttctaccagggacacgttgaaggatatcctgattccgccgcttcactgtctacatgtgccggtcttagaggcttctttcaggttggtagcgaccttcatctgatcgagccccttgacgaagggggcgagggtggcagacacgctgtttatcaggccgaacatctgctgcagactgccggtacttgcggagtgtctgacgacagtctgggatcacttcttggcccacgcaccgccgccgtttttcgaccccgccctggagatagcttacccagtcgcgagacccggtacgtggagctctacgtcgtggtggataacgccgagtttcagatgctcggtagcgaggccgccgtgagacatagagtcttagaggtggtgaatcatgtggataagctttaccaaaagctcaattttagggtggttttggttggtctggaaatttggaactcacaggacaggttccacgtatcgcccgatccctctgtaaccctggagaacctgctgacatggcaggccaggcaacggacgaggagacatttgcacgataacgtccaactgatcactggtgtggattttaccggaacaacagtgggatttgcccgggtgtcagccatgtgctcccatagttccggcgcagtaaatcaggaccactcaaagaacccagttggtgtcgcttgcactatggctcacgaaatggggcataatctcgggatggaccacgatgagaatgtgcagggatgtagatgccaggagcgatttgaagccggccggtgcattatggcaggcagcattgggtcatcatttccccgtatgttctccgactgttcacaggcatacctcgagtcctttttggaaagaccgcaatccgtttgcctggcaaatgcacctgacttgtcacacttagtgggaggtcccgtgtgtggtaatctcttcgttgaaaggggagaacagtgtgattgtggccctccagaagactgtcggaatcgttgttgcaactcgacaacatgtcagcttgccgagggagctcaatgtgcacacggcacatgctgtcaagaatgtaaagttaagcccgcaggtgaactatgccgccctaaaaaagacatgtgtgacctggaggaattctgtgacggcagacaccctgagtgccctgaagatgctttccaggaaaacggcaccccatgttcagggggctactgctacaatggcgcctgccctaccctcgcccaacagtgtcaggcattctggggcccaggtggtcaggcagctgaggagtcatgcttctcatacgacatcttgcctggctgcaaagcatcccgttacagagccgatatgtgtggagtgctccaatgcaagggcgggcagcaaccattgggacgggcgatttgcatagttgatgtgtgccatgccttgaccacagaagacgggacagcctatgagcccgtccccgagggcacacggtgcggccccgagaaagtttgttggaaaggtcgctgccaggatctgcatgtctatcggtcttcaaactgtagcgcccagtgccataatcacggcgtttgcaaccacaagcaggagtgccattgccacgccggctgggcgccgccccactgcgccaaactgctcaccgaggttcacgcagggtgtcagcctagggctggccagggacgagggtcctctccaatacaggggcctccacgcgcaggcccccatcatcccccggggcctgccaggcccacgcctggccttttgggaggctccgaagaggctgcaccttgttcaagtggccattgtgtgcagccaactctgccctcatcttgccttcacccggctggcacaaaggcaggccaccaggccaatgtgcggactccttccgccccatcacagaccaggggatggtgcggccagccctggtcttcctag

SEQ ID NO: 178033 - DNA, 2460 bp, Artificial Sequence
  Description of Artificial Sequence: Synthetic coding sequence
atgggcagcggcgcccggttccccagcggcaccctgcgggtgcggtggctgctgttacttggtttggtgggaccggtcttgggggcggccaggcccggcttccaacagaccagtcaccttagctcttacgaaataattaccccatggagattgacaagagagcggcgtgaggctcctcgtccctattccaaacaggttagctatgtaattcaggccgagggaaaagaacatataatccatttagagcgtaataaggatctgttgcctgaagacttcgtcgtctacacttataacaaggaagggacactgattactgaccatccaaatatccagaatcattgtcattaccgcggatacgtggagggtgtgcacaatagcagcatagctctctccgactgcttcgggctgcgcggcctgttacacctcgaaaatgcctcatatggcatcgaaccgctacagaatagctcacatttcgaacatatcatttatcggatggatgatgtttataaagagccgttgaagtgcggagtgtcaaacaaggatatcgaaaaggagaccgctaaggacgaagaagaggagcccccatcgatgactcagctactgagacggcggagagcggtcctgcctcagacccgctacgtggaacttttcatcgtggtcgacaaggagaggtatgatatgatgggtcggaaccagaccgccgtcagagaagagatgatattactagccaactatctcgattccatgtacattatgttgaacattaggatagtgcttgtgggccttgaaatttggactaacggtaatctgatcaatatcgtcggcggggcaggggatgttttgggaaatttcgtgcaatggagggaaaagttcctgataacgcgtcggcgtcatgactccgcccagctcgtgcttaaaaagggcttcggcgggaccgcaggtatggccttcgtgggcactgtgtgcagccggagtcatgccggtggcattaatgtctttggccagatcaccgtggagacattcgcttcgattgtcgctcatgaattaggtcataatctcggaatgaaccatgacgatggtcgggattgttcatgtggcgctaagagctgtatcatgaattctggggcgtccggcagcaggaacttctcatcttgctccgccgaagacttcgagaaattaacgcttaacaagggcggcaattgcctgctcaacatcccaaaacccgatgaggcctattctgccccgagctgcgggaataagctggtggatgctggtgaagagtgtgactgcgggacaccaaaagaatgcgaactggatccttgctgcgagggaagcacttgtaagctaaaatcttttgctgaatgcgcttatggcgactgctgtaaagactgcagatttttgcctggaggaactctatgccgcggtaaaaccagtgaatgcgacgtgcctgagtactgcaacggctcctcccagttctgtcagccagacgtgttcatccagaatggctacccctgccagaataataaagcatattgttacaatggcatgtgtcagtactacgatgcacagtgccaggtgatcttcgggtctaaggctaaagcagcaccaaaggactgcttcattgaggtgaactcaaagggagataggttcggcaactgcggcttttcgggaaatgaatataaaaagtgcgcaactgggaacgctctatgtggaaagctgcaatgtgagaatgtgcaggaaattcccgtgttcggcattgtgccagctatcatacaaacgccgagccggggtaccaagtgctggggtgttgacttccaactgggatcggacgtgcctgatccagggatggtgaacgaagggaccaagtgtggagcaggtaagatctgtcgaaattttcaatgtgttgacgcttcagtcctcaattatgattgcgacgtgcagaaaaaatgccacggacatggcgtctgtaactccaacaagaattgccactgtgaaaatggctgggcaccacctaactgtgagaccaaaggttatggaggctctgtggacagcggccctacatataacgagatgaataccgccttgagagatggcctactggtctttttctttctgatcgtcccactgatcgtgtgtgcaatcttcatttttattaagcgtgaccaactttggcgtagctattttcggaaaaagagatcacaaacttacgaaagcgatggcaagaatcaggctaatccaagtcgtcagcctggctccgtacccaggcacgtcagccctgtcactccacccagagaagtgcccatatatgccaataggtttgctgtgcctacgtacgccgctaagcagccgcagcaattcccctccagaccaccgccaccacaaccaaaagtgtcaagtcagggcaacctcataccggcgagacctgcccccgcaccccccctgtacagcagtttgacctag

SEQ ID NO: 178034 - DNA, 2904 bp, Artificial Sequence
  Description of Artificial Sequence: Synthetic coding sequence
atgcagcgggccgtgcccgagggcttcggccggcggaagctgggcagtgacatgggaaacgctgaaagggcgcccggcagcagatcctttggccctgtgcccacactgcttctcctagctgccgctctcctcgccgtgagtgacgccttaggccgcccttccgaggaggatgaagagttagtcgtcccagaactggaaagggcccccggccacggaacgaccagactgagacttcatgcctttgatcaacagttggacctggagctcagacccgatagttcatttctggcccctgggtttacactccagaacgtagggaggaagagtggttctgagaccccactgccggaaaccgacttggcccattgcttctactctggcaccgtcaatggcgaccccagctccgcagccgctctatccttgtgtgagggcgtgcgcggcgctttttatttgctgggcgaagcctactttattcagccattgccagccgcctcagagcgtctagcgactgctgcacctggagagaaaccgcctgcgcctctccaattccatctgctgagaagaaacagacagggtgatgttgggggcacatgcggagtagtggatgacgaaccccgccccacaggcaaggctgaaacggaagatgaggacgagggaacggagggtgaggatgagggcgcccagtggtcccctcaagaccctgcccttcagggagtaggacaacctacaggaaccggcagcattaggaaaaagcgctttgtctcctctcacagatacgtggaaaccatgctggtcgcagatcagtctatggcagagtttcacgggtctggcctgaagcactatctgttgactttgttctcagttgcagcacggctgtacaagcacccatcaattcgcaactctgtgagcctggtggtggtgaagattctagtgatccacgacgagcagaaaggcccggaagtgacatccaatgccgctctgaccctccgtaacttttgtaactggcagaaacaacataaccctccatctgatcgtgatgcagagcactatgatactgccattttgtttacgaggcaggacctgtgcggatcgcagacctgcgacaccctcggcatggctgacgtgggaaccgtgtgtgatcctagccggagttgttccgtgattgaggatgacgggttgcaggccgcatttacgactgcacacgaattgggccatgtctttaatatgccacatgatgatgctaaacagtgcgcttcgttgaatggcgtcaatcaagattcccacatgatggccagcatgctaagcaacctggatcattcacagccatggagcccctgcagtgcttatatgatcactagctttttagacaacggccacggggagtgcctaatggacaagccacagaacccaatacaactgcctggggaccttccgggcacaagctatgacgccaaccgacagtgccagttcactttcggcgaagatagcaagcactgtcccgacgcagcaagtacttgtagtacattgtggtgtaccggcacatctggtggggtgcttgtctgccaaaccaagcatttcccctgggccgacgggacctcctgcggagagggaaagtggtgtattaatggcaaatgtgtgaataaaacagatagaaagcacttcgacaccccctttcatggaagctggggcatgtgggggccctggggggattgttccagaacctgcggcggcggggtgcagtatactatgagggaatgcgataatccagttcccaaaaatggaggtaagtactgcgagggaaagcgggtgcgttatcgttcttgtaacttggaagattgcccagataataacggaaagacatttcgcgaggaacaatgtgaggcacacaatgagttctcgaaagcctcatttggcagtggccctgccgtggagtggatccccaagtatgccggcgtcagcccaaaagaccgatgcaagctgatttgtcaggctaagggcatcggctactttttcgtattgcagcccaaagtggtggacggaacgccctgctcacccgattctaccagtgtttgcgtccaaggccaatgtgttaaagcaggatgtgaccgcattattgactcgaaaaagaaatttgataagtgtggtgtgtgcggcggcaacgggtcaacctgtaagaagatttccgggtccgttacctcagccaagcctggctatcatgatattatcacaatacctacaggcgctaccaatattgaagtcaagcaaagaaaccagagaggcagcagaaataacggctcttttttagctatcaaagccgctgacggcacttatatcctaaacggagactacaccctaagtaccctcgaacaagacattatgtacaagggagttgttctgcgctatagcggttcttccgcagcgcttgaacggatccgaagcttctcgccactgaaggagcccctgacgattcaggttctgactgtgggcaacgcgctgcggcccaaaattaaatacacttatttcgtgaagaaaaagaaagagagcttcaacgccatcccaaccttcagcgcttgggtcatcgaagaatggggcgagtgctcgaagtcatgtgaattgggctggcaaagacgccttgtggagtgtagagatattaatggacagccggcttccgagtgtgccaaggaggtaaagcccgcttccactcggccctgtgcggatcacccctgccctcaatggcagctgggagaatggtcttcatgctcaaagacttgtggaaagggatacaagaagcggagtctaaagtgtctgagtcatgacggaggggtgctctctcacgaaagctgtgacccactaaagaagcctaaacatttcatcgatttctgcacaatggcagaatgttcatag

SEQ ID NO: 178035 - DNA, 3312 bp, Artificial Sequence
  Description of Artificial Sequence: Synthetic coding sequence
atggcccccgcctgccagatcctgcggtgggccctggccctgggcttgggtcttatgttcgaggtaactcacgcttttcgttctcaggacgaatttctgtcctcccttgaatcatatgagatcgccttccctacccgggtggatcataatggagccctgctggcattctctcctccgcccccccggcggcagcggcgaggaactggcgccacggctgagtccaggctgttttacaaagtggctagcccctcaactcacttcctgctgaacttaaccagatctagcaggctcttagcgggccatgttagcgtagaatattggacgagggaggggttagcatggcagagagcagctcgaccccattgtctgtatgctggacatcttcagggccaagcaagcacttcgcacgtggcaattagcacatgtggaggactgcacggactgatagttgccgatgaggaagagtacctgatcgaacccctccatggcgggcccaagggaagcagaagcccagaagagtcaggaccgcatgtggtgtacaaacgaagttcattgcgacacccccacctggatactgcctgtggcgtgagggatgaaaagccctggaagggacgtccctggtggcttcggacactgaaacctccacctgccaggcccctgggaaacgagaccgagcgtggacaacccggccttaaacgcagcgtcagcagagaaagatacgtggaaacgctcgtggtcgctgataaaatgatggtggcctatcacggaaggagggacgtagaacagtatgtgctggcgatcatgaacatcgtagcaaaattgttccaggactctagtctgggctccacagtgaatatcctcgtaaccagacttattctcttgaccgaggaccagccaacgttggaaattacccatcacgctggaaagtcccttgactccttttgcaagtggcagaaatcaattgtgaatcactcaggccatgggaacgctattccagagaatggcgtagctaatcacgacacagcagtcttgattaccagatatgatatttgtatttacaaaaataaaccctgtggaacgttggggctggcgcctgtcggtggtatgtgcgaaagggaaagaagttgcagtgtcaacgaggacattggcctggctactgctttcacaattgcccacgaaataggtcatacctttggaatgaaccatgacggagtgggtaactcttgcggagctcgaggccaggatcccgccaagctgatggcggcccatataacaatgaaaaccaatcctttcgtgtggtctagttgttcacgtgattatatcacctccttcctggattctggactaggactctgtctgaataacagacccccaaggcaggacttcgtgtaccctaccgtggctccgggccaggcctatgatgccgatgaacagtgcaggtttcaacacggcgttaaatcaaggcaatgcaaatacggcgaggtttgtagtgaattatggtgtctgtccaaaagcaacagatgcattaccaacagtatcccagctgctgagggcaccctgtgccagacccacaccatcgataagggatggtgctacaagcgcgtgtgtgtgccattcggctcacgtcctgagggggtcgatggggcctggggaccttggaccccctggggagattgcagccgcacatgtggtgggggagtgtcctcctcgtcgcgtcactgtgacagtccccggcccactatcggaggtaagtattgcttaggagaacgcagacgccaccggtcctgtaatacagacgattgtccacctgggagtcaggacttccgagaggtgcagtgcagtgaattcgacagcattccttttaggggaaagttttacaagtggaaaacatatagagggggtggcgtaaaggcttgcagtttgacctgcctggccgagggattcaacttctataccgagcgtgcggctgctgttgtggacggcacaccttgcaggccggacactgtggacatctgcgttagtggggagtgtaagcacgtgggttgcgacagagtcctgggatccgatttacgagaggataagtgtagagtctgcggtggtgacggcagcgcttgcgaaacaatcgaaggagtttttagcccggcatcacctggcgccgggtacgaagacgttgtgtggatccccaagggaagtgtgcacatctttatccaggacttgaatctatccctatcccaccttgccttgaagggtgaccaagagtcgctgttgttggaggggcttcccggaaccccacagccccacagactgccactggctggaacgacgttccagttgcgacaaggaccagatcaggtccagtctctcgaagctctgggaccgattaacgccagcttgattgtcatggtgctggcccggaccgagttgccagcattgcggtataggtttaacgccccaatagcaagggacagcctgccgccatacagttggcactacgcgccctggaccaaatgctcagcccaatgcgcaggtgggtcacaagttcaagctgtagaatgtcgaaatcagctggattcatctgctgtggctccacattattgctccgcccattccaagctgcccaagcggcagcgagcgtgtaacaccgagccttgcccgcctgactgggtagtgggaaattggagcttgtgtagtaggagctgcgacgccggggtacggtctagaagcgtggtgtgtcagagaagagtgtcagctgcagaagagaaggccctggacgacagcgcgtgtcctcaacctcgccctccggtattggaggcgtgccacggtccaacatgcccgccagaatgggccgcgctggactggtccgagtgcacgcctagttgtggtcccggactcagacaccgagtggttctatgcaagagcgcagaccatcgcgctacactgccacccgcccactgcagtcctgccgccaaaccacccgccactatgaggtgtaatctccgaaggtgcccacccgcccggtgggttgccggcgaatggggcgaatgctccgcccagtgcggggtgggccagcgccagcgatccgttaggtgtacttcacataccggacaggcttcccacgagtgtaccgaggcgctgcggccacctactactcagcagtgcgaagccaagtgcgactcccccaccccaggggacgggcccgaagagtgcaaagacgtgaataaagtagcttactgtcctctggtgttgaagtttcaattttgtagccgcgcctactttaggcagatgtgctgtaaaacctgtcacgggcactag

SEQ ID NO: 178036 - DNA, 2544 bp, Artificial Sequence
  Description of Artificial Sequence: Synthetic coding sequence
caggacgacggcggcctgagccgggcccccggctgcggcgccgtgtgccctggtcatcacgagcactgtcaggttgctaaactgtttcaggatagcagccttgggtccaccgttaatatcctggtgacccggctgatattgctgaccgaggatcaaccaaccttggagatcacccatcacgcagggaaaagcctagattccttttgcaaatggcagaagtctattgttaaccatagtgggcatgggaacgcaataccagagaatggtgtggccaaccatgacacggctgtgctcattaccaggtatgacatctgcatatataagaacaaaccgtgtggaactctggggctcgcccccgtggggggaatgtgtgaacgggaacgctcatgctccgtcaacgaggatatagggctggccacggctttcaccatagcgcatgagattggccacacattcggcatgaaccatgatggcgtgggcaacagctgtggggcgcggggacaagatcccgctaagttgatggcggctcacataacgatgaaaaccaacccttttgtatggagttcctgtagcagagactatatcacatccttcttagacagtggccttgggctgtgcctgaacaatagaccccctaggcaggattttgtttaccctacagtagcaccagggcaggcatacgacgccgacgaacaatgccggtttcaacacggcgtgaaaagccggcaatgtaaatatggagaggtctgtagcgagctttggtgcttaagcaagagcaaccgttgcatcactaattcgatcccagcagccgaaggtacactgtgccagacacacactattgacaagggatggtgctacaagagggtatgtgttcctttcggaagccgccctgagggagttgacggcgcatgggggccctggactccttggggtgactgctccaggacttgcgggggcggagtgtcgagtagctcccgccactgcgactccccccgaccaacaatcgggggaaagtattgtctaggcgagcggagaaggcaccgttcctgtaatacggacgactgtccaccaggctcccaggacttccgcgaagtacagtgctccgagtttgattcgattcccttcaggggaaaattctacaaatggaaaacttaccgaggggggggagtgaaggcatgtagccttacttgtcttgccgagggctttaatttttataccgaacgggccgccgccgtggtcgacggcaccccctgtaggcccgatacggtggatatctgtgtctcgggagaatgtaagcatgtaggctgtgaccgagtattggggtctgacctccgtgaggacaaatgccgggtgtgcgggggggatggatctgcgtgtgagaccattgaaggagtgtttagcccggcgtcccccggcgctggatacgaagatgttgtgtggattcctaaaggatccgtgcatatttttatccaagatctgaacttgtctcttagtcacctggctttaaaaggggaccaggagtctctgctgctggagggcctgcccgggactccccagccccaccggctcccccttgcggggacgacttttcagctgcgccaggggccggaccaggtccaatcccttgaggcactcggccccattaacgcctcacttatcgtgatggtactggcccgcactgagcttcctgccctgcggtatcgtttcaacgctccgattgcgcgcgactcccttcccccttactcttggcattacgctccctggactaagtgctcagctcagtgtgctggcggctcacaggtccaggccgtggagtgccgcaatcagctagattcatccgcagtggctcctcactattgctctgcgcacagcaagcttccaaagagacagcgggcctgcaataccgagccatgcccgcctgattgggttgtaggcaattggtctctttgtagtcgctcttgcgatgctggtgtccgctcccgcagtgtggtctgtcagaggcgcgtgtccgccgccgaggaaaaggcattggacgacagcgcttgcccacagcccaggccccctgtgctggaggcctgtcatggcccgacctgtcctcctgagtgggctgccctggactggagcgaggtgagcagacccctcccatcacgtcccctgggctgtcccggcggtgtgtctaccgagactccactgcggggccttcaggtgtcttgtcccctcttgacatctcactgggggtccactctttccacaaaaaggccttttcagctacagtgcactccatcctgcggacccgggctgcggcatagagttgttttatgtaagtctgctgaccaccgtgcaactttgccaccggctcattgcagccccgccgctaagcctccagctaccatgaggtgtaacctgcggagatgcccgcctgccaggtgggtggccggagagtggggtgagtgcagtgcccagtgtggggtgggccaacgccagcggtcggtccgctgcacctcccacactggccaggccagtcacgaatgcaccgaggcttag

SEQ ID NO: 178037 - DNA, 4530 bp, Artificial Sequence
  Description of Artificial Sequence: Synthetic coding sequence
atgccctgcgcccagcggagctggctggccaacctgagcgtggtggctcaactgctgaactttggggctctgtgctatggccgccagccacagccgggacccgttcgcttcccagacagacgtcaggagcattttataaaagggctgcccgagtaccacgtcgttggccccgtgcgagtggacgctagcggccattttctatcatacggcctacattacccaatcaccagctcgcggaggaaacgggacctggacggatcagaagattgggtgtactatcgtatttctcatgaagagaaggatctgttctttaatctgacggtgaatcagggcttcctaagtaattcttacattatggaaaagagatacggtaatctcagccatgttaagatgatggcgtcatcagcccctctgtgccatctctccggaacggtcctgcagcaggggactcgcgtcggcactgccgctctcagcgcttgccatggacttacaggattttttcaactgccccatggagactttttcatcgaacccgtgaagaagcacccactggtggagggaggataccaccctcacatcgtatataggagacagaaggtgcctgagaccaaggaaccaacttgtggactgaaggattctgttaacatatctcagaagcaggaactgtggagggagaagtgggagcggcacaacctcccttctaggagtttgtcccgccgcagcatttccaaggagaggtgggtggaaacgctggtcgtagccgacacaaagatgatagaataccacggttctgaaaatgtggaaagttatatattgacaatcatgaatatggtgactggtctgttccacaatcctagtattgggaatgccatccacatcgtagtcgtgagactgatactgttagaggaggaagaacagggccttaaaatagttcatcacgccgagaaaactctgtcatccttctgcaagtggcagaagagcatcaaccctaagagcgacttgaaccccgttcaccatgatgtggccgtgctgcttacccggaaggatatttgcgccggctttaaccgaccctgtgaaaccctggggctgtctcaccttagtggaatgtgccagccccatcgatcgtgtaatatcaacgaggactccggcctgcctctcgcctttacaattgcacacgagctgggccacagtttcggaatccagcatgatggcaaagagaatgattgcgagcctgtgggacgtcatccgtatatcatgtcacgccagctgcagtacgatccaacgcccctgacctggtcaaagtgctcagaagagtatataacacggttcctggaccgcggatggggcttctgtctggacgatatccccaagaaaaagggactcaaaagcaaggtgattgcccccggcgttatttatgacgtccaccaccagtgccaactccaatacggacccaacgccactttctgccaagaagttgagaatgtttgccagactctgtggtgtagtgttaaggggttctgtcgttcgaagttagacgccgctgcagatgggacccagtgcggggagaaaaaatggtgtatggcgggtaaatgtatcactgtgggcaaaaaacctgaatccatccctgggggttggggtcgatggtctccgtggtcacactgcagcagaacctgtggcgcgggcgttcaatctgcagagagactttgtaacaacccagaacctaagttcggagggaaatactgcactggcgagcgtaaaaggtatcgactttgcaatgttcacccatgccgctccgaagccccaacgttccggcagatgcagtgttcagagttcgataccgtgccgtataaaaacgagctgtaccactggtttcccattttcaacccaggatatgttgacattggtctaatccctaaaggagcacgagacattagggtgatggagattgaaggcgctgggaactttcttgctatacggagcgaagaccccgagaagtattatctcaacggaggctttataatacaatggaatggcaattataagctggctggaactgttttccagtacgatagaaaaggagacctggagaaactgatggccaccgggcccactaacgaaagtgtgtggatccagcttctgttccaagttactaatccagggatcaagtacgaatacacaatccaaaaggacgggttggataacgacgttgagcagcagatgtatttttggcaatatggacattggaccgagtgttctgtgacatgcggaaccggaattaggaggcagacagctcattgtataaagaagggacgtgggatggtgaaggcgacattctgtgatcctgaaactcagcctaatggccgccagaagaaatgtcatgagaaagcctgccctccaaggtggtgggcaggggaatgggaagcttgttccgctacctgcggcccccacggggaaaaaaagaggaccgtcctctgcatacagactatggtttctgacgaacaggccctgcccccgactgactgtcagcacctgctgaagcccaagacactgctgtcctgtaacagagatatactgtgcccgtcagattggaccgtgggaaactggtccgagtgtagcgtctcctgcggcgggggagtgcggattaggagcgtcacttgcgccaaaaaccatgatgagccgtgcgatgtgactagaaaaccaaactcacgtgccctttgcggcctacagcagtgcccgtctagtagaagagtgctcaaaccaaataaaggcaccatcagcaatggcaagaatcctccaacattgaaacccgtccccccccccacatcccgcccgagaatgctgacgaccccaacaggtcccgaatctatgagcacatcgactccagcaataagctcaccctcccctactactgctagtaaggagggagatctgggcggcaaacagtggcaggatagcagcacacagcccgagttgtccagtcgttacctcatatctactggttccacaagccaacccatcctcacatcccagtccctttctatacaaccatccgaagagaatgtgtcgagctccgacaccggacctacctctgaagggggcctggtcgcaacgacgactagcggatctgggctgagttcatctcgcaatccgatcacttggccagtgacacctttctacaataccctgaccaagggcccggaaatggaaatacatagtggctctggggaggagcgcgagcagccagaagataaggacgaaagcaaccctgtcatctggacaaagatcagggtcccagggaacgatgcccctgtagagtccactgaaatgccactggcaccccccctaactccggacttgtctcgtgaatcatggtggccccccttttccactgttatggaaggactccttccctctcagcgcccaaccacctccgaaaccgggactccccgcgtcgaaggcatggtgaccgagaaaccagccaatactctcctgcccttgggcggggatcatcaacctgagcccagtggcaaaaccgccaatcgaaaccacctcaagttaccaaataatatgaaccaaactaaaagttccgagcccgtgctgaccgaggaagacgcaacgtccctaattaccgaaggattcctgctgaacgcctccaattacaagcagctcactaatgggcatggatctgcacactggattgtcgggaattggtcagaatgctcgaccacctgcggactgggagcttactggaggcgggtcgaatgttccacacagatggactctgattgtgctgctatccagcggcctgaccccgccaagcggtgtcacttaagaccttgtgcgggctggaaagtgggaaattggagcaagtgttccaggaactgcagcgggggatttaaaatccgtgagatccagtgcgtggacagcagggaccaccgtaatctgaggcccttccactgtcagttcctcgcaggcattccacctcccttgtccatgtcttgcaaccccgagccctgtgaggcctggcaagtggaaccatggtctcaatgctcccggagctgcggcgggggcgtccaggagcgcggcgtcttttgtccaggggggctttgcgattggaccaaaagacccacttccaccatgtcctgcaatgagcatctctgctgtcattgggccaccggaaactgggatctctgcagcaccagctgcgggggaggatttcagaagaggacagtgcagtgcgtgccctccgagggcaacaaaacagaagaccaggatcagtgcttgtgcgaccacaagcctcggcctcctgaatttaagaaatgtaaccaacaggcatgcaagaagtcagctgacctgctctgtacaaaagacaagttgagtgccagcttttgtcagacattgaaggccatgaagaagtgttcggtgcccaccgtacgggcagagtgttgctttagctgcccccagactcacattactcacacgcagcggcaaaggagacagagactgctccagaagtctaaagaactatag

SEQ ID NO: 178038 - DNA, 4785 bp, Artificial Sequence
  Description of Artificial Sequence: Synthetic coding sequence
atgccctgcgcccagcggagctggctggccaacctgagcgtggtggctcagctgctcaattttggagctctgtgttacgggaggcaaccccagcctggcccggttcgattcccggatcgccgccaggaacatttcattaagggcctgcctgaatatcatgtagtgggcccagtccgagtcgacgcttctgggcactttctgtcctacggtctccactaccctattacgtcaagccgcagaaagagggatctggacggatctgaggattgggtgtactatcgcatctcacacgaggagaaggacctgttttttaatctaaccgttaatcagggctttctgtctaattcgtatatcatggaaaagcgctatggaaacttatctcatgtcaagatgatggcctcaagcgcccctctttgtcacctgagcgggacagtgctgcagcaggggacccgagtagggaccgccgccctctcagcctgtcacggcttgactgggttttttcagctcccacacggagacttcttcatcgagcctgtgaagaaacaccccctggtggagggcgggtaccatccgcatatagtatacagaaggcaaaaggtgcccgagactaaagagccaacctgcgggctgaaggacagcgtcaatatctcccagaaacaggaactgtggcgcgagaaatgggagagacacaacctcccttcccggtctctgtcccggcggtccattagcaaggagcgatgggtcgagacactcgttgtagcagacacgaaaatgatcgagtaccacggcagtgagaacgtggaatcatatatccttacgattatgaatatggtgaccgggctgtttcataatccctctatcgggaacgcgatacacattgtggtagtgcgcctgatcctgctggaagaagaggaacaaggactgaagattgtgcatcacgcagaaaaaaccctcagttcattttgtaagtggcagaagagtataaaccccaagtcggatttgaatcctgtgcatcatgatgtggcagttctgctcactagaaaggatatatgcgctggctttaaccggccgtgtgaaacactaggtctcagtcatctatctggcatgtgccagccccataggagttgtaatatcaacgaggacagtggcctgccattggccttcaccatagcacatgagctaggtcattcttttggcatccagcacgacggaaaggaaaacgactgtgaacccgtcggaaggcatccatacatcatgagccgtcagttacaatatgatcccacccctttaacatggtcgaagtgcagcgaggagtacattacacggttcctcgatagaggctggggcttttgcctcgatgacatcccaaagaagaaaggcttaaagagcaaggtgattgcaccgggagtgatatacgacgtacaccaccagtgccagctccagtatgggcccaatgccactttctgccaggaggtggagaatgtttgccagactctgtggtgcagtgtgaagggcttctgtagatcaaagctggatgcagcagcagatggtacacagtgcggggaaaaaaaatggtgtatggccggaaaatgtatcactgtgggaaaaaaacctgagagcatccccgggggatggggccggtggtcaccttggtctcattgctccaggacttgcggcgcaggagtacagagtgctgagaggttgtgcaacaatcctgagcctaagttcggaggtaaatactgcactggggagcggaagcgatacagactttgcaacgtgcatccttgcagatccgaggcacctacattccggcagatgcaatgttccgagtttgataccgttccctataagaacgagctgtatcactggtttcccatctttaaccctgcacacccctgcgagctgtattgtagaccaattgacggacagttcagcgaaaagatgctcgatgcagtaatcgacggcacaccctgctttgaaggcggaaactccaggaatgtttgcataaacggaatttgtaagatggtggggtgtgactacgaaatagactcgaatgcaacagaggatcgatgcggggtgtgtctgggggatggcagcagttgccaaaccgtgcgaaagatgtttaagcagaaagaaggctcggggtacgtggacattggactgattcccaagggggcaagggacatcagagttatggagattgagggggcaggaaacttcttggccattcggtcagaggacccagagaagtactacctcaatggcgggttcattattcagtggaatggaaattacaagctggccggcaccgtgtttcagtatgacaggaaaggcgatttggaaaaactgatggctactggacctactaacgaatccgtttggatccaattgctctttcaggtaacgaatcctggcattaaatatgaatatactatccaaaaggacgggctggataacgatgtcgagcagcagatgtacttttggcagtacggtcactggacagagtgttctgttacttgcggaactggaatccggcgccagactgcacactgtattaagaaaggccgggggatggtgaaggcaaccttctgcgaccccgagactcaacctaacggaagacaaaaaaagtgtcacgagaaggcgtgtccccctcggtggtgggctggagaatgggaggcttgttcagcaacttgcgggccacacggtgagaagaaacggactgttctttgcatacagactatggtttctgacgaacaggcactgcccccgaccgactgccagcacctccttaaacctaagacccttctgtcatgtaatagggacattttatgtccatcagactggaccgtgggaaactggagcgaatgtagtgtgagctgcggagggggtgttagaattcgctccgtgacctgtgccaaaaaccatgacgaaccatgtgatgttacccggaaaccaaattctagagctttatgtgggcttcagcagtgcccttcctctcggcgagtcttaaagcctaataagggaaccatctcaaacggcaagaacccccccacgctcaagcctgtgccaccaccgacgtcaagaccccgcatgctaaccactccaaccggaccagagagcatgtctacttctacaccagccatttcctccccgtctcctacaaccgcatctaaggaaggagacctcgggggtaaacagtggcaggattctagtacgcaacccgagctcagctctcggtatctgatttctaccggtagcacctctcaacccattctgacttcacagagcctgtctatccagccgagcgaagagaatgtctcttccagtgacactggcccaactagtgaagggggtttagtcgccacaaccacctcaggctccggactgagctcaagcagaaacccgattacctggcccgttacacctttttacaacacgctgactaaagggcccgaaatggaaatacactctggcagcggcgaggaacgagaacagcctgaggataaggatgaatcgaatcctgttatttggaccaagatccgagtgcccgggaacgatgcaccagttgaatccacagagatgccactggctcctcccctcacccccgatctgtctagagaaagctggtggcctccgttctccactgtgatggaggggcttctgccatcacaacggcccaccactagcgagactgggaccccccgggtcgagggaatggtgacagagaaacctgccaacacgctcctcccccttggtggagatcatcagcctgaaccctcaggtaaaaccgcgaataggaatcacctgaagctgcctaacaacatgaatcaaacaaaaagcagtgaaccggtgttaacagaagaggatgctacatccctcataacagagggctttctcctaaatgcttcaaattataaacagctaacaaacggtcacggatctgctcactggatagttggcaactggagcgagtgctccacgacatgtgggctgggagcttactggagaagagtggaatgctctacccaaatggacagtgactgtgcagctatccagcgtccagatcccgctaagaggtgtcacttaaggccatgcgccggctggaaagttggaaattggtcgaagtgctctcggaattgttctggcggatttaaaatacgagagattcaatgcgtcgactcccgcgatcacaggaatctcaggccctttcattgccagttcctggctggcatccctccgcccctcagcatgtcctgtaaccccgagccctgcgaggcatggcaggtcgagccctggagccagtgctcaaggtcctgcggtgggggcgtccaggaacgaggggtgttttgccctggaggcctgtgtgattggacgaaacgtccgacaagcaccatgtcctgcaacgaacacctttgttgccactgggcgacaggcaattgggacctttgctcaacaagctgcggcggcggattccagaagagaactgtgcagtgcgtgccctccgagggaaacaagacagaggaccaggaccagtgtttgtgcgatcacaagccacggcccccagaattcaagaagtgcaatcagcaagcttgcaagaaatctgccgacctgttgtgtacaaaagacaagctatctgcgtctttctgccaaactctgaaagccatgaagaagtgttcagtcccgactgtgagagcagagtgttgttttagttgcccacagacccatattacccatacacagcggcagcgcagacagaggttacttcagaagtcgaaagagttatag

SEQ ID NO: 178039 - DNA, 699 bp, Artificial Sequence
  Description of Artificial Sequence: Synthetic coding sequence
atgccctgcgcccagcggagctggctggccaacctgagcgtggtggcccagttgctgaactttggcgccctgtgttacggcagacaaccacaacctggcccagtcaggtttccagaccgtagacaggagcattttatcaaagggctgcctgagtatcatgtggttggcccagtcagagtagacgccagtggccattttctgagctacggcctacactaccctataacctcatccagaaggaaacgggacttggacggttccgaagactgggtctactaccgcatcagccacgaagagaaggacctgttctttaatctcaccgtgaaccaaggtttcctgtccaattcttatattatggagaaacggtacggtaatctatcacatgtgaagatgatggcaagctccgctcctttatgtcatctgagtggcactgttcttcaacagggaactcgcgtgggtacagcggctctgagcgcatgtcacgggctcacaggcttctttcagctgcctcatggggacttcttcatagaacccgtgaagaaacatccactggtggagggaggctatcaccctcatattgtatataggagacaaaaggtacctgaaactaaggaaccaacctgcgggcttaagggaatagtaacccatatgtcttcatgggtggaggagtccgtgctgttcttttggcttttctactag

SEQ ID NO: 178040 - DNA, 3675 bp, Artificial Sequence
  Description of Artificial Sequence: Synthetic coding sequence
atgaagccccgggcccggggctggcggggcctggccgccctgtggatgctgctagcacaggtcgcggagcaggctcctgcttgtgctatgggaccagctgccgccgctcccggctctcccagcgttccaaggccccccccaccggctgagaggcccggttggatggagaagggcgagtacgaccttgtaagcgcctatgaggttgaccataggggcgactacgtgagccacgagatcatgcatcaccagcgcaggcgtcgcgccgtcccagtcagtgaggtggaatccttgcatctgcggctgaaggggagccggcatgacttccacatggatctccgcacgtcctcatctctggtagcccctggcttcattgttcagactcttgggaaaacaggcactaagagcgtgcagacgctgcccccggaggacttttgcttctatcaaggcagcctgcggtcgcacaggaactcgagcgtagccctctccacttgccaaggtctgagcggcatgatcagaactgaagaggccgactattttttgagacccctgccctctcacctctcttggaagctggggagggccgcccagggttcaagtccgagccatgtactgtataagagaagcaccgaaccacacgctcccggcgccagcgaagtcctcgtcacttcccgcacgtgggagctcgcacatcagcctctccatagttccgatctgcgactgggcttgcctcagaaacagcacttctgtggtaggcgcaaaaagtacatgccccagcctcccaaagaagacctctttattctccctgatgagtataaaagctgcttgaggcacaagcggtctctgctgcgttctcacaggaacgaagagctcaacgtcgagaccctggtcgtagtggacaaaaagatgatgcagaatcacggacatgaaaatataactacgtatgtactgactattcttaatatggtcagcgcgttatttaaagacgggacgatcggcgggaacattaacattgcaatcgtgggcctcattctgctggaagacgaacagcctggcctggtcatctcacaccacgctgaccacactctgagctccttttgtcagtggcaaagtggtctgatgggcaaggatggaacccggcacgatcacgctatcctgctaaccggcctcgatatttgtagctggaaaaacgagccctgtgatacattggggtttgctcctatctcgggcatgtgctccaagtaccgttcgtgcacaattaacgaggacaccggcttgggtctggctttcaccatagctcatgaatccgggcacaacttcggaatgatccatgatggcgagggcaatatgtgcaaaaagagcgaaggcaacatcatgtcccccacactggccggccgcaacggggtattttcatggtcaccgtgctcaagacagtacctgcataagttcctgagtactgcccaggccatatgcctagcagatcaaccaaaacccgttaaagagtacaagtatcctgagaagctgccaggtgaactgtacgatgctaatacgcagtgtaaatggcagtttggtgagaaagctaagctgtgtatgttggatttcaagaaagatatttgtaaggccttgtggtgtcatcgcataggccggaagtgcgaaactaagtttatgcctgccgcggaaggcactatctgcggtcatgacatgtggtgccgcggaggacagtgcgtgaaatacggggacgagggccctaagcccacccatggacactggtccgattggtccagctggtcaccatgttcccggacctgcggcggtggcgtgtctcatcgctcccgcctctgcactaaccccaaaccttcacatgggggaaagttctgtgagggatctacaagaacgctgaaactgtgcaactctcagaaatgtcctagagactccgtcgatttccgtgccgcccagtgtgctgaacacaattctaggcgctttcggggacgtcactataaatggaaaccgtacacccaggtagaagaccaggatctctgtaagctgtactgtattgcagaggggttcgatttctttttcagcctgagcaacaaggtgaaagacgggacaccatgtagcgaggactcacgaaacgtgtgtatagacggtatctgtgagagggtcggatgcgacaatgtgctaggatctgacgccgtagaggacgtgtgtggggtgtgcaatgggaacaattctgcgtgcacaattcaccggggactatatacaaaacatcaccacacgaatcagtactaccatatggtgacaataccctccggcgctcggtccatccggatctacgaaatgaatgtttcaacttcatatattagcgtccggaacgcgctcaggagatattatcttaatggtcattggacggttgactggccaggtcgctacaagttctctggcactaccttcgattaccgccgttcctacaacgaaccagagaatctgatcgcgacaggtccaactaacgaaacccttattgttgaactgctctttcagggtcgcaaccctggcgttgcctgggagtatagcatgccaaggctgggcacggagaaacagccccctgcccagcccagctacacgtgggcgatcgtgcgctctgaatgctctgtatcctgtgggggcggccagatgacagtgagggagggatgctatcgcgatctgaaattccaagtcaatatgagcttttgcaaccctaagacccgcccagtgacggggctcgtaccttgtaaagtgtccgcctgcccgcccagctggtctgtgggcaactggtcagcgtgttcacgcacctgtggtggtggcgcacagtcccgaccagtccagtgtacaagacgcgtacattatgacagcgagcctgtgcctgcctcgttgtgtccccagcccgctcctagctcgcggcaagcatgcaactcccaaagctgtcctcccgcctggtccgcaggcccatgggccgaatgtagccatacgtgcgggaaggggtggcgtaagcgcgccgtggcctgcaaaagtactaatcccagcgccagggctcagttactccctgacgctgtctgtacctcggagcccaagccccgcatgcacgaggcctgcttgttacaaaggtgtcacaaacccaaaaagctgcaatggcttgtcagcgcttggtctcagtgtagcgtgacctgcgagaggggtacccaaaaaaggtttctgaagtgcgcagagaaatatgtgtcgggaaagtatagggaactggcaagcaagaagtgctcacacttgcctaagccctctctggagctcgaaagggcctgtgccccactgccgtgcccccggcacccgcctttcgcagcggccggaccaagtcgaggctcctggttcgctagcccctggagtcagtgtaccgcgagctgtggcgggggagttcagacacgatctgtgcaatgcctggccggcggacggcctgccagtggctgtctgctgcaccagaagcccagcgcatcccttgcttgtaatacacacttttgcccaatcgccgagaagaaagatgctttctgcaaagattactttcactggtgctatctcgtgccacagcacggaatgtgctcacacaaattctacggaaagcagtgttgcaagacctgttcaaaaagcaacctgtag

SEQ ID NO: 178041 - DNA, 2787 bp, Artificial Sequence
  Description of Artificial Sequence: Synthetic coding sequence
atgaagccccgggcccggggctggcggggcctggccgccctgtggatgctgcttgctcaggtggctgagcaagctcctgcgtgtgctatgggtccagcagctgcagcccctggcagtccgagcgtgccccgcccacctcccccggccgaacgtcctggatggatggaaaaaggcgagtacgatttagtctcagcctacgaggttgatcatcggggcgactatgtgagtcatgaaattatgcatcaccagcggaggagaagggcagtgcctgtttccgaagtggagtcattgcacctccgcctcaaggggagcagacacgactttcatatggacttgcggacatccagctctctggtggcacccggcttcatcgtgcagacactcggcaagaccggaacaaaatcggtgcagaccttgcctccagaggacttctgcttttaccaggggtcgctacggagccaccgcaattccagtgttgcgctttctacctgtcagggtctttccggcatgatccggaccgaagaggctgattactttttgagacctctgccctctcacctcagttggaaactcggaagagcggcacaaggaagcagccctagccatgtcctgtacaagcgatctaccgagccccacgcacccggagcctccgaagtcttagttaccagccggacctgggaacttgcccaccaacctttgcatagtagcgatctccgactcggattgcctcaaaaacagcacttctgcggtagacgcaaaaaatacatgccccagcctcctaaagaggacctgttcatcctgccagacgaatacaaaagttgcctgaggcataagcgatctttactgcggtcccatcgcaacgaagagctcaacgtcgagacattggttgtggtggataagaagatgatgcagaatcacgggcacgaaaatattaccacctacgtgctcactattctcaacatggtgagtgccttatttaaagacgggactatcggggggaatatcaacattgcaattgtgggactcatcctactggaggacgagcaacccggtcttgttataagccaccacgctgaccacacccttagttctttttgtcaatggcaatcaggactcatggggaaggatggcacccggcatgaccacgcaattcttctaacaggtctggacatatgttcctggaaaaacgaaccctgtgacactctcggcttcgcccctataagtggaatgtgttcgaagtatcgctcctgcactatcaatgaagacaccggcctgggactggcctttactatcgcccacgaaagcgggcacaactttggaatgatccacgacggggaggggaatatgtgtaaaaaaagcgagggcaatataatgtcgcccacgctggccgggaggaatggtgttttttcttggtcaccttgctccaggcagtatctccacaagttcctgtccacagcacaggcaatatgcctcgccgatcagccaaagccagttaaggagtacaagtaccctgagaaactcccgggagagctctacgatgccaatacccagtgcaagtggcaatttggggaaaaggccaagttatgcatgcttgattttaaaaaagatatctgcaaggcgctttggtgccataggatcggtcggaagtgcgaaaccaaatttatgccagctgcggagggcactatatgtggccatgacatgtggtgcaggggaggccaatgcgtcaagtacggggatgagggacctaagccaacacacggacactggtcagattggtcatcttggagcccgtgctcccggacctgcgggggtggggtgagccatagatcccggctttgtaccaaccccaagccctcccacggggggaaattttgcgagggttcaaccagaacactgaaactttgtaatagccagaagtgcccacgggacagcgtggacttccgtgctgcacaatgtgctgaacataatagccgtagatttaggggacggcactacaagtggaaaccgtatacccaggtggaagaccaggatttgtgcaagttgtattgcatcgccgagggcttcgactttttcttcagtttatccaataaggtcaaggacgggaccccctgctccgaagacagccggaacgtgtgcattgacggcatttgtgagcgggtgggttgcgataacgtcctgggctcagacgctgtggaggacgtctgtggcgtttgtaacggaaacaattcggcatgtacaattcatcgcggtctatataccaaacatcaccacacaaaccagtactaccacatggtgactatcccgagtggagccaggagcatccgcatatacgaaatgaacgtctcaaccagctatatttctgtgagaaatgccctcaggagatactacttaaatggccactggaccgtggactggcctggacgatataagttctctggtactacctttgattataggcggtcatacaatgaaccagaaaaccttatcgcgaccggacctaccaatgaaactctgattgtagaacttttattccaagggcgtaaccctggggtggcctgggagtattccatgcccaggctggggaccgagaagcagccccctgcccagcccagttacacctgggccattgtacgttcagaatgctccgtctcatgtgggggcgggcaaatgacggtccgggagggatgctatagggacttcttgtacttcatgttctacctctcccaactcttcgccagtgagtgtccattcaaaaacacgttgctgcacgccttcctgtgcaaatag

SEQ ID NO: 178042 - DNA, 3288 bp, Artificial Sequence
  Description of Artificial Sequence: Synthetic coding sequence
atgtgcgacggcgccctgctgccccccctggtgctgcccgtgctgctgttgctggtctgggggctagacccaggtaccgcagtgggagacgccgccgctgacgtggaagtggtgcttccctggcgggtccgaccagacgacgtgcacttgcctccgctgcctgccgcccccggaccacgccggagaaggagaccgaggaccccgcccgcagcacccagagctagacctggagagcgagctctgctgcttcacctgcctgccttcggacgcgacctctacttgcagctgcggcgggacttaagattcttgtcccggggcttcgaggttgaggaagctggtgccgctagacgccgagggcggccagcagagttatgtttctacagtggaagagtgcttggacaccccggaagtctggtaagcctatccgcctgcggagctgccggaggtttagtaggactgattcagctgggccaggagcaagtattaatacagccacttaataacagccaaggcccgttttcaggaagggaacaccttatccgacggaaatggtcactaacccccagtccatcagctgaggcccagcgccctgagcagctgtgtaaggtgcttacagagaagaagaagcctacctggggaagaccgagccgcgactggcgggagagacgaaatgcaataaggttaacaagcgagcacacagtggagactctggtcgtcgcagacgcggatatggtccaatatcacggggcagaagcggcccagcggttcattctaactgtgatgaacatggtttataatatgttccagcaccaatcgctgggcattaagatcaacattcaggttacgaaactggttcttctgagacagcgccctgcaaagctgtcaatcgggcaccatggggagcgcagtttagagagcttctgtcattggcaaaacgaggaatacgggggggccaggtacctcggtaacaaccaggtgccgggagggaaagacgacccacctctggtcgatgccgctgttttcgtcacacgcaccgacttctgtgtgcacaaggacgagccctgcgataccgtcgggatagcttaccttggcggtgtctgttctgcaaaaagaaaatgtgtcttggccgaggataacggcctcaatcttgcttttaccatcgcccatgaactgggacacaatctgggcatgaatcatgacgatgatcattccagttgcgctggacgatctcacatcatgtcaggtgaatgggtaaaaggccgcaacccgtccgatctgagctggagctcgtgctcccgtgatgatctcgaaaattttctgaagagtaaggtgtctacctgcctcctcgtgactgacccccgaagccagcatactgtgaggctgcctcataagttgccagggatgcactatagcgctaacgagcagtgtcagattttattcggcatgaacgccacattttgcaggaacatggagcacctgatgtgtgctgggctctggtgcttggtcgagggcgacacatcttgcaaaacgaagttagatccccctctggatgggacagagtgcggagctgacaagtggtgcagagcaggggaatgtgtgtcaaagacaccgattccagagcacgtagacggagattggtcaccctggggtgcttggagtatgtgttcacgaacatgcggtaccggagcccggttccgtcagagaaagtgcgacaatccccctcccggccccggcggtacccattgtcccggcgcgagcgtcgaacatgccgtctgcgagaacctcccctgtccaaaagggctcccatctttcagggaccagcagtgtcaggcccacgacaggctcagccccaaaaagaaaggcctgttgaccgctgtagtggtggacgataaaccctgcgagctgtattgcagccctctaggcaaagagagcccattgttagtagcagatcgggtcctggacggcacaccctgtggcccttatgagactgacctgtgcgtgcacggaaaatgccaaaagatcggttgcgatgggattatcggttccgctgccaaggaggatagatgcggggtatgcagtggcgacgggaaaacatgccatctggtcaagggagatttctctcacgcgagaggaactgcacttaaagactctggaaagggaagtatcaacagcgactggaagattgagctgccgggagagttccaaatcgccggaactacggtaagatacgtgcgcagggggctgtgggagaagatatccgccaagggtcctactaaactgcctctccatctcatggtgcttcttttccacgatcaggattatggaatccattacgagtatacggtgccggtgaacaggacagcagaaaaccaaagcgaacctgagaagccccaggatagtctgtttatttggactcactccggttgggaaggctgttccgttcagtgtggcgggggcgagcgtcggacaatcgtgtcttgcacacggatcgtcaacaagacaaccaccctggtcaatgacagcgactgccctcaggcctcccgccccgagccgcaggtgcggcgctgtaacctccacccttgtcagagtcggtgggttgccggcccttggagcccttgctcagctacttgtgagaagggatttcaacatcgtgaggtgacctgtgtctatcaactccagaatggaacgcatgtagccaccagaccactgtactgtcccgggcctagaccagctgcagtccagagctgcgaaggccaagactgcctctccatctgggaggccagcgagtggtcccaatgttcggcctcctgtgggaagggcgtatggaagcgtaccgtggcctgcactaattcccaaggcaaatgtgacgcatccacaagaccgcgcgctgaagaggcgtgtgaggactatagcggatgttatgaatggaagactggagattggagcacctgttccagcacctgtggtaaggggctgcagtccagagtggtccagtgcatgcataaggtcaccggacgtcacgggtcggaatgtcctgccttgagcaagcccgccccataccgccagtgttaccaggaggtgtgcaatgatcgaatcaatgccaacaccattacttccccacgactggctgcactgacttacaaatgtacccgcgatcaatggactgtatattgtcgtgtgatccgcgaaaaaaatctgtgccaggacatgagatggtatcaacggtgttgccagacttgtcgcgatttttatgccaataagatgcgccagcctccccctaatagctag

SEQ ID NO: 178043 - DNA, 3666 bp, Artificial Sequence
  Description of Artificial Sequence: Synthetic coding sequence
atggagtgcgccctgctgctggcctgcgccttccccgccgccggcagcggccccccccgtgggctggccggtctcggcagggtcgccaaggccctgcaactttgttgcttgtgctgcgcgtcagttgccgcagcactcgcgtccgatagtagctctggtgcctcgggacttaatgacgattatgtgtttgtcacacctgtcgaggtagattccgccgggtcgtacatctcccatgacattctgcataatgggcgtaagaagaggtctgcccagaatgcacgaagcagcttgcactacagattttccgcattcggacaagaattacatcttgagcttaaacctagtgcaatcctgtcctcacatttcatcgttcaggtactcgggaaggatggggcctccgaaacccagaaaccagaggtgcagcagtgcttttatcagggattcataagaaatgatagttcgtcttccgttgcagtgtccacttgtgctggcctgagtggattgataaggacccgcaaaaatgagttcctcatttcccctctgccccagctactggctcaggagcataactacagctcacccgccgggcatcatccacacgtgttatataaacgtacggccgaggagaagatccagagatatagaggttacccgggatctggtagaaactaccctggctacagcccctcccatatcccccatgccagtcaaagccgggagactgaatatcatcaccgtaggctgcagaaacaacatttttgcggaagacgcaagaaatatgcccctaagcctcctacagaagatacttacctccgattcgacgagtacggatcttcaggacgacctcgccgcagcgccggcaaatcacagaaaggcctgaacgtcgagaccttggtcgtggcagataagaagatggttgagaagcacgggaagggtaacgttacgacatatatcctgacggtaatgaacatggtttcagggttatttaaggacggtacaattgggtctgacattaacgtggttgtggtgtccctcatactcctagagcaggaacccgggggactgcttataaatcaccatgcagatcagagtctgaatagcttctgccagtggcagagcgccctgatcggaaagaatgggaagcggcacgaccacgccattctgcttacagggtttgacatttgtagttggaagaacgaaccctgcgacaccctcggattcgccccgataagcggaatgtgtagcaaatatagatcctgcaccattaatgaggacacggggctaggtttggccttcaccattgcacacgagagtggccataattttggtatgattcacgacggtgaaggaaatccttgtagaaaggcagagggcaacatcatgtctcctaccttgacggggaataatggcgtgtttagctggagcagttgctcgcgccaatacctgaagaaattcctgtccactccacaggctggatgtcttgtggatgagcccaagcaggccggccagtacaaatatcccgataagcttcctggtcagatctatgacgccgatacccagtgtaagtggcagttcggcgcgaaggccaaactgtgctccttgggcttcgtcaaagacatttgcaagtcattatggtgccatagagtcggtcatcggtgcgagacaaagtttatgcctgcagctgaaggcacagtatgcggactctccatgtggtgccgccaggggcagtgcgtgaagtttggcgaactcgggcctcggcccatccatggccagtggtctgcttggagtaaatggagcgagtgttcacggacctgcggggggggcgtgaagtttcaggaacggcactgcaataatcccaagcctcagtatggggggcttttctgccctggatcatcacgaatttaccagctgtgcaacattaatccgtgtaacgagaatagcttggattttcgggcacagcagtgtgccgagtacaatagcaagccctttcgcggctggttttatcagtggaagccctacacgaaagtggaggaggaagatcgttgcaagctctattgcaaagcggagaatttcgaattcttcttcgccatgagtgggaaagttaaggatggcactccctgcagcccaaataagaatgatgtttgcattgatggcgtctgtgagctggtgggctgtgatcacgaattaggatcaaaagccgtttcagacgcttgtggtgtctgtaagggagacaattcgacgtgcaaattctacaagggactgtatctgaaccagcacaaggcgaatgagtattatcctgtggtgctcatcccagcaggtgcaaggtcaattgagatccaagagctccaggtaagctcttcctacctggctgtaagaagtttgagccagaaatattatctgacaggcggttggtccatcgattggcctggtgagttccctttcgcaggaacaaccttcgagtaccagcgatcttttaaccgcccggagcgattgtatgcacctggaccaactaatgaaaccttggtcttcgagatcctaatgcaggggaagaacccaggcatcgcctggaaatatgcgttacccaaagttatgaacgggactccccccgctactaagcggcccgcctatacatggagtatagtacagtccgagtgttcagtatcttgtggtgggggctatattaacgtgaaggccatatgtctaagggatcagaacacccaagtgaatagctccttctgctccgctaaaaccaagcccgttactgaacccaagatctgcaacgctttcagttgccctgcctactggatgccaggtgagtggagcacttgctccaaagcctgtgcaggtggccagcagtctagaaagatccaatgcgtccagaagaaaccctttcagaaagaggaggcagtgcttcactctctgtgtcctgtaagtacccccacacaggtacaggcctgtaacagtcacgcttgccctcctcagtggagccttggcccctggtctcagtgctccaagacttgtgggaggggtgtgagaaagcgcgagctcctgtgtaaaggaagcgccgcagagaccttaccggaatctcagtgtactagtctaccccgacccgagctccaagaaggttgtgttctggggagatgtccaaaaaattcccgcctccagtgggtagcgagcagctggagcgaatgttccgccacctgcggccttggcgtgagaaaacgggagatgaaatgctctgagaaaggtttccagggaaagctgataactttcccagaaaggcggtgtcgcaatattaaaaaacctaacctcgaccttgaggaaacatgcaaccgcagggcttgccctgcacatcccgtgtacaacatggtggccggctggtatagccttccttggcaacaatgtacagtaacttgtggcgggggagtccaaacgaggtccgtgcactgtgtacagcaaggtcggccttcgtctagctgtctgctccaccagaaacctcctgtcttaagagcctgtaatacaaatttctgtcccgctccagaaaagcgggaagacccaagttgcgtggacttttttaactggtgccatctcgtaccccaacacggagtgtgcaatcataaattctacggcaaacagtgctgtaagtcctgcacgcgcaaaatttag

SEQ ID NO: 178044 - DNA, 825 bp, Artificial Sequence
  Description of Artificial Sequence: Synthetic coding sequence
atggagtgcgccctgctgctggcctgcgccttccccgccgccggctccggccccccgagaggactggctggattaggacgtgtcgctaaagcacttcaactgtgttgtctttgttgcgcgtctgtcgctgcggcactggcatcagatagctcgtcaggagcttccggcctgaacgatgattacgtgttcgttaccccagtcgaagtggactctgctggtagttatattagccacgacatcctgcataatggccggaagaaacgatccgcgcagaatgctcggtcctcgctgcattatcggttttccgctttcgggcaggagctgcatttggagttaaaaccatcagctattctgtcatcccatttcattgtacaggtgttggggaaggatggtgccagcgagacccagaaacctgaggtgcagcagtgtttctatcaaggatttatcaggaatgatagtagctcttccgtagcagtgtctacctgcgccggactctcaggactgatacgcactcgtaaaaatgaattcctgattagccctcttccacagctgctcgcacaagagcacaactactcatcacccgctggacaccacccccacgtactgtacaagcgcacagcagaggaaaaaattcagcgttataggggatatcccggatctggcagaaattatcccggctattcgcctagccacatcccacatgcctcgcagagtagagagaccgaatatcaccaccggcgcctccaaaagcagcacttttgcggacggcggaagaaatgcatttgctctcaggccagccatagaggccacctatccaaggtgtag

SEQ ID NO: 178045 - DNA, 3636 bp, Artificial Sequence
  Description of Artificial Sequence: Synthetic coding sequence
atggacccccccgccggcgccgcccggcggctgctgtgccccgccctgctgttgctcttattgcttctgcctccacccttgcttccgcctccgccaccgcctgccaatgcacggctagccgctgctgcagaccccccaggcggccccctagggcacggggctgaacgaatccttgcagtgccggtgcgcacggacgcccagggtcgcctggtatcacatgtcgtgagtgctgccacctctcgcgccggcgtcagagcccggagggcagcccctgttcgaaccccaagcttcccaggggggaatgaagaggaacctgggagccatcttttctataatgtcacggtattcggacgagatttgcacttgagactgagaccaaacgctagattggtggcccctggcgcaaccatggagtggcagggagaaaaagggaccactagggtggaacccctgctgggaagttgcctgtacgtgggtgatgtcgctggtctggcagaagcaagctcagtcgcactatccaattgtgacgggctcgcaggacttatccgcatggaggaagaggagtttttcattgagcctcttgaaaaaggtctcgcggctcaggaggccgaacaaggaagagtgcatgtggtgtaccgaagaccgccgacctcaccgccactgggcggaccgcaggcattagacactggggcgtctcttgattccctggactcactgagtagagctctgggagtgctggaggagcatgctaatagttcgagacggcgcgctaggcgccatgcggctgacgatgactacaacatcgaggtgttacttggggtggatgattccgtcgtccagttccatgggaaggaacatgtccagaaatatctcctgacactaatgaatatcgtgaacgagatataccacgacgagtccctgggggcccatatcaacgtggtgctggtcaggattattcttctgagctatggaaaatcgatgtccctgatagagattgggaacccgagtcagtctctcgaaaatgtgtgcaggtgggcgtacctgcagcaaaagcctgacacaggacatgacgagtaccacgaccatgccatcttcctgactaggcaagacttcggcccgagtgggatgcagggatacgctcctgtgactgggatgtgccatcccgtcagatcatgcacgctcaaccacgaggatggattctcctccgcgttcgttgtggctcacgagactggacacgtgttagggatggaacatgacggtcagggtaatcggtgcggggatgaggtgagactgggtagcatcatggctcctttagtccaggcagcctttcataggttccactggtcgagatgtagccaacaagaattgagtcgctatctgcactcatacgattgccttctagacgatcctttcgctcacgactggccagctctgcctcagcttcccggtttacattattccatgaatgagcaatgtcgctttgattttgggctcgggtacatgatgtgcaccgctttccgcactttcgacccttgcaaacagctgtggtgttcccacccagataacccatatttctgtaaaacaaagaagggcccccctctggatggaacgatgtgtgcccccgggaagcactgtttcaagggacattgcatctggctaactcctgatatactgaaaagagacgggagctggggtgcctggagccccttcgggtcgtgttccagaacgtgtgggacaggggtcaagttcaggactcggcagtgtgataatccccatccagcgaacggaggtaggacatgcagcggactggcgtacgattttcagctgtgctcccggcaagattgtccagatagccttgctgactttcgggaagagcagtgtagacagtgggacctctatttcgagcacggtgacgcccagcatcactggctcccacatgagcatcgagacgccaaggagcggtgccacctatactgcgaatctcgcgaaaccggtgaggtggtgtcaatgaagaggatggtgcacgatggcacacgctgttcctataaggacgcattcagcctctgtgtccgcggggattgtagaaaagtcggctgcgatggggtgataggctcatctaaacaggaggacaagtgtggtgtgtgtggaggtgataatagtcattgcaaggtcgtgaaggggacatttacgaggtcacctaagaagcacgggtacattaagatgttcgaaatacccgccggagctagacacctgcttatacaggaggtcgatgccacatcgcaccacctggccgtgaaaaaccttgagacggggaaatttatattgaatgaggagaacgacgttgacgcttcatctaaaactttcattgctatgggagtcgagtgggaatatagagatgaggacggtcgagaaactttacagaccatgggccccctccacgggacaattacagtgctagtgatacctgttggagacacacgggtaagtttgacatataagtatatgattcatgaagacagcttgaacgtggacgataacaacgtgctggaggaggactcagttgtgtacgagtgggcactcaagaagtggagcccttgcagtaagccgtgtggcgggggaagtcaattcactaaatacggatgcagaagacgtctggatcataaaatggtacacagaggcttctgtgcggcactcagtaaaccaaaagccataaggagagcttgtaacccacaggagtgcagccagcccgtgtgggtgactggggagtgggagccctgttcgcagacatgtggccgaactggtatgcaggtgaggtctgtgagatgtatccagccccttcacgacaacactacccgatccgtccacgcgaaacattgcaacgatgccaggccagaatcacgccgggcttgtagccgagaactgtgccctgggcggtggagagccggcccttggagccagtgcagtgtgacctgcggcaacgggacgcaggagagacccgtgctgtgccggactgccgatgattctttcggcatttgtcaggaagaacgcccagaaactgcccgcacatgcaggctggggccctgtccgcgcaacatttcagatccctcaaagaagtcatacgttgtgcagtggctgtctcgtcctgatcccgacagtccaataagaaagatctcatctaaagggcactgccagggggataagtctatattttgtcggatggaagtactttcgcgctactgctcaatccccggttataacaagctatgctgtaagtcatgtaatctttataataatctcacaaacgtggagggacgaatcgagcctccgccaggcaagcataatgatatcgatgtttttatgcctacgctgcctgtgccaacagtcgcaatggaggttcggccatccccatccacaccccttgaggtacccctgaacgcttctagtactaatgccaccgaagatcaccctgaaaccaatgcggttgacgagccatataagattcatggtttagaggatgaggtgcagccacctaatcttatcccacgccggccgagcccctacgagaaaactaggaatcagcgcatccaggagctgattgacgagatgaggaagaaggagatgttgggcaagttttag

SEQ ID NO: 178046 - DNA, 1701 bp, Artificial Sequence
  Description of Artificial Sequence: Synthetic coding sequence
atggacccccccgccggcgccgcccggcggctgctgtgccccgccctgctgctgctgctcttgctcctgccaccaccacttctgcctcccccacctccgcccgccaacgcacggttagccgccgctgcagacccacccggtggccccctgggacacggggccgagcgaatacttgccgtgcccgtgcgcacagacgctcaaggtcgactcgtctctcacgtggtctccgcagctacttcccgcgctggtgtgcgggctcggcgtgcggctcctgtgaggacccctagcttcccagggggcaatgaagaagagccgggaagtcatcttttttataatgtcaccgttttcggcagagacctccacttgcgactgagacccaacgccagattggtcgctcccggcgcaaccatggaatggcagggagaaaaaggaaccacccgcgtggaacccctgttggggagctgcctctatgtgggagacgtcgccggtctggctgaggcatcctctgtggccctgtcaaattgcgatgggcttgctggactgatccggatggaggaggaagagttcttcatcgaacccctggaaaaggggctggcggctcaggaggccgagcagggcagggtacatgtcgtctaccgaagacccccgacaagcccccctctgggcggacctcaagccttggacacaggcgctagtctggatagcctcgatagcctctcccgggctctgggcgtgctagaggagcacgccaatagcagtcgacggcgagcccgccgacacgccgctgacgacgactacaacatcgaagtactgctgggggttgacgacagtgttgtgcagtttcacggcaaagagcacgtgcaaaagtacctgctgacgttgatgaacattgttaacgagatttaccacgacgagagccttggggcccatataaatgtggtcctcgtgcgtatcatcctcttaagctatggcaagtccatgtcactaatcgaaattggtaatccgagccagagcctggaaaacgtgtgtcgctgggcgtacctccagcaaaaacctgataccgggcacgacgaataccacgaccacgccatcttcctgacaagacaggacttcgggccgagcgggatgcagggttacgcaccagtcaccgggatgtgccatccggtccgcagctgcactctaaaccacgaagacggcttttcttctgcgttcgtggtcgctcacgagaccggacatgtgctgggaatggagcacgatggtcagggtaatcgctgcggcgacgaagtccgactcgggtccatcatggctcccctggtgcaggccgcgttccatagattccattggtcccggtgctcacagcaagaactcagtagatacctacactcttatgattgtctattggatgacccttttgctcacgactggccagcattgccacaactgccagggctccactacagtatgaacgagcagtgcaggtttgacttcggtctgggttacatgatgtgcacagcatttagaacctttgatccctgtaagcagctctggtgttcccaccctgataacccctacttctgcaaaaccaaaaaaggcccaccactggatggaactatgtgcgcgccagggaaattccggcctggagccgttgcacacgcatgctacccgagtactcttggtggacagggacgctggatcgcgtag

SEQ ID NO: 178047 - DNA, 4515 bp, Artificial Sequence
  Description of Artificial Sequence: Synthetic coding sequence
atgtgggtggccaagtggctgaccggcctgctgtaccacctgagcctgtttatcactagatcctgggaggtagactttcatcctcgacaagaagccctggtcaggaccttaacctcttacgaggtggttattcctgagcgcgtgaacgaatttggggaggttttccctcagtctcatcatttctctcggcagaaacgaagcagcgaggccctggagccgatgcccttccggacgcattataggttcacggcctacggacagctcttccagctgaacctcactgccgatgctagtttcctcgccgctggatatacagaggtccacctgggaaccccggaacgtggcgcctgggagagtgacgctggcccatctgacctccgccattgcttctatcgcggtcaagtcaacagccaagaagattacaaggccgtcgtctccctgtgcggtggcctaactggaaccttcaaggggcagaacggggagtatttcctagaaccaattatgaaggccgatggcaacgagtacgaggatggtcacaacaagccacatctgatctatcgacaggatctgaataattccttcctgcagactctcaaatactgctcggtctccgaaagccagataaaagaaactagcctcccatttcacacctactccaacatgaacgaagacctgaacgtaatgaaagaaagggtgttggggcacacttctaaaaatgttcccttgaaggatgagaggagacattctcgcaaaaaaagattaattagctacccaagatacattgagattatggtaactgcggacgcgaaggttgtctccgcacatgggtctaatctgcagaactatatcctgacactgatgtcaattgtggcaacgatctacaaggacccatctatcggaaatctgattcacattgtagtagtgaagctagtgatgatacatagggaggaggagggacctgtcattaactttgatggagccactacactaaaaaacttttgttcctggcagcagacccagaatgacctagacgatgtgcaccctagccaccatgatacggctgtgctgattacgcgggaggatatctgttctagcaaagagaagtgcaatatgctgggcctgtcttaccttgggactatctgcgaccccctgcagagctgctttattaacgaggagaagggcctgattagtgcctttacgattgctcacgaattaggacatacactcggagtgcaacatgatgacaatcctcggtgcaaagagatgaaggttactaagtatcacgtaatggctccagcacttagctttcacatgagtccatggagttggtccaattgttcccggaagtacgtgacagagtttcttgacacagggtacggcgaatgccttcttgacaagcctgacgaggagatttacaacctgccatcggagcttcccgggagcagatatgacgggaacaagcagtgtgaattagccttcggacctggcagccagatgtgcccccacatcaatatctgtatgcacctgtggtgtactagtacggagaaattacacaagggctgcttcactcagcatgtgcctccggccgacggtacggattgcggccccggcatgcactgtaggcacggactctgcgttaacaaggagacggagaccagacccgtcaacggcgaatggggtccttgggaaccctattcaagctgctcgcgcacctgtggtggagggatagaatcggccactcgcaggtgcaatagaccagagcctagaaacggaggaaattattgtgtggggaggaggatgaagttccgtagttgcaacacagattcctgtccaaagggcacccaggactttcgcgaaaaacagtgctcagactttaatggtaagcacctagacatttcaggaattccatcaaacgttcggtggctgcccaggtatagtggtatagggacgaaggataggtgcaaactgtattgccaggtcgccggcaccaactacttctatctcctgaaagatatggtggaggacgggacaccgtgtggcacagagtcgtataatatcgactgcaactgtgtgcttaaggcagccggctgcgatcacgtccttaacagctcagcaaagatcgacaagtgtggtgtttgtggcggggacaacagctcgtgcaaaacaattactggagttttcaactccagtcactacggctacaatgtagtagtgaagattccggctggagcgactaacgttgacattcggcagtacagttacagcgggcagcccgacgactcctatttagccctgtcagacgccgagggcaacttcctgtttaatggcaactttctgctcagcacctcaaagaaggagattaacgtccaggggacccgaacagtgatcgagtatagcggaagcaataatgccgtggagcgtatcaactcaactaatcgacaggagaaagaaatcctcatcgaagtgttgtgcgtaggtaatctctacaaccccgacgtgcattatagtttcaatattccactggaagagagaagtgacatgttcacatgggacccatatggcccttgggaaggttgcacaaaaatgtgccaggggttgcaacgcagaaatattacctgtatccataaatcggatcattccgtggtttccgacaaagaatgtgaccacctacccctcccctccttcgtcacccaaagctgtaacaccgactgcgagctgcgatggcacgtcattggcaagtccgagtgctcaagccagtgcggccagggctataggactctggatattcattgtatgaagtactcgattcacgagggacagaccgtgcaggtggacgatcactactgcggggatcagttaaagcctcccacacaggagctctgccatggtaactgcgtgttcactaggtggcactacagtgagtggagccagtgcagccggtcctgcggaggaggcgagcgttctagggagagctactgcatgaataatttcggtcaccgtctagcagacaatgagtgtcaagaactttcccgagtaacccgcgaaaactgcaacgaattcagttgccctagttgggccgcaagcgaatggtctgagtgtctggtcacgtgtgggaaaggtaccaagcaaagacaggtttggtgccaactcaacgttgaccacctgtccgatggcttttgcaactctagcacaaaaccagaaagtctaagcccttgcgaactccatacctgcgcttcttggcaggtgggcccatggggtccctgtaccaccacgtgcggacatggttatcagatgcgagatgtcaaatgcgtgaacgagttagcttccgcggtcctagaggacactgagtgccatgaagcttcaagaccaagcgacagacagtcatgtgtattaaccccctgcagctttatctcaaagctagaaacagcacttctgcctacagtcctgataaaaaagatggctcagtggagacatggcagttggacaccttgctccgtatcttgcgggcgtggcacacaggcccggtatgtatcctgtcgcgacgccctggatagaattgcagacgagagctattgcgcccacctgccgcggcccgcggagatttgggattgcttcactccctgcggagagtggcaagcaggggattggtcaccttgctctgcgtcgtgtgggcatggtaagacaacaaggcaggtactgtgtatgaactatcaccagccaattgacgagaattactgcgatcctgaggtgcgccctttgatggaacaagaatgttccctggccgcctgcccaccggcccactcacacttcccctcttctcccgtgcaaccttcgtactatctctcaaccaatctgcccctcactcagaagcttgaagacaatgagaatcaggttgtgcatccgtcagtcagaggcaaccagtggcggacaggcccctggggtagttgctcctcatcctgcagcgggggcctgcagcatcgagccgtggtttgtcaggatgaaaatggccagagcgcctcctattgcgatgctgcttcaaagcctccagaattgcagcagtgcgggcctggcccttgccctcaatggaattacggaaactggggtgagtgtagccagacctgtggcggcggtataaaaagccgcttggttatttgccagtttcctaacggtcagatcctggaagaccacaattgcgagatcgtgaataaacctccctcagtgatacagtgtcatatgcacgcttgccctgccgatgttagctggcaccaggaaccctggacatcagaggacctcaaagtgaaattgctgccacagcgtactattatactttgggagttaatgaagaatattttttgtcatggaaagcactctcacatgtatcttattaatgttgtgaccgatcacctcttgtacccacggcactgtgaccccgagaccatcgagacatatttcctctccctttggtccctgcagttcacttggggggacctgaagtactacaagaactcgctgtag

SEQ ID NO: 178048 - DNA, 5733 bp, Artificial Sequence
  Description of Artificial Sequence: Synthetic coding sequence
atgtgggtggccaagtggctgaccggcctgctgtaccacctgagcctgttcataactcgctcctgggaagtggattttcaccctaggcaggaagcgttagtgagaactttgacatcatacgaagtcgtgatcccggagcgggttaacgaattcggagaagtgttcccacagtcgcaccacttttccagacagaaacggagctcagaagccctggagccgatgccatttcgcactcattatcgttttaccgcctatggacagctgttccaactcaatttgacagcggatgcctcttttctagccgcagggtacactgaggtgcatcttggaacccctgaaagaggtgcatgggagtcagacgcaggaccctccgatctgagacattgcttttatagaggacaagtgaattcccaggaggattataaagcagtcgtatcgctgtgtggggggctaacagggacctttaagggccaaaacggggagtactttctcgagccaatcatgaaggccgatggcaatgagtacgaagatggccataataagcctcacctgatctataggcaggacctgaataacagcttccttcagaccctcaaatattgcagtgtctctgaatcacaaatcaaagaaacctccctcccatttcatacctacagcaacatgaatgaagacctgaatgtcatgaaggaaagggtacttggccacacttccaagaacgtgcctctgaaggatgagcggcgccactctaggaagaaacgtcttatctcttatccccgctacattgaaatcatggttaccgccgatgccaaagtcgtgtctgcccacgggtctaacctgcagaactatatcttaactctcatgtcaatagtggccactatttataaggacccgtcaatcggaaatcttattcacattgtggtggtcaagctagtgatgatccacagagaggaagaagggcctgtgatcaattttgatggggccaccacgctcaaaaatttttgcagctggcagcagactcaaaatgacctggatgacgtgcacccctctcaccacgacacagcggttctgatcacacgcgaagatatctgctccagcaaggagaagtgcaacatgctggggctgtcttatcttggcactatctgtgatcctcttcagtcgtgtttcataaacgaagaaaagggtctcatcagtgcctttaccatcgcccacgagctcggacacactctgggcgtgcaacacgatgacaatcccaggtgtaaggagatgaaagtcactaagtaccacgtcatggcccctgccctctcctttcatatgtccccctggagctggtctaactgcagcagaaaatacgtgaccgaattcctagatacggggtacggtgagtgtcttctagacaaacccgatgaggaaatctataacctgccaagtgagctgcccgggagccggtacgacgggaacaagcagtgcgagctggcttttggtccgggcagccagatgtgcccccacattaacatatgtatgcatctctggtgcacttcaacggaaaaactgcataagggctgcttcacgcagcacgtcccccccgccgacggcacagattgcggccccggcatgcactgtaggcatggtctgtgtgtgaataaggagaccgagacccgccctgttaatggggagtggggcccatgggagccttactccagttgttctaggacctgtggtggaggcatcgaaagtgccacccggaggtgtaatagaccagaacccagaaatggcggaaactactgtgttgggaggcgcatgaagttccggtcctgtaatacagactcctgtcctaagggaacgcaggactttcgtgaaaagcagtgttcagattttaacgggaagcaccttgacatctccgggatcccatccaatgtacgatggctcccccgatactcgggaattggcacaaaggatcgctgtaagctgtactgccaggttgccggcacgaactacttttacttacttaaggacatggtggaggacgggacaccctgtgggaccgagacccatgatatctgcgtacagggacagtgtatggcggcgggttgcgaccacgttctgaactctagtgcaaagatagacaagtgtggggtctgtgggggagacaattcatcctgcaaaacgataacgggtgtgtttaactctagccactacgggtataacgtggttgtgaagatccccgccggtgccacaaacgtggacattcgccagtactcttactcaggacagcctgacgactcctatcttgctctctccgatgcggagggcaacttcttattcaacggaaacttccttctgtccacaagcaaaaaggagatcaatgtccagggcacacgtacagttatcgagtacagcggtagtaacaatgccgtcgagcgaattaacagcacaaatcgccaggaaaaagaactcatcctgcaggtgctgtgtgtgggtaatctctacaatccggatgtccattactctttcaatattcccctggaggagagatccgatatgttcacctgggacccctatggtccttgggagggctgcactaagatgtgtcaaggcctgcagcgaagaaacattacttgtatccataagtccgatcacagcgtggtgagcgacaaggagtgtgatcaccttcctctgccttcattcgtgactcagagttgtaatacagattgcgagctgcggtggcacgtcattgggaagagcgagtgcagctcccaatgcggccaaggctaccgcaccctagacatccactgtatgaaatacagcatccatgaagggcagaccgtccaagtggatgatcactactgcggagaccagttaaagcctccaacccaggagctgtgccacggcaactgtgtgttcacccgttggcactacagcgagtggtcgcagtgttctcggtcctgcggcggcggagagaggtccagagaatcctattgcatgaataatttcggccaccgactagccgacaatgaatgccaggagctgtccagggtgacacgagaaaactgcaatgagttcagttgcccgagctgggctgcgagcgaatggagtgagtgtttggtgacgtgtggaaaaggcaccaagcagcgtcaggtctggtgccaactgaatgtggatcatctcagtgacggcttctgcaactcaagtacgaaacccgaatcactatccccttgtgaactgcacacatgcgctagttggcaggtgggcccatggggtccttgtacgactacctgcggacatggataccaaatgagggatgtcaagtgcgttaatgagcttgcgtcagcagtcctcgaagacacggagtgtcacgaggcctcacgaccttccgatcgccagtcctgcgtgcttacaccctgcagtttcatatctaagctggaaacagctctcctccctactgtgcttattaagaaaatggcccaatggaggcatggatcttggactccttgctctgtttcctgcggccggggcacacaggctaggtacgtgagctgccgtgacgccctggacagaatcgcagatgaaagctactgcgcccacctacctcgccctgccgaaatatgggattgtttcaccccctgtggcgaatggcaagcgggggattggtccccgtgcagcgctagttgtgggcacggaaaaaccacaagacaggtgttatgtatgaattatcatcagccaattgacgagaattattgcgaccctgaggtacgcccacttatggaacaggagtgttcgctagccgcatgtccgcctgcccatagccactttccctcaagcccagtccagccttcctactacctgagtactaaccttccgctgactcaaaagctggaggataatgaaaaccaggtggtgcatcccagcgtgcgtggcaaccagtggagaacagggccttggggaagctgtagcagcagctgttcaggagggctacagcaccgcgccgttgtctgtcaagatgaaaatggccaatctgcctcctattgcgatgcagcctccaagccaccagaactacagcagtgtggccctggaccatgccctcaatggaactacggaaactggggagaatgcagtcagacatgcggtgggggcatcaagtcaagactcgtgatatgccagttcccaaacgggcaaatattagaggatcataattgtgagattgttaataagccgccctcagttatacagtgtcatatgcacgcatgtcccgctgacgtatcgtggcatcaagagccatggacctcctgctcagctagctgtggaaaagggcggaagtacagagaagtcttctgcatcgatcagttccaacgcaaattggaagacactaattgctctcaggtgcagaaaccccctacacataaagcatgcaggagcgtgcgctgcccaagctggaaggcaaactcttggaacgagtgctctgtgacttgcggtagtggcgtccagcaacgagatgtgtactgtaggctgaaaggagtaggacaggtggtggaggaaatgtgtgaccaaagtactcgcccatgctcccagaggcggtgctggagccaggactgtgtgcaacataaaggcatggagcgcggccgtctgaactgttcaacttcttgcgaacgaaaagacagccaccaacgcatggaatgtacagacaatcagattagacaggtaaatgaaatcgtttataacagcagcaccattagcctgacgagcaaaaattgtcgcaacccaccctgcaattacatcgttgtcacggcggactcttcacaatgcgccaacaattgcggcttcagctacaggcaacgaattacgtattgtacggaaataccaagtacaaagaagcacaaactgcatcgcttgaggcctattgtttatcaggagtgtccggtggtaccaagctctcaggtgtaccagtgtattaatagttgccttcatctcgctacctggaaagtgggaaagtggtctaagtgctctgtaacatgcggcataggtattatgaagcgacaggtcaaatgtattacaaagcatggcctgagctccgatctgtgtttgaatcatctgaaacccggggcacagaagaaatgctacgctaacgactgcaagagtttcacaacgtgcaaagagatacaggtaaagaaccacatccgaaaggacggagactattacttgaacattaagggaagaataattaaaatttactgcgcagatatgtacctcgaaaaccccaaagaatacttgaccctggtgcagggggaggagaacttctccgaggtgtacggctttcggctgaagaacccatatcaatgtccgtttaacggatccagacgtgaggactgcgaatgtgacaatgggcacctggccgccggctacaccgtattttccaagataaggatcgacttgacgagcatgcagattaagactaccgatctcctgttctctaaaacaatttttggtaatgcagtgcctttcgccactgccggtgattgttacagtgcctttaggtgtcctcagggtcagttctctattaacctctcgggcacagggatgaagatcagcagcaccgctaaatggctgacccaaggtagctacacatccgtttcaatcagacggtctgaagacggtaccaggttctttggtaaatgcggcggctactgcggcaagtgtcttccccatatgaccactggactgcccattcaggtcatttag

SEQ ID NO: 178049 - DNA, 1869 bp, Artificial Sequence
  Description of Artificial Sequence: Synthetic coding sequence
atgttcacctgggacccctacggcccctgggagggctgcaccaagatgtgccagggcctgcagagaagaaatataacatgtatacacaaaagcgatcattcagtagtttcggacaaggagtgcgaccaccttccactgccttcattcgtcacccagagctgcaacacggactgtgaactgagatggcacgtgattggcaagtctgaatgctcttcgcagtgcggccaggggtatcgaacactggacatccattgtatgaagtacagtattcatgagggccagacagtgcaggttgacgaccattactgcggggatcagctgaagccccctacccaggaactctgtcatggcaattgcgtattcacgcggtggcactatagcgaatggagccaatgctcacgtagttgcggggggggtgaaagaagcagggagtcctactgcatgaataacttcgggcaccgcttggccgacaacgagtgtcaggagttaagtagagtgacgagagagaactgtaacgagttttcatgtccgagctgggcagccagtgagtggtcagagtgtcttgtcacatgcggcaagggtacaaaacagaggcaggtttggtgtcagctgaatgtggaccacctctcagacggcttctgtaactcttccaccaagccggagagccttagtccgtgtgagctccacacatgcgcttcctggcaggtgggtccatggggtccttgcacaacaacttgcgggcacggctaccaaatgagagatgtaaaatgtgtcaatgagctcgccagtgcagtgttagaagacacagagtgccatgaggcctccagacccagcgaccgacagtgtagtgtgagttgcggccgaggtacacaggcccggtacgtgtcctgtcgcgatgcactggacaggatcgccgacgaaagctactgcgctcacctgcctagacccgcagagatttgggactgtttcaccccttgcggggagtggcaggccggggattggtcaccctgcagcgcaagctgtggacatggcaaaaccacacgccaagtcctctgtatgaattatcaccagcccattgacgagaactactgcgacccagaggtccggccacttatggaacaggagtgctccctcgctgcatgccctccagcccactcccattttccctcatcgccagtgcagccttcctactatctgagcacaaacctgccactgactcagaaactcgaggataacgagaatcaggtggtccacccatccgtccggggtaatcagtggaggaccggtccgtgggggagttgctcctctagctgtagtggaggcctgcaacaccgcgccgtggtgtgccaagatgaaaatggacagtcagccagttactgtgacgcagcttccaaaccacccgaactacaacagtgtggacccggcccctgtccacagtggaactatgggaactggggcgagtgctcacagacctgtggtggcggtatcaagtctcggctggtgatatgccaatttcccaacggccaaattcttgaagaccacaactgcgagattgtcaacaagcccccttcggtcatacagtgtcacatgcatgcttgtcctgctgatgtcagctggcaccaggagccttggacatccgaggacctaaaagtcaagcttttacctcaaagaacaataattttgtgggagctgatgaaaaatatcttctgtcacgggaagcacagccatatgtatctcattaacgtggttactgaccaccttctataccctcggcattgcgacccagaaactattgaaacctatttcctgagcctctggtcacttcagtttacgtggggagacctgaagtattacaagaacagcctctag

SEQ ID NO: 178050 - DNA, 4515 bp, Artificial Sequence
  Description of Artificial Sequence: Synthetic coding sequence
atgtgggtggccaagtggctgaccggcctgctgtaccacctgagcttgttcattacaagaagttgggaggtggattttcaccctaggcaggaagcgctcgtgagaacccttacatcatacgaggtggtgatccccgaacgcgttaatgaatttggcgaagtatttcctcaatcacatcacttcagccgacaaaagcgatcatctgaagctctcgagccaatgcccttccgcacacactaccggtttacagcttatggccagcttttccaactgaacctgacagcagacgcctccttccttgcggccggatatacagaggttcaccttggcacccccgagaggggggcgtgggaaagtgacgccgggccttctgatcttaggcactgtttttacaggggccaagtgaatagtcaggaggattacaaggccgtggtgtccctgtgcggcgggctgaccggaacctttaaggggcaaaacggcgaatactttctggagcccatcatgaaggcagatgggaacgaatacgaggacggacacaacaaacctcacctgatttatcggcaggacctgaacaatagctttctacaaacactcaagtattgctccgtctccgaaagccagattaaggagacctcccttcccttccacacatatagcaacatgaacgaggacctcaacgtgatgaaagagagggttctcggtcatacttccaaaaacgttccgctgaaagatgaaaggcggcacagccgaaagaagcggctaataagctacccccggtacattgagatcatggttactgccgatgccaaggttgtgtccgcacacggaagcaacttgcagaactatatcttaacgctgatgtcgatcgtagctactatctataaagaccccagcatcgggaacttgattcacatcgtcgtggtgaaacttgtcatgatccatcgggaagaagagggccccgtgatcaattttgacggggccacaaccctgaaaaatttctgttcatggcaacagactcaaaatgacctggatgacgttcaccctagccatcacgacactgcagtgttaatcaccagagaagacatctgttctagcaaggagaaatgcaatatgctcgggctgtcctacctagggacaatctgtgaccctttgcagagttgcttcataaatgaagaaaagggcctcatcagtgcattcaccatcgctcatgagctgggccacaccttaggcgtgcaacacgatgacaaccccagatgcaaggaaatgaaagttactaaataccacgtcatggctcctgcccttagttttcacatgtcaccctggtcttggagcaattgttctcgcaagtacgtgacagagtttctagatactggttacggtgaatgtctcttggataaacccgatgaggaaatctataatctgcccagcgaactgccgggcagtcgctacgacggcaacaagcagtgtgagctagctttcggccccggttctcagatgtgtccacatatcaacatttgcatgcatctttggtgcacttcaacagagaagctgcataaaggatgtttcacccagcacgtgccgccagcggatgggacagattgtggaccaggcatgcattgcagacatgggctgtgcgtgaataaggagaccgaaacccgacctgtgaatggcgaatggggaccttgggagccctatagtagctgcagcaggacttgcggaggtggtatcgagtccgccacgcgaaggtgcaatcgcccagagccacgtaacggcggaaactactgtgtgggccggaggatgaagttccgttcatgcaacacggacagttgcccgaaaggaacccaagacttcagagagaagcagtgcagcgacttcaacggaaagcaccttgacatttccggcatcccatctaacgtgcgatggcttcccagatattctggcataggcactaaggataggtgtaagttgtactgccaggttgctgggacaaactacttctacctgctgaaagatatggtcgaggacgggaccccttgcggtaccgagacacacgacatttgtgtacagggccagtgcatggcagccggctgtgaccacgtgctgaactcttcagctaaaatcgataaatgtggcgtgtgtgggggagataactctagctgcaagaccattacaggagtctttaactctagccactacggctataacgtcgtggttaagatacctgccggcgccacaaatgtggatatcaggcagtactcatacagtggccagcccgatgactcctatctcgcactgtccgacgcagaaggcaatttcctgttcaacggcaacttcctattgagcacttccaagaaagaaataaacgtgcagggcaccaggacagtaatagagtacagtgggtcgaacaatgcggtggagagaattaatagtaccaaccgccaagaaaaggagctcattctacaagtgttatgtgtgggcaatctgtacaaccctgatgttcactactcatttaatatccctctcgaggagcgaagtgatatgttcacctgggacccatatggcccttgggaaggatgtactaaaatgtgccaagggctacaaagaaggaacatcacttgtatccacaagtctgatcactcagttgtaagcgacaaggagtgtgatcatcttcccctgcctagcttcgttacccagtcctgcaacaccgattgcgaactgaggtggcatgtcatcggcaaatccgagtgcagttctcaatgcggccaaggatataggacccttgacatccactgcatgaaatactccattcacgagggtcagaccgtccaggtcgatgaccattactgtggagaccagttaaagccccccactcaggagttgtgccatgggaactgtgtctttaccagatggcactattccgagtggagccagtgttctcgatcatgcggcggcggcgagcggtctagagagtcctattgcatgaacaacttcggacacaggctagctgacaatgaatgtcaggaactgagtcgcgtgacgcgagagaactgtaacgagtttagttgcccttcttgggccgccagcgaatggagtgagtgtcttgtcacatgtggtaaagggaccaaacaaagacaggtgtggtgccaactcaatgtggatcatttgtctgatggcttctgcaattcaagcacaaaaccggagtctctgtccccatgcgaacttcacacatgtgcgagctggcaagtcggtccctggggcccttgtactactacttgtgggcacgggtatcagatgcgggacgtgaaatgtgtgaacgagctagctagtgccgttttagaggataccgagtgtcacgaagccagtcggccatccgacaggcaatcctgtgtgctgacaccctgctcctttatctctaaactagagaccgccttgctcccaaccgtgctcatcaaaaaaatggcacagtggaggcacgggtcctggactccatgttcagtttcgtgcggtcgcgggacccaggcccgatacgtctcttgcagggacgcactcgatcgcatagcagacgagagctactgtgcccaccttccgcgtcccgctgagatatgggactgtttcacaccttgtggggaatggcaggctggcgactggagcccgtgctccgcctcatgtggccacgggaaaacaacacgacaggtcttgtgcatgaattatcaccagccgatagacgagaattattgcgaccctgaagttagaccgctgatggagcaggagtgcagccttgccgcctgtccccccgcgcactcacatttcccctcaagccccgtccaaccatcatactatctgtctacaaacttgccactgacccagaaattagaagacaatgagaaccaggttgtccatccttccgtgcgtggtaatcagtggcgcaccgggccatggggtagttgtagtagtagctgcagtggcgggttgcagcacagggcggtcgtgtgccaggacgagaacggacagagcgcatcttattgtgacgccgcaagcaagcctcctgaactgcaacagtgcggccctggcccttgcccccagtggaattacggcaactggggtgagtgttcacaaacctgtggtggaggtataaagtctcgactggttatctgccagttcccgaacggccaaattttggaggatcacaattgtgagattgtgaataaacccccatccgtgatccagtgtcatatgcacgcctgccctgcagatgtgtcttggcaccaagaaccatggaccagcgaggaccttaaggtgaagttgctgccgcagaggaccataatcttgtgggaattaatgaaaaatatcttctgccatgggaagcatagccacatgtatttaatcaatgtggtgacggatcatctgctatacccaagacattgcgatccagaaactatcgagacctacttcctcagcctctggtcactccagtttacgtggggggacttaaagtactataaaaactctctctag

SEQ ID NO: 178051 - DNA, 3618 bp, Artificial Sequence
  Description of Artificial Sequence: Synthetic coding sequence
atggtgctgctgagcctgtggctgatcgccgccgccctggtggaggttagaacttccgccgatggacaggcgggcaacgaggaaatggtacagatcgatctgccaatcaaaagatacagggagtatgagcttgttacccctgtgagcacaaatctggagggaaggtacctgtcacataccctgagcgcctcccacaaaaaaaggtcagccagagacgtgagctccaacccagaacagctcttcttcaatattaccgccttcggcaaagacttccacttgcgactaaagccaaatacacagctagtcgcccccggggcagttgtcgagtggcatgagacaagcctagtgccaggaaatatcaccgaccctatcaataatcatcagcctggttcggccacgtaccgaatcaggaggaccgaacctctccagaccaactgtgcctacgtgggagatatcgtggacatacctggaacaagcgttgcgataagcaactgcgacggactggccgggatgatcaagagtgataacgaggagtatttcattgaacccttggagcggggcaagcagatggaagaggagaaggggcggattcacgtggtatataagcgctccgccgttgagcaggctcctattgacatgtctaaagactttcactacagagaatcagacttggagggtctggatgacctgggcaccgtatacgggaacatccatcaacagttaaatgagacaatgcgcagacgtagacatgctggcgaaaacgattataatattgaagtgctgcttggagtggacgattctgtggttcgctttcacggcaaagaacacgtgcagaactacctactaactttgatgaacatcgttaacgagatctatcacgacgaaagcctaggcgtgcacatcaatgttgttctggttagaatgatcatgctcgggtatgctaagagtattagtctcattgaacgcgggaatccatctaggagcttggagaacgtctgccgttgggcttcccaacagcaacgctcagacttgaaccactcagaacaccacgaccatgcgatcttcctgactcgccaggacttcggccctgcagggatgcaaggttatgccccagtgactggcatgtgccaccccgtccgttcatgtaccctcaatcacgaagacggattctcaagcgcctttgtagtcgcacatgaaaccggtcatgtcctaggaatggagcacgacggccagggtaaccgctgcggagatgagaccgccatgggtagcgtaatggcccccctggtgcaggcagcctttcataggtaccattggagcaggtgcagcggacaggaattaaagcgatatatccactcttatgactgcctgttggatgatccattcgatcatgactggccgaaactccctgaacttcccggtataaactacagcatggatgagcagtgtaggttcgacttcggtgtagggtacaaaatgtgtacagcatttaggactttcgacccatgcaaacaactgtggtgctcgcatcccgataatccttacttctgtaagactaagaaggggcctccactggatggaacggagtgcgctgcggggaaatggtgctacaaaggccattgtatgtggaaaaatgccaatcaacaaaaacaggatggaaattggggctcctggacaaagttcgggtcatgttcgaggacctgtggaaccggcgtgaggtttcggacacggcaatgcaacaatccgatgcccatcaacgggggccaggattgtcccggagtaaattttgagtaccagctttgcaatacagaggagtgccaaaaacatttcgaagactttagggcacagcagtgccaacagaggaactcccacttcgagtaccagaatactaaacaccactggttgccttacgaacaccctgaccccaagaaacgatgtcacctgtattgccagagcaaggagaccggcgacgttgcctacatgaaacagttggtacacgacggcactcactgcagctacaaggatccctatagcatctgtgtcagaggggaatgcgtgaaggtaggatgcgacaaagaaataggctctaacaaagtggaggataagtgcggcgtgtgcggaggagacaattcccactgccggacggtgaaaggaacttttacacgaactcctagaaaattggggtacctgaaaatgttcgatatcccccctggtgctcggcatgtgctgatccaggaggacgaagcttcccctcacatacttgccataaagaaccaggcaaccgggcattacattctgaacgggaagggagaagaagccaaatcccgcacctttattgacttgggagtggagtgggattacaatatcgaagacgacatcgaatccctgcataccgatggcccgctccatgaccccgtaatcgtgctgatcatccctcaggagaacgacaccagatctagtctgacctacaagtatatcatacacgaggacagtgtgcccactatcaattctaataacgtaatccaggaagagctggacacctttgagtgggccctcaaaagttggagtcagtgcagtaaaccatgtggcggtggctttcagtataccaaatacgggtgccggcgcaaatccgataataagatggtccatcgctctttttgtgaggctaataagaagcccaagcctattcgacgcatgtgtaacatccaagagtgcactcacccactctgggtggctgaggaatgggagcactgcacaaagacttgtggcagctcaggatatcagttgcgcactgtgagatgtttgcaaccactgcttgacggcaccaacaggagcgttcactctaaatattgtatgggagaccgccccgaaagccgtaggccttgcaatagagtcccatgccctgctcagtggaaaactggtccctggtccgagtgcagtgtaacctgcggagaaggtaccgaggtgcgccaggtcctatgccgggcaggcgatcattgtgatggcgaaaagcctgaatctgttagggcctgccagttacccccttgcaacgacgaaccctgcctaggggacaagagcatcttctgccagatggaggtgttggcccgatactgctccattcccggatacaacaaactctgctgtgagtcgtgctcaaagcggtcctccacattaccccctccatacctcctggaagccgccgaaacgcatgatgacgtcatctcgaatccttctgatctcccccgcagtctagttatgcctacctccttagtaccataccatagtgagacaccggcgaagaaaatgtccctgagttccatatcttctgttgggggtccaaacgcatacgcggcattcaggccgaactcaaaacccgacggggcgaacctgcggcagcggagcgctcaacaggctgggtccaagacagtgcgcttagtgacagtgcccagctcacctcctactaagagggtccacctcagcagcgcttcacagatggctgctgcaagtttctttgccgctagcgacagtataggggcctcaagtcaagccagaacctcaaagaaagacggtaaaatcatcgacaacaggcgccccacccgcagctccacacttgagcgatag

SEQ ID NO: 178052 - DNA, 1020 bp, Artificial Sequence
  Description of Artificial Sequence: Synthetic coding sequence
atgagccagaccggcagccaccccggccggggcctggccggccggtggctgtggggtgctcaaccttgccttctgttgccaattgtaccactgtcgtggctggtctggttgttactcttgctactggccagcctcttgccaagcgccagattagcttcaccacttccccgggaggaggaaattgtcttccccgagaaactgaatggcagcgtgctgccagggagcggtgcccctgcacgcctcctctgcaggcttcaggcttttggtgagaccctgttattggaattagagcaagacagcggggtccaggtcgaaggattaactgtccaatacctcggccaggctcccgaactactcggtggagctgagcctggaacctatttaacgggtacaattaacggcgacccagagtctgttgcctctcttcactgggatggcggtgctcttttaggagtgctgcagtacaggggagcagaattgcatctgcagccactcgaaggcggcactccaaattctgccggagggccaggggcgcacattttgcgtaggaaatcccctgcttccggccaggggcccatgtgtaacgtgaaagctccactgggttctccttcccctaggccacgcagagccaaaaggttcgccagtctaagccgcttcgtggagaccctggtagtcgccgacgacaaaatggccgctttccatggggctggcctcaaaagatacctgctgacagtgatggctgctgcggcaaaagctttcaagcacccgtcaatcaggaaccctgtgagcctagtagtgaccagactggttatattggggtctggagaagaaggaccccaggtcggtccctccgcggcccagaccctgcggagtttctgcgcatggcagaggggccttaacactccagaagactctgacccagatcacttcgacactgcgatcctatttacaaggcaggtgcggccccagtcagccccccaagccatgcactgtacaatccttcgttctgcgaccacatag

SEQ ID NO: 178053 - DNA, 2514 bp, Artificial Sequence
  Description of Artificial Sequence: Synthetic coding sequence
atgagccagaccggcagccaccccggccggggcctggccggccggtggttatggggagcccaaccgtgcctgctgctcccgattgtcccattaagctggcttgtctggctattgcttctgctcctggcatccctgcttccgtcagcgcgacttgcgagccccctgccccgcgaggaggagatcgtcttccccgagaagctaaacggctccgtgctccctggtagtggcgccccagcgcggctgctgtgccggctgcaggcttttggtgaaaccctcctgctggaattagagcaggactccggggtgcaggtggagggtctcactgtacagtaccttggacaggccccagaactgctcggcggtgcagaacctggtacttatctgacaggaactatcaatggggacccggagagtgtagcctctctgcattgggacgggggggccctcttaggagtgctgcaatatcgaggagccgagctacatctgcagcccctggagggaggaacaccgaactcagcaggggggccaggagcgcatatcctccggcgcaagtcacctgccagcggtcaggggcccatgtgcaatgtcaaagcccccctaggttctccctcacctaggcccaggagagccaaacggttcgcttctttaagccgcttcgtagagaccctggtggtggccgacgataaaatggccgcctttcacggagccggattgaaacgctacctccttactgtcatggccgccgcggccaaggcctttaaacatccctctatcaggaaccctgtgtccctggtagtaacccggctcgtcatactcgggtcgggagaggaagggccccaggtgggtccctcagcggcccagactctcaggagcttctgtgcttggcaaagaggcctaaatacacccgaggatagtgacccggaccacttcgacaccgccatcctgtttacaaggcaagatttgtgcggggtgagtacatgcgataccctgggaatggccgatgttggcaccgtatgtgatcctgcgcggtcctgtgcaatcgtcgaggatgatggactgcagtcagcctttacagccgcacatgagttgggacatgtcttcaatatgttacatgacaactcaaagccgtgtattagcctgaacggtcccctgtccacatctagacatgtgatggcccctgtgatggcacacgttgaccctgaagaaccatggtccccctgttccgctcgctttattactgatttccttgacaacggctacgggcactgtctgttagacaagcccgaggctccactgcatctgccagtgacattcccagggaaggattatgacgctgaccgtcagtgtcagctgacatttggccctgactctcggcactgccctcagctccccccaccttgtgcagccttatggtgctcaggccatttaaacgggcacgccatgtgtcaaacaaagcattcaccttgggcggacggaactccatgcggacccgctcaggcttgtatggggggcagatgcttacatatggatcaacttcaggacttcaacatcccgcaagcagggggctggggaccctggggaccctggggagactgttctcgaacatgcgggggcggagttcagttttcctctcgggactgcacacgaccagtgcctagaaacggcggaaagtactgtgaaggacggcggacacgattcagatcctgtaataccgaagactgccctactgggtccgccctaactttccgagaagagcagtgtgctgcgtacaatcacaggacagacctcttcaaatcttttcctggcccgatggattgggtgcctcgctatacaggagtggccccacaggatcagtgcaaattaacctgtcaagctcaggcactcgggtattactatgtgctcgagcctagggtagtggacggtacaccatgctcacctgattcctcgtctgtctgcgtgcagggacggtgtatccacgctggttgcgacagaataatcgggtccaagaaaaaatttgacaaatgcatggtgtgtgggggagatgggtccggctgctccaaacagtctggttcgttcagaaagtttcgttacggctataacaacgtcgttaccattcccgcaggagccacccatattctcgtccggcagcagggtaaccctggccatagatcaatctacctggcactcaaattgcccgatggatcatacgcattgaatggcgagtataccctgatgccaagccctaccgatgtggtgttgccaggggcagtgtctttgcggtactcaggggcaaccgctgcatcagaaacactgagcggacatgggccccttgctcaacccttgacactgcaggttctggtggctggcaacccacaggatacacgtttgcgctacagctttttcgtaccacgacctactccctctactccgcggccaacacctcaagactggttgcataggagggcccagattctggagatactgaggaggagaccatgggctggtagaaaatag

SEQ ID NO: 178054 - DNA, 2793 bp, Artificial Sequence
  Description of Artificial Sequence: Synthetic coding sequence
atgctgctgggctgggccagcctgctgctgtgcgccttccggctgcccctggccgccgttggccctgccgccactcccgctcaggataaggccggtcagccacccaccgccgcagcagcagcgcaacccaggagacgccaaggcgaagaagttcaggaaagggctgaacctcctggccatccccatccactcgcgcagagacgccggagcaagggtctcgtccaaaacattgatcaactgtattccggaggagggaaggttgggtacttggtgtacgccgggggtcggcgcttcttgctggatcttgaaagagatggttctgtcggcatcgctggattcgtacctgccgggggtgggacgagtgccccctggaggcaccgaagccactgcttttacagagggacggtggatggctctccacgatctcttgccgtctttgatctttgcggcggactggacgggttctttgcggtgaaacatgctcggtacacactcaagcccttattgcgtggcccatgggcagaagaagaaaagggaagagtgtatggggatgggtccgctcgcatccttcacgtgtatacccgcgaaggcttctcctttgaggctctcccgcccagagcctcatgcgagacacccgcttccacccccgaggcccacgagcacgcacctgcacattccaatccctccggccgtgccgcccttgccagtcagctacttgaccaatctgcactgtcccctgccggtggctcaggtcctcaaacctggtggcgcaggcggcggcgatccatctcacgggctcgccaggtcgaactcctgctagtggcggatgcgtctatggcccgcctgtatgggaggggcctgcagcactacctactgaccctggcctccattgctaaccgactgtacagtcacgctagtatcgagaatcatatccggctggcagtcgtaaaagtggtcgtgctaggtgacaaagataaatctctggaagtgtccaagaacgccgctaccacccttaaaaacttctgcaaatggcagcatcagcataatcagctcggagacgatcatgaggagcactacgatgctgcgattctctttaccagggaagatctgtgcggccatcactcttgcgatacacttgggatggctgatgtcggaaccatctgttcgcccgaacgctcatgcgccgtcatcgaagatgatggcctgcacgccgcttttacagttgcccacgagatcggtcacctcctgggactgagccacgacgacagtaagttctgtgaggagacgttcggtagcacagaggacaaaagattgatgagctctatactgacaagcatcgatgcttcaaagccctggtccaaatgtacctccgccacaatcactgagttcctggatgacggccatggtaattgtctgctcgatcttccaagaaaacaaattctagggcctgaggaacttccgggccagacctacgatgctactcaacagtgcaacctaacgttcggaccagaatatagcgtctgtccagggatggatgtctgcgcgcggctgtggtgtgccgtcgtgaggcagggtcaaatggtatgcctgactaaaaaactccctgccgttgaaggaaccccctgcggtaagggccgcatttgccttcagggtaagtgcgttgacaagacgaagaaaaaatactacagtactagttcacatggcaactggggaagttggggcagctggggtcagtgctccagaagctgtggcggaggcgtccagtttgcctacagacactgtaacaaccctgcaccccgcaataacgggcgctactgcaccggtaagcgtgcaatctaccgtagctgttccctgatgccttgtccaccaaatggtaaaagttttcgccacgagcagtgtgaagctaagaacggttaccagtctgatgcaaagggggtgaaaactttcgttgagtgggtcccaaagtacgccggagtgctgcccgcagatgtctgtaaactcacatgccgggccaagggtaccggctattatgtggtgtttagcccaaaggtgaccgacggaaccgagtgccggctgtactctaattcagtctgcgtgcgaggaaagtgcgttcggaccggatgtgatgggataattgggagcaaactccaatatgataagtgtggggtttgtggtggagataactcctcctgtaccaagattgtcgggacatttaacaaaaagagtaaagggtatacagatgtggtgaggatccccgagggcgccacccatattaaggtgcgtcaattcaaggccaaggatcagacacggtttacggcgtacctcgcgttgaaaaaaaagaatggcgagtatttgattaatggaaaatacatgattagcacctcagagacaatcatcgacattaacggcactgtgatgaactatagcggatggagtcaccgggacgattttctccacggaatgggttactccgctactaaagagatcctgatagtccaaattttggctactgatcctactaagcctcttgacgtgcgatattcttttttcgtgcctaagaagtccacccctaaagttaacagtgttacaagccatggaagcaacaaagtaggcagccatacctcccaacctcagtgggtcactggaccttggttggcgtgcagtaggacttgcgacaccgggtggcacactaggacagtgcagtgccaagacggaaaccgaaaactagctaaaggctgccccctgagtcaacgcccgtctgcatttaagcagtgcttgttgaagaagtgttag

SEQ ID NO: 178055 - DNA, 2577 bp, Artificial Sequence
  Description of Artificial Sequence: Synthetic coding sequence
atggagatcctgtggaagaccctgacctggatcctgagcctgatcatggccagttcagaattccactcagatcacagactgagctattctagccaagaagaatttttaacgtatcttgaacattatcaactgaccataccaattagggtcgaccagaatggggcattcctgagtttcacggtgaaaaatgacaaacattcccgacggaggcgaagcatggaccctatcgatccccagcaggccgttagcaaactgttcttcaagctgtcagcgtacggcaagcacttccatctaaacctcaccttgaacacggacttcgtttctaaacattttactgtggaatactggggtaaggacggtcctcagtggaagcacgattttctggataattgccactacacaggatacctccaggaccagcgcagcacaacgaaagtcgcccttagtaactgtgtgggactgcacggtgtgatcgccacggaagatgaggagtattttattgagcccctcaagaataccaccgaagactccaaacatttctcctacgagaacgggcaccctcatgtgatctacaagaaatcagccctccagcaacgccatttatacgaccactcccattgtggagtttccgattttactcgtagcggaaaaccctggtggctgaacgatacttcaactgtatcctattcccttcccattaacaacacacatatccatcaccgacagaaacgtagtgtgagtatagaacgctttgtggagactctcgtggtggccgataaaatgatggtagggtatcacggcaggaaggatatcgagcactatattctgtccgttatgaatattgtggcaaaactgtaccgcgacagttctctcggtaatgttgtaaatatcatagtggcacggctgattgtcctcacagaggatcagcccaacctggagatcaatcaccacgcagataaaagtctagatagcttttgtaaatggcagaaaagcatactcagtcaccagtcagacggtaacactattcccgaaaacggtatcgcccatcacgacaacgcagtgctgattaccaggtacgatatctgcacatataagaataagccctgtggcacgctgggactggcgtccgtggccggcatgtgtgagccagagcgtagctgttccatcaacgaggacatagggttggggtcagctttcactatcgctcacgaaatcggacacaattttgggatgaaccatgacggtattgggaactcctgcagaaaggtaatgaagcaacagtacggctcttcgcattattgtgagtaccaatcgttcttcctcgtatgcctgcagagtcgactgcaccatcaactgagccgcgaagtttgtcgagagctgtggtgcctgtcaaagagtaatcggtgcgttacaaacagcatccctgcagcggagggcaccctctgccagacggggaatatcgaaaagggctggtgttaccaaggtgactgtgtcccatttggtacctggccccagtcaatcgacgggggctggggcccatggtctctttggggtgagtgttcgcggacctgcggagggggagtgtccagcagtcttcgacactgcgatagtcctgccccatcaggaggaggaaaatactgtctgggggagagaaagcggtatagaagctgcaatacagacccatgtcctctcggcagtagggacttccgagagaagcaatgtgcagatttcgacaatatgccttttagaggcaaatactacaattggaagccatatacaggcggtggagtaaagccctgcgctctcaactgcctggctgaaggttacaatttctatacagagcgtgcaccggctgtcatcgatggcacacagtgcaacgccgattctcttgatatttgcattaatggggaatgcaaacatgtgggctgcgacaacatcctcggatctgacgcaagagaagaccggtgcagggtgtgcggtggagatggatcgacttgtgatgcaatcgaaggcttcttcaacgattccctgcctcggggcggctatatggaagttgtacagattcctcgcggaagcgtgcacatcgaagtccgcgaagtcgccatgagtaaaaactacatcgcactgaaatctgagggtgatgattattacataaatggggcatggacaatcgattggcctagaaagttcgacgttgcagggactgcctttcactataagcggccaaccgacgaacctgagtctctggaggctttgggcccaacctccgaaaatctgatagtgatggtgcttctgcaggaacagaacctggggattaggtacaagtttaatgtcccaatcacgcggaccgggagcggagacaacgaggtcggtttcacatggaatcaccaaccttggagtgaatgttctgccacctgcgcaggtggtaaaatgcccacaagacaacctacccagcgcgcccgttggaggactaaacatatcctgagttacgcattatgccttctaaagaaactgatcggaaatatatcatgtagattcgcctccagttgcaacttagctaaagagactttgctgtag

SEQ ID NO: 178056 - DNA, 3354 bp, Artificial Sequence
  Description of Artificial Sequence: Synthetic coding sequence
atggagatcctgtggaagaccctgacctggatcctgagcctgatcatggcgagctctgagttccatagcgatcacaggctgtcttatagcagccaagaggaattcctcacttatctggaacattatcagctcacaatcccaattagagtggaccaaaacggggcatttctcagctttaccgtgaagaatgacaaacattcccgacgtcgccggtccatggacccaatcgatcctcagcaggccgtctctaagttgttttttaaactctccgcttatggtaagcactttcatctgaaccttaccctgaacactgattttgtcagtaaacattttaccgtcgagtactggggcaaggacggtcctcagtggaagcatgatttcctagacaattgtcactacactggatacctccaggatcagcgcagcactacaaaggtggctttatctaactgtgtgggcctgcacggggtgatagccacagaggacgaagaatacttcattgaacctctgaagaacactacagaagacagcaaacacttcagctacgaaaacgggcacccacacgtgatctacaaaaaaagtgctctccagcaaaggcacttatatgaccactcccattgtggagtctctgattttacgcggtcaggaaaaccctggtggctcaacgatacatccaccgtgtcatactcactgcccataaacaatacacacattcatcatcggcagaagagatccgtctcaatcgagagattcgttgaaaccctcgtggtggcagacaaaatgatggtgggctaccacgggcggaaagacattgaacactatattctgagcgtgatgaacatcgttgctaagctgtatcgagattcgtctctggggaacgtggtcaacatcattgtagcaagacttatcgttttaaccgaggaccagcccaatctggagatcaaccaccatgcagataaaagccttgattcattctgcaaatggcagaagtctatcctgagccatcagtccgacgggaatacgattcctgaaaacggcatcgcacaccacgacaacgccgtgcttatcacaaggtacgacatctgtacctataagaacaagccttgcggaacacttggactcgcgtcagtagcagggatgtgcgagccagaaaggagctgttcaatcaatgaggacatcggtcttggtagcgccttcacaattgcccatgaaataggacataatttcggaatgaaccacgatgggattggcaatagttgcggcaccaaagggcacgaggccgcaaagttgatggctgcccacataaccgcaaacactaaccctttctcttggtctgcctgctcgcgggattatataacgtcattccttgattccggacgcggaacatgtttagacaacgaaccacctaagcgggattttctataccccgccgtggcccctggccaagtgtacgatgctgatgagcagtgtagatttcaatatggagccacctcgagacaatgcaaatatggggaggtgtgtagggagctctggtgtcttagcaagagtaacagatgcgtcaccaattctatccctgccgccgagggaacattatgccagactgggaacatagagaaaggttggtgttaccaaggggactgcgtgccatttggaacttggccacagtcaattgatgggggctgggggccatggagcttatggggtgaatgttctcgaacctgcgggggtggagtctccagttctttacgtcattgcgacagtccagctccctcgggcgggggtaagtactgtttgggggaaaggaaacgttataggagctgcaacaccgacccatgcccgctcgggtcaagagattttagggagaagcagtgcgctgatttcgacaatatgcctttccgaggaaagtactacaactggaagccatatacaggaggaggcgttaagccgtgcgcactgaactgcctggcggaggggtacaatttctataccgaacgagcgcctgctgtgatcgacggcacacagtgcaacgccgattcactcgacatttgcatcaatggagagtgtaagcatgtgggatgtgacaacatccttggatctgacgcgcgggaggatcgctgcagagtgtgcggaggtgacggcagcacgtgtgatgcaatagaggggtttttcaatgattccctccccagaggagggtatatggaggtggtgcagattcccagaggcagcgtccacatcgaggtgagggaagtggcaatgagcaaaaactatatcgccctgaagagtgagggcgacgattactacattaatggagcttggacaattgactggccaagaaaattcgacgtcgctgggactgcctttcattataagcggccaacagacgagcccgagagccttgaagcgctgggtcccactagtgaaaatctgattgtgatggtcctgctccaggagcagaatttgggcatccgctacaagtttaacgtgcccataaccaggactggatctggcgacaacgaagtaggtttcacatggaatcaccaaccctggtccgaatgtagcgctacctgcgccggtggagtccagaggcaggaggttgtctgcaaaagattagacgataacagcattgtgcaaaacaactattgcgatccggacagtaagccaccagagaatcagcgagcctgcaacacggaaccttgccctcccgaatggttcattggcgactggctcgagtgtagtaagacttgtgatggggggatgcgtaccagagctgtgctttgtattcgcaaaatcgggccgtcagaggaagagactttggattactccggatgcctgactcatcggcccgttgaaaaagaaccatgtaataatcaaagctgtccccctcagtgggtggcacttgactggtccgaatgtactcctaaatgcgggccaggcttcaagcaccggattgtactgtgcaagtcatccgacctcagtaaaacattcccggccgcccaatgtcccgaagaaagtaaaccaccagtgcgtataagatgttctctcggacgatgccctccgccccggtgggtgactggtgattgggggcaatgtagtgctcaatgtggactgggacagcagatgaggacagtacagtgcctgtcatatactgggcaggcttcatctgactgcttggaaacagtgcgcccaccatcaatgcagcaatgtgaatccaagtgcgactccaccccgatatcaaacactgaagaatgtaaagatgtcaataaagttgcctactgtccgctcgtcctaaagttcaaattttgtagccgggcctacttccggcagatgtgttgcaaaacatgtcaggggcactag

SEQ ID NO: 178057 - DNA, 1407 bp, Artificial Sequence
  Description of Artificial Sequence: Synthetic coding sequence
atggagatcctgtggaagaccctgacctggatcctgagcctgatcatggcatcttcagagttccattccgaccaccgtctgtcctattcctcccaggaagagtttctgacatacctggaacactaccagctcactattccaatccgcgttgatcagaacggggcctttctgtctttcaccgtaaagaacgacaagcactcaagaaggagacgctctatggaccccatcgatccccagcaggctgtgtccaagctgttctttaagctctcagcttatggcaaacacttccacctgaatctcacccttaatactgactttgtttctaagcacttcactgtagagtactggggaaaggatggccctcagtggaagcatgacttcctggataactgccattacacaggctatctccaggaccagcgctctacgaccaaagtagccctaagcaattgcgtgggtcttcatggggtcatcgccacagaagatgaggagtacttcatcgagcctctgaaaaacacaaccgaggacagcaagcatttcagctatgaaaacggacaccctcacgtgatctataaaaaatctgcattgcagcagaggcatctgtacgatcactcacactgtggtgtaagcgactttacccgatcaggcaagccctggtggctgaacgatacaagcacagtgagctactccttgcccataaacaatacacatattcatcaccggcagaagaggtcagtgagcattgaaagatttgtggagactctcgttgtggccgacaaaatgatggtgggctatcatgggcggaaggatatcgagcactatatccttagtgtcatgaacatcgtggccaaactttatcgtgattcttcattgggaaacgttgttaatatcattgtggctcgcctgatagtcctgaccgaggaccagcctaatctcgagattaatcatcatgcagataagtcacttgattctttctgcaagtggcagaaatcaatcttgtctcatcagagcgatggcaatactattcccgagaatggtatagcccatcacgataatgccgtgctcatcacaaggtatgacatctgcacatataaaaacaaaccatgtggtacactgggcctggcatctgtggccggaatgtgcgagccagaacgctcatgcagcatcaacgaggacataggactcgggagcgcattcaccatagcacacgaaattggccacaatttcgggatgaaccatgacggcatcggaaactcctgtgggactaaaggccatgaagccgccaaactgatggcagcacacattaccgctaacacgaaccccttctcttggtccgcttgctctagagactatattacctcttttcttgagttcctgaaactgggagactccatttccggatcatag

SEQ ID NO: 178058 - DNA, 5061 bp, Artificial Sequence
  Description of Artificial Sequence: Synthetic coding sequence
atgcccggcggccccagcccccggagccccgcccccctgctgcggcctctgctgttgctcctttgtgcgctggcccctggagcacctggcccagctccaggacgagctacagaggggcgcgcagctctcgatatagtacaccccgtgagagtggatgctggaggcagcttcctgtcttatgagctttggccacgcgccctgcgcaagcgggatgtgtcagtgcggcgcgatgcccctgcattttatgagctgcagtaccgcggccgcgaacttagattcaacctgactgcaaaccagcatctcctggcgcccgggtttgtttctgagacacgtaggcgggggggcctaggacgagcccacataagggctcacactcccgcctgtcaccttctgggagaagtccaggatcctgagttggagggcggcctggctgctatttctgcatgcgatggactgaagggagtttttcagctgtctaacgaggattatttcattgagccactcgatagtgccccagcgaggcccgggcatgctcaaccacacgtggtgtataagagacaggcacccgaacggttggcccagagaggcgatagctctgccccctccacctgcggcgttcaggtctaccctgaactggaatccaggagggagcgatgggaacagcgtcagcagtggaggcggccgagactcaggaggcttcaccagcggagtgtttccaaggagaagtgggtcgaaaccctcgtcgttgctgatgcaaaaatggtggagtaccatggtcagccccaggtagaatcatacgtccttactattatgaatatggtcgcaggcctgttccatgatcccagtattgggaacccgatccacattacgattgtgcgattagtcctactggaggatgaggaagaagatcttaagattacccatcacgccgacaacacactcaaaagtttctgtaagtggcaaaaatcgatcaacatgaaaggtgatgcccaccctctgcaccacgacacagccattcttctcaccagaaaagatctgtgcgctgctatgaatcgaccatgtgaaaccctggggttgtctcatgttgccggcatgtgtcagccacacagatcttgcagcatcaatgaagataccggcctccctttagctttcaccgtggcccacgaactcggacacagttttggaatccagcacgatgggtccggcaatgactgtgagccagtgggtaagcggccgtttattatgtctccacagcttctatatgatgccgcccctttgacatggtcacgctgctcccgacagtacatcacccggttcctggaccgtggatggggactgtgccttgatgatccacctgcaaaggacatcatcgattttccatccgtaccacccggggttttgtatgatgtatcacatcagtgcagactgcagtatggtgcctacagcgcattttgcgaagacatggacaacgtgtgccatacgctctggtgtagcgtaggcacaacttgccactcaaaactggatgccgcggtggatggcacccggtgcggtgagaacaaatggtgcctcagtggagaatgtgtcccagtcggattccgccctgaagccgtggacggcggctggagcggatggtctgcgtggtcaatttgttctcggtcatgtggtatgggcgtgcagagtgccgagcggcagtgtacccagccaactccaaagtataaggggcggtattgtgttggcgaacgaaaacggtttcggttatgcaatcttcaggcctgccccgccggcaggcctagttttagacatgtgcagtgtagtcactttgacgctatgttgtataagggtcagctgcatacctgggtgcccgttgtgaatgacgtcaacccttgtgagctccattgtagacccgcaaatgaatattttgctgaaaagctacgagacgccgtagtggatgggacaccatgttaccaggtccgcgccagccgagacctctgcatcaacgggatttgcaagaatgtcgggtgtgacttcgaaattgactcgggggccatggaagatagatgcggtgtgtgtcacggaaacgggagcacatgccacactgtctcaggaacatttgaggaagcagagggcctgggatatgtcgacgttggactcatacctgccggcgcccgagaaattcgcattcaagaagtggccgaagctgcaaactttctggccttgaggtcggaagaccctgagaaatattttttgaatggtggatggaccatccagtggaacggtgactaccaggtggcaggcacaacgttcacttatgccaggcgggggaattgggaaaatctgaccagccccggaccgacaaaggaacctgtgtggattcagcttctttttcaggagagcaacccaggagtgcactacgaatacactattcacagagaagctgggggacacgatgaggtccccccgcctgtgttctcatggcattacggcccttggacaaagtgtacggtgacatgtggacggggcgtacagcgccaaaacgtttactgcctcgagaggcaggccgggcccgttgatgaagaacactgtgaccctttaggaaggcccgacgaccagcagcgtaagtgcagcgagcagccatgtcccgctaggtggtgggccggagagtggcagctttgctccagctcctgcggccctgggggtctaagccgtagggctgttctttgcataagatctgtgggcctagacgagcagagcgctttggagccccctgcctgcgaacatctgccccggccccctaccgaaaccccctgcaatcgacacgttccttgtccggcgacatgggctgtagggaactggtctcagtgtagcgtgacatgtggagaagggacgcagcgtcgcaacgtgctttgcacgaacgacaccggtgtgccatgtgatgaggctcagcagcccgcatcagaggttacctgttcccttccactctgccgatggcccctgggaaccctgggccctgaaggcagcggtagtggatcctcctcccatgaactgttcaacgaagctgattttattccccatcacctggctcctcgccccagtccggccagctccccaaagcccggcaccatgggtaacgccattgaggaagaggctccggaactcgacctgccaggccctgtctttgttgacgacttttattatgattataactttattaacttccatgaagacctcagttatggcccctcagaggagcctgacctggacctggccgggacaggggatcgcacccctccccctcacagccatcccgctgcacctagcaccgggtctccagtcccagcaactgagccaccagccgccaaggaggaaggagttctcggtccctggtctccctctccatggcccagccaggcgggaaggagtccgcctcctccttcagagcaaaccccaggtaacccattgattaatttcctacccgaagaggacaccccaattggcgcccctgacctgggcttgccttctctgtcttggccacgggtctctacagacggcctgcagaccccagcaaccccggagtcccagaatgattttcccgttggcaaggactcccagtcacagctcccaccgccctggagggaccgtactaacgaagtctttaaggatgatgaagaacccaagggaaggggtgctcctcacctccctcctcggccatccagtactctgcccccactgtctcctgttggatctacacactcctccccatccccagacgttgctgagctgtggacagggggaactgtggcttgggagcccgcacttgagggaggcctcggacccgtggatagcgaactgtggccaaccgtcggggtggcttctctcttgcctccccccatagccccccttcctgagatgaaagttagggatagctccctggaacctgggacacctagtttccccactcctggccctggcagctgggatttgcagaccgttgctgtatggggcacttttctccctacaactctgaccggtctggggcatatgcctgagcctgcactgaatcctggtcctaaggggcagcccgaatccctctcgccggaagttccactcagcagtaggctcctgagtactccagcatgggattctcccgcgaactcacaccgggtgccagagacccagcctctggcacccagtcttgctgaggccggcccccccgccgaccctctagtggttcgcaacgcaggttggcaggccgggaactggagtgagtgttctacgacgtgcggcctgggtgccgtgtggaggcctgtccgctgttcgtctggaagggatgaggactgtgcccccgccggtcgccctcagcccgctcggaggtgccaccttaggccatgtgctacatggcactccggaaactggagcaagtgcagtagaagttgcggcgggggtagctccgttcgcgatgtgcagtgtgtcgatactagagatcttaggccgttacgtccgttccattgtcaacctgggccagccaaacctccggctcataggccctgtggcgcacaaccttgtctgagctggtatacatcctcgtggagggaatgctctgaggcctgcgggggaggcgaacagcagcgcctggtgacatgtcccgaaccaggactctgcgaagaggctttgagacccaacacaactagaccctgtaacacgcatccctgtacacaatgggtggtgggaccgtggggacagtgcagcgggccttgtggaggcggcgtacagcgccggctcgtcaagtgcgtcaatacccagacggggctgcccgaagaggacagtgaccaatgcggacacgaagcctggccggagtcatccagaccgtgcggcactgaggattgtgaacctgtagaacccccacgatgcgaacgagaccgtttaagtttcgggttctgtgagacactgcggcttctaggacggtgccaacttcccactataagaacacagtgctgccggagttgcagcccgccttctcacggcgccccctctcggggccaccagagagtcgccagaagatag

SEQ ID NO: 178059 - DNA, 1383 bp, Artificial Sequence
  Description of Artificial Sequence: Synthetic coding sequence
atgcccggcggccccagcccccggagccccgcccccctgctgcggcctctcctactgctcctttgcgctctcgctcccggtgcgcccggccccgcccccggtcgagccacggaggggagagctgccttagatatcgtgcacccagttcgggtcgacgcaggaggaagctttctctcgtacgagctttggccccgtgcccttcggaaaagagatgtcagcgttcgtagggatgcacccgccttttatgaactccagtaccgcggtagagaactgagatttaacctgaccgcaaaccagcatctgctggcccctgggtttgtgtccgaaacacgtagaaggggaggcctgggtcgagctcacatcagggctcacaccccagcctgtcacctcctgggagaggtgcaggaccctgaattggaaggcggcctggccgctatttctgcttgcgatgggctcaagggcgtctttcagctgtccaacgaggattattttatcgaaccattagactctgcaccagctcgtccggggcacgcccagccccacgttgtctataagcgacaggcccctgagaggctagcccagcgaggggacagctcggcgccctctacttgtggtgtgcaggtgtaccccgaactcgaatctaggcgcgaacgttgggaacagcgacaacaatggcgccgtccacggttgcggcgcctgcaccagaggtctgtttctaaagagaagtgggtcgaaacactggtcgtggccgatgcgaaaatggtagaatatcatgggcagccccaggtggaaagctacgtcttgaccattatgaacatggtagccggcctgtttcacgacccttcaatcggcaaccccattcatatcacaatagtaaggttagttttattagaagacgaagaagaggacctgaaaatcactcatcatgccgataataccctgaaatctttttgtaagtggcagaaaagcattaacatgaagggcgacgcacatccgctccaccatgacacagccatcttgctgactcggaaggatctctgcgcagctatgaatcggccctgtgagacacttggtcttagtcacgtcgcgggaatgtgccagccacacagatcctgttccattaacgaagacaccggcctccccctggccttcaccgtggcccatgagctcgggcacagcagctgtactacccccctgccatcccctggacccgccgcagcagcgtcaattagcccaggctctctaagcgttcagcggcagaacgtgtactgtctggaacgccaggcgggtcccgtagatgaggagcactgcgatcctttgggccgtccggacgaccagcagagaaagtgtagcgaacagccatgcccagcttcggctcagtag

SEQ ID NO: 178060 - DNA, 2670 bp, Artificial Sequence
  Description of Artificial Sequence: Synthetic coding sequence
atgctgcccgcccccgccgccccccggtggccccccctgctgctgcttttgctcttgcttctgcctttggcacggggtgcccccgcgagaccggccgctgggggtcaagcgagtgaattagtggtgcccacccgattgcccggttctgcaggcgaactcgcactgcacctgagcgctttcggcaaggggttcgtgctgcgccttgcccctgacgacagtttccttgcaccagagttcaaaattgagagactgggcgggtctgggcgggcgaccgggggcgagaggggattgagggggtgctttttctccggcacagttaacggagaaccagagtctctcgccgccgtgtcactttgcaggggcctttctggctcgtttctactcgacggtgaagaattcaccatccagcctcaaggggcaggtgggtccttggctcaacctcaccgtctccagagatggggccccgccggggccaggccgctgcctcgcggcccagagtgggaggtggaaaccggcgaaggacagaggcaggagaggggggatcatcaggaggattctgaggaggaaagccaagaagaggaggcagaaggagcctctgaacccccccctcccctgggggccaccagtagaactaaacgatttgttagcgaggctaggttcgtggaaacactactggtcgcggatgcgtccatggccgcattctatggagctgatcttcaaaatcacatactgacacttatgtcggttgccgctaggatttacaaacacccgtctattaaaaactccatcaatctgatggtggtgaaggttcttatcgtagaggacgagaagtgggggcccgaggtgagcgacaacggaggcctgaccctgcgaaacttctgcaattggcagcgaagatttaatcagccctccgataggcatccagaacactacgacacagctatcttacttacacgacaaaatttttgcggtcaagagggcctgtgcgatacactcggtgtggcagatatcggcacaatctgcgatcctaacaaaagctgttctgtcattgaggatgaagggctgcaggccgctcacaccttagctcatgaactgggacatgtgctttccatgccacacgatgatagtaagccttgcacccgactcttcggaccaatgggcaagcatcatgtgatggcccctctgttcgtgcacttaaaccaaactctcccttggagcccatgttccgcaatgtatctcacagaactgttagatgggggccacggagactgtcttctggatgcgccggcagctgcactccccctacctaccggcctgcccggcagaatggctctgtaccaattagatcagcaatgcaggcagatctttggcccggacttcagacactgccctaataccagcgcacaggacgtgtgtgctcagctgtggtgtcacaccgacggcgccgaaccactgtgccataccaagaacggaagcctgccgtgggcagatggaaccccctgcggccccggccacttgtgctccgagggctcctgtttgccagaggaagaagtggaacgacctaagcccgtggctgacgggggatgggccccctggggaccatggggagaatgttcacgaacctgtggtggcggcgtccagttcagtcatcgtgagtgcaaagatcccgaacctcagaatgggggccgctactgtctagggagaagagcaaaatatcagtcatgccatacggaagagtgccctcccgacggcaaatctttcagagaacagcagtgcgagaagtacaacgcctacaactacaccgacatggacggcaacttgctccagtgggttcccaagtatgcaggtgtcagccccagagatcgatgcaagctgttctgccgcgccaggggacgttccgaatttaaggtgtttgaagccaaagtcattgacggtactctctgcgggccggagaccctggcgatttgtgtgcgaggccaatgtgtgaaagctggttgtgaccacgttgtggattctccccggaagcttgataagtgcggcgtgtgcgggggtaaaggaaatagctgtagaaaggtgagcggctcactcaccccaaccaattacgggtataacgatatagtcaccattccagctggcgccaccaatatcgatgtgaaacagagatcacaccccggtgttcagaatgatggtaactacctggctctgaaaactgcagatggacagtatctgttgaacgggaatctcgcgatttctgctatagaacaggatatactcgtgaaaggaactatcttgaagtacagcgggtcaattgccacattagagagactgcaaagcttccgccccctccctgagccactgaccgttcagctgctaaccgtccccggagaggtgtttccgcctaaagtgaaatatacattctttgtcccgaacgatgttgacttctctatgcaatcgtcaaaagaacgggcaacgaccaatatcatccaacctttacttcatgcccagtgggttttgggggactggagcgagtgttcttctacctgcggagcaggatggcagcgaaggaccgtggaatgtagagaccccagtggacaggctagtgcaacatgtaacaaggcattgaaaccggaagacgcaaagccatgcgagtctcaactatgtcccctgtag

SEQ ID NO: 178061 - DNA, 2757 bp, Artificial Sequence
  Description of Artificial Sequence: Synthetic coding sequence
gccgcccgggcccggctgggcggcggcggcgccggcggcgccggctgtgcatctcagagagggagaagaggtagtgctccagctgcaggcccccgtggcccaagcagaccctgcacacggctgatacccctcttcctcgagagagcagcagggccgaggtctgggagacagcacctgcctgccccaggcggtttactcccatcccccgcgaggtcacataggcggtctccacacgcccctaggccacgccggcctccagtggcctcagccccagcggccgcagctgccgcagcagcggctggaccccgtagaccagggcctgcacgaagccgtggagccgggctcggggccggaggggcacatgctgttgctagacttcgcggatgtttcttcagtggcacagtgaacggcgaacccgaatccttagccgccgtaagtctgtgtcggggactttcaggttcgttcctgctggacggtgaggagtttaccatacagccacagggcgctggtggttctctcgcccagccccaccggttacagcggtggggtcctgccggcgccagacctctgcctcgaggacctgagtgggaggtggagaccggagaggggcaacgccaggaacgaggcgaccaccaggaggactcagaagaagaaagccaggaggaagaggctgaaggtgcctccgaacccccaccacctctaggggccacgtcacggaccaaaaggtttgtcagtgaagcgcgcttcgttgagacattgttggtggccgacgcctctatggcagcattttatggtgccgatttgcaaaaccacatcttgacccttatgtcggtagccgctagaatttataagcacccctcaatcaagaattcgatcaacttgatggtcgtgaaggtcctcattgtggaggatgagaagtgggggccagaagtgagcgacaatgggggattaaccttgcgcaacttttgcaactggcagcggaggttcaaccagccttctgacaggcatcctgagcactatgacacggccatcctcctgacccgacagaatttttgcggtcaagagggactgtgtgatacgttaggggtggccgatattggcaccatatgcgatccaaataagtcttgttccgtcattgaggatgagggccttcaagcagctcatacactcgctcatgaacttggacacgtgttatccatgcctcatgatgactccaagccttgcactagactgttcggtccaatgggcaagcaccatgtaatggccccactgtttgtccacctgaaccagacccttccctggtccccatgttccgccatgtacctgactgaactgctggacggcggacatggagattgtctgctcgacgccccagcggcagcactacccttacctactggactgcctgggcggatggccctctaccagcttgaccagcagtgtaggcagatattcggccccgacttcaggcattgtcccaatacaagcgcacaggacgtgtgcgcccaactgtggtgccatacagatggagccgagcccttatgtcacaccaaaaatggttcgctcccatgggcagacggcaccccttgcggccctggccacctatgttcagaggggtcatgccttccagaggaggaagtcgagcgccctaagccagtagccgacggcggatgggccccgtggggcccctggggcgaatgtagtcgcacttgcggcgggggcgttcagtttagccacagggaatgtaaggacccagaacctcagaatggcgggagatattgcctgggaaggcgtgctaagtaccagtcatgtcacaccgaagaatgcccaccagatgggaaatccttccgcgagcagcagtgcgagaagtataacgcctataattatactgatatggacggaaatctcctccagtgggttcccaaatatgccggagtatcgccacgggatcgctgtaagctcttctgccgggcgcgcggacggtcggaattcaaagtctttgaggctaaggttatagatggaactctttgtggtcccgagaccttagccatctgtgtgagagggcaatgcgtcaaagctggctgtgaccacgtagtagacagtccccggaagctcgacaagtgtggagtgtgcggtggtaaaggcaactcttgtcgaaaggttagcgggagcttaacgccaacaaactacggatataacgacatcgtgaccattccggccggggctaccaacattgacgtgaaacagcggtcacaccctggggtgcagaatgatgggaattatttggctctcaaaacagcggatggacaatacctccttaatggtaatttggccataagtgctatcgagcaggatatcctggtgaagggaacaatcctgaagtattccggcagtattgccactctggaaagactgcagtcattccgccccctacccgagcctttgacagtccaattattgactgttcctggcgaggtttttccccccaaagtgaagtataccttctttgttccaaacgatgtcgatttttctatgcaatccagcaaggaaagagccacaacaaacataatccagccccttctgcatgcacagtgggtgctgggggattggagcgaatgcagcagtacctgtggagccgggtggcagcgacgtacagtcgagtgccgcgacccaagcgggcaggctagcgcaacatgcaacaaggccctaaagccggaggatgcaaaaccttgtgaaagccagctgtgccccctttag

SEQ ID NO: 178062 - DNA, 5724 bp, Artificial Sequence
  Description of Artificial Sequence: Synthetic coding sequence
atgcagttcgtgagctgggccaccctgctgaccctgctggtgcgggacctggccgagatggggtcgcctgacgccgcagccgccgttcggaaagaccgactacacccgagacaggttaaacttctggagacattgagcgagtatgagattgtgagtccaattcgtgttaacgcacttggtgaacctttccctacaaacgttcactttaagagaactaggcggtccatcaacagcgccaccgatccgtggccggctttcgcttcatcttcttcatcatcaacaagctcacaagcccactaccgcctgtccgctttcggacaacaatttctattcaacctgactgctaacgcgggatttatcgccccattatttacggtgaccctcctcgggaccccaggggtgaaccagacaaagttctactcagaggaagaggcagagctcaaacattgtttttacaagggctacgttaacacaaattcagagcataccgcagtgatttccctgtgctctggaatgttgggaacatttcgttcccatgatggcgattatttcattgaacctcttcagtctatggacgaacaagaggatgaagaggagcagaacaaaccccatatcatctatcgtagaagcgctccccagcgggaaccttctaccggtcgccatgcatgtgacacttctgagcacaagaaccgacacagtaaagataaaaagaaaacgcgggcgagaaagtggggcgaacgtattaatctggcaggcgatgtggccgcacttaactccggcctggccacagaagccttctctgcatacggcaacaagacggataacactagggagaagcgcacacatcgtcgcaccaaacgcttcctctcttacccccggttcgtggaagttctggtggtcgccgataacagaatggtgtcttaccacggtgagaacttgcagcactatatcctcactctgatgtcaattgacgggccaagcataagcttcaacgcccagacaacactgaagaacttctgtcagtggcagcactctaaaaactcccccgggggcatccatcacgataccgctgtgctgttaacacggcaggatatttgcagagcacacgataagtgtgatacgctcggattggccgagctcggcacaatctgcgacccataccggtcctgttccatcagcgaggattcgggcttgagcaccgcctttactattgcccatgagttgggccacgtgttcaacatgccacacgatgacaacaataaatgtaaagaagagggcgttaagtctccacaacacgtgatggccccaacactgaacttctacaccaacccttggatgtggtccaagtgctctaggaagtatatcaccgagtttttggataccggctatggggagtgcctgttaaacgaacccgagagtagaccatatcctctgcccgttcaactccctggcatcctgtacaatgtgaataagcaatgtgagctaatatttggccctggctctcaagtgtgcccctatatgatgcaatgccgcaggctgtggtgtaacaatgtaaatggcgtccacaagggatgcaggacacaacacactccatgggctgatggcacagagtgcgaacccggaaaacattgtaagtacgggttctgtgtcccgaaggagatggatgtgccagtgaccgatggtagctggggaagctggtcccctttcgggacgtgctcgagaacctgcgggggtggaatcaagacagcaattcgggaatgcaaccgacctgagccaaagaatggcgggaaatattgcgttgggcgtcggatgaagtttaagagctgtaatacggagccatgcctaaagcagaaaagagactttcgggacgagcagtgcgctcattttgacggcaaacattttaatataaacggcctcctgccaaatgtcaggtgggttccgaaatactctggaatcctgatgaaagatagatgcaagctgttctgtcgggtggcagggaacaccgcgtattaccagcttagagatagagtgatcgacggtaccccatgtgggcaagataccaacgatatctgcgttcagggcctgtgccggcaggccggatgcgaccatgttctgaacagcaaagccagaagggacaagtgtggagtctgtggcggcgataacagtagctgcaaaacagtcgcggggacctttaataccgtgcattacggatataacacggtcgtgcggataccagctggagccacaaacatcgatgtgagacagcacagtttctccggagagacagacgacgacaattaccttgctttgagctcatcaaagggagagtttcttctgaacggtaatttcgtggtgacaatggctaaaagagaaattagaatcggtaacgctgtcgtggagtattcaggcagcgagactgccgtggaacgaattaattccactgaccgaatcgaacaagagttgctgctgcaggtcctctctgtgggcaaactctataatcctgacgtgcgatacagcttcaatatcccaatagaggataaacctcagcagttctattggaactcacatggtccttggcaggcctgctcgaagccatgccagggggaaagaaaaagaaagctggtctgtacacgtgaatctgaccaactgactgtctccgatcagaggtgcgaccgtctcccacaacctggccacatcaccgagccttgtggaaccgactgcgatcttagatggcatgtggcttcccggtccgagtgcagcgctcaatgcgggctgggctacaggactctcgacatctactgcgcgaagtactcgcggttggatggtaagaccgagaaagtggacgacggcttctgctctagccatcctaagccaagtaacagggaaaagtgtagcggagaatgcaacactgggggatggagatactccgcctggaccgagtgtagcaagtcctgtgacggggggactcaacgacgccgtgccatctgtgtaaatacccgaaatgatgtactggatgatagcaaatgcacccatcaagagaaagtcactatccagagatgctccgagttcccgtgcccccagtggaaaagcggagactggtcagaatgtctcgtcacttgtggcaagggacataagcaccggcaagtctggtgccaatttggagaagaccggctgaatgatcgcatgtgtgacccggagaccaagcccacttccatgcagacttgccaacagcccgaatgtgcaagctggcaagctggaccttggggacaatgcagcgtaacctgcgggcaagggtaccaactgcgtgccgtcaagtgcatcattggcacatatatgagtgtggtcgatgataacgactgcaacgctgcaactcgaccaactgatacacaagattgtgagctcccttcgtgccacccaccccctgctgcccccgaaaccagaagaagcacgtattcagctccgcgcactcagtggcgtttcgggtcttggacaccgtgttcagcgacatgtggtaagggcacccggatgcgttacgtttcctgccgggatgaaaatggtagcgtggccgacgaatctgcatgcgctacacttccgcgcccggtcgcaaaagaagagtgcagtgtcactccatgcggccaatggaaagccctggactggtcgagttgttctgttacttgtggacaggggcgggccaccagacaggtgatgtgtgttaattatagcgatcacgtgattgacagatccgagtgtgaccaagattacattcccgagacggatcaagactgctcgatgtccccttgcccccagaggactcccgatagcgggctggctcagcatccatttcagaacgaagattataggccccggtctgccagccctagcaggacacatgtcttaggcggaaaccagtggcgcacgggcccatggggtgcatgcagctcaacgtgcgccggcggttcccagcgccgggtcgtcgtctgtcaggatgagaatggctatacagccaatgattgcgtcgaacggataaagcctgacgaacagcgagcctgtgaaagcggcccgtgccctcagtgggcctacggcaactggggggagtgtaccaaactgtgtggagggggaattcgcacacgactcgtagtctgtcagcgtagcaacggtgagagatttcctgatctgagctgtgaaattctggataagcccccagatcgcgagcagtgcaacacacacgcctgcccccacgacgccgcttggagtaccggtccctggagctcttgtagcgtatcgtgcgggaggggacacaagcagaggaacgtgtactgcatggcgaaagacggaagccacttggagtctgactattgtaagcacctggctaagccccacggacacaggaaatgccgcggcggacggtgcccaaaatggaaagccggagcatggtcccaatgtagtgtgtcttgtggtcgcggggttcagcagagacacgtgggctgtcagattgggacacataaaatcgcgagagaaacggaatgcaacccatacacacggccagaatccgagagggattgccaaggaccccgctgtcccctgtatacgtggcgcgctgaagaatggcaagagtgcaccaagacatgcggggagggctcgcgatatcgcaaggtggtgtgcgtagacgacaataagaacgaagtccatggagctcgatgcgacgtgagcaagaggccggtcgatagagagtcatgttccctccagccatgcgagtacgtatggatcactggcgagtggtccgagtgctctgtcacttgcggcaaaggatataaacagcggctggtatcctgctctgaaatctatactgggaaggagaactacgagtactcttaccagaccacaataaattgtcctgggacgcagccgccttcggtccatccttgttacctgcgagactgtcccgtcagcgccacgtggcgtgtgggcaactggggcagctgctccgtatcttgtggcgtgggagtgatgcagcgctccgtgcaatgtctcacaaatgaagaccagccctcccacctctgccacacagatctaaaacctgaggagaggaaaacctgtcgcaatgtgtacaactgtgagctcccccagaattgcaaagaggtgaagagacttaaaggcgccagtgaggacggggagtacttcctcatgattcgggggaaactgctaaagattttctgcgccggcatgcattctgatcacccaaaggaatatgttactctggtgcacggagactccgagaatttctctgaggtctatggccaccggctgcataacccaaccgaatgcccatacaacggcagccgtagggatgattgccagtgtcgcaaggactacaccgccgcgggcttctcctctttccagaaaatacggatcgacctcactagcatgcaaatcatcacaacggatctgcagtttgcccgcacaagcgaaggccaccccgtgccttttgctacggcgggtgactgctacagcgcggcaaaatgtccgcagggccggttctcaattaacctgtacggtactggtctaagtttaacggaaagcgccagatggattagccagggaaactacgcagtgagcgacataaagaaaagccccgatgggaccagagtcgtaggcaaatgcgggggctactgtggaaagtgcacccccagctccgggacaggtctggaagtccgcgtactatag

SEQ ID NO: 178063 - DNA, 2976 bp, Artificial Sequence
  Description of Artificial Sequence: Synthetic coding sequence
tgagagtgcagcgcccagtgcggcctgggctaccggaccctggacatatattgtgcaaagtactccagacttgatgggaagaccgaaaaggtggatgacggcttttgcagcagtcacccaaagccaagtaatagagaaaaatgttccggcgagtgtaatacaggcgggtggcgctattcagcctggaccgagtgcagtaagagctgtgatggcggcacacaaagaagacgagctatatgtgtgaatacacgaaacgatgtgttggacgacagtaaatgtactcaccaggagaaggtgaccatccagcggtgcagcgaatttccctgccctcagtggaagtctggggactggagcgagtgtttggtaacatgtggtaagggtcacaagcaccggcaggtgtggtgccaatttggagaggatcggcttaacgatcggatgtgtgatcctgaaaccaagcctacatctatgcaaacatgtcagcaaccggagtgtgcatcatggcaagcgggtccctggggacagtgctccgtcacatgtggtcagggataccagctgagagctgtgaagtgcattatcggcacgtacatgagtgtcgtggacgacaatgactgcaatgcagctactagaccaaccgacacgcaggattgcgagctcccgtcgtgtcacccgccaccggccgctccagagacgaggcgctctacttatagcgcacctcggacgcagtggcggtttggtagttggaccccgtgctccgctacctgcggtaagggcactcgaatgagatatgtcagctgcagagacgagaacggatctgttgccgacgagagtgcttgcgcgactcttcccagacctgtggctaaagaggaatgttctgttactccctgtggacagtggaaagcattggattggtctagttgtagtgtgacatgtggccagggacgcgctactcggcaggtaatgtgtgtgaactactcagaccacgtcatagataggtcagagtgtgaccaagactacatccccgagaccgaccaggactgcagcatgtctccttgcccacagcgaactcctgatagtggacttgctcaacacccttttcagaacgaagactatcgccccagaagcgcaagtcctagcaggacacacgtgctaggtgggaaccagtggcgcacaggaccctggggagcctgctcgtcaacgtgcgctggcgggtcacagaggcgggtggtggtgtgccaggacgagaacgggtataccgccaacgactgtgtggagagaatcaagcctgatgagcagcgcgcctgtgagagcgggccctgtccgcagtgggcttacgggaactggggcgagtgtaccaagctgtgtgggggcggaatcaggactcggctggtggtgtgccaacggtcaaatggtgagagattccccgatctgagttgcgagatcctggataaacctcccgatcgagagcaatgtaatacccacgcttgcccacatgacgcagcgtggagcaccgggccctggtcttcttgtagcgtttcctgcggcagaggacataaacagcggaatgtgtactgcatggcaaaggatgggtcccatctggaaagtgactattgcaaacacctcgccaaaccgcacggacaccggaaatgtcgagggggacgatgcccgaagtggaaggccggtgcctggagtcagtgtagtgtcagctgtggcaggggtgttcagcagcgacacgtgggctgccagatcggcacacacaagatagcaagagagacagagtgcaatccttatacacgccccgaatcagagcgtgattgtcaaggcccacggtgccctctttacacctggcgagctgaggagtggcaggagtgcaccaagacatgcggggagggtagccgctatcggaaagttgtgtgcgtggacgataacaaaaatgaggtgcacggggccagatgcgatgtttcgaagcgccccgtggaccgagaatcctgcagtctccagccatgtgagtacgtgtggatcactggggagtggagtgagtgtagcgtcacttgtgggaaaggttataaacaacgcctcgtaagttgctctgagatatataccggcaaagaaaactatgaatatagctaccagaccacaatcaactgccctggtacccagccgccctctgtgcacccatgttatctgcgcgattgccccgtcagtgccacatggcgtgtgggcaactggggctcatgtagtgtgagctgcggagtaggagtgatgcagagatcagttcagtgcctgactaatgaagatcaacccagtcacttatgccataccgaccttaagccagaagaacggaagacatgccgcaatgtgtacaactgtgagctgccccagaactgcaaggaggtgaaaaggctcaaaggagcctcagaggatggtgaatacttcctgatgattcgcgggaagctgttgaaaatcttctgtgccggtatgcactcggaccaccctaaggagtatgtaactcttgtccatggggacagtgagaacttcagtgaagtatacggtcaccgactccacaaccctaccgaatgcccctacaacggtagtaggagggacgactgccagtgcagaaaggattacactgctgctggcttcagcagtttccagaagattcgtatcgacttgacgtcaatgcagattatcaccacagatttacagttcgccaggacttctgaaggccaccccgtacctttcgcaactgcaggggattgctatagcgccgcaaaatgtccccagggcagattttccattaacctgtacgggaccggcttgtcgctgactgagagcgccagatggattagccaaggcaactacgcagtcagtgacattaagaaaagcccagatggcacccgggtggtgggtaagtgtggtggatattgcggaaagtgtacgccatcctctggtacagggctcgaagtcagagtgttatag

SEQ ID NO: 178064 - DNA, 5808 bp, Artificial Sequence
  Description of Artificial Sequence: Synthetic coding sequence
atgcagttcgtgagctgggccaccctgctgaccctgctggtgcgggatctagcggaaatgggcagccctgacgcggcggccgcggttcggaaagaccggctccaccctagacaagtgaaattattggagaccttatcagagtacgaaattgtgtcccctattagggtgaatgctctgggagagcccttcccaacgaatgtccacttcaaaagaactaggcggagtattaatagtgcaaccgatccatggccggccttcgcgtcttcctcctcctcaagcacatcctctcaggcacattatcgactgtcagcgtttgggcagcagttcctgttcaacttgacagccaacgcgggtttcatcgctcctctgtttacagtgactctgcttggaaccccaggggtaaaccagaccaagttttattctgaagaggaggcggagctgaaacactgtttctataagggatatgtgaacacaaactccgagcacaccgccgtgattagcctgtgctccggcatgttgggcacctttagatctcatgacggcgactacttcatcgagcctttacagtccatggatgaacaggaagatgaagaagaacagaataagccacatattatctaccgacgctctgctccccagcgagaaccttcaaccgggcgtcatgcctgcgatacctcagaacataagaacagacattcaaaagacaagaagaaaacccgcgccaggaaatggggcgagcggataaatctggccggggatgtggcagcccttaactccgggctggcgactgaggcattcagcgcctatggtaataagactgacaacaccagagagaaacggacccaccgtcggactaaaaggttcctgtcctatcccagatttgttgaagtgctggttgtggctgataaccgaatggtttcataccatggtgagaatctgcaacactatatcctgactctgatgtccatcgtcgcttcaatttataaagaccctagtattggaaacctgattaacattgttattgttaatctgatagtcattcacaatgaacaggacgggccatccatctccttcaacgcccagactaccctgaagaacttttgccagtggcagcacagtaaaaactccccaggtggaatccaccatgatacggctgtcctcctcaccaggcaggatatatgccgcgcccatgataaatgtgacacgttaggactggccgaactgggcaccatttgtgatccctaccgctcttgtagtatcagtgaagactctgggttgagtacggcttttacaatcgcacatgagctgggacatgtgttcaacatgccacatgatgataacaataaatgtaaggaagagggcgtgaagtctccccagcatgtgatggcgcccacactgaacttctacacaaacccctggatgtggtctaagtgcagccgaaaatatatcaccgagttcctggacaccggctatggagaatgtttgctgaacgagcctgaaagccggccctaccctctgccagtgcaattgccaggtatcctgtataatgtgaataaacaatgcgagttgatttttggacccgggtcacaggtttgcccatacatgatgcaatgccgacgcctgtggtgtaataatgtcaatggggtccacaaaggatgccgaacacagcacacaccgtgggcagacggcactgagtgtgaaccgggcaagcattgtaagtacggcttttgtgttccgaaagagatggatgtccctgttaccgatgggtcctggggctcatggagccctttcggaacttgctcgcggacctgcggaggaggcataaagactgctatacgcgagtgtaacaggcccgagccaaaaaatggcggcaagtattgtgttggccggagaatgaagttcaagtcctgtaacacagaaccatgcctgaaacagaagcgcgatttcagggacgaacagtgcgcccattttgacggcaaacattttaacatcaatggcctgctccctaatgtgcggtgggtgcccaagtactctggcattctgatgaaggaccggtgtaagctgttctgccgggtggccgggaataccgcttactatcagctgagagacagagtgattgatgggacaccctgcggacaggacactaacgacatctgcgtgcagggtctttgtcgccaggccggctgcgaccacgtcctgaactccaaggcacgacgcgataaatgtggcgtgtgtggtggggataactcctcatgtaagacagttgctggcaccttcaatacagtccactacgggtataatactgttgtcagaattcccgctggggccacgaatatcgatgtgcgccaacactcattctccggtgaaacagatgatgataattacttagccctgtctagctcaaagggcgaatttctgttgaacggaaatttcgtggtaaccatggccaaacgagagatccgcatcgggaacgctgtggtggagtactccggaagcgaaaccgccgtcgagagaattaacagcaccgaccggattgagcaggaactgctactgcaggtactgtccgtgggaaaactgtataaccctgatgtccggtacagctttaacatcccaattgaagacaaacctcaacaattttattggaactctcacggcccctggcaggcgtgctccaaaccgtgccaaggcgaaaggaagcggaagttggtgtgtactcgggagtcggaccagttaacagtgtccgaccagaggtgcgatcgactgccacaaccaggacacattacagagccctgcggcaccgattgtgacctccgttggcacgtagctagtcgaagcgagtgctctgcccagtgtgggcttggctatcgtactcttgatatatactgcgctaagtattcccgtctcgacggcaagactgaaaaggtggatgacggtttttgctcaagtcaccctaaaccaagtaaccgcgagaagtgctctggcgagtgcaacacagggggctggagatattcggcttggaccgaatgcagcaaatcttgtgatggaggcactcaaagacggagggccatttgcgttaacaccaggaacgacgttctcgatgattccaagtgtacccaccaggaaaaagtaacaatccagcgatgctccgaattcccttgtccccagtggaagtctggtgattggagcgaatgtttggtgacctgcggaaagggtcacaagcaccgccaggtgtggtgccagtttggcgaggaccggttaaacgaccgcatgtgtgacccagagaccaaacccacaagtatgcagacttgccagcagccagagtgcgcgtcctggcaggccgggccatggggtcagtgtagcgtaacatgtgggcagggttaccagctaagggccgtcaaatgtatcataggaacctacatgtctgtcgtcgacgacaacgactgcaatgccgctacaaggcctacggacactcaggattgtgagctaccctcatgccacccgcctcccgcggctcccgagacacgccgatctacctacagcgctcccaggacccagtggaggtttgggagctggacgccttgtagcgctacctgtggtaaggggacaaggatgcggtacgtgagttgtagagatgaaaacggcagcgtggccgacgaatctgcttgcgccacactccccaggcctgtggccaaggaagagtgctccgtcacgccttgtggccagtggaaggccctggactggtcatcgtgtagtgtgacttgcggacaagggcgggccactcgtcaagtcatgtgtgttaattatagtgatcatgtaatagatcggtccgaatgcgaccaagattatattccagagaccgaccaggactgttccatgagtccgtgtccccagagaactccggacagcgggctggcccagcacccatttcagaacgaagactacagacccaggagtgcttccccctcacggactcatgtgcttggcggcaatcagtggcgcacaggaccctggggtgcttgttcttccacttgcgctggagggagccagcgtagagttgtcgtctgccaggatgagaacgggtataccgcaaacgactgcgtagagcgtatcaaaccagatgaacagcgggcttgcgaaagtggtccttgcccacagtgggcttatggcaattggggtgagtgcacgaaactgtgtggcggggggattagaacacggctcgttgtgtgtcagaggagtaacggggaaaggttccccgacctcagttgcgagatactggataaacctcccgaccgagagcaatgcaatactcatgcctgtccacacgatgcagcctggtcgacggggccgtggtcttcctgcagtgtttcttgtggcaggggccacaaacagcgaaatgtgtactgtatggcgaaggatggctctcacctggagtccgactattgcaagcaccttgccaaacctcatggccacagaaagtgtagaggcggaagatgtcccaaatggaaggcgggggcttggtcccagtgctcagtctcctgtggacggggcgtgcagcagcgacacgtgggttgtcagattggcacccacaaaatagctagagaaactgagtgcaatccgtacaccaggccggagtcagaacgggactgtcagggaccccggtgtccactatatacctggcgcgcagaggaatggcaggagtgtaccaaaacctgcggggaaggctctcgctatcgcaaagtggtctgcgtggacgataataaaaacgaagtgcacggcgccaggtgcgacgtaagcaagagaccagtggatcgcgagagttgtagcctgcagccatgtgagtacgtttggattactggcgaatggagcgagtgctccgtgacctgtgggaagggctataaacagagactcgtttcttgcagtgaaatttacactggcaaagaaaactatgagtattcatatcaaaccactatcaattgtccaggcacccagcctccatcggtacacccttgctacctgcgtgattgccccgtgtctgctacctggcgagtcgggaactggggatcttgctctgtatcctgtggcgttggagtgatgcagcgatccgtgcaatgcttaactaacgaggaccagccctctcatttgtgtcatactgacctcaagcctgaagagcgcaagacatgtcgcaatgtatacaattgtgaactgccccagaattgtaaggaggttaaacgattaaagggtgcttccgaggatggcgagtactttttgatgatccggggcaagcttttaaagatattctgcgctggcatgcatagcgatcacccaaaggagtacgtgacgctcgtccatggggattctgaaaacttttcagaggtctatggacacaggctgcataatccaaccgaatgcccttacaacgggagtcgtcgcgatgattgccagtgccgaaaagactacacggcagctggatttagtagttttcaaaagattcggatagatctgacgtctatgcagatcattactacagacttgcagtttgcaaggaccagcgagggacatccagtacccttcgcaacagctggcgattgctacagcgcagcaaagtgtccacagggtcgcttctccattaatttatacggaactggactaagtcttacggagtccgccaggtggatctcccaagggaactacgctgtcagtgacatcaagaagtcgcctgacggtacaagagtggttgggaaatgtgggggctattgcggaaaatgcacgccttcgtcagggacaggactcgaagtgcgggtgctctag

SEQ ID NO: 178065 - DNA, 1176 bp, Artificial Sequence
  Description of Artificial Sequence: Synthetic coding sequence
atgatcctgaacggcgaggagatcatcctgagcctgcagaagaccaaacacctgctgggcccagactatactgaaaccctgtacagtccaagaggagaagagattacaactaaacctgaaaacatggaacattgttactacaagggcaatattcttaacgaaaagaacagcgtggccagcatctccacgtgcgatgggttgcgcggctactttacccaccaccatcagcgataccagattaagcccctgaagtctacggacgaaaaagagcatgcggttttcacctccaaccaagaggaacaggaccctgcaaatcacacctgcggcgtgaaatccacagacggcaaacaaggccccatccgtatatcgcgatcgctgaaatcacccgaaaaagaagatttcctgcgagcccagaagtatattgatctttatctggttctggacaatgcattttataagaactataatgagaacctaacactcatccgaagctttgtctttgatgtgatgaatctgctgaatgtcatatacaacactattgacgttcaggtggcactggttggaatggaaatctggagtgatggcgacaaaatcaaggttgtgcccagcgcgtcgacaactttcgataatttcctcaggtggcactcctccaatctgggaaaaaaaatacatgaccacgcacaactgctctctggcatctctttcaataatagaagagtgggtttagctgcttctaacagtctttgttctccctcctccgtcgctgtcattgaagctaagaaaaagaacaatgtggccctcgtgggagtgatgtcccacgagctgggtcatgtgttaggaatgcctgacgtcccctttaataccaagtgcccaagtggatcgtgcgtaatgaatcagtacctgtctagcaagtttccaaaagactttagcacctcatgtagagcccattttgagagatacctgctttcacagaaaccaaagtgcctgctgcaggcacctattccaaccaatatcatgactactccggtgtgcggaaatcacctgctggaggttggagaggattgtgattgtggaagtcctaaagaatgcacgaacctctgttgtgaagcccttacctgtaagctaaagcctggaaccgactgcggaggggacgctccaaaccacacaaccgagtag

SEQ ID NO: 178066 - DNA, 1413 bp, Artificial Sequence
  Description of Artificial Sequence: Synthetic coding sequence
atgctgcggggcatcagccagctgcccgccgtggccaccatgagctgggtcctcctacccgtgttgtggcttattgtgcagacccaggcaattgctattaagcaaacgccagaactgactctgcatgagatcgtgtgtcccaaaaagctgcacattctccataaaagagagattaagaacaaccagaccgagaagcacggtaaagaggaaagatatgaacctgaagtgcagtaccagatgatcttgaacggcgaggagatcattctgagcctgcagaagactaagcatttgcttggacccgactatacagagacgctgtattctcctcggggggaggagattacaactaagccagaaaatatggagcactgctattataagggtaatatcctgaatgagaaaaatagcgtggccagtatctccacttgcgacggcttgcggggctatttcacccaccaccatcaaagataccagattaaacctctgaagtcaaccgatgaaaaagagcacgcggtgtttacttctaaccaggaagaacaggaccccgccaaccacacctgtggcgtcaaaagtacagatgggaaacaggggcctattaggatctccaggtctctaaaatctcccgagaaagaagattttctgcgcgcacagaagtacatcgacttgtacctggttctggataacgccttctataagaactataacgagaatctgactctgattcgatcatttgtctttgacgtaatgaatctgttgaacgtgatctacaatacgattgatgtacaggtcgctctggtgggcatggagatctggagcgacggcgacaaaataaaagttgtgccttctgcatctaccacttttgataatttcctgcgatggcactccagcaacctcggaaaaaaaatccacgaccacgcacagctactgagcggaatctccttcaacaaccgacgggtcgggttggcggcgagcaactcattgtgcagcccatcatcagtggcagtcattgaggccaagaagaagaacaatgtggccctcgtgggcgtgatgagccacgagctgggccatgtgcttggtatgcctgacgtgccctttaacactaaatgtccctccggatcctgcgtcatgaatcagtacctttcctctaaattccctaaggacttcagcaccagctgccgcgctcactttgagagatacctgctgtcccagaagccaaaatgtctgctgcaagccccaatccccaccaatatcatgaccactcctgtctgtggcaatcacctcctcgaagtgggcgaagattgcgactgcggatcccctaaagaatgcaccaacctatgttgcgaggccctgacttgcaagctcaagcccgggactgactgcgggggagacgcccctaaccacaccactgaatag

SEQ ID NO: 178067 - DNA, 1176 bp, Artificial Sequence
  Description of Artificial Sequence: Synthetic coding sequence
atgatcctgaacggcgaggagatcatcctgagcctgcagaagaccaaacacctgctcgggccggattacaccgagacactgtattcccctaggggtgaagaaattaccaccaagccggaaaacatggagcactgctactataaagggaacattctcaatgagaaaaacagtgttgcctctataagtacatgtgacggactacgggggtattttacccatcaccatcaaaggtatcagattaaacccttaaagagtaccgatgagaaggagcacgcagtctttacgtcgaaccaggaggagcaagacccggctaatcatacatgcggtgtgaaatcaactgacggaaagcagggaccaatccgcatcagtcgtagtcttaaatcacccgagaaagaggactttcttcgagcccagaaatacatcgacctgtatcttgttctggacaacgctttttacaagaactacaatgagaatcttaccttgatacggagcttcgtgtttgacgttatgaacctcctgaacgttatttataatacgatcgatgtgcaagttgcgttagtgggtatggaaatatggagcgatggcgataagatcaaagttgtgcctagtgccagcaccacgtttgacaactttctgagatggcactcctcgaatttaggcaagaagatacacgatcatgcccagctgctatcgggcattagcttcaataaccgacgcgtgggtctcgctgcgagcaattccctgtgtagtccaagcagcgtcgctgtcatcgaggccaaaaaaaaaaataacgtggcactagttggcgtgatgagccacgagctgggacacgtactcggaatgcctgatgttccatttaacacaaagtgcccctctggatcttgcgtgatgaatcaatatttgtcctcaaaattccccaaggacttcagcacctcctgccgggctcacttcgaacggtatcttctctcccagaagccaaagtgtctgctgcaagctccgatccccactaacatcatgactacccctgtctgcggcaaccacctcctggaggtgggggaggactgcgattgcggcagccccaaggaatgcacaaatctatgctgtgaggctctgacttgcaaattaaagcctggaactgactgtggcggtgacgctcctaaccatacaacagaatag

SEQ ID NO: 178068 - DNA, 2052 bp, Artificial Sequence
  Description of Artificial Sequence: Synthetic coding sequence
atggagtgctgccggcgggccacccccggcaccctgctgctgttcctggctttcctccttttgtcctcccgaactgccaggtccgaggaggatcgtgacgggttatgggatgcttggggaccttggagcgagtgcagccgaacctgcggaggaggagctagctacagtcttaggcggtgtctgtcctcaaagagctgcgaaggccgcaatatcagatataggacatgctctaatgttgactgtccacccgaagcgggggactttcgagcccaacaatgttccgcacacaatgacgtaaagcatcatgggcagttttacgagtggctacctgtgtctaatgatcctgacaatccttgctccctcaagtgtcaggcaaagggaactaccctggttgtcgagctcgcacccaaagttctcgacggcacaaggtgttacacggagtccctcgatatgtgcatctccggtttatgccaaattgtgggttgcgaccatcaactaggaagcactgtaaaagaggacaattgtggggtctgtaacggagacggctcaacctgcagactcgttagaggccagtataaatcacagctgtcggcgacaaaaagcgacgacacagtggtggcaattccctacggctctcgacacatcaggctggtgttgaagggtcctgaccatctgtatctggagacaaaaacattgcagggcacaaaaggcgagaattctctttcctctaccggaactttcctggtggataattctagcgttgacttccaaaagttcccagacaaggagattttaaggatggctggccccctaacagccgactttatcgttaagatccgcaattcagggtctgcagatagtactgttcaattcattttctaccaacccatcatccacagatggagggagactgactttttcccctgtagcgcaacctgcggcggcggctaccaactgacaagcgctgagtgttacgacttgcgcagtaatagggtagtggcagatcagtactgccactactatcctgaaaatatcaagcccaagccaaaactccaggagtgtaacctggacccttgccccgcttcagatggttataaacagattatgccatacgacctataccaccctctgccacggtgggaagcgactccctggaccgcttgtagcagttcctgcgggggggggatccaatcacgggccgtgtcatgtgtagaggaagatatccagggacacgtgacctctgtggaggagtggaagtgcatgtacaccccaaagatgcctattgctcaaccatgcaatattttcgactgtcccaaatggctggcacaggaatggagcccatgtacagtgacttgtggccagggcctcagatacagggtagtgctgtgtatcgaccatcggggcatgcatacgggcggctgtagccccaaaaccaaaccacacatcaaagaggagtgcatcgttccgactccctgctacaagcctaaagaaaagctgcccgtggaggcaaaacttccttggttcaagcaggcccaggagctggaagagggagccgccgtgtcagaggaaccaagctttatccccgaagcctggtcggcctgcacagtgacatgtggagtcggtacgcaggtccggatcgtgcgctgccaggttctcctctccttctcccagtcggtcgcagatcttcctattgacgagtgtgagggaccgaagcctgcttctcagagggcctgctacgccggcccttgctcgggtgaaatccctgagttcaatcctgacgagacggacggactgttcggcgggctacaggattttgatgaactgtatgactgggaatacgagggattcacaaaatgtagtgagagctgtggcggcggtgtgcaggaagccgtagtctcttgtctaaacaaacagacccgagagcctgccgaggagaacctctgcgtgacctcccggcggcccccccagctcctgaagagttgtaatctagacccttgcccggcaagatcgagcatcgactccgcttggaacgcctgtaatgttttgtgttag

SEQ ID NO: 178069 - DNA, 1401 bp, Artificial Sequence
  Description of Artificial Sequence: Synthetic coding sequence
atgtgcctgaccgacgagtggggcttcttcttcttcttcttcctgggagtgccggaggctgaagtgacttggttccggaataagtctaagctgggcagcccacaccatctgcacgagggatccctactgttaacaaacgtgtcctcttcagaccagggactgtacagttgtcgagctgctaacctgcacggggagcttactgagagcacccagctgttaattctggaccccccccaagtccccactcagctggaagacatccgagccctcctggccgctactggtcctaacctcccaagcgttttgactagtccattggggacacagttagtgctggaccccggaaattcagcgctcctcggctgccccataaaaggtcacccggtgcccaatatcacctggttccacggcggtcagccaattgtgacagctaccggcttgacgcatcatattcttgccgccggtcaaatcctgcaagtggccaatctgagcggcgggtcccagggcgaattctcatgcttggcacagaacgaggctggggtattgatgcagaaggctagtctagtgatacaggattactggtggtccgtagatcgcctcgccacctgttccgcaagctgcgggaacaggggtgttcagcagcccaggcttaggtgcctcctgaattcgacagaagtgaatcctgcacactgtgccgggaaagttcggcctgcagtgcagcctatagcttgtaacagacgtgactgccccagccgttggatggtgacttcgtggtccgcttgcactcgaagctgtggcggtggtgttcaaacacgacgcgtgacctgccagaagctgaaagcctccggcatttccaccccagtctcaaacgatatgtgtacacaggtagccaaaagacccgttgatacacaagcctgtaaccagcagttgtgcgtagagtgggcctttagcagctgggggcagtgcaacggcccatgtatcggcccccatctggcagtccagcaccgccaggttttctgtcagacaagagacggaatcacgctgcctagtgagcaatgttcagcccttcctagacccgtcagtactcaaaactgctggagcgaagcctgcagtgtgcattggagagttagtctctggaccttgtgtaccgcgacgtgtggtaactacggtttccagtccagacgggtcgagtgtgttcacgctagaaccaataaggcagtgcctgagcacctgtgctcttggggcccccgacccgccaattggcagcggtgtaacatcaccccctgcgaaaacatggagtgtcgagacaccactcggtactgcgagaaggtgaaacagctgaagttgtgtcagcttagccagtttaaatcacgttgctgcggaacttgcggaaaagcatag

SEQ ID NO: 178070 - DNA, 1578 bp, Artificial Sequence
  Description of Artificial Sequence: Synthetic coding sequence
atggagtgctgccggcgggccacccccggcaccctgctgctgttcctggcctttctgctcttaagttctcgaaccgcccgcagcgaagaggatagagatggcctgtgggacgcctggggaccatggtctgaatgttctcgaacatgcggaggaggtgccagttactcactgagaagatgtctgagctccaagagctgcgagggcaggaacatcaggtatcgcacatgtagcaatgtcgattgccctccggaagcaggggacttcagggctcagcagtgcagcgcccataatgacgttaagcaccacggtcagttttacgagtggttaccagtctcaaacgaccctgataacccgtgttctctgaagtgccaggcaaaggggaccaccctggtggtggaacttgctccaaaggtattagatggaacccgctgctataccgagtcactcgacatgtgcatctcgggcctttgtcagattgtgggttgcgaccaccaactcggctcaaccgtcaaggaagataattgtggtgtgtgtaatggggatggctctacctgtaggctcgtgcgaggtcaatacaaatcccagctctccgcaacaaaatccgacgataccgtcgttgccattccctatggcagtcgccacataaggctcgtactgaagggccctgaccatttgtatttggagaccaagacgctgcagggcaccaaaggcgaaaactcactctcaagtactggaacgtttctcgtggacaattcgtctgttgactttcagaaattccccgataaagaaatcctgaggatggccggcccccttacagcagacttcatcgtgaaaatcaggaactccgggtccgctgattcaaccgtccagttcatattctaccagcccattatacaccggtggcgcgagactgatttctttccctgctcagccacgtgtggtgggggctatcaactaacatcagccgagtgttacgacctcagatccaaccgtgtagtcgccgatcagtactgccactattatcctgagaatatcaagccaaaaccaaagctccaggagtgcaatttagatccatgccctgcctcagatggctacaagcaaatcatgccttatgatctctaccacccgctgcccaggtgggaggccacaccctggacagcctgttcttcatcctgcggtggcggcatccagtctagagcagtgtcatgcgtagaagaggacattcagggtcacgtgacaagcgtggaagaatggaagtgcatgtacactcctaagatgcctattgcacaaccttgtaacatcttcgactgcccgaaatggcttgcccaggagtggtcgccatgcacagtgacttgtggtcaaggccttcggtatagggtggtgctttgtatcgatcacaggggaatgcacactggagggtgttcacctaaaactaaaccccatatcaaggaagaatgtattgtgccaacaccgtgctacaagcctaaggaaaagctcccagtggaagccaaactcccatggttcaagcaggcccaggaattagaagagggggctgcggtctccgaagagccaagttag

SEQ ID NO: 178071 - DNA, 786 bp, Artificial Sequence
  Description of Artificial Sequence: Synthetic coding sequence
atgtgcctgaccgacgagtggggcttcttcttcttcttcttcctgggtgtgccagaggctgaggtgacatggttcagaaacaagagtaagctggggtcaccacatcaccttcacgaaggctccttgctgctgacaaatgtgtcctcctccgatcaagggctctacagctgcagagccgccaatctgcacggtgagctgacagagtcaactcagctgctgatacttgacccgccacaggtgcccacccaacttgaggacattcgcgcgctgctggcggctacaggtcctaatttgccctctgtccttacctccccactgggcacacagcttgtactggacccaggtaactccgcactgctcggctgcccaatcaaagggcatcccgtgcccaatatcacatggttccacgggggtcagcctatagttactgccacggggttgacccaccacatcttagcagctggccagatcttgcaggtggccaacctttctggaggtagtcagggagaattcagttgtcttgctcagaacgaagccggtgtgttgatgcagaaggcctcactggtcattcaagactattggtggtcggtcgaccggctcgcaacttgctcagcaagttgtggaaaccgcggcgtccagcagcctagactgcggtgcctgttgaattctaccgaggtgaatcccgcccactgcgccggcaaagtgaggccggctgttcagccaattgcttgcaatcgcagggattgcccaagtcgcgccatgggactggcttctgggttgacatag

SEQ ID NO: 178072 - DNA, 5289 bp, Artificial Sequence
  Description of Artificial Sequence: Synthetic coding sequence
atggagtgctgccggcgggccacccccggcaccctgctgctgttcctggcatttctcctgctgagctctcgaaccgctagaagcgaggaagaccgagatggactgtgggatgcttggggaccatggtcagaatgctccaggacctgcggggggggggcttcctactcacttaggagatgtctgagttctaagagctgcgaaggcagaaacattagatatagaacttgcagcaacgtggactgtccacccgaagctggcgatttcagggcgcaacagtgctcggcacacaatgatgtgaagcaccacgggcagttttatgaatggctgcccgtctccaacgacccggacaatccatgctctctgaagtgccaggccaaaggcacaactttagtcgtggagctcgcacccaaggtgctagacggtacaagatgctacactgaatccctcgacatgtgtatcagcgggctgtgtcagatcgttgggtgtgatcaccaacttggtagtaccgtgaaagaagacaattgtggggtatgtaacggcgatggaagtacatgccggttagtaagaggccagtacaaaagccagttatctgctaccaaatccgacgatacggtggtggccattccttacggatctcgccacattcgactggtgttgaagggacccgaccacctgtatctcgagaccaagacactgcaggggactaagggagaaaattctcttagtagcactggaacatttctcgtggacaactcctccgttgattttcaaaagtttccagacaaagagattctgcgcatggccggtcccctgaccgccgactttatcgtcaaaattagaaatagtggtagtgccgacagcacggttcagtttattttctaccagcctatcatccaccgttggcgcgagacggacttttttccatgcagtgcaacttgtggcggtgggtatcaactgacaagcgccgaatgctacgatctgaggtcaaacagggtagtagccgatcagtattgtcactactaccccgagaacatcaaacccaaaccaaagctgcaagaatgcaatctggacccctgtccagcatctgacggctataaacagataatgccctacgatctataccaccctctgccacgctgggaagctaccccctggactgcctgttcctcttcttgtggaggagggatccaatcgcgggcagtgtcttgtgtcgaagaggatatccagggccatgtcacctctgtcgaggaatggaaatgtatgtacacacccaagatgcccatagcccaaccctgtaacatcttcgactgtccaaaatggttggcacaggagtggagcccatgcactgtcacatgcggccagggcttgcgctaccgagttgtgctttgtattgatcaccgcggcatgcacacaggaggatgttcccctaagacaaaacctcacatcaaggaagagtgtattgtccctacaccttgttacaagcccaaagaaaagttacctgtggaggccaaactgccttggttcaagcaagcacaggagctggaggagggagccgctgtctccgaggaaccgagcttcatccccgaagcctggtctgcatgcacagttacctgtggagtcggcacacaggtccggatcgtgcgctgtcaggtcttgttatccttcagtcagtccgtcgctgatcttccgatcgatgaatgtgagggccctaagcctgcttcacagagggcctgctatgccgggccttgcagcggggaaattcccgaatttaacccagacgagacggacggcctgtttgggggtctccaggatttcgacgagttatatgattgggaatacgaggggttcaccaagtgttctgaaagctgcggggggggcgtgcaggaggctgtagtgagttgtctgaacaagcagacgcgcgaaccggctgaagaaaacttgtgcgtgacctcccgccgacctccacagttactcaaaagttgtaatttggatccatgccctgcccgctgggagataggcaaatggagcccttgcagtctcacttgtggtgtcggtctccagacaagagacgtcttttgttcacacctcttgtctagggagatgaatgaaaccgtaatcctggctgatgaactctgccgccaacctaaaccctctactgtccaggcctgtaaccgcttcaactgtccaccagcctggtaccctgcgcaatggcagccttgtagccgcacttgtgggggtggcgtgcagaaacgagaagtgctgtgtaagcagcgaatggcggatggctcctttttggaactcccagaaacattctgttccgcaagcaagccagcctgtcagcaggcttgtaaaaaggacgattgtccatccgaatggctgttatcagattggaccgaatgctccacctcctgcggtgagggcacgcagacccgatcggccatatgtagaaaaatgctgaaaacaggcctgtctacggtggtcaactcaactttatgccccccattgccgttctcctcctctatcagaccctgcatgctggccacctgtgcaagacctggcaggccttctacaaaacactccccacatatagcagccgctagaaaagtgtatattcagacccgcaggcagcgtaaactgcatttcgttgtcgggggattcgcctatctgctgcccaaaactgcagttgttctcagatgtccagcccgccgagtaagaaaacccctaattacatgggagaaggacggtcagcacctgatttcttctacacacgttacagtggccccattcgggtatttgaagattcataggctgaaaccgtcggacgcaggagtctatacgtgtagcgcagggccagcgagggaacactttgtcatcaaacttatcggaggaaaccgaaaactcgtggcacggcccctgagtcctcggagcgaggaggaagtgctggccggacggaaagggggccctaaagaggccctccagacacacaaacaccaaaatggcatcttctctaatggttccaaggctgagaaacgcggactcgccgccaaccccggctcccgctatgacgacctcgtatcccggcttctcgagcagggggggtggcctggtgagcttttggcgagctgggaagcacaagactccgccgaacggaatacaacaagcgaggaggacccaggggcagaacaagtcctgctgcacctacccttcacaatggtcaccgaacagcgacgacttgacgacatccttgggaacctgtcgcagcaacccgaagagttgagggacctgtacagcaaacaccttgtggcccagctcgctcaggagatctttaggagtcatctcgaacaccaggacaccctgcttaagccctccgaacgtcgcaccagccccgtcaccttatcccctcataagcatgtttctggtttttcatcaagtctcagaacatcatcaacgggtgacgccggggggggcagtcgccgcccccacagaaagcccaccattctgaggaagatcagcgctgctcaacagctgtctgccagcgaggtagtgacacacttggggcaaaccgtcgctctggctagcggcaccctgtctgtcttgttacattgtgaggcaatcgggcacccccggcccaccatcagctgggctagaaacggagaagaggtacagttttccgatcggatcttactgcagcccgacgactccctccagattctggcgcccgtggaggccgacgtgggcttttacacctgtaatgcaactaatgccctggggtatgattccgtcagtattgccgtcactcttgcagggaaacctctcgtgaagacgagccggatgacggtgattaacaccgaaaagcccgccgtgactgttgacatcggtagtactattaaaaccgtgcagggggtgaatgttaccatcaactgtcaggtcgcaggggtcccagaggcagaggttacctggttcaggaacaagtccaagctgggcagtccccaccatcttcacgaaggcagtctgctcttgactaacgtctcctcaagcgaccagggcctgtactcatgcagggccgccaatcttcatggcgaactgacggaaagtactcagcttctgatcttggatcctccgcaggtcccaacccagttggaagatattcgcgcactcctcgccgctacggggccaaatcttcctagtgttcttaccagtcccctgggtacccagctcgtcctggatcccgggaattctgccttgctgggctgcccgattaagggacacccagtgcctaacatcacttggtttcacgggggccagcctatcgttacagcaacagggctcacacaccacattttggcagcgggtcagattttacaggtagccaacctttccggcggttcgcaaggcgagttctcgtgtctggcccaaaatgaagctggcgtcttgatgcagaaagccagtctcgtaattcaggactactggtggagtgtcgatagactggcaacatgctctgcatcctgtggaaatcggggtgtacagcagcctcggctccgttgcctgctgaattcgacagaagtcaatcctgcgcactgcgcgggaaaggtcaggcctgccgtccagcccattgcctgcaaccgacgggactgtccgagccgatggatggtgactagctggtctgcttgcactcgcagctgtggtggaggagtccagaccaggagagtgacctgtcagaaactgaaggcatctggaatctccacccccgtgtccaatgatatgtgtacccaagtggctaagcgccccgttgacacacaagcctgtaatcagcagctctgcgttgaatgggcttttagcagctgggggcaatgcaatggcccgtgcatcggccctcacttggcggtgcagcaccgacaggtgttttgccagacacgggatggcataactcttccaagcgagcagtgctctgcattacctcggcccgtgtctacgcaaaactgttggagtgaggcatgcagcgtgcactggcgagttagtttgtggaccctgtgtacagctacctgcggaaactacggcttccaatctcgccgcgtcgagtgtgtccacgcccgcacaaacaaagctgtgcccgagcatctgtgttcatggggaccgcggccagccaattggcagagatgtaacatcacgccctgtgagaatatggagtgccgggataccaccagatactgcgagaaggtcaagcagctcaaactgtgtcagttgtcccaatttaagtctagatgttgcggtacctgtggcaaagcatag

SEQ ID NO: 178073 - DNA, 1320 bp, Artificial Sequence
  Description of Artificial Sequence: Synthetic coding sequence
atggagtgctgccggcgggccacccccggcaccctgctgctgttcctggccttcttgctcctctcttccagaactgcgagaagcgaggaagatagggatgggctgtgggacgcgtggggcccttggagcgagtgttcaaggacttgcggtgggggcgcctcatatagcctgcggagatgcctctcctcaaaaagttgcgaagggaggaacattcggtatagaacctgttcaaatgtggactgcccccctgaagcaggtgattttagggcccaacaatgctctgcacacaatgatgtcaaacaccacggtcagttctatgagtggctgcctgtctccaacgatcctgacaacccgtgctctcttaagtgccaagccaagggcactacactggttgtcgagttggctccgaaagtattggatggaacccgctgctataccgagtccttggacatgtgtattagcgggttgtgccagatcgtggggtgtgatcaccaactgggttccactgtaaaggaggataattgcggagtttgcaacggcgacggcagcacctgtaggctggtgcggggacagtataaatcccagctttccgccaccaagagcgatgacactgttgtggctattccctatggcagccgccacatcagactagtcctgaaggggccggatcacctttacctggaaacaaagacattacagggtacgaaaggggaaaacagtctttcaagcactggaaccttcctggtggataatagctcggtagatttccagaagttccccgataaagagatcctaagaatggcaggacctttgaccgccgactttattgtcaagattcggaattctgggagtgctgattccacagtgcagtttatattctaccagcccatcatccataggtggcgggagactgattttttcccttgttctgccacgtgcgggggcggttatcaactgacctccgctgagtgctacgatctccgttccaaccgggtggtggcagaccagtattgtcactattacccggagaatatcaaacctaaacccaagctgcaggagtgtaatctggatccttgcccggctagatgggaggctacaccgtggaccgcttgctctagcagttgcggaggaggtatacaaagccgcgccgtgtcttgtgtagaagaggacatacaaggacatgtgacctcagtcgaggagtggaaatgtatgtatactcccaagatgccaattgcgcagccctgcaacatcttcgattgccccaaatggctggcgcaggagtggtcacctgtcacggtgccgagcttctttgtgcattag

SEQ ID NO: 178074 - DNA, 2856 bp, Artificial Sequence
  Description of Artificial Sequence: Synthetic coding sequence
atggacggccggtggcagtgcagctgctgggcctggttcctgctggttctagcagtagtggccggcgacactgtgtctacaggatctacagataattccccaacaagcaacagcctggagggcgggaccgatgcaacagcgttttggtggggggaatggaccaaatggacagcttgcagtcgctcctgtggcgggggcgtaaccagccaggagcgacactgtctgcagcagcgccggaagagcgtgccggggcctggtaaccggacttgcacagggacaagtaagcgctatcagctttgcagagtacaggagtgcccacccgatggcagaagcttccgggaagagcagtgtgtgagctttaatagccacgtatataatggaaggacacaccagtggaaaccgctctaccccgacgattatgtccacatctcaagcaagccttgtgatctgcattgcactactgtggacggtcagcgacaactgatggtccccgcccgcgacggaacttcctgtaagctgacagatctacgtggtgtgtgtgttagtgggaaatgtgagccaatcgggtgtgatggcgtgctcttcagcacccacacactggataagtgcgggatatgccaaggggacgggagctcttgcacacacgtcaccgggaattacaggaagggaaacgcacaccttgggtattccctagtgacacacattcccgccggcgctcgagacatccaaatcgtagaaagaaaaaaatcagccgatgttctggcgctggctgatgaggcgggctactatttctttaacgggaattataaagttgacagccccaagaattttaatatcgccggcaccgtggtgaagtaccggcgacctatggacgtctacgagacaggtattgagtatatcgtggcacaggggcctaccaatcagggtctcaacgtgatggtgtggaatcagaacgggaagagccccagtatcacatttgaatacaccctgctgcaacctcctcatgagtctcgaccccagcctatctactacggcttttctgaatccgcagaaagccaagggttagacggcgccggcctcatggggttcgtgcctcataacgggagtctgtatggacaagcttctagcgagcggctagggctggacaacaggctgttcgggcatcctggcttggatatggaactcggaccctcccagggtcaagaaaccaacgaggtgtgtgagcaggctggcgggggagcctgcgagggccctccaagaggcaaggggttccgcgataggaacgtgacagggacgccactgactggtgataaagacgacgaagaggtagacacccacttcgcctcccaagagttcttttccgcgaacgccatctcggaccagctgcttggtgccggatcagaccttaaagacttcacactaaatgagactgtgaattcgatctttgcacaaggtgccccgaggtcttccctggctgagagtttcttcgttgactatgaagaaaatgaaggagctggtccgtacctgctgaatgggagttacttggagttgagcagcgaccgcgttgcaaacagctcttccgaggcgcctttccccaacgtcagtacatccttattaactagtgccgggaatcgaacacataaagcgagaacgcggcccaaggcccggaagcaaggcgtgagtcctgcggatatgtaccggtggaaactttcttcacacgaaccctgctcagcgacttgcacgaccggggtaatgtcagcttatgccatgtgcgtcagatatgacggcgtggaggtcgatgatagctattgtgacgccctaacccgcccggagcctgtccatgaattctgcgccggccgagagtgccagcctcgttgggagaccagtagctggtctgaatgttccagaacttgtggagaaggatatcagtttcgtgttgtgcgatgctggaagatgctgtctcctgggtttgacagctctgtttatagtgacttgtgcgaagctgccgaggctgttcggcctgaagagcgtaagacttgccgcaacccagcgtgtggtccccagtgggaaatgtccgagtggtccgaatgtaccgccaagtgcggtgaacgaagtgtggtcaccagggatattagatgtagcgaagatgaaaaactgtgtgatccgaataccagacccgtgggcgagaagaattgtaccggccctccttgtgacaggcagtggacagtcagtgattggggaccttgcagcggcagctgcggccagggacgcacaattagacacgtctactgtaagactagcgatggccgagtagtgccagagtcccagtgccagatggagactaagccattggctatccatccttgtggagataaaaattgcccagcacattggctggcgcaggattgggaacggtgcaacactacttgcggaagaggcgtgaagaagcgtctcgtcttgtgcatggagttggctaacggcaagcctcagacgaggtcgggccccgagtgtgggctggccaagaagcctcccgaagagagcacttgttttgaaagaccatgcttcaagtggtacacgtccccttggtctgagtgcacaaagacctgcggtgtgggagtccggatgcgggacgtgaagtgctaccaaggcacggacattgtaaggggatgcgaccctctggtgaagccagtgggtcgacaagcctgcgacctccaaccctgtcctactgaaccacccgacgactcatgccaagaccagccgggaaccaactgcgcactggcaatcaaagtcaatctctgtggacactggtactacagcaaggcctgctgtagaagctgtcgtccaccccacagctag

SEQ ID NO: 178075 - DNA, 2856 bp, Artificial Sequence
  Description of Artificial Sequence: Synthetic coding sequence
atggacggccggtggcagtgcagctgctgggcctggttcctgctggtcctggctgtggttgccggggacaccgtctcaaccggcagcaccgacaattctcccacctccaactctctcgagggcggcacggacgcaactgctttttggtggggagagtggaccaagtggacagcatgtagccggtcgtgtggaggtggagtaacgtcccaggagcgtcattgtcttcaacagcggagaaagtcagtacccggcccaggtaacagaacttgcaccggcacctccaagagataccagctgtgtagggttcaggaatgtcccccggacgggaggtcttttcgcgaggagcaatgcgtgtctttcaactcccatgtgtacaatggacgcacacaccagtggaagccactttacccagatgactatgtgcacatctcatccaagccctgcgacctgcactgtaccacagtggatggacaaagacaactgatggtacctgccagggatggcacctcctgcaaactcacagacctgcgaggcgtatgcgtgtctggaaagtgtgagcctatcggttgtgatggggtgttatttagtacccataccctggataaatgcgggatatgccagggtgatggtagcagctgcacacatgtgaccggcaactataggaaaggcaatgcgcatcttggatattcactggtcacccatatcccagccggagcccgtgatatccaaatagtcgagcgcaagaaatctgctgacgttttagctctggccgacgaggcaggctactattttttcaatggcaattacaaagtggattcccccaagaatttcaatattgccggaaccgtggtgaaatacagaaggcctatggacgtatatgagacagggatagagtatatcgtggcacaagggcccactaaccaggggttaaatgtgatggtttggaaccagaacggaaagtctccgtctattaccttcgaatacacgctgctacaaccccctcacgagagcagaccacaaccaatctactatgggttttccgaaagtgcagagagccaaggactggatggcgcaggcctgatgggatttgtaccccacaacgggtctctgtacgggcaggcttcatcagagcgcctcggtctggataatagacttttcgggcacccggggctggatatggagctcgggccaagccagggacaggagacgaacgaagtgtgcgaacaggccggcgggggggcatgcgaggggccgccgcgggggaaaggcttcagggatagaaacgtaacagggactccactgaccggagataaagatgacgaggaagtggatacccactttgcatcccaggagtttttctcggcgaatgccatcagtgatcagctgcttggggccgggagtgacctgaaggatttcacgttgaacgaaaccgttaattctatctttgcacaaggcgccccgcggtcttcactggctgagagctttttcgtggattacgaggaaaatgaaggagccggcccctatcttctgaacggctcctatctagaactcagcagcgatcgggtcgccaatagctcctctgaagccccatttcccaatgtttcaacgtctctgttgacatcagcgggtaatagaacccacaaagctaggacccggcccaaagcgaggaaacagggggttagtccagctgacatgtataggtggaagctgtcctctcacgagccctgttcagctacttgcactacaggagtgatgtcagcctatgcgatgtgcgtaaggtacgacggcgtggaggtagacgactcctattgtgacgccttgactcgcccagaacccgttcatgaattttgtgcgggcagggaatgtcaacctcgatgggagactagtagctggtcggaatgttctagaacctgcggagaggggtatcagttcagggttgtccgctgctggaagatgctatcgccagggttcgatagctcagtgtactcggacctctgcgaggcggctgaagcggtgaggccagaggaaagaaagacttgcagaaaccctgcctgcggcccccagtgggagatgtctgagtggagtgagtgtaccgccaagtgcggcgagcggagcgtcgtcacaagggatatccgttgcagcgaggacgaaaagctgtgtgaccccaatacaagacccgtgggggaaaaaaactgtaccggaccaccttgtgatcggcagtggaccgtgtcagactgggggccatgcagcggatcatgcggccagggccgtacgatcaggcatgtgtattgcaaaacatccgatggacgggtagtgcctgagagccagtgccagatggaaacaaagccccttgccatccacccatgtggagataaaaactgtcctgcccattggctcgcccaggactgggagaggtgtaatactacgtgtgggcgaggagtgaagaagaggctggtgttgtgtatggaactagctaacgggaagccccaaacgagaagtggccctgagtgcgggctcgccaagaaaccacctgaggaatcaacgtgtttcgagaggccgtgtttcaagtggtatacctctccatggtccgaatgtacaaagacttgcggtgtcggtgtgcgaatgcgcgacgttaaatgttatcaggggacagacattgtgcggggatgtgacccactggtcaagccggtaggacggcaggcatgcgaccttcagccatgtcccacagaacctcctgatgactcttgccaggaccagccaggaacgaattgtgctctggccattaaagtaaatctttgtggccattggtactattccaaggcttgttgcagatcgtgtcgacccccccattcctag

SEQ ID NO: 178076 - DNA, 3183 bp, Artificial Sequence
  Description of Artificial Sequence: Synthetic coding sequence
atgctgttcgaggtgggcgagggcggcggcgccggcgaggagggcaagggacggggcaggcccggcaggtctttgtgtacacatgccgccccagctcggacagctcacctggctccatccgctctaaggtctgcgagacctttcctttgggaggataatctcctgacccgtagtcagggcttaccggacaaccatgatcaactggtgccagacaatctggaagcatgggccctcgcaggccctagaggccttttccccaaacgcaccctggtgatttggaaaagaatcggggccggactcgtcgttaccgtagcattgctccctagaatggacggcagatggcagtgttcctgttgggcatggtttctcctggtgctggcggtggtggcaggcgatacagtcagtactgggagcactgacaacagtcccacctccaactcactcgagggcgggaccgatgctacagccttttggtggggggagtggactaagtggactgcatgctcacgcagttgtgggggcggcgtgacaagccaagaaaggcactgtcttcagcaacgtcgaaagtccgtacccggccctggaaataggacttgtacagggacatctaagcggtaccaactgtgcagggtgcaggaatgccctccagacggaaggagctttcgagaagagcagtgtgtttctttcaattcccatgtgtataatgggagaacacaccagtggaagccactgtatcccgatgactatgttcacatttccagcaagccctgcgatctgcactgtacaaccgtcgatggccagcggcagctgatggtcccggcaagggatggcacttcatgcaaacttaccgatctgcggggagtgtgcgtgtctgggaagtgcgagcctatcggctgcgacggggtgctcttctccacacataccctggacaagtgcggtatatgccagggggacggttcctcctgtacacacgtcaccggaaattacagaaagggcaatgctcatctgggctattctttggtgactcacatcccagctggggcccgcgatattcagattgtggaaagaaagaaaagcgccgatgttctggccctagctgacgaggccggctattacttttttaacgggaattacaaggtggactcacccaagaattttaacatagcagggaccgtggttaagtacagacgtcctatggatgtctacgagactggcattgaatatattgtggctcagggcccaaccaatcaagggctcaacgtgatggtctggaatcagaacggcaaaagtccatcaataacattcgaatacacacttctccagccccctcacgagagccgcccacagcccatctactacggcttttcggagtcagctgagtcacaggggctggacggcgcagggcttatgggctttgtgcctcacaacggtagcctgtatggccaggcctcatctgaacgactggggcttgataaccggctgtttggccaccccggcctcgatatggagctaggtcccagtcagggacaggagaccaacgaggtctgcgaacaggcaggaggcggagcatgcgaaggaccgccgagagggaagggcttcagggataggaatgtgactggaaccccactcacgggcgataaggacgacgaagaggtcgatacccacttcgcgtcacaagagttcttctcagctaacgccattagcgaccaactgttgggagcgggctccgaccttaaggatttcacacttaatgagacagttaattcgatctttgctcaaggcgccccaaggagcagcctggccgaatctttcttcgtggattatgaagaaaacgagggagccggcccctaccttctaaatggttcatatctcgagttatcgtctgatcgagtagccaactcttccagtgaggctccttttcccaatgtgagcactagcctgctgacatcagccggtaatcggacacacaaggcacgcacgcgtcctaaagccaggaagcagggagtctctcccgctgatatgtataggtggaagctgtcatctcacgagccatgcagtgctacatgtaccactggcgttatgtctgcctacgccatgtgtgtgcggtacgacggcgttgaggtggatgatagctattgtgacgcactaacaaggcccgaacccgtgcacgagttttgcgccggacgcgagtgtcaacccagatgggaaacctcctcctggagcgagtgttctcgtacttgtggtgagggctaccagttcagagtagtcaggtgctggaaaatgttgtcccccggcttcgactctagcgtctattccgatctctgtgaggccgcagaagcagtacgtcctgaagagcgtaaaacctgtcgtaaccctgcatgtgggccccaatgggagatgtccgagtggtccgagtgtaccgccaaatgtggcgaacggtccgtggttactcgcgacattcgttgcagtgaagacgaaaagctttgcgacccaaacacgcggcccgtgggagagaagaactgtactggacccccatgcgatagacagtggacggtttccgactggggcccatgcagtggtagttgcggccaagggaggacaataaggcatgtctattgcaaaacaagtgacggccgtgttgttccagaaagccagtgccagatggagaccaagccactggccatccacccctgtggagacaagaattgtccagctcattggttggcccaggactgggaacgttgtaacacgacctgcggccgcggtgtgaagaagcgcctggtcttgtgcatggagctggctaacggcaagccacagacaaggtcagggccagaatgtggactggcgaaaaagcccccagaagaatctacatgctttgaaagaccttgtttcaagtggtacactagtccctggagcgaatgcaccaaaacgtgtggcgtaggtgtgagaatgcgcgatgtaaagtgctatcaaggcacggatatcgtcaggggctgcgaccccctggtgaagcccgttggccggcaggcttgtgacctgcagccctgtccaactgagccccccgacgacagctgccaggaccagcccggtacaaactgcgccttagcaattaaagtcaacctgtgtggtcactggtattactctaaggcgtgttgtagaagctgtcggccgcctcacagttag

SEQ ID NO: 178077 - DNA, 5076 bp, Artificial Sequence
  Description of Artificial Sequence: Synthetic coding sequence
atggccagctggaccagcccctggtgggtgctgatcggcatggtgttcatgcattcgccactgccccaaaccaccgcagagaagagtccaggggcatacttcctaccagagtttgctctgtctcctcagggaagctttttggaggacaccacaggcgaacagttcctgacctaccgatatgacgaccagacatcccggaatactcgctccgacgaagacaaggacggaaattgggatgcatggggcgactggagtgattgctctcgaacctgcgggggcggcgcctcttacagcctgaggcgatgcctgacaggacggaactgtgaaggccaaaatattagatataagacctgtagtaatcatgattgcccaccagatgcggaagactttcgggcgcagcagtgttccgcgtacaacgacgttcagtaccagggccattattatgagtggctgcctcgatacaacgatccagctgccccgtgcgcactcaagtgtcacgctcagggtcaaaacctggtggtggagctagcccccaaagtgctcgatgggacaagatgtaatactgactctctcgacatgtgcatctcaggtatctgccaggcggtgggctgcgataggcaactgggctctaatgctaaagaggataactgcggcgtatgtgctggagacggcagtacttgcagactagtcaggggccagtcaaaatcccatgtctcccccgagaaacgggaggagaatgtcatcgccgtccccctcggctcgcgctccgtgcgcattacagttaaaggacccgctcacctgttcattgaatccaaaacactgcagggctctaaaggagaacacagctttaacagtcctggcgtctttctggttgagaacaccacagtcgagttccaacggggttcagagagacagacttttaagatccctggaccactcatggcagatttcatttttaaaactaggtatactgcagccaaggactcagtcgtccagttctttttttaccagcccatcagccaccagtggcggcagacagacttttttccctgcaccgtgacgtgtgggggcggctaccagctgaacagcgccgagtgcgttgatatccgcctgaagcgggttgtaccggaccattactgtcactactatcctgaaaatgtcaagcctaaaccaaagctcaaggagtgctccatggatccttgcccttctagtgatggattcaaagaaattatgccctacgatcattttcaacctcttccacgttgggaacacaatccatggaccgcctgctcagtcagctgtggcggaggtattcagagacggtcgtttgtctgcgtcgaggagagcatgcacggagagatcttgcaggtggaagagtggaagtgcatgtatgctccaaaaccaaaagtaatgcaaacttgcaacctgtttgactgtcctaagtggattgccatggaatggtctcagtgtactgtgacttgcggccggggcctgcgataccgtgtggtactttgtatcaaccatcgaggcgagcatgtcggaggctgcaacccccagctcaaactccatatcaaagaggagtgcgtaatcccgatcccgtgctacaagccaaaagagaaaagccccgtggaagctaaacttccttggctcaagcaggctcaggaactagaagagaccaggattgccacagaggagccgacatttattccggagccctggagcgcctgtagtacaacttgcgggcccggggtgcaggtcagggaagtgaaatgccgcgtcctgttaacttttacacaaaccgagaccgagcttccagaggaggagtgtgagggccccaaattgccgactgagagaccatgtttactcgaagcttgcgatgagtcccctgctagtcgggagctggacatacccctccctgaagattccgaaaccacatacgattgggaatacgcgggttttacaccgtgtacagctacatgtgtgggaggacatcaggaggcaatcgcggtgtgtttgcacatccagacccaacagacggttaacgacagcctatgcgatatggtacaccgacctccagcaatgagtcaggcctgcaacacagagccttgccctccccgctggcacgttgggagctggggcccctgcagcgctacatgtggagttggtattcagacaagggatgtctactgtctgcaccccggcgagacgccagccccccctgaggagtgtcgggatgagaaaccccacgccttgcaggcctgtaatcagtttgactgcccacctggttggcacatcgaggagtggcaacagtgctcccgaacttgtggcggaggtacgcagaatcggagagttacatgtcgacagctcttaacagatggtagtttcctgaacctaagtgatgagctgtgccaggggccaaaagcgtcaagccacaaatcatgcgcccgcaccgactgtccgcctcacttggctgtgggggattggtcaaagtgtagtgtgtcatgcggggtgggcattcagagaaggaaacaggtgtgtcagaggcttgcagccaaaggtagaagaatcccattgagcgagatgatgtgtcgggacttaccagggttgcctctggtgcgctcttgtcaaatgcccgaatgctccaaaatcaagagcgaaatgaaaaccaagcttggtgaacagggccctcagattctcagcgtgcagagggtgtatattcagacgcgggaagaaaagagaatcaatctgacgatcggctccagggcttacctgctaccaaatacgagcgtcatcataaaatgccctgtcaggcgatttcaaaagtcactcatacaatgggagaaggatggcagatgcctccaaaactccaagcgactcggaataactaagtctgggtccctaaaaatccatggcttggctgcaccagatatcggagtttacaggtgtatcgcaggatctgctcaggagacagtggttctgaaactgatcggcaccgacaaccgtctgatcgctcgacccgctcttagggaaccaatgcgggagtatcccggcatggaccattctgaagcgaattcactgggtgttacctggcacaaaatgcgccagatgtggaacaataaaaatgacctgtatctcgatgacgaccacatcagcaatcagccattcctgagagcactcctgggacattgtagcaattcagctgggagcactaactcttgggaactgaaaaacaagcagttcgaagccgctgtgaagcagggcgcctacagcatggacactgcccagttcgatgagctaatcaggaacatgtcccagttgatggagacgggagaggtaagtgatgacctggcctctcagctgatttatcagttagtggcggagcttgctaaagcccaaccgacccatatgcagtggaggggaatccaggaggaaacccctccggctgcccagctgagaggggagaccggatccgtgtctcagtctagccatgccaaaaatagcggaaaactaacctttaagccaaaaggccccgtgttaatgcggcagtcacagcctccctccatttcttttaataagacaattaattctcgtatcggaaataccgtgtacataacaaagcgaaccgaggtgattaacatcctctgtgacttgataacacccagcgaggccacctatacatggacaaaggacggtaccctgctgcagccatctgtgaaaataatattggatgggacggggaagattcagatccaaaaccctactcggaaggaacagggtatctacgagtgtagtgtcgccaaccatctgggcagcgatgtggagagcagtagcgtgctatacgccgaggcccccgttattttgagtgttgaaaggaatatcaccaagccggagcacaatcatctctccgtcgtcgttgggggcattgttgaggcggcactgggcgcgaacgtgacgattcggtgtcctgttaaaggtgtgccacagccaaatattacgtggttgaagcggggggggtctctttccggaaacgtctccctcctcttcaacggtagtctgctgctgcaaaacgttagtctagaaaatgagggcacgtacgtgtgcatagccaccaacgccctgggaaaagccgtcgcgacttccgtgctccatctcttagaaaggcgttggcctgagagtaggattgtctttctccaaggccataaaaagtatattttgcaggcaaccaacactcgcaccaatagtaacgaccccaccggtgagcccccccctcaggagcccttctgggaacctggaaattggagccattgttccgctacctgtggtcatctgggggctagaattcagagacctcagtgtgtaatggccaacggccaggaggtgtctgaagcactgtgtgatcacctgcagaaaccgctggccggcttcgagccttgtaacatacgcgactgtcccgcccgttggttcacatccgtgtggtcccagtgcagcgtctcctgcggagaaggttatcacagcaggcaggtgacttgcaaaagaactaaggcaaatggtaccgtacaggtcgtgagccccagagcctgtgctccgaaggacagaccactgggacggaagccctgctttgggcacccttgcgtacagtgggagccagggaatcgctgtcctgggagatgtatgggaagggccgtgcggatgcagcagagacacaccgcttgccagcacaactcttcggactccaactgtgacgatcgaaaaagaccgacactcagacgtaactgtacgagcggggcatgcgacgtgtgctggcacaccggaccttggaaaccatgtacagcggcctgcggcagaggttttcagagcagaaaggttgactgcatacacacacgctcctgtaagcctgtagccaagagacactgtgtgcaaaaaaagaagccaatcagctggcggcattgcttgggaccaagctgtgatagagactgcactgataccacgcactactgcatgtttgtgaagcatttgaacctgtgcagcctggataggtacaaacagcggtgctgtcagagttgccaagagggctag

SEQ ID NO: 178078 - DNA, 3225 bp, Artificial Sequence
  Description of Artificial Sequence: Synthetic coding sequence
atggagaactggaccggccggccctggctgtacctgctgctgctgttatccctgccacagctctgcctagaccaggaggttctcagcggacactctttgcagacacccaccgaagaaggccaggggcctgaaggcgtatggggaccttgggtacagtgggccagttgctctcaaccttgcggagtgggggtgcaacggcggagccgaacttgtcagctccccaccgtacagttgcacccaagcctcccactgccaccccggccccctcgccaccccgaagccctcttgccacggggacagggacccagaccccagaccagcccagaaactcttcctctctatcgcacccagagtcggggtcggggcggcccgctgagagggccagcttcccacctcggccgtgaggagacacaggagatcagagctgcaagaagaagccgccttagagacccgataaagcctggtatgtttggttacgggcgcgtgccattcgcactccctctgcacaggaatcgaagacatccgcggagtccgccgcgctctgaactcagtctgatctcaagccgcggtgaagaggctatcccctccccaacacccagagccgagcccttctccgcaaacggtagtccacaaacggagctccctccaactgagctgtcggtacatactccttctccacaagcggagcccctgtccccagagaccgcccagacagaggtagccccaagaactagaccggctccactgcgccaccacccccgggcccaggccagtgggacagagccaccaagccccactcacagcctgggagaagggggatttttccgtgccagccctcagccccgtcggccatcatcccagggatgggccagcccccaagtagccgggcggcggcctgaccctttcccctcagtgcctcgtggaaggggccagcagggccagggtccttggggcacaggaggaaccccacacggcccacgattagagcccgatccccagcaccccggggcatggctgcctctgctgtcaaacggacctcatgcgtctagcctgtggtctttgtttgctcctagcagccctatccctcgctgcagtggcgagtcagagcaactgagagcctgcagccaggctccttgcccccccgagcagccagatcctcgcgccctgcagtgtgctgcttttaactcacaggaatttatggggcaactctatcaatgggagccttttaccgaagttcagggttctcagcgttgtgaactcaactgtcggccgcgcggattccgattctacgtgcgtcataccgagaaagtgcaggacggcacactgtgccagcctggagccccagatatttgtgttgcaggcagatgcctaagtcccggctgtgatggcattctggggtctggacgtagacccgatggctgtggcgtgtgtggcggcgatgacagcacctgcagactggtgagcggaaatcttactgacaggggcggtccactagggtaccagaaaattctctggatccctgccggggcactgcggctgcagattgctcagttacgcccttcaagcaattatctggccctcaggggaccagggggacggtccattattaatggaaattgggcggttgaccccccgggctcctaccgggctggagggacagtatttcgctacaacagacctccacgcgaggaagggaaaggggagagcttatcggcagagggtccaacgacacagcccgtggacgtttacatgatttttcaggaagaaaacccaggagttttttaccagtacgtgattagcagccctccacctattctcgagaaccctactccagagccccccgtgcctcagctccagccagagatcctccgagtggagcctcctctcgccccggcccctagaccagcacggacacctggcacccttcagcggcaggtaagaattccacaaatgcctgcgccccctcatcctagaactcctctgggaagtcccgcggcatattggaagcgggtagggcattccgcttgttctgcctcttgcggcaaaggagtctggcgccccattttcctctgcatttctcgtgaatcaggggaggaattggatgaaagatcctgcgcagcgggagctcgacctccagcttcccctgagccatgccatggtacgccatgccctccttactgggaagcgggcgaatggaccagttgtagtcgatcctgcggaccaggcacgcaacacaggcagctgcagtgtcgccaggaattcggaggaggcggctcatcagtcccgccggagcgttgcggacatctccctcggccgaatatcactcagtcttgtcagctgcgtctgtgtggacattgggaagtgggctccccttggagtcaatgtagtgttaggtgcggccgggggcagagatcccgtcaggtacgatgtgtgggaaacaatggagacgaagtctctgagcaagaatgcgcaagtgggccccctcagccaccgagtagagaagcatgtgatatgggtccctgcacaactgcctggttccactcagactggtcatctaagtgcagtgcagagtgcggtacaggcatccaacgaagaagtgtcgtgtgccttggctccggggcagcccttgggcctgggcagggcgaagcaggcgcaggcacgggccagagttgtcccactggctcaaggccccccgatatgagggcatgttccttgggaccctgtgaacggacttggagatggtataccggcccttggggagagtgtagttcagaatgcggatcaggcacccagcgccgagacatcatttgtgttagtaagctgggaacagaattcaatgtgacctccccttcaaattgtagccacttgccgagacctccggctctacagccttgtcagggacaggcctgccaggatcgatggttcagcacgccgtggagcccctgtagtagatcctgccagggcggcactcagactagagaagttcaatgtctcagtacgaatcagacgctttccacaagatgtccccctcagctcaggccgagccgaaagcgaccatgcaatagtcaaccctgctcccagagaccggatgatcagtgcaaggatagtagtccacactgtccacttgtggtccaagcaaggttatgtgtgtacccctactacaccgctacttgttgccgatcttgtgcccatgtactggaacggtcaccccaggatcctagttag

SEQ ID NO: 178079 - DNA, 3225 bp, Artificial Sequence
  Description of Artificial Sequence: Synthetic coding sequence
atggagaactggaccggccggccctggctgtacctgctgctgctgctcagcctcccacagctgtgcttggaccaggaggtactgtctggccacagtctgcagacaccaactgaggaaggacagggtcctgaaggcgtttggggcccttgggtccagtgggcctcctgtagccagccttgcggtgtgggcgtccaaaggcgttcaaggacctgtcagctgccaaccgtgcagctgcatcctagcctacccttgcctcccagacctcctcgccatcctgaagccttgctgcctagaggccagggacccaggccccagacctccccagagacccttcctctgtacagaacgcagtctcgcggccgtgggggccccctgcggggcccagcctcccatctcgggagggaggaaacacaggagattcgcgccgcccggcggagcaggttacgcgatcccatcaagcccggaatgttcggctatggaagggtgccgtttgctctgcccctgcaccgcaaccggcggcaccccaggtcccccccccgcagtgagctgtctttgatctcaagtaggggagaggaggcgatcccctctccgaccccgcgcgcagagccctttagtgccaatggcagtccacaaaccgagttaccacccacagagttaagcgtgcacacgcctagcccacaggctgaaccactttctcctgaaacagcccaaacggaggtagccccacggacccgccctgccccccttagacatcatccgagagcccaggcaagtggaacagaacccccgtctcctactcattccctcggcgagggcggcttcttccgcgctagccctcaaccacggcgcccatctagccaggggtgggcgtcacctcaggtcgccggtaggagacctgatccgttcccctctgttccaaggggccgcggccaacagggccaaggaccttgggggacaggcggtactcctcacggcccccggttggagcccgaccctcaacaccccggcgcttggctccctctgctttcgaacggcccacacgccagcagcctgtggtcactgtttgctccctcctcccctatccctcgatgcagcggggagtctgaacagctgcgtgcatgttcacaggcgccatgccctccggaacagcccgaccctagggctttgcagtgcgccgctttcaactcccaggagttcatgggacagctgtaccagtgggagccttttactgaagttcagggcagccaaagatgcgagctgaactgccggccccgaggcttccggttctatgtgcgtcataccgagaaagtccaggatggtacgctttgccagcccggtgcccctgatatttgcgtggcaggaagatgtctgagccccggctgcgatggcatcctggggagcggtcgcagacccgacggttgcggcgtctgcggaggagacgactctacctgtagactggtatctggaaacctcacagacaggggagggcccctgggttaccagaagatcttgtggatacccgccggtgctcttagactgcagattgctcaactacggccctcaagcaactacctcgccttgaggggccccggaggtaggagtattattaacggaaattgggcagtcgaccctccagggagttatagggcaggtggcacggtcttccgctataaccgaccccccagggaggaaggaaagggggagtcactcagcgctgaggggcctaccacccagccagtggacgtttatatgatcttccaagaggaaaaccctggtgtcttctaccagtacgttatctccagcccgcctccaatactggaaaaccctactcccgagcccccagtgcctcaattgcagccggagatcctgcgggtggagccccccttggccccagccccgaggccggcccgtactccaggcaccttgcagcggcaggtgcgtatcccccaaatgccagctcccccccatccacggaccccgcttgggtcacctgcagcttactggaaaagggttggacattcagcctgttcggcttcctgtggcaagggggtctggcgccctatcttcttgtgtatttccagagagtcaggcgaagagttagacgagcgctcttgcgcagctggggcccgtcctccagcctctccggagccctgtcacggcaccccatgtccaccctactgggaggcaggggagtggacctcatgctcacgctcctgcggaccagggacgcaacacagacagctgcagtgtaggcaagagttcgggggcggaggatcgagtgtgccacctgagcgctgcgggcacttacctcgcccaaacattactcagtcatgccagctgcgcctctgcgggcattgggaggtggggtctccgtggagtcagtgcagtgtacggtgcggtcgaggccaaagatctcggcaggtccgctgtgtaggtaacaatggcgatgaggtttctgagcaggaatgcgcctccggtccaccccagcctccttcacgcgaagcatgcgatatgggtccatgtacaaccgcatggttccatagcgattggtctagcaagtgtagtgccgaatgcgggacaggaatccagcgacggagcgtggtgtgcctgggctccggggcggcactcggcccaggccagggggaagcaggagccggtacaggccagagttgtcctaccggttccaggccgcctgatatgagagcctgctccctaggcccatgtgaaagaacttggcgctggtacacgggtccctggggcgagtgcagctcagaatgtggaagtggcacccagcggcgcgatattatttgcgtgtctaagctcggcacagagtttaacgtaacgagcccgtccaattgttcccacttgccacgtccacccgctttgcaaccctgtcagggccaggcttgccaagacaggtggtttagtactccctggtctccctgctcacgcagttgtcaagggggtacacaaacgagagaagtccagtgcttatcaacaaatcaaaccttgtctacacggtgccccccacaacttagaccgagccgcaaaagaccatgtaatagtcagccctgctcacagcggccagacgatcagtgtaaagacagctcgcctcattgtcccctggttgtccaggccagactctgtgtatacccctactatacagcaacttgctgtcgatcctgtgcgcatgtcctggaacgctccccacaggatccatcttag

SEQ ID NO: 178080 - DNA, 3294 bp, Artificial Sequence
  Description of Artificial Sequence: Synthetic coding sequence
atggagaactggaccggccggccctggctgtacctgctgctgctgctcagtctcccccagctatgtctcgaccaggaagtgctgagtggccattctctgcagaccccaacagaagagggacagggccctgaaggcgtctggggaccctgggttcaatgggcttcctgttctcagccttgtggtgtgggcgtgcagagacggtctcgcacctgtcaactcccgaccgtgcagctacacccttccctgcccctgccaccacggcctccacgacacccagaggcactgctgccccgggggcaaggcccacggccacagacctcgcctgaaacattgccactgtaccggacacagtctagagggcgaggggggcccctgcgcggacctgcctctcacctcggccgggaggaaacccaggagatcagggcagcccggcgctctcgccttagggatccgatcaagcccgggatgttcggatacgggagagttcctttcgcgctgcccctgcaccggaaccgacgtcatccaaggtcaccccctcgatctgagctctcccttatttcgtctagaggtgaagaagctataccgtctcccaccccgagagctgaacccttctctgctaacggcagtccccagacagaactcccgcctaccgaactctcggtgcacacaccctcaccacaggccgagcccctaagccccgaaaccgcccagacggaagtagctccccgcaccagacccgcacctctccgccaccacccacgcgcccaggccagcggtacagagccgccaagtccgacacacagcctgggcgagggaggattttttcgggcttccccacaaccccgtagacccagcagtcaagggtgggccagcccccaggttgctggccgaagacccgacccttttccttccgtcccccgcggccgcggccagcagggtcagggcccgtggggtacgggcggcaccccccacggcccacggctggagcccgacccacagcatcccggcgcctggctgcctttgttatccaatgggccccatgcctcaagcctgtggagcctctttgctcctagttcacccattccacgatgttccggagaaagcgaacagcttcgggcttgctcccaggcaccatgccccccagagcagcctgaccctcgcgctcttcagtgcgcagcatttaacagtcaagaattcatgggtcaactctaccagtgggaaccatttacagaggccccccttctgcccctcaggcacgcatttttccttctccctggcgctgggtctggcgattccaccggcgtgcagggttctcagcggtgcgagctgaattgccgcccacgaggcttcagattctatgtgcgccacactgagaaggtgcaggatggtacactctgccagcccggggcgcctgacatttgtgttgctggaagatgcctctcacccggttgcgatggaattctgggatccgggcggcgacctgacgggtgtggggtctgtggaggggatgatagcacgtgtaggctcgtgtctggaaacctcacggatcggggtggacctctggggtatcagaagattttatggatcccagccggggcacttagactgcagatcgctcaattacggcctagttctaactacctagctcttcgcggcccaggtggccgctccattattaatgggaattgggccgtggaccccccagggagctaccgcgcaggcggtacagttttcaggtacaaccgcccaccccgagaggagggtaagggggagtcccttagcgccgaaggacccaccactcagccggttgatgtgtacatgatctttcaggaagaaaaccctggcgtgttctatcagtatgtgatctcaagccccccacccattctggagaaccccacccccgaacctcccgttccacaactgcagccggagatcttgagagtggagcccccattagcacccgccccccgccccgccaggacgccaggaacattacaacggcaagtgagaatccctcagatgccagcgcccccgcacccaagaacgccccttggatcaccagctgcctactggaaaagagtgggccactctgcctgcagtgccagttgtggcaagggagtgtggcggccaatctttctttgcatctcacgggagtctggcgaggaattggatgaaaggtcgtgcgccgccggtgcgcgcccacctgcttcgcctgaaccctgccatggtacaccgtgccctccctactgggaggcaggcgagtggacatcatgctcaaggtcctgcggcccggggacccagcaccgacagttgcagtgccgccaggaattcggcggagggggatctagcgtgcctccggagcggtgcggtcacctccctcgcccaaatattacccagtcatgtcaactcagactttgtgggcattgggaagtaggatcgccttggtcccaatgcagtgtgcggtgcggtaggggacagcggagccgacaggtacgatgcgtaggtaacaacggcgacgaagtcagtgagcaggagtgcgcatctgggcctcctcagcctccctctagagaagcatgcgatatgggaccatgcacaacagcatggttccatagtgactggtcttccaagtgctcggccgaatgtggaactggaatccagaggcgatcggtggtttgtcttgggtcaggggcagctcttggcccaggacagggtgaggctggggccgggaccggccagtcatgtccaactggctcccgtccaccagatatgagagcttgttctcttggaccatgtgagcgcacatggcgatggtataccgggccctggggggagtgttcctctgaatgcggaagtgggacacagcgccgggatataatctgtgtctctaagctcggcacagaatttaatgtgacaagcccgtcaaactgcagtcatctgcccagaccccccgcccttcagccatgtcagggacaagcctgccaggaccggtggtttagcactccgtggtctccttgctcaaggtcctgtcagggagggacccagacaagggaagtccaatgcctgagcacaaatcagaccctctctacgagatgtccccctcagctacgcccttcccggaaacgcccatgtaattcacagccatgctcacagcgacccgatgaccagtgcaaggattccagcccccactgcccgctcgtggtgcaagcccgactgtgtgtgtacccctattataccgcaacttgctgccgctcctgtgctcatgtgctcgaacgtagcccccaggatccgagttag

SEQ ID NO: 178081 - DNA, 2634 bp, Artificial Sequence
  Description of Artificial Sequence: Synthetic coding sequence
atggagaactggaccggccggccctggctgtacctgctgctgctgctgtccctgccacaactgtgcctggatcaggaggtgctctctggtcattcattgcagacccccacagaagaaggtcaaggccccgaaggagtttggggcccctgggtccagtgggcaagttgcagccagccttgcggcgtaggcgtgcagcgccgctctcgaacatgtcagctgccgacagttcaactccacccaagcctgccactgcccccccgtccaccccgccaccccgaggccctgctccctagaggccagggaccacggccgcagacatctcctgagactctgcctctctacagaacccagagccgcggacggggggggccactgagaggccctgcctctcatctcggccgagaggagactcaagagatcagggcagctagacgctccaggttgcgggaccccataaagcccggcatgtttggctacgggcgagtgcctttcgccctgcctctccatcgaaaccgccggcacccacgatccccacctcggagtgagctcagtctcatatcttcccgtggtgaagaagctataccctcgccaacgcctagagccgagccattttcagctaatggctccccccagaccgaactccccccgacggagttgtccgtccacaccccctcaccgcaggctgagccattgagtccagaaacggcccaaaccgaggtcgctcctcgcactcgtccagccccactgagacaccatccacgcgcacaggcgagcggtactgaaccgccatcacccacccatagcttgggggaggggggtttcttccgtgccagtcctcagccccggaggccctccagccagggctgggctagccctcaggtggcaggcaggcgccctgacccgtttccatctgtgcctcgcgggaggggccaacagggccaaggcccttggggtacaggaggaactccacacggtccccgcctcgaacctgaccctcagcaccctggcgcctggctccctctgctgtcgaacggcccacacgcctccagcctgtggagtctcttcgcaccaagtagtcccatccccaggtgttccggagagtccgagcagctgagggcatgcagtcaggcaccatgcccacccgagcagcctgacccacgggctttacagtgtgcagcattcaactcacaggagttcatgggacagttatatcagtgggaaccctttacagaggtgcagggatcgcagcggtgtgagctaaactgccgtccccgcggatttcggttttacgtaaggcacactgagaaggtccaggacggaacattatgccagccgggcgcaccagacatttgcgtggccggcagatgcctgagtcctgggtgtgacgggattctgggaagcggcaggcggccagacgggtgtggggtgtgcggcggggacgactctacatgcagattggtttcgggcaatttaaccgaccgggggggaccgctgggttaccaaaaaattttgtggattcccgctggtgcactgcggctgcagattgcccagctccggccatcgtctaattacctcgccttacgcggtcctggaggacggagcatcatcaatggcaattgggcggtcgaccccccaggatcatatagagcaggggggaccgtgtttcgctacaacaggcctccccgggaagaaggcaagggagagtctttgtctgcggagggcccaacaactcagcctgtcgatgtgtatatgatctttcaggaagaaaacccgggagtgttctaccagtacgtgattagttcacccccgccaattctggaaaatcctacccccgagcctcctgttccccagctgcaaccagagattttacgagtggaaccacccctggcccccgcaccccgtccagccaggacgccagggactctccagcgtcaggtccggatcccccaaatgcccgcaccgccacatcctagaactccactgggctctccagctgcatactggaagagggtgggccacagcgcttgttccgctagctgcggtaagggtgtgtggaggcccatcttcctgtgtatctcccgtgaatctggggaggagctggacgagagaagctgcgcggccggcgctcgcccacccgcgtccccagagccctgccacggtactccctgcccaccctactgggaggcaggcgaatggacgtcatgctcgcgatcttgtggccccggcacacagcataggcaactgcagtgtcgtcaggaattcggcggaggcggaagcagtgtccctccggaacggtgcggccacctgccaagacccaacataacccagagctgtcaactaagactgtgtggtcactgggaggtaggaagcccatggtcccagtgctcagttagatgcggcaggggccagaggagtcggcaagtcagatgtgtaggtaataacggggacgaggtatctgagcaggagtgcgcctctggtccccctcaacctccctccagagaggcatgtgacatgggaccttgtactaccgcctggtttcacagtgattggtccagcaaggtgagtcctgaacccccagcgatctcttgtatcctgggtaaccatgctcaagacacttccgctttccccgcctag

SEQ ID NO: 178082 - DNA, 1311 bp, Artificial Sequence
  Description of Artificial Sequence: Synthetic coding sequence
atgggcagcctggccctggccggcgtgctgatggccgtggagagcgtgggagtcatgattctgccagtggctttgtttaggggaacatccttgaccgagggggccccctgggccattcggagaagctgcggatttcaaagggaaccctgtggaagtaggctgcccagttccggattggctcccacgacatggcacttcgtcgctctgggcaggagtatcatcaacggaaattgggccgtagatcctcctggcagttatcgcgcaggagggaccgttttcaggtataatcggccgccaagggaggaaggcaaaggtgagtctctgtcagcagagggcccaacaacccagccagtggatgtgtacatgatttttcaggaggagaaccccggagtgttttatcagtatgtaataagcagccctccacctatcctggagaaccccaccccagagcccccagtcccccagctgcagcccgaaattttgcgagtggagccgcctctagcgccagcgccgaggccagctcgaaccccaggtacacttcagcgccaggtgagaataccacagatgcccgccccgccacacccaagaacgccacttgggtcccctgcagcgtattggaaacgcgtcgggcactccgcctgctccgcaagctgtggtaagggcgtttggaggccgatctttctgtgtatctctagggaaagcggcgaggaattggacgaaaggtcttgcgccgcaggtgctagaccacccgcctcccccgaaccttgtcatggaaccccctgccctccttattgggaagcaggcgagtggacaagttgttctcgaagctgcggacccggtactcagcataggcagttgcagtgtaggcaggagttcggcgggggcgggtcttccgtgcctcccgagagatgcggtcatttgcccaggcctaatataactcagtcgtgccagctgagactttgcggccattgggaggttggaagcccctggtcacagtgttctgtccgctgcggccgggggcagcgcagcagacaggtccggtgtgtcggcaacaatggggacgaggtctctgaacaggaatgcgctagtggacctcctcagcctccctcccgggaggcttgcgatatgggaccttgtactactgcctggttccacagtgattggagttcaaagtgctcggcggagtgcgggacagggattcagcgccgctccgtggtatgcctggggagcggcgctgcgctcggtcccgggcaaggcgaagccggcgctggaactggacagtcatgtccaactgggtctaggcccccatag

SEQ ID NO: 178083 - DNA, 2130 bp, Artificial Sequence
  Description of Artificial Sequence: Synthetic coding sequence
atgcccggcatcgacaagctgcccatcgaggagaccctggaggactcgccccagacgcgatcattgttgggcgtgtttgaggaagatgccaccgccatttccaactatatgaaccagctataccaggccatgcaccgaatttatgatgcccagaacgagctatcagcagcaacacacttaacaagcaagttgctgaaggaatacgagaagcagcggtttccactgggaggcgatgacgaagtaatgtcctcaaccctccaacagttttctaaagtgatcgatgagctgagttcatgtcacgcagtgttatcgacccagctcgcagatgccatgatgttccccattacccagttcaaggagcgggatcttaaggagattttgactttaaaggaagtcttccagattgcctcgaatgaccacgatgctgcgatcaaccggtattcccgtctgtcgaaaaagagagagaacgataaagttaaatacgaagtgaccgaagacgtctacacaagccgcaaaaaacagcatcagactatgatgcactacttctgtgcactcaataccctgcagtacaagaaaaaaatcgcccttctggagcccctgctgggttatatgcaggcgcagatttctttttttaagatggggagcgaaaacctcaacgagcagctggaggagtttcttgccaacatcgggaccagcgtgcagaatgtacgccgcgaaatggatagcgacatagagaccatgcagcagaccattgaggacctcgaggtggccagcgatcccttatacgtccccgacccagatcccaccaaattccctgtgaaccggaacctgaccaggaaagccggatacctcaatgctaggaataagaccggcctcgtgtcatccacctgggatcggcagttctacttcactcaggggggcaacctcatgagccaggcgcggggcgacgtcgcgggagggctggcaatggacattgacaactgctcggtgatggcagtcgattgcgaggatcgccggtactgcttccagatcacgagcttcgatggcaagaaaagtagcattctacaggctgaaagtaagaaggatcatgaagagtggatttgcactatcaacaatatttccaaacagatttatctatcagagaatcccgaagaaacggccgccagagtgaaccagtccgcactggaagctgtgacaccaagcccctcctttcagcagcgacatgaatcattgcgaccggctgccggccagtctcgtcctcccacagcccgcacctcatcatctggaagcctcggctctgagtccactaacctggctgccttgtccctagacagtctggtagctcctgacacacccattcaattcgacatcatttcccctgtctgtgaggatcagcccgggcaggcgaaagctttcggacagggggggcgtcggaccaatccatttggcgaaagcgggggtagtactaaatctgagacagaggatagtatcctccatcaattattcattgtgcgcttcttgggctctatggaggtgaaatcggatgatcatcctgatgttgtctatgaaacaatgaggcagatattggctgcccgcgccatccacaatatctttcgtatgacagagagtcatctactggtcacatgcgattgtctgaagctaatcgacccacaaacgcaagtgacgcgcctgacattcccgctcccatgtgtggtcctgtacgctacacatcaagagaataagagactgtttgggttcgtcttgagaacatccagcggccggtctgaatccaatctctctagcgtgtgctacatctttgaaagcaacaacgagggggaaaagatttgtgatagcgtggggctggccaaacaaatcgcgcttcatgccgagttggacaggcgtgcctctgagaaacagaaagagatcgaacgggttaaagagaaacaacagaaggagctgaacaagcagaagcagatagagaaggacctggaggagcagagccggctgatcgcggcttccagtcgccctaatcaggcctcctccgagggtcagtttgtggttctatcctctagtcagtcggaagaatcagacctgggtgagggcgggaagaaaagagaatcggaggcatag

SEQ ID NO: 178084 - DNA, 1995 bp, Artificial Sequence
  Description of Artificial Sequence: Synthetic coding sequence
atgcccgccgtggacaagctgctgctggaggaggccctgcaggactctccacagacccgcagtctgctgtcagtgttcgaagaagatgccgggactttgaccgactacacgaaccagcttcttcaggctatgcagagggtatacggcgcacagaatgagatgtgcttggcaactcagcagctcagcaagcagcttcttgcttacgagaaacaaaactttgctctcggcaagggtgacgaagaagtaatttctacacttcattatttttcgaaggtggtcgacgaattaaatttgcttcataccgaactcgctaagcagctggccgacaccatggtcctgcctattattcagttccgggagaaggacctaacagaggtaagtacgctaaaagatcttttcggtcttgcgtcaaatgagcacgatctctccatggcaaaatactcccggcttcctaagaaaaaggaaaacgaaaaagtgaagactgaggtagggaaggaagtcgcggcagccagacgcaagcagcatcttagctcactccagtattattgtgctctaaacgcattgcagtaccggaaacagatggcaatgatggagccaatgatcggcttcgcacacgggcagatcaacttctttaagaaaggggccgaaatgttttcaaagagaatggattcattcctttcgtccgtggcagacatggtgcagagcattcaggtggaacttgaagcagaggctgagaagatgcgggtttcacaacaagagttgctgtcggtagacgagtccgtgtatacaccagacagcgatgtggctgcccctcaaatcaacaggaacctcattcaaaaagccgggtacctgaatctcagaaataaaaccggcctagtgacaacaacgtgggagcggttatattttttcacccagggggggaatctaatgtgccagcccaggggggccgtggcagggggcctgatccaagatctggataattgttcagtcatggctgtggattgtgaagatcgaaggtactgtttccagattaccacccccaacggaaaaagcggcatcattctgcaggcagagtctcggaaggaaaacgaagagtggatttgcgccatcaataatatctctcgtcagatctacctcactgataatccggaagccgtggccatcaaactcaaccagacagccttgcaggcagtgactcctatcacttcctttggcaagaagcaggagtcttcctgtccgagtcagaacttgaaaaatagcgagatggagaacgagaacgacaagattgtgcctaaggccacggcaagcctccccgaggccgaagagttgatagcacctggaaccccaattcagttcgatatagtgctgcccgcaactgaattcttggaccagaacaggggatcccgcaggacaaatccctttggagagactgaggatgaatcttttccagaggcagaggatagcttgctgcaacagatgttcatcgtgaggtttctgggtagtatggcagtcaagacagattctaccactgaagtgatttacgaggctatgaggcaggtgctggctgcccgcgccatacacaatattttccgaatgacagagtctcatcttatggttacatcccagtccctgcggttaatcgacccccaaactcaagtcagccgcgctaattttgaacttacctcggtgactcagttcgccgctcatcaggagaataagcgcctcgtaggtttcgtcatcagggtgccggaaagcacaggagaagagagcctgtcaacttacatttttgaatccaacagcgagggcgagaaaatctgctatgcaatcaatctgggcaaggagattatcgaggtgcagaaggatcccgaagccttggcccagctgatgctgtccatccctctaacgaatgacggtaagtacgtactactgaatgaccaacccgacgacgatgacgggaacccaaatgagcatagaggggcagagtcagaagcttag

SEQ ID NO: 178085 - DNA, 2013 bp, Artificial Sequence
  Description of Artificial Sequence: Synthetic coding sequence
atgcccgccgtggacaagctgctgctggaggaggccctgcaggactctccacagacacggtccctgctgagcgtctttgaagaagatgccgggacactgacagactacacgaaccaacttctgcaagcaatgcaacgggtatacggtgcccaaaacgagatgtgtctggctacacagcaactgtccaagcagttgcttgcctacgagaagcagaacttcgccctgggcaagggggatgaagaggtcatcagcacattgcattacttcagcaaagtggtggatgagctgaacttgctgcacaccgaattggcgaaacagcttgcagataccatggtcctgcctatcattcagttcagggaaaaagatcttaccgaggtctccaccctgaaggatctgttcggtttagcgtctaacgacgtgtgcctgtttcttgagcatgatctgagtatggctaaatactcccgcttgcctaagaaaaaagaaaacgaaaaggtgaaaaccgaggtaggaaaagaggtcgcagctgccaggagaaaacagcacctatcaagtctacagtattattgtgctttaaatgctctgcagtatagaaaacaaatggccatgatggagccaatgatcggcttcgcacacgggcagatcaatttcttcaagaaaggtgccgaaatgttttctaaaaggatggattccttcttgtcatctgtggccgatatggtgcagtctatccaggtggagctagaggccgaggcagaaaaaatgagggtgtctcagcaggaacttctctcagtggacgaaagtgtgtacactcctgattcggatgtggccgctcctcagatcaaccgaaatcttattcaaaaagccggttatcttaatttgcgcaataaaactggacttgtgactaccacatgggaaaggctgtatttttttacccagggcggaaatctcatgtgccagcctaggggggccgtggccggaggattgatacaggacctggataattgttctgtcatggctgtggattgcgaggaccgtaggtattgttttcagatcacaacccccaacggcaaaagcggcattattctgcaggccgaatctcggaaggagaacgaggagtggatttgtgcaatcaacaacatatcgcggcagatttacctgacagacaatccagaggctgtggcaataaagttgaaccagaccgcactccaagccgtgacacccattactagtttcggtaagaagcaagaatcctcatgtcccagccaaaacttaaaaaactcagaaatggagaatgagaatgacaagatcgtccctaaggctacagcctctttgcctgaggcagaagaactgatcgccccaggaactccaatccaattcgatattgtactgcctgctacagagtttctggaccagaataggggctcgagaaggactaatcctttcggtgaaactgaagacgagagtttcccagaggccgaagacagtttgttacagcaaatgttcattgtgcgcttcctggggtctatggccgttaaaacagacagcaccacagaggtgatatacgaggctatgaggcaggtgctggccgccagggcgattcacaacatcttccggatgactgagtcccacctgatggtcacctctcagtcattgcggttgatcgaccctcagacacaagtcagcagagccaactttgagctgacgtctgtgacacagttcgccgcacaccaggaaaacaaaaggcttgtcggttttgttatccgcgtgccggagagcacaggcgaagagagcctgtccacctatatctttgagtccaactctgagggagaaaagatctgttatgctatcaacctgggtaaagagattatcgaggtgcagaaagatccagaagcgcttgctcaattaatgctatccatccctctaacgaatgatgggaaatacgtgctcctcaacgatcaaccggatgatgacgacggaaatcctaacgagcacagaggcgcggagtccgaggcttag

SEQ ID NO: 178086 - DNA, 2760 bp, Artificial Sequence
  Description of Artificial Sequence: Synthetic coding sequence
atgaccgacagcaagtacttcaccaccaccaagaagggcgagatctttgagcttaaagctgagttgaattcagacaagaaggagaaaaaaaaggaagccgtcaagaaagtgatcgcaagtatgaccgtgggcaaggatgtgtcagccttgttccccgacgtcgtgaactgtatgcagacagacaatttggaactgaaaaaattggtgtacctgtacctcatgaactacgccaaaagtcagcctgacatggctatcatggccgtgaatactttcgtgaaagactgcgaagatcccaaccctctgatccgggctctggccgttcgcactatgggctgcattcgagtggacaaaatcacagaatatctgtgtgagcctctccggaagtgcttaaaggacgaggacccctatgtgcggaaaaccgcggcagtttgtgttgccaaactgcacgacatcaatgctcagctggttgaggaccaggggttcctggacacgttgaaggacctcatcagtgactccaaccccatggtcgtggcgaacgcagtggccgctctgtctgaaattgctgaatcccacccatctagcaatctactggatctgaatccccaatcaattaataaactgttaacagccctgaatgaatgcaccgagtggggtcagatatttatcctcgactgcctggctaactacatgccaaaggacgacagagaggctcagagcatttgcgaaagggtgacccctaggttatctcacgctaactcggccgtcgttctcagtgccgtaaaggtgcttatgaaattcatggagatgttgtcaaaagatctagattactatggtacgctgcttaaaaaactggccccacctttagtgactctgctaagtgctgagccagagctacagtacgtcgcccttaggaatattaacctcatcgttcagaaacgcccggaaatcttgaaacatgagatgaaagtgttcttcgtcaagtacaatgatccaatttacgttaagctggagaaactggacatcatgattcgcctagcttcccaagccaatatcgcccaagtcctggcagagctgaaagagtacgcaacagaggttgatgtggactttgtgagaaaagccgtcagagctattgggagatgcgccatcaaagtcgagcaatccgcggagcggtgtgtgtcaacacttttagacctgatccaaacaaaggtgaactatgtcgtccaagaggccatcgtcgttattaaggatatattccggaaatacccaaacaagtacgaatctgttatagcaactctgtgtgagaacctggattccctggatgagccagaggcccgggccgcaatgatatggattgttggtgagtatgctgaacggatcgataatgcggatgaactactcgaaagctttcttgagggctttcacgatgagagtacccaggtgcagctccagctgttgaccgccatcgtgaaattattcctcaagaaacctacagaaacacaggaactggtgcagcaggtccttagcctcgcaactcaggatagcgacaatcccgacctcagagacagggggtatatctactggcgattgttgtcaacagatcccgtcgcagccaaggaagtagtgctggccgaaaaacctttaatctcagaagagactgatctgatcgagcctaccctgctggatgaactcatatgttacattggaacgctggcatcagtgtaccataagcctccgagcgctttcgtcgaaggtggtcgcggagtggtccataaaagcctgccacctcgcacggcgagctctgagtccgcggagtctcccgaaaccgctcctaccggtgctcctccaggggagcagcccgatgtgattccggctcagggtgacctcctaggggatctgctcaatctggacctggggccccccgtgagtggtcctcccctggcgacctcttcagtgcagatgggtgccgtggatctcctgggtggcgggctagattctctgatcggcgggactaactttgttgcaccaccaaccgctgcagttccggccaaccttggggcccctatcggatccggattatccgacctgtttgatctcacatcaggggtcggaaccctgagcggctcctatgtggctcctaaggcagtggggagcattagcatggacctgcaacttaccaacaaggcgttgcaagtgatgacagatttcgcaattcagtttaaccgcaatagcttcggccttgctcctgccaccccgctgcaggttcatgcccccctgtctcctaatcagacggtcgaaattagcctgccgctcagcacggttgggtccgtgatgaagatggaacctctgaacaacctgcaggtagcagtgaaaaataatatcgacgtcttctacttcagcactctctacccactgcacatcctgttcgttgaggacggtaagatggatcggcaaatgttcctagctacgtggaaagatattcccaatgagaacgaagcacagttccagattcgcgactgcccattgaacgcagaggccgccagctccaagttgcagagcagcaatatcttcacggtggctaaacggaacgtcgagggccaagatatgttgtatcaatctctgaagctgaccaatggcatctgggttctggccgagctacgcattcagccgggaaatcccagctgtaccttgagcctgaagtgcagagctccagaagtgtcacagcacgtatatcaagcctatgaaactattctcaagaattag

SEQ ID NO: 178087 - DNA, 2829 bp, Artificial Sequence
  Description of Artificial Sequence: Synthetic coding sequence
atgaccgacagcaagtacttcaccaccaccaagaagggcgagatctttgagctgaaagcggaattgaattccgacaaaaaagaaaagaagaaagaggcagttaaaaaagtaatagcctccatgacggtgggaaaggacgtgagtgctctgtttccggacgttgtgaattgtatgcagacagataatctcgaacttaaaaaacttgtctacttatatctgatgaattatgccaagtctcagccagacatggccattatggctgtgaataccttcgtgaaggattgcgaagacccgaacccccttatccgcgccctggctgtaagaactatgggctgcatccgcgtcgataaaattacggagtatttgtgtgagcccctgagaaagtgcctgaaggatgaggacccttacgttcgtaagaccgctgctgtgtgcgtcgctaagctgcacgacataaatgcccagctggttgaggaccagggttttctcgacaccctgaaagaccttattagtgatagtaatcccatggtcgttgctaacgctgtagcagccctgagcgaaatcgctgaaagccaccccagtagcaatctgctggacctgaatccccagtcaataaacaaattgctgacagctcttaatgagtgtaccgagtggggacagatcttcattctggactgcctggctaattatatgcccaaagatgatcgagaggcccagtccatctgtgaacgggtcacacctcgcctgtcccacgccaatagcgctgtggtcctttctgccgtcaaggttcttatgaaatttatggagatgctgtcaaaggacttggattactatggcacgttattaaagaaattggccccccctctcgtcaccctcctgagtgccgagccggaactgcaatatgtcgcactgcggaacatcaatttaatcgtacagaagcgcccagagatccttaagcatgagatgaaagttttttttgtaaagtataacgaccctatctacgttaaactggaaaagctcgacatcatgatcaggctcgcatcccaggcaaacatcgcacaggtgctggccgaactgaaggaatatgcaaccgaagtcgatgtggattttgtgagaaaagccgtccgcgccatcgggcgatgcgccattaaggtggagcaaagtgctgagcggtgtgtgtcgactttgctggacctgatccagactaaggtcaactatgtcgtccaggaagcgatcgtggtaataaaggacatttttcgcaagtacccaaacaaatacgagagcgtgatcgctacactatgcgaaaacttggactcactggacgagccagaagccagggcggcgatgatttggatcgtgggcgagtatgcagagcgcattgataacgcagacgagctgttagagagctttctcgagggattccacgatgagagtacacaggtacagctccagctgcttacagccattgtgaaactctttctgaagaagccgactgagactcaggaattggtgcaacaggtgctgagcctggctactcaggactcagacaaccccgacttgcgtgaccggggttacatatactggaggctcttaagcaccgaccccgttgccgccaaagaagtcgtgttggctgagaagcctctgatttccgaggaaacggacctaattgaacctacactgctggatgaactaatctgttatattggcactttagcttccgtctatcacaagcctccatccgccttcgtggagggtggtaggggggtggttcataagtctctccccccaaggacggcctcaagcgaatctgccgagtctcctgaaactgcacctacaggcgcacctcctggagagcagccagacgtgattcccgcgcagggagatctgttgggtgacttgctgaatttggatttgggtccaccggtttctggccccccccttgctacctcctcggtacaaatgggggccgttgatttactgggcggcgggctggatagcttgattggtgggaccaattttgtggccccacctacagccgctgttcctgccaatttaggcgcccctattgggtctggtctgagcgacctgttcgatctcacctccggtgtggggactctgtccggtagctatgtggcacctaaggccgtttggctccctgccatgaaagcaaagggattggagatcagtggcacatttacgagacaagtagggtctatttctatggacctgcagctaacaaacaaggctcttcaggtgatgaccgactttgctatccagttcaacaggaactcattcggtctggcgcctgcaacgcccctgcaggtccacgccccgcttagtccgaaccagacagtggaaatcagccttcccctatctaccgtcggctccgtcatgaaaatggagcccctcaacaatctgcaggtggcagttaagaacaatatcgatgtgttctacttttcaacactgtaccccctccacattctgttcgtggaggacgggaagatggaccgacagatgttcctagccacatggaaagatatccctaacgagaacgaagcccagttccaaatccgtgattgcccacttaacgcagaggcagcctcctccaaactgcagagttcaaatatcttcaccgtcgcaaaacgtaacgtggagggacaggatatgctataccagtccctcaaactaaccaacggtatttgggtgctcgctgagctgcggatccagcctggcaatccgtcttgtacagatctcgaattatcactgaagtgtagggctccggaagtctcacagcacgtgtaccaggcctacgagacgattttgaaaaactag

SEQ ID NO: 178088 - DNA, 2850 bp, Artificial Sequence
  Description of Artificial Sequence: Synthetic coding sequence
atgaccgacagcaagtacttcaccaccaccaagaagggcgagatctttgaactcaaagccgaactgaacagcgacaaaaaagaaaagaagaaagaagctgtgaaaaaagtcatcgcctcaatgactgtgggtaaggatgtgtcagcgctgtttccagacgttgttaattgcatgcaaactgataacctcgagctcaaaaaactagtgtatctgtacctgatgaactacgctaaaagccaacctgatatggctattatggctgttaacacctttgttaaggattgcgaagacccaaaccctctgattcgagccctggccgtgaggaccatgggctgcatccgggttgacaagattaccgagtacctgtgcgagccactgcgcaaatgtttgaaggatgaggatccctacgttcgcaagaccgcagccgtatgcgtggctaagttgcacgatataaacgcgcagcttgtcgaagaccagggatttctggatacactgaaagacctaatctccgattccaatccaatggtggtggcaaatgcagtcgccgctctgtctgagatcgccgaaagccatcctagcagcaatcttttggaccttaacccccagagcattaataaactgctaaccgccttaaatgaatgcaccgaatggggtcaaatattcatcctggactgtctagcaaactatatgccaaaggacgatcgcgaggcgcaatccatttgtgagagagtgacccccaggttgtcccacgctaatagtgcagtcgtgttatcagcagtgaaggttctgatgaagttcatggaaatgctgtctaaagacttggattactacggaacccttttgaaaaaactcgcaccaccattggtgactctcttgtccgctgagcccgagctccagtacgtggccctgcggaatatcaacctgatcgtccagaagagaccagagattctcaagcatgagatgaaggtgttcttcgtaaagtacaacgatcctatctacgttaaactggaaaaactcgacataatgattcggcttgcctctcaggcaaacatcgcacaggttctggctgaactgaaggaatacgctaccgaggtcgacgtggatttcgtgagaaaagccgtgagggccatcggccgctgcgcaattaaagttgaacagtctgcagaacggtgcgtcagcaccctgctggatctaattcagacaaaagtcaactatgtcgtccaggaggcaatcgtggtcataaaagatatctttagaaaatatccaaataagtatgagtctgtgatcgccactttgtgtgagaaccttgattctcttgacgagcctgaagcccgcgctgctatgatatggatagtgggcgaatacgccgagcggattgacaatgcggatgaactgttggagtccttcctagagggctttcacgacgaaagcacccaggtccagctccagctgctcactgccatagtcaagcttttcctgaagaagccaactgaaactcaggagcttgtgcagcaggttttatctctcgccactcaggactcagacaaccccgacctgcgggaccgcggttacatttattggagactcctgagtacagatccggtggccgctaaggaggttgttcttgctgagaagcccctgatttccgaggaaaccgacctcatagaaccgactctgttagatgagctgatctgctatatcggtacactagccagcgtgtaccacaagccaccctctgcatttgtggaagggggccgcggggtcgtccacaaaagtctgcctcctagaactgcctcatctgaatccgcagagagccccgagacggcccccaccggtgcccctcctggggagcagcccgacgtgattcctgcccagggtgatttgttgggcgatctgctgaacctagacctggggcctccagtgagcgggcccccacttgcgactagcagcgtgcaaatgggagccgttgatctgctgggaggcggcctggactctctgatgggggatgagcccgaagggattggcggcacgaatttcgtggcccctccaaccgcagcagtgccggctaaccttggcgccccaatcggaagtggcctgtctgatctcttcgacttgacatctggagtggggacccttagcggatcgtacgttgcccccaaggctgtttggctgccagcaatgaaagctaaagggctggagatttcaggaacttttaccagacaagtcggctcaatcagcatggacctacagctgaccaacaaagcactccaagtcatgactgactttgccatccagttcaatcggaattctttcggactcgcccctgcgactcctcttcaagtgcatgcaccattatcccccaatcagaccgtcgagatctcactgcctttgagtacagtaggaagcgtgatgaagatggagcccctgaacaatctgcaggttgcagtcaagaacaacattgatgtattttattttagcaccctgtaccccctgcacatcctctttgttgaggatgggaagatggacaggcagatgttcctggccacctggaaggacatccctaacgagaacgaggctcagttccagattcgagactgtccgttgaatgctgaagccgctagtagtaagttgcagagttccaacattttcacggtcgctaaaagaaatgtggaaggtcaggacatgttgtatcagagcctcaaacttaccaatggaatctgggttctggccgagcttaggattcaacctggaaacccctcctgcactgaccttgagttgtctctgaagtgccgcgctcccgaggttagccagcacgtgtatcaagcctatgagactattcttaagaattag

SEQ ID NO: 178089 - DNA, 2820 bp, Artificial Sequence
  Description of Artificial Sequence: Synthetic coding sequence
atgaccgacagcaagtacttcaccaccaccaagaagggcgagatctttgagttgaaggccgagctgaactccgacaagaaggagaagaagaaagaggccgtgaaaaaggtgatcgcctctatgactgttggcaaggacgttagtgctttatttccagatgtggtgaattgcatgcaaaccgacaacttagagctgaagaagttggtttacttatacctgatgaactacgcaaagagtcagccagatatggctatcatggctgtcaacacctttgttaaggactgtgaggacccaaacccgttgattcgggctctggcggtccgcacaatgggatgtatccgcgtggacaaaattaccgaatatttatgtgaaccgctccgtaagtgcctcaaggacgaggatccttatgtcagaaaaacagcggcagtttgcgtggcaaaactgcacgatattaatgcccagctcgttgaagaccaggggtttctggataccctgaaagatctgattagtgacagcaacccaatggtggtggctaacgccgtcgcggccctctcggaaatagctgagtcccacccaagttcaaatctgctcgacctcaatccccaaagcattaacaaactgttgaccgcactgaatgagtgtacagagtgggggcagatcttcattctggactgtctcgccaattatatgccaaaggatgaccgggaggctcaaagtatttgcgagcgggttactcctagactgagccatgcaaattcagcagtcgtgctgagcgccgtgaaggtcctgatgaagttcatggagatgctttccaaagatttagactactacggcactttgctgaagaaactcgcccccccgcttgtgactctactgtcagcagagcccgagctgcagtacgtggctctgcgtaacatcaaccttatcgtgcagaaacgccccgagatactcaaacacgaaatgaaagtgttcttcgtgaaatataacgaccccatatacgttaagctggaaaagctcgatataatgataaggctggcatcccaggcaaatatagcacaagtgcttgccgagttaaaagaatacgcaacagaggtcgatgtggactttgtcagaaaggccgtgagggctatcgggcgatgcgccatcaaagtggaacagtcagccgagaggtgcgtatccacactgctcgacctgatccaaaccaaggtcaactatgtggtccaggaggctatcgtggtcatcaaggatatctttcgaaagtatcctaacaagtatgaatctgtcatcgctacactgtgcgagaatctcgactctttggacgagccagaggcacgtgctgcaatgatttggatcgtaggggaatacgccgagaggatcgataatgccgacgaacttctggagtccttcctcgaagggttccacgacgaatctacgcaagtccaattgcaactcctgacagctatagtcaaactatttcttaagaagccaacagagactcaggagctggtgcaacaggtgctatcacttgcaacccaagatagtgataatccagatctgcgagaccgagggtacatttattggcgtctgctaagcacggaccccgttgcggctaaagaggttgtcctggcagaaaaacctctcattagcgaagagacagacctgattgaacctacactgctcgacgaactgatctgctatatcgggaccttggccagcgtgtaccataagcccccatctgctttcgtggagggaggtcggggcgtggtacataaatctctgcctccacggacggcttcttctgaatccgccgagtcaccagaaactgcacccaccggcgccccccctggggagcagccggacgtcatccctgcccaaggcgacctgcttggggacctgctgaacctcgatctcggacctcccgttagtggaccaccactggctacctccagtgtccaaatgggagcagtggacctgctcgggggcggcctcgactctcttatcggtggaaccaatttcgtcgccccgcccaccgccgccgtccctgccaatcttggcgcccctatcggatccggactatcagatctcttcgacctcacctctggcgtgggtacgctttctggaagctatgttgccccaaaagcggtgtggcttccagcgatgaaggccaaaggtctggagatttctggcacattcacacggcaggtcggatccatctcaatggatttgcaactgaccaataaagccctccaggttatgactgatttcgcgattcagttcaacagaaacagctttggcttggccccagctaccccactgcaagtgcatgctccattaagccccaaccaaacagtggagattagccttcctctctctacagtgggcagcgttatgaagatggaacctctgaacaatcttcaagttgccgtgaaaaataatatcgacgtgttctacttttctacactctatcccttacatatcctcttcgtggaagacggaaagatggacaggcagatgttcctggccacatggaaggatattccaaatgagaacgaagctcagtttcagataagggactgtccactcaacgccgaggcagcgtctagtaagttgcagagctccaatatcttcacggtcgctaaacggaatgtagaaggccaggacatgctttaccagagtttaaagttgactaatggtatatgggtactggctgaattacgtatccagccaggcaatccttcttgcaccctttctctgaagtgcagggcaccagaggtaagccagcatgtttatcaggcctatgagaccatactgaaaaactag

SEQ ID NO: 178090 - DNA, 2850 bp, Artificial Sequence
  Description of Artificial Sequence: Synthetic coding sequence
atgaccgacagcaagtacttcaccaccaccaagaagggcgagatcttcgagctcaaagccgaactcaacagcgataaaaaggagaaaaaaaaagaggctgtaaaaaaggtgatagcaagcatgacagttggcaaggacgtgagcgcacttttcccggacgtcgtgaattgtatgcagaccgacaacttagagctgaagaaactggtatatctctacctgatgaattatgctaagtcgcaaccggacatggccattatggccgtcaatacattcgtcaaggattgcgaggatccaaatcctctcatcagggcgctcgctgtccggacaatgggctgtatccgtgtggacaagataaccgaatacttgtgcgaaccattgaggaaatgtctgaaggatgaggacccatatgtgcggaagactgccgcagtgtgcgtggcgaagcttcatgacattaatgcacaactggtcgaggatcaggggttcctggacacgcttaaagacctgatctcggattcaaatcctatggtcgtcgccaacgccgtggcggctctcagtgaaatagccgaatcccacccaagttctaatcttctggatttgaatccccagtctattaataagttgctgactgccctgaatgagtgtaccgaatgggggcagatattcatcctagactgtctggctaattatatgcctaaagacgaccgcgaagcccagtcgatttgcgaacgggttaccccacgattgagtcacgccaactccgctgttgtccttagtgccgtgaaggttttaatgaaatttatggagatgctttcaaaggatctcgactactacggcaccctcctcaagaaactggctccacccctggttacgctactgagcgcagaaccagagctgcagtacgtcgcgctgcgcaacataaacttaattgttcagaaacggccggagatcttgaaacacgagatgaaggtcttcttcgtcaagtataacgatccgatttacgtgaagctggagaagctagacatcatgatcagactcgcctcacaggccaacatcgcccaggtgcttgccgagctcaaagaatacgccacagaggtcgacgtcgatttcgtgaggaaggcagtgcgagccattggtcggtgtgccatcaaagttgaacagtcggcagaacgctgcgtgtcgacccttttagatctgattcaaaccaaggtgaactacgtggtgcaggaagcaattgtggtgataaaggacatcttccggaaatatccaaataagtatgaaagcgttatagcaaccctttgcgagaacctggattccttagacgagccggaggcaagggccgccatgatttggatcgtaggcgaatacgctgaaagaattgataatgctgacgagctgttggagtcatttctggaggggtttcacgatgagagtacacaggtgcagctccagctgcttacagccattgttaaactatttctgaagaagcccacggagacccaggagctggttcagcaggtgctatcgctggccacccaggactcagataaccccgacttgagggatcgggggtacatctactggcggctcttaagtactgacccagtcgcggccaaagaggtggtcctggcagagaagcctctgatttctgaagagacagatcttatagaaccgacactgctcgatgaactcatctgctatattggcaccctggcgtctgtgtaccacaagccccctagtgccttcgtagaagggggaagaggcgtcgttcacaagtccctcccgccccgcaccgctagcagtgagtctgccgagagtcctgaaacagcccctacaggggcccccccaggcgagcagcctgatgtcatacccgcccagggagatctgctgggggacctgctgaacctggacctggggccccctgtgtccggtccccccctcgccacatcatcggtccagatgggtgccgtggatctcctcggaggggggctcgactcactgatgggcgacgagccagagggcatcggtggcaccaactttgtggccccccctaccgcagccgtccccgccaatctcggagcccccataggtagcggccttagcgacctgtttgatctcacctcgggggtagggactctctccggctcttatgtagcgccgaaagccgtttggctccctgccatgaaggccaaagggctggaaatatcgggaacattcacacggcaggtgggatccattagcatggatcttcagctaactaataaggctcttcaggtaatgaccgattttgccatccaatttaatcggaacagctttggtctggcccccgcgacaccactgcaggtccacgctccattaagtcctaatcagaccgtggaaatatctctaccactaagcacagtgggttccgtgatgaagatggagccccttaacaacttacaggtggccgtaaaaaacaatatagacgtgttctatttcagtactctctatcctctgcacattctgttcgtggaggatgggaagatggatcgccagatgttcctggctacatggaaagacattccaaatgagaatgaggcacaattccagatacgcgactgcccactgaacgccgaagcagcatcatcaaagctacagagctcgaacatattcaccgtggcgaaacgcaacgttgaaggacaggacatgctctatcagagcttgaaactgaccaatggtatctgggtgctggcagagcttagaattcaaccaggcaacccttcatgcaccgacctggagttgtcactgaagtgtagagcgccagaggtttctcagcatgtgtatcaggcttacgagactattctcaaaaactag

SEQ ID NO: 178091 - DNA, 2820 bp, Artificial Sequence
  Description of Artificial Sequence: Synthetic coding sequence
atgaccgacagcaagtacttcaccaccaccaagaagggcgagatcttcgaactaaaggccgagttgaattctgataaaaaagaaaagaagaaggaagccgtgaagaaggtcatcgcaagtatgacagtgggaaaagacgtcagtgccctgttcccagatgtggtgaactgcatgcagacagacaatctggagctgaagaaactggtgtatctgtatctgatgaactacgctaaaagtcagcccgatatggctatcatggctgttaatacgttcgtcaaggattgtgaggatccgaacccactgatcagggcccttgccgtgcgcaccatgggctgtatacgcgtcgacaagattacagagtatctatgtgaacccctcaggaagtgcttgaaagacgaggatccgtatgtgagaaagaccgctgcagtctgtgtggcaaaactccacgacatcaacgcccaactcgtcgaagatcagggtttcctggacactctcaaggaccttatctctgattccaatcctatggtggtcgcaaatgcagttgccgccctgtctgaaatcgccgaatcacatccctcgagcaaccttctagatctcaacccacagtcaatcaataagttgctaactgccctgaatgaatgcaccgaatggggtcaaatctttattcttgattgtctggcaaattacatgccaaaagacgaccgagaagcacaatccatttgcgagcgcgtaactccaagactgtcacacgccaactcagcggtggtcctgtcggcagtgaaagtcttgatgaaattcatggaaatgctctctaaggaccttgactactatggtacactgcttaagaaactggcacctcccctggtcaccttgttgagcgcggaacccgagctacagtacgtagcactgcgaaatatcaatctgattgtgcagaaaaggccagagattcttaagcatgagatgaaggtgttttttgtgaaatataacgaccccatttacgtcaaactagagaagctcgacattatgatccgcctcgcctcacaggcaaatattgcccaggttctggcagagctcaaagaatatgccacggaggttgatgtggatttcgttagaaaggctgtacgcgctatcgggcggtgcgccatcaaggtcgagcaaagcgcagagagatgcgtatcaacactgctggacctaatccagaccaaggtgaactacgttgttcaggaagctattgtcgtaattaaagatatattcagaaagtatcccaacaagtacgaatccgtcattgccaccctatgcgaaaacttagactcactcgacgaacccgaggctagagccgccatgatctggattgtaggcgaatatgctgaaagaatagacaacgctgatgagcttctagaaagtttcctggagggctttcatgatgaatctacccaggtccagcttcagttgctgacagcaattgtgaagctgtttctgaaaaaacccactgagacacaggagctggtgcagcaagtactgtcattagcaacccaggattcagataatcccgatcttcgggaccgtggttatatctactggcgccttttgagcactgaccctgtggccgctaaagaagttgttctggcagagaagccactgatctctgaggagactgatctgattgaaccaaccctgctggatgagctcatttgctacatcggaacccttgcctctgtgtatcataaaccaccctcagctttcgtagaaggtggacgcggtgtggtgcacaaatcgctcccacctaggaccgcgagctctgaaagtgcggagagccccgagaccgctcccaccggggcaccacctggtgagcagccggatgtgattcctgcccaaggtgatctgcttggagacttgctaaatctggatctgggcccccccgtcagcggtccccctctggccaccagcagcgtgcagatgggagcagtggatctcctgggaggcggtctcgactcacttatcggcgggaccaacttcgtcgcccctcccactgccgctgtccccgccaatctcggagcacctatcggtagcggcttaagcgatctgttcgacctgacatctggcgttggtaccctgtccgggtcctacgtggcgcccaaagcggtgtggctgccagcaatgaaggccaagggtcttgagatttccggaacattcactaggcaggtgggaagcatctctatggacctgcagttgacaaataaggccttgcaggttatgacagactttgcaatacaattcaatagaaacagctttgggttagcccctgcaacaccgctccaggtgcatgcgcctctgtcccccaaccagacggtagaaataagcctcccactttcgacagtgggtagcgtcatgaaaatggagcctctgaataatctccaggtcgcagtcaagaataatatcgacgttttttattttagtacgctgtatccacttcacatcctgtttgtggaagacggcaaaatggatcgacagatgtttctagctacatggaaggacattcctaatgaaaatgaagcccagttccagattagggattgccctctgaacgcagaagccgctagctccaaactccaaagttctaacatctttactgtcgcaaaacggaatgtggagggacaggacatgttatatcagtctctgaaactgactaacggtatctgggttctggctgaactcaggatacagcccggaaatccctcatgtaccctgtcacttaagtgtagggcccctgaggtgtcacagcacgtataccaggcctacgaaacaattttgaagaattag

SEQ ID NO: 178092 - DNA, 1737 bp, Artificial Sequence
  Description of Artificial Sequence: Synthetic coding sequence
atgaccgacagcaagtacttcaccaccaccaagaagggcgagatcttcgagcttaaggcggaattgaatagtgacaagaaggaaaaaaaaaaagaagcagttaagaaggtgattgctagcatgacggtgggtaaagacgtcagcgccctgttccctgacgtggtgaattgtatgcagaccgataacctggagctgaaaaaacttgtgtacctgtatcttatgaactatgctaagagtcagccggacatggctatcatggcagttaataccttcgtcaaggattgtgaggatcctaatccactgattcgggctctggccgtccgcacaatgggctgtatccgtgttgacaaaataaccgagtacttgtgtgaaccacttcggaaatgcttgaaagatgaagatccttacgtaaggaagacagcagccgtgtgtgttgcaaaactgcacgatattaatgcccaactagtcgaagaccaggggtttcttgacaccctcaaagaccttatcagtgatagcaatccaatggtagtggctaacgccgttgccgcgctttccgaaatcgccgagtctcatccatcatcaaatttattagatctcaatcctcaaagtattaataagctgctcacggcattgaatgagtgcactgaatggggccaaatctttatcctggattgccttgctaactacatgccaaaggacgatagggaggcacagtccatttgcgagcgtgtgaccccaaggctttctcacgccaactcagccgttgttctctcagccgtgaaggtgctcatgaaattcatggaaatgctctcaaaagatctggattactatgggacgctgctgaagaagctggctcccccgctggtcacactgctctccgccgaaccggaacttcaatacgttgcccttcggaatataaatctgatcgtgcagaagcgacccgaaatccttaaacatgaaatgaaggtgtttttcgttaaatacaacgatcctatttacgtgaagctggaaaaactggacatcatgatcagactcgccagccaggctaatatcgcgcaagttctcgcggagctgaaagagtacgccaccgaagtagacgtggactttgtgcgcaaggcagtgagggccatcggaaggtgcgccataaaggtagaacagagcgctgaacggtgtgtgagcaccctgctcgacttaattcaaacaaaggtgaactatgtggttcaggaagctatcgtggtgatcaaggatatttttcgcaagtatcctaacaaatacgagagtgtcatcgccacgttgtgcgaaaatctggacagcctggacgaaccagaggcgcgcgccgcaatgatctggattgtgggcgagtacgccgagcgcatcgacaatgccgacgagctgctcgagtctttcttggaaggattccatgatgaaagcacccaggtacaactgcaactgctgaccgctatcgtgaagctgttcttgaaaaagcccacagaaacgcaagagctagtacaacaggtcctgtctctggccacgcaggattctgacaaccccgacttgcgcgacagagggtacatttactggcgcctgctgtcaaccgatcccgtggctgcaaaggaagttgtattggccgagaaacccctcatcagtgaggaaactgacctaatagaacctacacttttggacgaattaatttgttatataggtacactggcatcagtctaccataagcctccttag

SEQ ID NO: 178093 - DNA, 2820 bp, Artificial Sequence
  Description of Artificial Sequence: Synthetic coding sequence
atgaccgacagcaagtacttcaccaccaccaagaagggcgagatctttgagctgaaagctgagcttaattccgacaagaaggaaaagaagaaggaagcagtgaagaaggtgattgctagtatgacagtggggaaagacgtcagtgccctttttccagatgttgtaaactgcatgcagaccgacaacctcgagctgaagaaactggtttacctttaccttatgaactacgcgaaaagccagcctgatatggccatcatggctgttaatacctttgtcaaggattgcgaagaccccaatccacttattcgggcactcgcagtgcggaccatgggctgtattcgtgtagataagatcaccgaatacctctgcgagcccctgcggaagtgcttgaaggatgaagatccatacgtccgcaaaaccgcagccgtgtgtgtggccaaactgcacgacataaatgcccagctggtcgaggaccaaggatttctggacacgcttaaggacctgatttcagacagcaatcccatggtggttgccaacgccgtagctgctctaagcgaaattgccgagtcgcaccccagtagtaatctcctggatctcaacccacagtcgatcaacaagctcctgaccgctctcaacgagtgtaccgagtgggggcagatctttatccttgactgccttgcaaattacatgccaaaggacgacagagaagctcaatccatatgtgaaagagtcacaccccgtctaagccacgcgaacagcgccgtcgtcctgtccgcagtaaaggttctaatgaaattcatggaaatgctctcaaaagatttggattattacggcacccttctaaagaaacttgcacccccccttgttacgctgctcagcgcggagccagaactgcagtacgttgctttaagaaacataaacctgatcgttcagaagaggcccgaaatcctgaagcacgaaatgaaggtatttttcgtgaagtacaacgatccaatttatgtaaagttagagaaactggatattatgatcagactcgcgtctcaggccaatatcgcgcaagtgcttgctgagctaaaggaatatgccacggaggttgatgtggactttgtgcggaaggcagtgcgggcgattggtagatgtgctataaaggtggagcaatccgcagaacgatgtgtttctacactcttagacctcatccaaaccaaagttaattacgtggtccaggaagccatagttgtgatcaaggacattttcagaaaatatccgaacaaatacgagagcgtaatcgcgactttgtgtgagaacctcgactctctagatgagcctgaggcacgcgccgcaatgatctggatcgttggcgaatacgcggagagaattgacaacgctgatgagctgctggaaagctttctggagggcttccacgacgagagcacccaggttcagctgcagttattgaccgccatagtcaaactttttctaaaaaaacccacagaaactcaggaactggtgcaacaggtgcttagcctggcgacacaggattccgacaacccagacctgcgagaccgcggttacatatattggagacttttaagcacagatccggtggccgccaaagaggtggtcctcgctgagaaacctctgatctccgaggaaacggatcttattgagccgacactactcgacgagctcatctgttatattgggactctagcgagtgtctaccacaagccaccgagcgccttcgttgaaggagggaggggggtggttcacaagagtctgccaccaagaacggcatcctctgaaagcgcagagagccctgagacagctccgaccggcgcacccccgggggagcagcctgacgtgattccagcccagggggacttactgggggacctgctgaacctagacttgggtcccccagtgagcggcccacctttggcaacttccagtgttcagatgggtgccgtggatttgctgggagggggcctggacagtttaatcggggggacgaacttcgtcgccccgcctaccgcggctgtccctgctaatctgggggcaccaataggttcaggactgtccgatctgttcgacctcacctctggagtcggtaccctaagcggttcctatgttgcacccaaagccgtttggctacctgccatgaaggctaaggggctggagattagcggcacattcacacgccaggtcggcagcatctccatggacctgcagcttacaaataaggctctacaagtgatgaccgactttgctatacagtttaaccgaaattccttcgggctggcccctgccactcctctacaagttcatgccccgctgtcaccaaaccagacagttgagatctcactgccgctgagtacagtcggtagcgtcatgaagatggagcctctgaataatttgcaggtagcagtaaaaaataacattgacgtgttttactttagtactctttatcccctgcatattctgttcgtggaggatggcaaaatggaccgccaaatgttcctggctacgtggaaagatatacctaatgaaaatgaggcacagttccagatccgcgactgtcccctgaacgctgaggcagctagcagtaagctacagagctctaacatcttcacagttgccaagcggaatgtggaggggcaggacatgttgtaccagtctctgaagttgacaaatggcatctgggtattggccgagttgcgcatccaacctggcaacccttcttgtacactaagccttaagtgcagagccccagaggtgagccaacacgtgtaccaggcttacgaaactatactgaagaactag

SEQ ID NO: 178094 - DNA, 2469 bp, Artificial Sequence
  Description of Artificial Sequence: Synthetic coding sequence
atgcccgcccccatccggctgcgggagctgatccggaccatccggacggctcggactcaagctgaagagcgagaaatgattcagaaagagtgtgctgcgataaggtcgagtttccgagaggaggataatacctataggtgtcgaaacgtggcgaaattactgtatatgcacatgctgggatatcccgcacactttggccagctggagtgcctgaaactgatcgcttcccagaaatttacagacaagagaatagggtatctcggcgctatgctgctgttagatgagcggcaggatgtgcacttgcttatgacgaactgtatcaagaatgacctgaaccattccacgcagttcgtgcagggcttggcactctgcacactgggttgtatggggtcttcagagatgtgtagggacttggctggcgaagttgaaaagcttcttaaaacctctaatagttacctaaggaagaaagccgcactgtgtgcggtgcacgtcattcgcaaagttcctgagcttatggaaatgttcctacccgccacgaaaaatttactcaacgagaagaaccacggtgtactacatacatccgtggtacttttaactgaaatgtgtgagcggagtcccgacatgttagcacactttcgcaaacttgtcccgcaactggttagaattctgaaaaatctgattatgtccggctactcgcctgagcacgatgtgtcaggcattagcgatcccttcctgcaggtccggatacttagactccttagaatactgggacgcaacgatgacgactcttcagaagccatgaatgatattctggcacaagtggctacaaacactgaaacatctaagaacgttggtaatgccatactatacgagactgttctgactattatggacataaaatcagaatctggcctgcgggtgttggctattaacatcttagggagattcctgctgaataacgacaagaacattagatatgtggcgcttacatctctgctgaagaccgtgcagaccgatcacaacgccgtgcagagacatcgatctaccattgtggactgtctcaaggacctggatgtcagtattaaacgcagagcgatggaactctcgtttgctctggtcaacggaaataacatcagggggatgatgaaagagcttctatactttttggacagttgcgagccagagtttaaagccgactgcgccagcggcatcttccttgcggccgaaaaatacgcccccagcaaaaggtggcatattgacaccattatgcgtgttctcacaacagccgggagctatgtgcgggatgatgcggttcccaaccttattcaactaatcacgaatagcgtagagatgcatgcatacactgtccaacgactgtataaagctatattgggggactattcccagcagcccttggtccaggtggcagcttggtgtatcggagagtacggcgacctgctggtttccggacagtgcgaggaagaagaaccaatccaggtgactgaggacgaggtgcttgatattttggaatccgtcctgatcagtaacatgtcaacctccgtgacccgtgggtacgccttgacggcgataatgaaattgagcaccagatttacatgcaccgtcaataggattaaaaaagtggtgtccatatatggcagttcgatagacgtggagcttcagcagcgggcggttgagtacaacgccctcttcaagaagtatgaccatatgcgcagtgcactcctggagcgaatgccagtcatggaaaaggtgaccaccaatgggcccacagaaattgtgcagaccaacggggagaccgagcctgcaccactggagacaaagcctccaccttcgggccctcagccaacgagccaggcaaatgatctccttgatttgttgggaggaaacgacattacaccagtcattcccacagcccctacgtccaagccatccagtgcaggcggagagctactggatctactaggtgatattaatctaactggagcaccggcggcagctcctgcgcccgcctctgtgccacagatttcacagcctccttttctgctcgatggcctgagcagccaacccctcttcaatgatatagccgccgggatcccatctataacggcctattccaagaatggactgaagattgagttcacattcgaaagatccaacactaatccgtcagtcacagttatcacaatccaggcctctaactctaccgagcttgatatgactgattttgtatttcaggcagccgtgccgaagactttccagttgcagctcctgtcaccgtcctcttccatagtgccagctttcaatacaggaaccataacccaagtgattaaggtattgaatcctcagaaacagcagcttaggatgcgcatcaaactcacctacaaccacaagggctccgccatgcaggatctggctgaggtgaataacttccccccgcagtcctggcagtag

SEQ ID NO: 178095 - DNA, 2478 bp, Artificial Sequence
  Description of Artificial Sequence: Synthetic coding sequence
atgcccgcccccatccggctgcgggagctgatccggaccatccggaccgcacgcacacaggccgaagagcgtgagatgatccaaaaagagtgcgccgcaatccggtccagcttcagagaggaggacaatacatatcgttgtaggaatgtggccaagctcctctacatgcacatgctcggctaccctgcccatttcggacaactcgagtgcctgaaactaatcgcatcccagaagttcaccgacaagcgcatcggttacctgggcgccatgctgctccttgatgagcggcaagacgtgcacctacttatgactaattgcatcaaaaacgacctgaatcattcgacacaattcgtgcaaggcttggccttgtgtaccttgggctgcatgggtagtagcgagatgtgccgcgatcttgctggagaagtggaaaaactgctgaagacctctaactcctatctgcggaagaaagctgcactgtgcgcggtgcacgtgattaggaaggtgcctgagctgatggagatgtttctgcctgctactaagaatctgttgaacgagaagaatcacggagtcttgcacacaagcgttgtactgctgaccgaaatgtgcgaacggagccccgatatgctggcccattttaggaaaaatgaaaaattggtaccgcagctggtccggattcttaaaaatttaatcatgagcggatactcaccagaacacgatgtgtctggcatctctgacccctttctgcaggtaagaatactgcgcctgctgcgtatcctgggaagaaatgatgatgactcctcagaagccatgaatgacatcttggcgcaggtggcgaccaacacagaaaccagcaaaaacgtcggtaacgctattctgtatgaaaccgttctgaccatcatggacattaagagtgagtccggcctccgagtgctggccataaatattctgggccggttcctcttaaataatgacaaaaacatccgctacgttgctctgacttctctgctgaaaacagtccaaaccgatcataatgcagttcaacgacatagatccaccatcgttgactgcctgaaagacctggatgtgtctatcaagcggagagccatggaattgtcattcgccctcgtgaacgggaataacatacgaggcatgatgaaagagcttctttactttttagatagttgtgagcccgaatttaaagccgattgcgcctctgggattttcctggccgccgagaaatacgccccatcaaagcggtggcacatagacaccataatgagagtgctgaccactgccggtagctacgtgcgggatgatgcagttccaaacctgattcagctcatcactaactctgtggagatgcacgcttatacagtccaacgtctgtataaggccattttaggcgactactcccaacagccccttgtccaagtagccgcttggtgcatcggggaatacggcgatctgctggtgagcggacaatgcgaagaagaagagcctatacaggttacagaagatgaggtactggatattctcgaatcggtcctcattagtaatatgtcaacgtcagtgacccgggggtacgccttgaccgctattatgaaactctccaccaggttcacatgtaccgttaaccgaatcaagaaggtcgtgagtatttatggttccagcatcgacgtcgaacttcagcaacgggccgtggaatacaatgcgctgtttaagaagtatgatcacatgcgctcagcactattagaaagaatgcccgtgatggaaaaggtgaccaccaacggtcctactgaaattgttcaaaccaacggagagactgaaccagcccctctggagacaaaacccccaccttctggccctcagccgaccagccaggccaacgacctgctagatctgttgggcgggaatgacataaccccagtgattcccactgccccaacgagcaaaccgtcttctgccggtggcgaacttctagatctattaggggatattaacctaactggcgcccctgcagctgcccctgccccggccagtgtccctcagatcagtcagccaccgtttttactggatggattgagtagtcaacctcttttcaacgatatcgcagcgggcatcccatctattactgcttattcaaagaacggcctgaaaatcgagtttacctttgaaaggtctaacacaaacccatctgttacagtgataacgatccaagcatccaattcaacggagctggatatgactgactttgtgtttcaggcggcggtacctaaaacctttcagctgcaattgctgtctcccagttcttcaattgtgcctgcttttaatacaggaaccattacacaagtgatcaaagtacttaatccacagaagcaacaattgcgcatgcgtattaaattaacctacaaccataagggcagtgctatgcaggatttggctgaagtgaataacttcccccctcagagctggcagtag

SEQ ID NO: 178096 - DNA, 2478 bp, Artificial Sequence
  Description of Artificial Sequence: Synthetic coding sequence
atgcccgcccccatccggctgcgggagctgatccggaccatccggaccgccaggacccaggctgaagagagggaaatgatccaaaaggaatgcgcagccatcagatcaagctttagggaggaggataacacttaccgatgtcgcaacgtcgctaagctcttgtacatgcacatgttgggctacccggcccacttcggccagctggagtgtctgaaactcatagcttcacagaagttcacagacaaacgcatcgggtatttaggggcaatgcttttgctggatgagcgccaagacgttcacctgttgatgactaactgcatcaaaaacgatctaaatcattcaacccagtttgtgcaaggactggctctgtgcacgctgggctgcatgggcagctctgagatgtgtagggatttggcaggcgaagtagaaaagttgcttaaaacaagcaattcatatctacggaagaaggcggccctttgcgccgttcatgtgatacgaaaagtcccagaactcatggaaatgttcttgccagcaacaaaaaatctcctgaatgagaagaatcatggggtgcttcacacgtccgtggtcctcctcaccgaaatgtgtgaacgaagccccgacatgctagcccattttaggaaagaatcgaaactcgtacctcagctggtgaggatcctcaaaaacctaattatgagcggctattccccagagcacgatgtatctgggatctcggacccattcttgcaagtgcgcattctaagactacttcgtatcctcggtcgaaacgacgatgattcatccgaagccatgaacgacattctagcccaggtcgccactaataccgagacgagtaagaatgtggggaatgcaatcctgtatgaaaccgttcttactattatggatattaaaagcgagtctggccttcgcgtgcttgcgatcaacattctgggtaggtttctgctgaacaacgacaagaacattcgttacgtggctctgacgtccctgcttaaaacggttcaaaccgatcataacgctgtgcaacgacatcggtccaccattgtagactgcctgaaggacctcgacgtgtctattaagcgccgggccatggaattgagctttgctctggtaaacggcaataatattcggggcatgatgaaagagctgttgtacttcctggatagttgtgaaccggagttcaaggctgattgcgcttcaggaattttcttggccgccgagaaatacgctccctcgaagcggtggcacattgataccatcatgcgcgtcttaacaactgctggttcttacgtgcgtgacgatgcagttcctaaccttattcagctgataacaaactcagttgagatgcacgcttacacggtgcaacgactttataaagccattctgggagattattcacaacagccactggtccaggtggcagcctggtgtattggagaatacggggaccttctggtgtcaggccagtgtgaagaagaagagccaattcaagtcaccgaagatgaggtacttgacatcctggaaagtgtgctcatctctaatatgtctacttctgtgacccgcggttacgccttgaccgctatcatgaagctgtccaccagattcacatgcacagtcaatcgcattaagaaggtggtgagcatttatggctcgtccatagatgtggaacttcagcaacgtgcagtggaatataatgccttgtttaaaaagtatgaccacatgcgcagtgctctcctggagcgcatgcctgtgatggaaaaagtgacaaccaatggaccgacagagattgttcagactaacggcgagactgagcctgcgccactggagaccaagccgccaccctccggaccccagccaacctctcaggctaatgacctgctggaccttttgggagggaacgatattacgcccgtcattcctacagcccccacctcaaaaccatccagcgcgggcggtgagctcctagacttgctgggggatataaacctgactggtgctccagccgctgcaccggcaccagctagtgtgccacagatctcccagcccccttttcttctggacggcctaagtagccaaccactttttaacgacattgcggccggcatcccgtcgataacagcctattccaagaacggcttgaaaatcgagttcaccttcgaaaggtcaaataccaacccaagtgtgaccgtcataaccattcaggccagcaatagtactgagctcgatatgacggattttgtgttccaggctgcagtgccaaaaacttttcaacttcagcttctgagtccttcttctagtatcgtaccggcctttaacactggaaccatcacgcaggtcattaaagtgctgaatcctcaaaaacagcagctaaggatgagaattaagttgacatataatcacaagggctcggccatgcaggatctggccgaggtgaacaattttcccccacagtcttggcaatag

SEQ ID NO: 178097 - DNA, 1698 bp, Artificial Sequence
  Description of Artificial Sequence: Synthetic coding sequence
atgttcggcagctgctgccactgctgccggcggccccggagctgctggttccattctaggttcagagccgttagcggtgtacagtcacaggctgttggagtggagaagcggagacagcgctcctgggcccggaggggaagagaacctcaaggattattgagacttctggagggtcggcctcggggcctcggaccgggcggcagtgcacggcgaggggtgccttgctgcggggtggcaccacctcggatgcccgcacccattagattaagggagctcatccgaaccatcagaaccgcccgaacacaggcagaggagagggagatgattcagaaagaatgcgctgccataaggagctcctttcgggaggaagataatacttataggtgcagaaatgtggctaaactcctgtacatgcacatgctcggttaccccgcacattttggccagctggagtgcctgaagttgatagcttcacaaaagtttacagataaaagaattgggtacctgggggcaatgttgttactcgacgaacgacaggacgtgcaccttctgatgactaattgtatcaagaacgatctcaaccactctacccagtttgtgcagggactggccctctgtacactgggatgcatgggtagctctgaaatgtgtagggaccttgccggagaggtcgagaaattgctgaagactagcaactcatatctgaggaaaaaagccgctctttgtgccgtgcacgtaataagaaaggtgcccgagctgatggagatgttcctgcctgctaccaagaatctgctgaatgagaagaaccatggcgtcctgcatacctcagtagttttgcttactgagatgtgcgagagaagtcccgacatgctggctcatttccgcaaagaaagcaaactggttccccagctggttcgcatcctgaagaacctcatcatgagcggatatagcccagaacatgatgtctcaggtattagcgatcccttcttgcaggtgcgaatcctccgattactgcgtatcttaggacggaatgacgacgactcttcagaagccatgaatgatattttggcgcaggtagcaactaataccgaaacctccaaaaatgtgggcaatgcaattctgtacgaaaccgttttgaccataatggacatcaagagcgaaagtggactgcgggtgcttgccatcaacatcctgggacggtttttgctgaataatgacaagaacattcggtacgtcgcccttacgagcctgcttaagactgtccagacagatcataacgccgttcagcggcacaggagcacaattgtcgattgtctgaaggatctggacgttagtatcaaacggcgtgcgatggagttgtcattcgctttggtgaacgggaataacatacgcggcatgatgaaggagctgctttattttctagatagttgtgagcctgagttcaaagccgattgcgcctcaggcatatttttagccgcagagaagtatgcaccatccaagcgctggcatatcgatacaatcatgagggttctgacaactgccggcagctacgtgagagacgatgccgttcccaaccttattcaactgattactaacagcgttgaaatgcatgcttacacggtgcagaggctttataaggcgatcctgggtgattacagtcccacatttggcacttccggctgcatggtttatagatag

SEQ ID NO: 178098 - DNA, 2538 bp, Artificial Sequence
  Description of Artificial Sequence: Synthetic coding sequence
atggagaagaacatcaacctgcggaactgccagaccctgaacacctatgttatgctgactcacctgaggatgccggctcctatcagactccgcgagctcattcgtaccattagaacagcaaggacccaggcagaagagcgcgagatgattcaaaaagaatgcgccgcaatcaggagttcattcagggaagaagataatacatacaggtgtagaaacgtcgctaaactcctgtacatgcatatgctgggatatcccgcacattttgggcagcttgagtgtctgaaactgatcgctagtcagaaatttacggacaagcgtattggctatctaggcgccatgcttttgttggacgagaggcaggacgtccacctattaatgaccaactgtatcaaaaacgatttgaaccactctacacagttcgtccagggactggccctgtgcaccctaggctgcatgggttcttctgaaatgtgccgtgatcttgccggggaagtggaaaaactcctgaaaacctccaacagctatctgagaaaaaaagctgccctgtgtgccgtacatgtgattcggaaagtgccagaactgatggaaatgttcctgcccgcgacaaagaatttgctgaatgagaaaaatcatggcgtgctgcacacctccgtggtactgctcacggaaatgtgcgaaaggagcccagatatgttagctcacttccgcaaactcgtgcctcagctagtgcgaattctgaagaatttaattatgtccgggtactccccagagcacgatgtaagcggcataagcgatcctttcctgcaagttcggatcctgcggctacttaggattctcggccgaaacgacgacgacagcagcgaggccatgaacgacattctcgcacaggtggcgaccaacaccgaaacaagtaagaatgtcggaaatgccatcctgtacgagacggttctgaccatcatggatatcaaatcagaaagtgggttgcgggtactggccattaacatcctgggccggtttttgttgaataatgacaaaaacatccgctacgtcgcactgacctcccttctcaagacagtgcagaccgatcacaacgcagtacagaggcaccgaagcacaatagtcgattgcctgaaagatttggatgtgagtatcaagcgcagggccatggagctgtcatttgcccttgtgaacgggaataacattcgcgggatgatgaaagagctgttgtatttcttagactcatgcgagcccgagttcaaagcggattgtgcctccggtatctttctagccgcagagaaatacgccccctcgaagcgatggcacatagataccataatgcgagtcctgacaacagcaggatcttacgtgagagatgatgccgtgcccaatctgatccagctgatcaccaactcagtggagatgcacgcgtataccgttcaaagactttacaaggccatcctgggtgattactctcaacagccgttggttcaggtggccgcctggtgcataggggaatacggagacctactcgtcagcggacaatgtgaagaggaggaaccaatccaagtgaccgaagacgaagttttggatattctcgagtccgtactgatctcgaacatgtctacctccgtgacacgaggatacgcactcacagccattatgaagcttagcacccgcttcacgtgtactgttaatcgaatcaagaaggtggtgtctatttatggatcttcaatcgatgtggaactccagcagcgagccgtggagtataacgcccttttcaagaagtacgaccacatgagaagcgccttactagagcgtatgcctgtcatggaaaaggtcacaacaaatggccccacagagattgtccagactaacggcgaaaccgaacccgccccactggaaactaagccccccccatccggtccccaacctacctcacaggccaatgatttgcttgaccttctggggggcaacgatataacacctgttattccaactgcccctacgagtaagccctcctctgctggcggcgaactgctagacctgctgggagatatcaatttgaccggcgcacccgcagccgcacctgccccagccagtgtgccgcagatttcgcagccaccatttctactcgacggcttaagcagccagcctcttttcaacgacatcgctgccggcattccttccatcaccgcgtatagcaaaaatgggctgaaaattgaattcaccttcgagcggagtaacacaaatccatccgtgacagtaatcacaatccaggcctccaattccactgagctcgacatgacagatttcgtatttcaagcagcagtgccgaaaactttccagctccaactactgtctcccagttcaagcattgtcccagccttcaacaccggtactataacgcaggtgatcaaggtgctgaacccacaaaagcaacagttgaggatgagaataaaattaacctataaccataaggggtccgcaatgcaagatttggctgaggttaacaactttcctccacaatcgtggcagtag

SEQ ID NO: 178099 - DNA, 531 bp, Artificial Sequence
  Description of Artificial Sequence: Synthetic coding sequence
atgcccgcccccatccggctgcgggagctgatccggaccatccggacagcccgcacacaagctgaagaacgagaaatgattcagaaggaatgtgccgcgatcagatcctctttccgagaagaagacaatacataccgctgtcgtaatgtcgctaagcttctgtatatgcatatgctcggctaccccgcccattttggtcaattagagtgtcttaagttgatagccagccagaaatttactgacaagcgcataggttacttaggggcaatgcttctgcttgacgagaggcaggatgttcacctgcttatgactaattgtatcaaaaacgatcttaatcactctactcagttcgttcaggggctggctttgtgtaccctaggctgcatgggcagcagcgaaatgtgcagggacctggcaggagaagtggagaagcttctcaagacatccaactcctatctacggaaaaaggaaatgatttataagcagacaaatgtgaccggctatatccttggcggcattccaaattcatag

SEQ ID NO: 178100 - DNA, 1047 bp, Artificial Sequence
  Description of Artificial Sequence: Synthetic coding sequence
atgaaggacaagatgtgccgggacctggccggcgaggtggagaagctgctaaagacatctaatagttatctccgaaagaaagctgcactgtgtgccgttcacgtgatccgaaaagtgccagaactcatggagatgttcctgcctgctacaaaaaatcttttgaacgaaaagaaccacggcgttctgcacacctcagtggtgctgctgaccgagatgtgtgaaaggagccccgatatgttggcccatttcaggaaactcgtgcctcagttggtgagaattttaaagaatctgatcatgagcgggtacagtcccgagcatgacgtgagcgggatttccgatccttttctgcaggtcaggatcctaaggctcctccgaatcctgggcaggaacgacgatgactcgagtgaggccatgaacgacatactggctcaggtcgccactaataccgaaacctctaagaacgtgggaaacgcaattctgtatgaaactgtcttaactattatggatattaaatcagagtctggcttgcgagtactggcaatcaatatcttaggaagatttcttctcaacaatgataagaatatccgttatgttgctctgacttccctgctcaaaacagtacagacagaccataatgccgtacagcgccatcgttccacaattgttgattgccttaaggatcttgacgtcagtattaaaaggcgcgcaatggagctatccttcgcgctggttaatggaaacaatattagggggatgatgaaagaactcctgtactttctagactcatgcgaacccgagttcaaggccgattgcgcgtccgggatcttccttgccgctgtccccaagacattccagctgcagttactctccccttctagctcgattgtgccggctttcaacaccgggactatcacacaggtgatcaaagtcctaaatccccagaagcaacagctgcgcatgagaatcaagcttacgtacaatcataagggttccgccatgcaggacctagccgaagtgaacaactttcctccgcagtcttggcaatag

SEQ ID NO: 178101 - DNA, 1272 bp, Artificial Sequence
  Description of Artificial Sequence: Synthetic coding sequence
atgagcgccagcgccgtgtacgtgctggacctgaagggcaaggtgttgatctgtaggaattatcggggcgacgtcgatatgtctgaggtggagcattttatgcctatcctgatggaaaaggaagaggagggaatgcttagcccaatcctggcccacgggggtgtcaggtttatgtggatcaagcataataacttgtacctcgtggccacaagtaaaaaaaatgcttgcgtgagcctggtattcagtttcctgtacaaagtggtccaggtgttctctgagtacttcaaagagctggaggaggagtctatcagggataattttgtgattatttacgagctcctcgacgaactcatggacttcggatacccacagaccaccgacagcaagatattgcaggaatatataacacaggagggccataaactcgagacaggtgcccctaggccaccagccacagtgaccaatgcggtgagctggagatctgagggtatcaagtaccggaagaatgaagtgttcctggacgtgatcgagtctgtcaatctactggtgagcgctaatgggaatgtcctgcgatctgagattgtgggcagcatcaaaatgagggtgtttttatcaggcatgccggaattgaggttagggctcaacgataaagtgctcttcgataatactgggcgggggaaatctaagtctgtcgagcttgaggacgtgaagtttcaccagtgcgtccgcctgtcccggttcgaaaacgaccgcactattagcttcatccccccagatggagagtttgagcttatgtcctaccgtcttaatacacacgtcaagcccctcatctggattgagtcagttatcgaaaaacatagccattcccggattgagtacatgataaaagccaaatctcagtttaaacgccgcagcaccgcaaataacgttgaaattcacattccagtgcccaacgacgccgattctccaaaattcaagacgaccgtgggatcagtcaagtgggtgcccgagaacagtgaaatcgtctggagtataaagagctttcccgggggcaaggagtacctgatgcgggcccacttcggcttgcccagcgtggaggccgaggacaaagaaggcaaacctcccatctcagtcaaattcgagataccctacttcacaacatccggaatccaagtgcgataccttaagattattgagaagtccggctatcaggccctaccctgggtgcggtacatcacacagaacggagactaccagctgaggacgcagtag

SEQ ID NO: 178102 - DNA, 1113 bp, Artificial Sequence
  Description of Artificial Sequence: Synthetic coding sequence
atgagcgccagcgccgtgtacgtgctggacctgaagggcaaggtgttaatttgtcgaaactaccgtggagacgttgacatgtccgaggtcgaacacttcatgcctatcttgatggaaaaggaagaggaaggtatgttgagccctatccttgcacatggcggcgtgcgttttatgtggattaaacataataatttgtatctggtggctacaagcaagaaaaacgcctgcgtatcactggttttctcatttttatacaaagtcgtccaggtgtttagtgaatatttcaaagagcttgaggaggagtctattcgcgacaatttcgtgattatttacgaattattggatgagctgatggatttcggctatccacaaaccactgacagtaaaatattacaagaatatattactcaggaaggccacaagctagagaccggcgctccacggccaccggccaccgtgactaatgcagttagttggcgcagtgaggggattaaataccggaagaacgaagtgttcctcgacgtgatcgagagcgtgaatctgctcgtgtcagccaatggaaacgtgctaaggtctgagatcgttgggtcaattaaaatgcgagtctttcttagtggcatgcccgaactccgtctgggactgaatgacaaagttcttttcgataataccggaagaggcaagtccaagtctgttgaactcgaggacgtgaagttccaccagtgtgtgagattaagtcggttcgagaacgatcggacaatctctttcattccccctgacggagagttcgagctaatgagttataggctaaatacccacgtgaagccattaatttggattgagagcgttatcgagaagcatagccactccaggattgagtatatgatcaagggcggaaaggaatacttgatgcgcgcccattttggattgccctccgtagaggcagaggataaggaggggaagcctccgatttcagtgaaatttgagatcccatattttaccacgtctggaatccaggttagatatcttaaaatcatcgagaagagcggctatcaggcccttccgtgggtccggtatatcacccagaatggtgattatcagttgaggactcagtag

SEQ ID NO: 178103 - DNA, 1308 bp, Artificial Sequence
  Description of Artificial Sequence: Synthetic coding sequence
atgagcgccagcgccgtgtacgtgctggacctgaagggcaaggtgctgatctgtaggaattaccggggagacgtcgacatgtcagaagtcgagcacttcatgccaattctaatggaaaaggaagaggaaggcatgttgtccccaatactggcccatgggggcgtgaggtttatgtggatcaaacacaataacctttacctcgttgccacatcgaaaaagaacgcgtgtgtcagcctggtattttccttcttgtacaaagtggtgcaagtcttctccgaatactttaaagagctcgaagaggagtcgataagggataacttcgtgatcatatacgagctgctcgacgagctaatggatttcggatacccacagaccacagattccaagattctgcaagagtatatcacccaggaaggtcacaagctcgaaacaggagcccctagaccccctgctaccgtgacaaacgcggtgagctggcgttccgagggaatcaaatacaggaaaaacgaggtcttcctggacgttatcgagagtgtcaatctgctgggtaaataccctggagttgggtggctcgggcacacggtatccgctaacggtaatgtgctgaggtctgagattgtgggttctattaaaatgagagttttcttgtcagggatgccagagctcaggctagggctgaatgataaagttttgtttgacaacaccggccggggaaaaagcaagtcggtcgagcttgaggacgtcaagtttcaccagtgcgtccggctctctcgattcgagaatgatcggacaatcagttttattcccccagatggcgaatttgagttgatgtcctatagactgaatactcatgtcaaacccttgatctggatcgaatccgttatagagaagcacagtcattctcgcatcgaatacatgatcaaagctaagagtcaattcaaaagaaggagcaccgccaacaatgtggaaatccacatccctgtcccaaacgacgcagatagccctaaattcaagactaccgtggggtccgtaaagtgggtgccagagaactctgagatagtgtggtcaattaaaagcttcccaggtggtaaagagtatctgatgcgcgcccacttcggcttaccgagcgtagaggccgaggacaaggagggcaagcccccaatttccgttaagtttgagattccgtacttcaccacatccgggatacaggtccgatacctgaaaatcattgagaaaagcggctatcaggcgcttccatgggtgcggtatattactcagaacggcgactatcagctccgcacccaatag

SEQ ID NO: 178104 - DNA, 1056 bp, Artificial Sequence
  Description of Artificial Sequence: Synthetic coding sequence
atgagcgccagcgccgtgtacgtgctggacctgaagggcaaggtggtccaggtgttttccgagtacttcaaggaactcgaggaggagtccatccgagataatttcgtgatcatttacgagctcttagacgagctgatggatttcggatatccacagacaacggactctaagattctgcaggagtacatcactcaggagggccacaagctcgagaccggggctcctcgcccccctgccaccgtgaccaatgccgtttcgtggaggtctgaaggcataaaatacaggaagaatgaagtgttcctagatgtgattgaatctgtcaacctgctcgtctcagctaacggcaacgtgctgaggagcgagatagtcggctctattaagatgagggtctttctgtctgggatgccggagctccgcctcggactcaacgataaggtgcttttcgacaacacaggcagaggaaaatcgaagagcgtcgagcttgaggacgttaagttccaccagtgtgtacggctctcaagatttgaaaacgacagaacaatttccttcattccccccgatggcgaattcgaacttatgagctataggctaaacacccatgtgaagcctctcatctggatcgagtctgttatcgagaagcacagccacagtcgcatagagtacatgataaaggcaaagtcgcagtttaagcgtcgatctactgctaataacgtggaaatccacatccctgtgccaaacgatgccgactcacccaaattcaagaccacggttggaagcgtcaagtgggttcccgaaaactctgaaatcgtttggtcaattaagagtttccctgggggcaaagaatatttaatgcgtgcacactttggactgcctagcgtcgaggcagaggacaaggaagggaagccacctatcagcgtaaagttcgagatcccctacttcacaacctccggaatccaggtaagatacttaaagattatcgagaaatctggataccaggccctgccatgggtgcggtacattacgcaaaacggagattatcagctgagaacacagtag

SEQ ID NO: 178105 - DNA, 1272 bp, Artificial Sequence
  Description of Artificial Sequence: Synthetic coding sequence
atgagcgccagcgccgtgttcatcctggacgtgaagggcaagcccttgatcagtcgcaactataagggggatgttgcaatgtccaaaatcgaacactttatgccacttcttgtgcaacgtgaagaagagggggctctggctccactcttgtctcacggccaagtccacttcttatggattaaacactcaaatctctacctcgtggccaccacctcaaaaaacgctaatgcctctctggtttactcattcctgtacaagacaattgaagtgttctgtgagtacttcaaagaactcgaggaagaaagcatccgcgacaactttgtcattgtgtatgaactgttggatgagctcatggatttcgggttcccccagacaacggactcgaaaatccttcaggaatatattacacagcaaagtaataaactcgagactggaaaaagccgagtccctccaaccgtgaccaacgccgtgagctggcggtcagaagggatcaaatacaagaagaatgaggttttcattgacgtcatcgaaagcgtgaacctcctggtgaacgcaaatggatcagtcctcttgagcgagatcgttggcacgattaagctgaaagtttttctctccggaatgcccgagttgcggctcggacttaatgatagagtgttgtttgagctcacgggacgctcgaaaaataagtctgttgagctagaggacgttaaattccaccaatgcgtgcggctgagtagatttgacaatgatcgaacaatctcctttatacctccagatggagactttgagctgatgtcttatcgcctttcaacccaggttaagccactgatttggatagagagtgtcattgaaaagttcagccatagtcgcgtcgaaatcatggtcaaggccaagggccaattcaagaaacagagcgttgctaatggcgtggagatctctgtcccggtcccatcagatgccgactcccctagattcaaaacctcagtgggcagcgcaaaatacgtacctgagaggaacgtcgtgatctggtcgatcaagagtttcccgggtggcaaagaatatttaatgagggcccattttggtctgccatccgtcgaaaaagaggaagtggaggggcgcccgcctatcggagtaaaattcgaaatcccctatttcacagtttctggcattcaagtaaggtacatgaagatcatcgaaaagagtgggtaccaagctctgccatgggtgagatatatcactcagtcaggggattatcagttgcggaccagctag

SEQ ID NO: 178106 - DNA, 477 bp, Artificial Sequence
  Description of Artificial Sequence: Synthetic coding sequence
atgatgcggttcatgctgctgttcagccggcagggcaagctgcggctgcagaagtggtatcttgctacctccgacaaagagagaaagaagatggtccgcgagcttatgcaagtagtgctcgcccggaagcctaaaatgtgttccttcctggagtggagagatcttaaggtcgtttacaaaagatatgcttccctgtacttctgttgcgccatagagggccaggacaatgaattgattacactcgaactgattcaccggtacgttgagctcttagacaaatacttcggcagcgtttgtgaactggatatcatttttaattttgaaaaggcctacttcattctcgacgaatttctcatggggggagacgtgcaggatacaagcaagaaaagcgttcttaaggccatagaacaggccgacctcctacaagaggaggacgaatcaccaaggtcagtcctggaggagatgggactggcctag

SEQ ID NO: 178107 - DNA, 477 bp, Artificial Sequence
  Description of Artificial Sequence: Synthetic coding sequence
atgatgcggttcatgctgctgttcagccggcagggcaagctgcggcttcagaaatggtacttggccacttcagataaagaacgcaagaagatggtgagggagctcatgcaggtcgtactggccaggaagcccaagatgtgctcattcctggagtggcgtgaccttaaggtcgtgtacaaacggtatgccagtctatatttttgttgcgccattgaggggcaggataacgagcttatcactctggagcttattcatcggtacgtcgaactgctcgacaagtactttgggagcgtgtgcgaactggacataatatttaacttcgagaaggcttacttcattctggatgagtttttgatgggtggcgatgtgcaggacacctcaaagaagagtgtccttaaggctattgaacaagccgatctcttacaggaggaggacgaaagtccccgtagcgtgcttgaggaaatgggactggcttag

SEQ ID NO: 178108 - DNA, 474 bp, Artificial Sequence
  Description of Artificial Sequence: Synthetic coding sequence
atgcagttcatgctgctgttcagccggcagggcaagctgcggctgcagaagtggtatgtgcctctctccgataaagagaagaagaagatcacgcgcgaactggtgcagaccgtgctggcacgtaagcccaagatgtgtagttttttggagtggagagacctgaaaatcgtgtacaagagatacgcctccctttatttctgttgcgccatagaagatcaagataatgagcttatcacactcgaaatcattcatagatatgttgagcttctggacaagtactttggcagcgtgtgcgagttggacataatcttcaactttgaaaaggcctactttattctggacgaatttctgttaggaggggaagtgcaggagacatctaagaaaaacgtgctgaaggcgattgagcaggcagatttgctgcaagaggaagccgagaccccgaggtcagttctggaggagattgggttgacatag

SEQ ID NO: 178109 - DNA, 462 bp, Artificial Sequence
  Description of Artificial Sequence: Synthetic coding sequence
atgctgctgttcagccggcagggcaagctgcggctgcagaagtggtatgttccgttgtccgataaagagaaaaagaagattacccgggagctggttcagacagtccttgcgagaaaaccaaagatgtgttctttcttagagtggcgcgaccttaagatcgtgtacaaacgctacgcttccctgtacttctgttgtgccatcgaggatcaggacaatgaactcatcactctggagattattcaccgctatgtggagttgctagataaatattttgggtccgtctgtgaactggacattatctttaactttgaaaaggcctactttattcttgatgaatttctgctgggcggtgaggtgcaggagactagtaaaaagaatgtcttgaaagctatcgaacaggcggacttgctccaagaatcccagaatgaggaatggggcgggttgtccgaggatatactgtag

SEQ ID NO: 178110 - DNA, 483 bp, Artificial Sequence
  Description of Artificial Sequence: Synthetic coding sequence
atgcagttcatgctgctgttcagccggcagggcaagctgcggctgcagaagtggtatgtccccctgtccgacaaggaaaaaaagaaaatcactagggagttggtgcagaccgtcctggcaaggaagccaaaaatgtgctcatttctcgagtggcgggacctcaagatcgtgtacaagagatatgcctctctgtacttctgctgcgctatcgaggatcaggacaacgagctgatcacattagagattatccatagatatgtcgaactgctcgacaaatactttgggtcagtctgcgaactcgatataattttcaattttgagaaggcctattttatacttgatgaattcctgttggggggcgaggtccaggaaacctcaaagaagaacgtgctcaaggctattgagcaggccgatctgctgcaggagaaaaccgagacaatgtaccactccaagagcttcattggattcaaaaaggcctattag

SEQ ID NO: 178111 - DNA, 609 bp, Artificial Sequence
  Description of Artificial Sequence: Synthetic coding sequence
atgcccgccggctgccccccccacagcaccaccgccagcctgccccagcatggcgaccgcggattcccattcgccgccgccgcggcagccggacaggcccccccccgtccgagacccgcggcagccatgcagttcatgctcctcttttcccggcagggtaaactgcggcttcagaagtggtacgttcctttgtcagataaggagaaaaaaaagatcacccgggaacttgtccagaccgtccttgctagaaagccaaagatgtgcagtttcctggagtggcgggacctcaagatagtatataaaaggtacgcctctttatatttttgctgtgcaatcgaagaccaggacaacgaacttatcacgctcgagattatacaccggtacgtggagttactggacaaatattttgggagcgtttgcgaattggatattatcttcaactttgagaaggcttattttatcctggacgagttccttctaggaggagaagtgcaggaaacaagcaagaagaacgtgttaaaagctatcgagcaggccgatctgctccaagagaaaaccgagaccatgtaccattcgaagagctttatcggcttcaaaaaggcgtactag

SEQ ID NO: 178112 - DNA, 441 bp, Artificial Sequence
  Description of Artificial Sequence: Synthetic coding sequence
tgacggcagggcaagctgcggctgcagaagtggtacgtgcccctgtccgataaagaaaaaaaaaagatcacaagggagctcgtgcaaaccgttttggcccgcaaaccgaagatgtgcagtttcctggaatggcgggatcttaagattgtgtacaagcgctacgcatccctctacttttgttgtgctattgaggaccaggataacgagctgatcacgctggagattatccacaggtacgtagagctgctagacaagtatttcgggtcagtgtgcgagctcgatattatcttcaacttcgagaaggcatactttatccttgatgaattcctgcttggaggtgaagttcaggagaccagtaaaaagaacgtcctaaaagcaatagaacaggcagacctactccaggagccccgacacgagtatttcaatgtccccgtctactag

SEQ ID NO: 178113 - DNA, 462 bp, Artificial Sequence
  Description of Artificial Sequence: Synthetic coding sequence
tgactgctgttcagccggcagggcaagctgcggctgcagaagtggtacgtgccactgtccgataaggagaaaaagaaaattacaagagagctagtgcagaccgtattggctcgaaaaccaaagatgtgttcctttcttgagtggcgagacctaaagatcgtatacaagaggtacgcctctttgtatttctgttgtgcaatcgaagaccaagacaacgagttgatcacactggaaattatacaccgctacgttgaactgcttgacaaatacttcggttccgtgtgtgagttagacatcatatttaacttcgagaaggcgtacttcatactagatgaattcctactaggcggtgaggtccaggaaacgtctaaaaaaaacgtactgaaggccatcgagcaggccgatttactgcaggagtcccaaaatgaagaatggggaggattgagcgaggacatactgtag

SEQ ID NO: 178114 - DNA, 588 bp, Artificial Sequence
  Description of Artificial Sequence: Synthetic coding sequence
atgcccgccggctgccccccccacagcaccaccgccagcctgccccagcacggggatcgggggttcccctttgccgctgcagcggccgccgggcaggctcccccgcgcccccgtcctgccgccgccatgcagttcatgcttctgttctctaggcagggaaagcttcgcttgcagaaatggtatgtgcccctgtccgataaagagaagaaaaagatcacgagagaactagtgcagacagttttggcccgaaaacctaagatgtgctctttcttagaatggcgggatctcaaaatcgtttacaagcgatacgcctcactctacttttgttgcgcaattgaagaccaggacaatgagctaatcactttggagatcatccaccgctacgtggaattgctggacaaatattttggcagcgtttgtgaattggacataatcttcaacttcgaaaaggcttacttcatactagatgagttcctcttggggggtgaagtgcaggagacctccaagaagaacgtgttaaaggccattgaacaggcagatctcctgcaggagcctcgacacgagtatttcaacgtaccggtatattag

SEQ ID NO: 178115 - DNA, 315 bp, Artificial Sequence
  Description of Artificial Sequence: Synthetic coding sequence
atgatccggttcatcctgatccagaaccgggccggcaagacccggttggccaagtggtatatgcaatttgatgacgacgagaaacagaaactaattgaggaggtacatgccgtcgtgactgtgagagatgcaaagcacacgaacttcgtggaggtgctgaacgagtacttccacaatgtatgcgaactggacctggtttttaatttctataaagtgtacaccgtggtggacgaaatgtttctggcaggagagataagagagaccagtcagacaaaagtcttgaagcagctgctgatgttgcagagcctcgaatag

SEQ ID NO: 178116 - DNA, 2868 bp, Artificial Sequence
  Description of Artificial Sequence: Synthetic coding sequence
atgcccgccgtgagcaagggcgacggcatgcggggcctggccgtgtttatttctgacattcgcaactgcaaaagtaaggaggctgaaatcaagagaattaataaagagcttgccaacattaggtcaaaattcaaaggagacaaggccctggatggatactccaaaaagaagtacgtgtgcaagcttctgttcatattcctgcttggacatgacattgatttcggtcacatggaagcagttaacctcctgtcctctaacaagtatactgaaaagcagattggttatcttttcattagcgtgcttgtgaacagtaatagtgaattgatacgactgatcaataacgcaatcaagaatgatctcgctagcagaaaccctacctttatgtgcctcgcactgcattgcatcgccaatgtgggctctcgagaaatgggggaagcatttgcagcagatattccacgaattctggtagctggggatagcatggatagtgttaagcagtccgcagctctttgtctcctgcggctgtacaaagcttccccggatctcgtcccgatgggcgagtggacggcccgtgtcgtgcatctgctgaacgaccagcatatgggggtggtcacagccgccgtgtcccttattacctgcctgtgtaagaagaatcctgacgatttcaaaacatgcgtatctctcgccgtaagccgcttgtccaggatcgtgtccagcgctagtacggacctacaggactacacgtattacttcgtcccagctccatggctgtctgtcaaattgttaagattgttacagtgctatccaccacctgaggacgccgcagtgaaaggacgcctggtggagtgccttgagaccgtccttaacaaggcccaggaaccaccaaagtccaagaaggtgcagcattcaaatgccaagaacgcaatactattcgagactatcagtcttatcatccactatgactctgagccaaacttgctagtccgtgcttgcaatcagcttggccaattcctccagcacagggaaaccaatctacgctatttagccctggaatctatgtgcacactcgccagttccgaattttcccacgaggccgtcaagacccatatcgataccgttatcaatgctttgaagaccgaacgcgatgtcagcgtaaggcagcgggcagccgaccttctttacgccatgtgcgacaggtctaatgctaagcaaattgtatctgagatgctccgctatctggaaacagcagactatgctatccgggaggagatcgtgctgaaagttgccatcttggcagagaaatatgcagtggattacagctggtatgtggacaccatcctgaaccttattcggatcgccggtgattatgttagcgaagaggtgtggtacagagtgctgcagattgttacgaaccgggacgacgtgcagggttatgctgccaagacggtgttcgaagctctccaggccccggcttgtcacgagaacatggtcaaggtcggaggatatatcctgggagagtttggaaatcttatcgccggggatcccagaagcagcccccccgtccagttctctttgctccacagtaagtttcacctatgttctgtggccacccgcgcgctactgctgtccacctacattaagttcatcaatttatttcctgagacaaaggctactattcagggtgtgctgagagcagggagccaactcaggaacgccgacgtggagcttcagcaaagggcagtggaatacttgaccctgtcaagtgtcgcctcaacggatgttctggccaccgtgctggaagagatgccacctttcccggaaagagagtcatcgatccttgccaagttgaaaaggaagaagggccccggggcgggctcagccctcgacgacggacgccgggatccaagctctaacgatatcaatgggggcatggagcctacccctagtacagtttccactcctagtccaagcgcagacctgctggggctcagagcagcacctcctcctgccgcccctcctgcctccgcaggcgctggcaacctgcttgtcgacgtgtttgatggtcccgctgcgcaacccagcctgggacctactccagaagaggccttcttgtcaccaggccccgaagacatcgggccacccatcccagaggccgacgaactgcttaataaatttgtgtgtaaaaataacggcgttctttttgagaatcagctcttacagattggtgtgaaatcagaattccgtcaaaacctagggcggatgtaccttttctacgggaacaagacctcagtgcaattccagaacttcagcccaacagtggtgcatcccggcgacctgcagacccagcttgcggtgcagaccaagcgggtagctgctcaggtcgatggtggggcccaagttcagcaggtgctcaacatagaatgcctgagagattttctgacacctcctttgcttagcgtcaggtttcgttacggcggggccccacaggccctgaccctgaagctcccggtcactatcaataaattcttccagcccacagaaatggccgcccaggatttctttcaaagatggaaacagctgagcttgccgcaacaggaggcccagaaaatttttaaagcaaaccaccctatggacgcagaagtgacaaaggccaagctgctcggcttcggttccgccctactagataacgtggacccaaatccggagaattttgtcggggctgggataattcagactaaggcgctgcaggtcgggtgtctgctgcgactagaacccaatgcgcaggctcagatgtaccggttaaccctccgcacctccaaggaaccagtgtcacgacacttgtgtgaactcttggcccagcagttttag

SEQ ID NO: 178117 - DNA, 2934 bp, Artificial Sequence
  Description of Artificial Sequence: Synthetic coding sequence
atgcccgccgtgagcaagggcgacggcatgcggggcctggccgtgttcattagtgacatccgaaactgcaagagcaaagaagcggagatcaagagaattaacaaagaattggcgaacattcgctccaaattcaaaggggataaggcccttgatggctactctaagaagaaatacgtctgcaagttgttgtttattttcctcctgggacacgatatcgattttggtcacatggaggcagtgaacctccttagcagtaataaatacacagagaagcagataggttatttatttatcagcgtgttggtgaattccaattcagagcttatccggctgatcaacaacgccatcaaaaacgacctggcctccaggaaccctacattcatgtgcctggcactgcactgtatagccaacgttggcagccgcgagatgggcgaggcctttgccgcggacattcctcgcatcctggtcgccggcgacagcatggattctgttaaacagtccgctgctctgtgtctgctgcgcctgtataaagcatctcctgacttggtccccatgggggaatggaccgcgcgcgtggtgcaccttctcaacgaccagcacatgggtgtggtgactgccgctgtaagcttgataacatgcctttgtaagaaaaatcctgatgacttcaagacatgtgtgtccctagctgtttcccggctctcccggattgtaagttccgcaagcacagatctccaagactatacctattattttgtccctgcaccatggctcagtgttaagctgctgcgtctactgcagtgttacccgccccccgaagatgccgcagtgaagggaaggctggtggaatgcctagagaccgttctcaataaggcccaagaacccccgaagtccaagaaagtccagcattctaatgcaaaaaatgccattctgttcgagactatttccctgattattcactacgactcagaaccaaatttgctagttcgtgcatgcaatcagctgggacagtttctgcagcaccgggagaccaatctgcgatatctggctcttgagtctatgtgcaccttagcgtcctccgaatttagccacgaggcagtaaagacccacattgatacggttatcaacgctctcaaaactgagcgggatgtctcggtgcgccagagagctgctgatctgttgtacgctatgtgcgatcgctcaaatgccaagcaaatcgtgtcggaaatgctgaggtatctcgaaactgctgactacgccatcagggaggagattgttctgaaggtggctatcctggctgaaaagtatgccgtggattattcttggtatgttgatacgatcttgaacctcatcagaatcgccggcgactacgtgtctgaggaagtatggtaccgtgttttgcagatcgttactaaccgagatgatgtacaggggtacgcggccaaaacagtgttcgaggctctgcaggcaccggcctgtcacgagaacatggtcaaagtgggagggtacattttgggtgagttcgggaacttaatcgctggggatccccggagttcacccccggtacagttttctctgctacactcaaagttccacctctgtagcgtggctacacgggcactgctgctatccacttacatcaagttcattaacctgtttcccgaaacgaaggcaaccatacaaggggtcctccgcgccggctcccagctacgcaatgctgacgtcgaactgcagcagcgtgccgttgaatacctgactctgtccagcgttgccagcaccgatgtgctggcgactgttcttgaggagatgcctccgttcccagagcgcgagagtagcatcctggcaaaactaaagaggaaaaaaggccctggcgctggtagtgcgcttgacgatggccggcgtgacccaagcagcaacgatatcaatggcggaatggagcccaccccatctacggtttctacacccagccccagtgctgatctcctgggcttacgcgcagctccaccgccagctgcaccaccggccagcgctggtgctggaaatctcctggtggacgtatttgacgggccggccgctcaaccatctctcgggcccacccccgaagaagcctttctgtctgaactggaaccccccgcacctgagtctccgatggcacttctcgctgaccccgcccctgccgcggaccctggacctgaggacattggccctcccattcccgaggctgatgaactcctcaacaaatttgtgtgcaaaaataacggcgttctgtttgagaaccaattgctgcagatcggcgtgaagtctgagttccgacaaaatctgggccgcatgtatctgttttacgggaacaagacaagtgtgcaatttcagaatttctctcctactgtggttcacccaggtgacttgcagactcaactagcagtccagacaaaacgagtggccgcacaggtggatggcggcgctcaagttcaacaggtgcttaacatagaatgtctgcgcgacttcctcactccacccctgctttcagtgaggttcagatacgggggagctccccaagcgctcactcttaagctgcccgtgaccataaacaagttcttccaaccaaccgaaatggccgctcaggatttctttcagaggtggaaacagctctcactgccacaacaggaggcccagaaaatattcaaggccaaccatccaatggatgccgaagttactaaggcgaaattactgggattcggcagcgcacttctggataatgtcgaccctaatccagagaacttcgttggcgccgggattattcagactaaggcactgcaggtgggctgcttactcagactggaacctaatgcccaggctcagatgtaccgtctcacgctgaggactagtaaggaacctgtatcacggcatttgtgtgagcttctggcccagcagttttag

SEQ ID NO: 178118 - DNA, 1404 bp, Artificial Sequence
  Description of Artificial Sequence: Synthetic coding sequence
atgggcctggccctgcactgcatcgccagcgtgggcagccgggagatggcggaagcgttcgccggggaaattccaaaagtattagtggcaggcgataccatggacagcgtcaagcagagcgccgccctttgccttttgcggctatataggacatcaccggatctcgtacctatgggcgattggactagtagagttgtgcacctccttaatgaccagcatctcggcgtggtgacggccgcaacaagtctgattactaccctcgctcagaagaatccagaggagtttaaaacaagcgtgagcttggccgtcagccggctaagtcggattgtaacgagcgccagcactgacctacaggattatacttattacttcgtgccggctccctggctgtctgtgaagttattacgcctcctgcagtgctacccgcccccagaccccgcggtgagaggcaggctgacggagtgtcttgaaactatattaaacaaggctcaggaacctcctaagtctaagaaggttcagcacagcaacgccaagaacgccgtcctcttcgaggctatctctctcataatccaccacgatagtgagcccaatctgctcgtgcgagcctgcaaccagctgggtcagtttctacaacaccgcgagacaaatctgaggtatctggccctggagtctatgtgtacgctggccagcagcgaattctcacatgaagctgttaagactcatattgagacagtgattaatgctctgaagacagaaagggacgtctccgtgctgcctcctactcctcctcgatccttgtgggagcagcaatgccattgcgcctggaggggcctgagcttaggcgtatggccaagctggtggctccacacctggcgtcgacctggacccctgggcggcgcgcagttgacacttgtgttgcttcaatctcagctggactgttttcctcgccaggattttaacctggagtttaggaacatctgcatttgcaacgatttctggcaaaagcatgtctcttggcctgatgttactgtgctgttgtcacagctgctgttcgtgaagggagtgtgttatgctccggccgttgcagaggctctggatgtgcagccaggcgaagaaagacctgccggcccagcgggcccgccggggctgcaaggcaaggtctgggccgggggggctagactgcgcggtgtactcgttagcttcctgtctgagtgggcgtcccctggccatggggcgggcctgagcccctcaacgggacctgtgcagtcctccttagaagggctgtggcgccgggacgccagcgtttggtcaggaagcgaaggagctattggccggatgccgtgcgccacgtgtggcctatgtctgacctgccatttggacagcgctccgcgactccacgtgtag

SEQ ID NO: 178119 - DNA, 2823 bp, Artificial Sequence
  Description of Artificial Sequence: Synthetic coding sequence
atgcccgccgtgagcaagggcgacggcatgcggggcctggccgtgttcatttcggatattcgcaattgcaaatccaaagaagccgagataaagcggattaataaggaactggccaacatcagatctaaattcaagggggataaggcccttgacgggtacagcaagaagaagtacgtttgtaaactcttatttatcttcctgttaggccacgatatcgactttgggcatatggaggcagtcaacctgttgtcctccaaccgatataccgagaaacagattggctacctgtttattagcgtgcttgtcaactcaaacagtgagctcatccggcttattaataatgccatcaagaatgaccttgcttcacgcaatcccacctttatggggctagccctgcattgcatcgcgtctgtcggctcccgtgaaatggccgaagcctttgcgggcgaaattcccaaagttttggtggcaggggataccatggactcagtaaaacaatccgcggctctgtgtctgctgcgactttaccgaacaagcccagacctcgtgcccatgggagactggacctcacgagtcgtgcacctgttgaatgatcagcacctcggcgtggttacggccgcaacctctctaattacaacactggctcaaaagaatcctgaagagttcaaaacctccgtgtccttagcagtttcaagactgtctaggatagtcacatccgcctctactgacctgcaagattacacctactactttgtgccagctccttggctgagcgttaagctcttgagactgcttcagtgctatccccctcctgaggaccctgccgtacgtggacggctgaccgaatgcctggagaccatcctcaataaggctcaggagcctcccaagagcaagaaagtccagcattccaatgctaaaaatgcagtgctcttcgaggccattagtctgatcatccaccatgattcagagcctaatctcctggtccgagcctgcaaccagttgggtcagttcctgcaacatcgagagacaaatttaagatacctcgcgctggagtctatgtgcaccctggcaagctctgaattctctcacgaggccgtgaagacccacatagagacggtgattaatgctctgaagacggagagggacgtgagcgttaggcaacgcgctgtcgatctcctgtacgccatgtgtgatcgttcgaatgcaccccagattgttgctgagatgttaagctacttggaaactgctgattactcaatacgggaagagatcgtgcttaaggtcgcaatacttgcggagaaatacgcggtggactacacctggtacgtagacacaatattaaatctgataaggattgctggcgattacgtgagcgaagaggtctggtatagggtcatccagatcgtaataaaccgtgatgacgtccagggctacgctgcgaagacagtgttcgaagccctccaggcccccgcctgccacgaaaacctcgtaaaagtggggggctacatcctgggtgaattcgggaatctgatcgcgggcgaccctagaagcagtcctttaattcaattccacctcttgcattccaagtttcacctgtgtagtgtccccaccagagccttgcttttgtctacttacatcaagttcgtaaatctatttccggaggtgaagcccacgatccaggatgtgctgcgcagtgattcacaactcagaaacgctgacgttgagttgcagcagagggcagtggagtatctgcgactcagcacagtcgcatcaacagacatcttggccacagtactggaggaaatgcccccctttccagagcgggagagctccatcctcgccaaattaaaaaaaaaaaagggcccttccaccgtcaccgacctcgaggatacaaagagagatcggtccgtggatgtcaacgggggaccagaaccagcccctgctagcactagcgccgtttcgacacctagccccagtgcagatttattgggactcggagcagcaccacctgcaccagcgggcccaccgccttcctcgggcggatctggactactggtggatgtcttctctgactccgcgtctgtcgtggcacccttggcacccgggagcgaagacaatttcgcccgattcgtgtgcaaaaataatggggtgctgtttgagaatcagcttctgcaaatcggcctgaaaagcgaatttcgtcagaacctgggaagaatgttcatattttatggaaacaaaacatcaacgcagttcctgaactttacacccacccttatctgctctgacgatctgcagccaaatctgaatttacaaaccaagccagtggatcctaccgtggagggaggagcacaggtgcaacaggttgttaacattgaatgcgtatccgatttcacggaagctcccgtcctaaacatccaatttagatatggtgggaccttccaaaacgtctccgtgcagctcccaattaccctgaataaattcttccagccgaccgaaatggcgagccaggacttcttccagcggtggaaacagctatctaaccctcagcaggaagtgcagaatatttttaaagctaagcatcccatggacactgaagtgacaaaagccaaaatcatcggctttgggtcagccctgctcgaggaagtagatcccaacccagccaacttcgtgggggccggtataatccacaccaaaacgacacagatcggatgtctgcttcgcctcgaacctaatctgcaggcccagatgtaccggctgactctccgcacaagcaaggaggcagtgtcccagcggctgtgcgagctcctgtcagcccaattttag

SEQ ID NO: 178120 - DNA, 1062 bp, Artificial Sequence
  Description of Artificial Sequence: Synthetic coding sequence
atgcccgccgtgagcaagggcgacggcatgcggggcctggccgtgtttatctcggacatccgtaactgcaaaagcaaggaagccgagattaagcgcattaataaagagttggccaatatacggtccaagttcaagggcgacaaggccctcgacgggtactccaaaaaaaagtacgtttgcaagcttctttttatttttctgctgggccatgatatagactttgggcatatggaggcagtgaaccttctgagttctaacaggtatacggagaaacaaatcggctacctgtttatctcggtgctggttaactcaaattccgaacttataaggctgatcaataacgctattaagaatgatttagcctcccggaatcctacgtttatgggcctggcgctgcactgtattgcatctgtgggctcgcgggagatggcggaggccttcgcgggggagattccaaaggtgttggtggccggagacacaatggatagcgtgaaacaaagtgcagctctttgtttattgcgtttgtatcgcacatcccctgacttggtcccgatgggcgactggacttcacgggtggttcatttactgaatgaccaacacctgggcgtcgttacagccgcaacgtccctaattacgacattagcccagaagaacccggaggagttcaagacttctgtctcactagctgtgagccgtttgagcaggattgtgacctcagcctctaccgatctacaagactacacttattatttcgtgcccgcaccctggctgagcgtaaagttactccgactgctgcagtgttacccgccccccgatccagccgttcgcggcaggttgacagaatgccttgagaccattctgaataaagcgcaggagccgcctaaatccaaaaaagttcagcacagcaatgctaagaatgccgtgctttttgaggctatcagtttgatcattcatcatgaccgggagccaaatctgcaagctcagatgtacaggctgacactccggacctctaaggaagctgtttcccagcgcctatgtgaacttctatctgcccagttttag

SEQ ID NO: 178121 - DNA, 1971 bp, Artificial Sequence
  Description of Artificial Sequence: Synthetic coding sequence
atgcccgccgtgagcaagggcgacggcatgcggggcctggccgtgttcatcagtgacatcaggaactgtaaatcaaaggaagctgaaatcaagcggatcaataaggaactcgccaatattaggtccaaattcaaaggcgataaagcactcgacgggtattccaagaaaaagtatgtgtgcaagttactcttcatttttctgctcggtcacgacatcgacttcgggcacatggaggctgtaaacttgttgtcttccaaccgctacaccgagaagcaaattggctatcttttcatctcggtcctagtaaacagcaactctgagttaattcgactgatcaacaatgcgatcaaaaatgacttggcgagtaggaaccctacttttatggggctggcactccactgcattgcttcggtgggtagccgtgagatggccgaagcatttgccggggaaattcctaaggtactggtggcgggcgatactatggactctgtgaagcaatccgccgcactgtgtctgcttaggctgtatcgcacttcgcctgatctggtgcccatgggggattggacttctcgggtagtacatctgctgaatgatcagcatttgggcgtggtcacagccgctaccagccttatcaccacgcttgctcaaaagaaccctgaggagttcaagacgtctgtctccctggccgtatcaagactgagtcgcatcgtgaccagcgcaagcactgatttgcaagactacacttattattttgtgcccgctccctggttgagcgtgaaactccttcgactcctccaatgctacccccccccggaagaccccgccgttcggggcaggctcaccgagtgccttgagacgattctgaataaagcccaggagccgccaaagagtaaaaaggtgcagcattcaaatgccaaaaacgccgttttgttcgaggctatcagcctgatcatccatcatgactccgaacctaacctcctggtgcgggcgtgtaatcagctgggacaatttcttcagcaccgcgagactaatttgaggtatctcgcacttgagagtatgtgcaccctggcttcaagtgagttcagtcacgaagcagtgaagactcacattgaaacggttatcaatgccctcaagaccgagcgagacgtgagtgtgcgccagcgagcagtcgatctcctgtacgcaatgtgcgataggagcaatgctcctcagatcgtcgcagaaatgctcagttaccttgagactgctgactatagtattcgagaagagatagtcctgaaagttgccatactggctgagaaatacgccgtggactatacatggtatgtggatacaatcctgaatctaattagaatcgccggagattatgtgtctgaagaagtgtggtatagagtgatccaaatagtgataaaccgtgatgatgttcagggatatgctgcaaagacagtattcgaagcattacaagcaccagcctgtcacgaaaacctcgtgaaggtcggtggatacatccttggcgagtttgggaatctaatcgcaggcgatcccaggagcagccctttgatccaatttcatctgctccattctaagttccacctgtgctccgtgcccaccagggccctgttgctatccacttacataaaatttgtaaatctgttccctgaagtgaaacccactatccaggacgttctcagatcagattcacagctgcgaaacgcggatgtggaactgcagcagagagccgtggagtacctgcggctatcaacagttgcatcaactgacatcctcgcaacagttctcgaagagatgccaccctttcctgaacgcgaatccagtattctggccaagctcaagaagaaaaaagggccttcaacagtcaccgacttggaggacaccaaaagggacaggtctgtagacgtcaacggagggcccgagccggcccccgcgagcacttctgccgtgctatgcctctag

SEQ ID NO: 178122 - DNA, 2820 bp, Artificial Sequence
  Description of Artificial Sequence: Synthetic coding sequence
atgcccgccgtgagcaagggcgacggcatgcggggcctggccgtgtttatatcagatattagaaactgcaagagtaaagaagccgaaattaaacgtattaataaggaactcgcaaacatccggtccaagttcaagggtgacaaagcgctggacggctactctaagaagaagtacgtgtgtaagttgcttttcattttcctgttgggccatgacattgactttgggcacatggaggcggtgaatttgctgtcttcaaatcgctacaccgagaagcagatcggatatctgttcatttctgtcctggtgaacagcaattccgagctgatacgtctaatcaacaacgcgatcaagaatgatctggccagtagaaatcccactttcatgggtctggctcttcactgtattgcaagtgtagggtcaagggagatggccgaagctttcgccggcgaaataccaaaagtgttggtcgccggggatacgatggactccgttaaacaatctgcagctctgtgtctccttaggctgtatcggacaagccccgacctggtgcctatgggcgactggactagtagggtggtacacctactaaacgaccagcacctcggtgtcgtgactgccgctactagcctcatcacgactctggcccaaaagaaccctgaggaattcaagacttctgtcagcctagccgtctcacgtctgagcaggatcgtcaccagcgccagcactgatctccaagattatacttattacttcgtgcctgccccatggctgtccgtgaagctgctgagacttctccagtgctaccccccgccagatcccgcagtgcggggacgccttacggaatgtctggagacaattttgaacaaagcccaggagccccctaaatctaagaaagtgcagcactcgaatgctaaaaacgcagttttgtttgaagcgatcagcctgatcattcaccacgattctgagcctaacctgctggtcagggcctgcaatcagcttggccagtttctccagcatcgggagactaatcttaggtatctggcgctggagagcatgtgtacactggcaagtagtgaattttctcatgaagccgtgaaaacacacattgaaaccgtaatcaatgcgctgaaaactgaaagggacgtctcggttcgtcagagagcagtagacttgctgtacgcaatgtgcgacagatccaatgctccccagatcgtggctgagatgctgtcctatctggaaacagcagactacagtatacgcgaggaaatcgtgctaaaggtcgcaatactggcagagaaatatgccgtggattatacctggtatgtggataccattcttaacctcattagaatagcaggcgattacgtgtccgaagaagtctggtacagagtgatacagatcgtgatcaatcgggatgatgtacagggctacgccgcaaaaactgtcttcgaggctctccaggcacccgcatgccatgaaaacttagtgaaggttggaggctacatattgggcgagtttggaaacctgatcgctggggatcctagatcctcacctttaattcagttccatttgctgcattctaagttccatctatgctctgtcccaaccagagccctgctcctttctacttacattaaattcgtgaacctgtttccagaggtgaaaccaacaatacaggacgtcttaaggtccgactctcaattgcgcaacgctgatgtggagctgcaacagagggcagtggagtacttaaggctctccaccgtcgcaagtaccgatatcctggctactgtgctcgaggaaatgcctccatttcccgagagggaatcttccatcctggccaaacttaagaagaagaaggggccatctactgtgacagacctggaagatacaaagagagaccggagcgtggacgtcaatggaggcccagaaccggccccagcttcaacttcagcagtatctaccccaagtcctagcgctgatctgcttggattgggtgctgccccaccggcacccgccggtcctccaccttcctccggcggttctgggcttctcgttgacgttttctctgattctgcctcagttgttgctcctctggcccccggctctgaggacaacttcgcgagattcgtgtgcaaaaacaatggcgtgctcttcgaaaatcagctgcttcagataggccttaagtccgaatttcggcagaacttgggccgaatgtttattttctacggcaataagacctcaacacaatttctcaacttcacccccactctgatctgtagcgacgacctgcagcccaacttgaatctacagaccaagcctgtggaccctactgtggaggggggtgcccaggtgcaacaagtggtaaacatcgagtgtgtctcagatttcactgaagccccggtgttgaacattcaatttagatacggaggcacattccaaaatgtgagcgtgcaacttcccattaccctgaacaagttctttcagcccaccgaaatggctagtcaggactttttccaacgctggaaacagctgagcaacccccagcaagaggtgcaaaacattttcaaggcgaagcatcctatggatacggaggtaacaaaggcaaagattatcggctttggaagtgcccttctcgaggaagtggatcccaatcctgcaaattttgtgggcgccgggatcatccatacaaagaccactcagattgggtgtctgctgagactggagccgaatctccaagcccaaatgtataggctgacactgcgcactagtaaggaggctgtgtctcagcggttatgtgagctgctttctgctcagttttag

SEQ ID NO: 178123 - DNA, 2040 bp, Artificial Sequence
  Description of Artificial Sequence: Synthetic coding sequence
atgcccgccgtgagcaagggcgacggcatgcggggcctggccgtgtttatatcagacattagaaactgcaagtctaaagaagcagagataaaacgtattaataaagagctcgctaacatccgatccaaattcaaaggtgacaaggcactcgacggctactccaaaaaaaaatacgtgtgtaagctgctcttcatctttttactgggccacgatattgatttcggacacatggaggccgtaaacctcttgagttcaaataggtacactgagaagcagattgggtatctgtttatttccgtcctggtaaattccaattcagagctgattcgattgatcaacaacgcaattaagaccgaaagggacgtatccgtacggcagcgtgccgtggatctcttatacgcgatgtgtgacaggtctaacgcacctcagattgtggctgagatgcttagctacctggaaacagctgattattccatccgagaagagatcgtgttaaaggtggctattctcgcagagaaatatgcagtcgactatacatggtatgtggacacaattctgaatcttatacgaattgcgggcgactacgtgtctgaagaggtctggtacagagtgatccaaattgtgattaacagagatgatgtccaagggtacgcagcaaaaacagtcttcgaggctctccaggcccctgcgtgtcacgaaaatttggtcaaagtggggggatacatcctcggtgagtttgggaacttaatcgccggcgatcctagatcctctcccttaattcagttccacctgttacattcaaaattccatttgtgttctgtgcccacccgcgcgttgctgttgtctacttacattaagttcgtaaatctattccctgaagtgaaaccaaccattcaagacgttttacgatccgacagtcaattgaggaacgccgacgtggagttacagcagcgggctgtggaatacctaaggctgagtacggttgcatcgaccgatattttagcaaccgtgctggaggaaatgccaccttttccggagcgggaaagttccatcctggccaagctaaagaaaaaaaagggcccctccactgtgacagatttggaggacacaaaacgcgacagatccgtggatgttaatggggggccggagcccgcacccgccagtactagcgctgtctcaacaccttccccgtcggcagacctgctgggtctgggcgccgcgcccccggcccccgccgggcctcccccatcgtccggaggatccgggttgcttgtggacgttttttcagattccgctagcgtagtagcacctctcgcaccggggagcgaggataactttgctcgctttgtgtgtaagaataacggcgttctctttgagaatcagctcctgcagattggattgaagtctgagttccgccagaatctcggaagaatgttcatcttctacggcaacaagacctctacccagttcttgaatttcacccccaccctaatctgttccgatgatcttcagcccaacctcaatctgcaaacaaagcctgtggatccaaccgtcgaggggggagctcaagtccagcaggtggtaaacattgagtgcgtatccgacttcaccgaagccccagtgctcaacatccagttccggtacggtggaaccttccaaaacgtttccgttcagctgcccatcactctgaacaaatttttccagcccactgagatggctagccaggatttctttcagagatggaagcaattgagtaacccacaacaagaagttcagaacatattcaaagcgaagcatcctatggataccgaagtcaccaaagccaagataatcggcttcggcagtgctctgctggaggaggtcgaccccaatccggctaactttgtcggggccggaattatccacaccaaaaccacccagatcggatgtctgctcaggctggaaccaaacttgcaggcccaaatgtacagactgacgctcagaacctcaaaggaggccgtctctcaaagactgtgtgaactcctttcagctcaattttag

SEQ ID NO: 178124 - DNA, 2031 bp, Artificial Sequence
  Description of Artificial Sequence: Synthetic coding sequence
atgcccgccgtgagcaagggcgacggcatgcggggcctggccgtgttcataagtgacatcaggaattgcaaatcaaaggaggccgaaattaagcgcatcaacaaagagctcgccaatatcagaagcaaatttaagggagataaggctctggatggttacagtaaaaaaaagtacgtgtgcaagcttctcttcatcttcctgttgggtcacgacattgattttggtcatatggaggccgtgaacttgctcagctccaatcgatacacagaaaaacagattggctatctgtttattagcgtgctggttaatagtaactctgagctcatcagactaattaataatactgaacgcgacgtatcagtgcgccaacgtgcagtcgacttgttgtatgctatgtgcgaccggtccaacgccccccagattgttgccgaaatgctgagttacttagagacggccgactatagcattcgcgaggagattgtgctgaaggttgcgattctcgctgaaaagtacgctgtggactacacatggtacgttgatacaatcctgaatctcattcgcattgctggcgactacgttagtgaagaggtgtggtatagggtcatccaaattgtgataaatagagatgacgtgcaaggctacgctgcaaagactgtattcgaagccctccaagcaccggcctgtcacgaaaacctcgtgaaggtggggggctacatcctgggagagtttggcaacctgatcgccggcgaccctagaagtagtcctttgatccagtttcacctgctgcacagcaaattccacctgtgcagcgtgccaactcgtgcacttctgctctccacatatatcaagtttgttaacctgtttccagaggtgaaaccaacaatccaagatgtacttcggtccgatagccagctgcggaatgccgacgtggagcttcagcagcgagcagttgaataccttcgtttaagcaccgtggcaagcaccgacattctggccaccgtgctggaggagatgccaccattcccagaacgggagagcagcatcctcgccaaactgaagaagaaaaaaggcccatctactgtaaccgatctagaagatactaaaagagaccgaagcgtggatgtcaacggtggccccgaaccagcccctgcgagtacttcagccgtttcgactccgtcgccgagcgccgatcttctggggctcggggccgccccacccgccccagcaggaccacctcccagcagcggagggtctggactgcttgtcgatgttttcagcgattctgcttcagtggtagcccccctggccccaggctctgaggacaacttcgcgcgctttgtgtgtaaaaataatggagttttgttcgagaaccaactgttgcagattggcttgaaatccgagttcaggcaaaacctgggccgaatgtttattttctacgggaacaagacttctacccagtttctgaattttacaccaactctgatttgtagcgatgacctccagcccaatcttaaccttcagactaaacctgtcgacccaacagtcgaagggggtgcccaggtacagcaggtggtgaatattgaatgtgtgagcgatttcacggaagctccagttcttaacatccagttccgttatggtggaacatttcagaacgtttcagtgcagctcccaatcaccttgaataaattctttcagccaacagaaatggcatctcaagattttttccaacggtggaaacagctttcaaacccacagcaagaggtgcagaacatttttaaggctaagcatcctatggataccgaggtgacaaaagccaagataatcggattcggctcagcactgctcgaggaggtggatccaaaccctgccaacttcgtaggtgctggaataattcacacaaagacgacccagatcggctgtctcctaaggttagagccaaacctccaggctcagatgtaccggctgactttaagaacatccaaggaagccgtgtctcaacggctctgtgagctgttgtcagcccagttctag

SEQ ID NO: 178125 - DNA, 2814 bp, Artificial Sequence
  Description of Artificial Sequence: Synthetic coding sequence
atgaccgacagcaagtacttcaccaccaacaagaagggcgagatctttgaattaaaggccgaattgaacaacgaaaagaaagaaaaacggaaggaggctgttaagaaggtgatcgccgccatgacggtgggaaaagatgttagcagcctgtttccggacgtggttaactgtatgcagaccgataatttggaacttaagaagctcgtgtatctgtaccttatgaattacgcaaaatcccagcctgacatggcgatcatggctgtgaatagtttcgtgaaagactgcgaagatcctaatcccctcatccgcgcactggcagtgagaacgatggggtgtataagagtggacaaaatcacagaatatctctgtgaacctttaagaaagtgccttaaggatgaagacccctacgtgaggaaaacagccgccgtttgcgtcgccaaacttcacgatatcaacgcacagatggtggaagaccagggattcctcgattcattaagagatctgatcgccgattcgaacccaatggtcgtcgcaaatgccgtggccgctctgtccgagatcagcgagtcccatccgaactcaaacctcttggatttaaaccctcagaacatcaacaagctcctcaccgctttgaacgagtgcaccgaatggggtcaaatcttcatcttggattgcctaagcaactacaaccctaaggatgaccgcgaagctcagtcaatctgcgagcgcgtcacccctcggctgtcccatgccaacagcgctgttgtcctgtccgcggtgaaagttctgatgaaatttctggaactgctgcctaaggacagcgattactataacatgttactgaaaaagctggctcctcctctcgtgacactcctgagtggcgaaccagaggttcagtacgtcgcacttcgtaacatcaacctgatcgtgcaaaaacgccccgaaatcctgaagcaagaaattaaggtgttctttgtcaagtacaacgaccccatttatgtgaaactcgagaaactggatattatgatacgactggcatctcaggccaatatagcgcaggtgctagccgaactaaaggagtacgcaactgaagtggacgttgatttcgtgcggaaggccgtcagggccatcggtcggtgtgccatcaaagtggagcagagcgcagagcggtgcgtatcaactttactcgacctcatccagacaaaagtgaactatgttgtccaggaggcaatagtggtgattcgtgatatcttcagaaagtatcccaacaaatatgagagcatcatagccactctgtgcgagaacctggattccttggacgagcctgatgccagggccgccatgatttggatagttggggagtacgcagaacgaatcgacaacgcggatgagctgctggaatctttccttgaaggttttcacgacgaatcaacacaggttcaactcacccttttaactgccattgtgaaactcttcctcaaaaaaccaagcgagacgcaggagctggttcagcaagtgctttcgctagccacccaggattctgacaaccctgatctaagggacagggggtacatttattggcgattgctgagcaccgatccagttacagccaaggaggtggtcctttccgagaaacctttaatatccgaggaaacagatctgatcgaaccaacgctcctggatgaactgatttgccacatcggctccctggcttcagtgtaccacaaacctccgaacgcttttgtcgaggggagtcatgggatacaccgaaagcaccttcctatccaccacggctctacagacgctggggacagccccgttggaacaaccaccgctaccaacctggagcaaccacaagtgataccttcccagggggatcttctgggagacctgttaaacttggatcttggacctcccgtgaatgtaccacaagtatccagcatgcagatgggagcagttgacctccttggtgggggtctggacagcttggttggccagagcttcataccctcttcagttccggcaaccttcgccccctccccaacaccggcagtagtgagcagtggcctaaatgaccttttcgagctaagcaccgggatcgggatggccccaggagggtacgtcgccccaaaggccgtatggttgcccgcagtaaaagccaagggcttggagatctctggaacatttacgcatcgacagggtcacatatacatggaaatgaatttcactaacaaagccctccaacacatgactgatttcgccatccagttcaataaaaactcatttggagtcatcccttctaccccactggccatacacactcccctgatgccaaaccagagcatcgatgtgtccctgcccctgaatacactcggccctgtgatgaagatggaaccgcttaacaacctgcaggtcgcggtgaaaaacaacattgacgttttttactttagttgcctgattccactgaatgtcctctttgtcgaagatggtaagatggaaaggcaagtgttcctggctacatggaaggatattccaaacgagaacgaactccagtttcaaatcaaagaatgtcatctaaacgccgacacggtgagttcgaagcttcagaataacaacgtctacactattgctaagcggaatgtcgaaggtcaggatatgctttatcagagcttgaagctgacaaatgggatctggatcctcgctgagctccgcatccaacctggcaatccaaactacaccctttccctgaaatgcagagcaccagaggtgagccagtacatctaccaggtctacgatagtatcctcaaaaactag

SEQ ID NO: 178126 - DNA, 2856 bp, Artificial Sequence
  Description of Artificial Sequence: Synthetic coding sequence
atgaccgacagcaagtacttcaccaccaacaagaagggcgagatcttcgaactgaaagcagagcttaacaatgaaaagaaggagaagaggaaagaagctgtgaagaaggttatcgcagcgatgacagtggggaaagacgtcagctctctcttccccgacgtggtcaactgtatgcaaacggataacctggagctgaagaaattggtctatctgtacctgatgaattatgcaaagtctcagcccgacatggctatcatggccgtgaattcgtttgtcaaagattgcgaggaccctaatcctttgatccgcgcactggctgttagaacaatggggtgcatacgggttgacaaaatcaccgaatacctgtgcgaacctctgcggaaatgtctgaaagatgaggatccatatgtcaggaagacagccgctgtttgcgtcgcaaaactgcatgacattaatgcccagatggtcgaggaccaaggatttctggattccctccgagacctcattgcagactccaaccctatggtggttgcgaatgcagtcgctgccttatctgaaatatcggagtcccaccccaattctaatctactggacctcaatcctcagaatataaataaattgctgaccgctcttaacgaatgcacggagtggggacaaatctttatcctggattgtctgtcgaattataaccctaaggatgaccgggaagctcagagcatctgcgagcgagtgactccccgccttagccatgcaaatagtgcagttgtgctttcagccgttaaggtgctgatgaaattcttagagttacttccaaaagactccgactattacaacatgttgttgaaaaagttagccccacctctggtgaccttactatcaggtgagccagaggtgcagtacgttgctctgaggaatattaacctcatcgtgcagaagaggcctgaaattctcaagcaggagatcaaagtgtttttcgtcaaatacaatgaccctatatatgtgaagctggagaaactggacattatgataaggttagcctctcaagccaacatagcccaggtcttagccgaactcaaggagtatgctaccgaagtggacgtagatttcgtaagaaaggctgtgcgcgcaataggtcgctgtgccattaaggtggaacagtccgcagaacgctgcgtgagtacgctgctggatttaattcagacaaaggtaaactatgtggtgcaggaagcaatcgttgttatacgggatatttttcggaagtaccccaacaaatatgaatctattatcgctaccctttgtgaaaatctggattcccttgatgagccagatgctagggccgccatgatctggattgtgggggaatacgccgagaggatcgacaacgccgatgaactgctggaaagctttcttgaaggctttcacgatgaaagcactcaggttcagctaactctgttaacagccatcgttaagctgttcctgaaaaaaccgagcgaaacccaggaactggttcaacaggtgctaagcttggcgacacaggactcggataatccagacttacgagatcgtggatatatttattggcggctgctttccaccgaccccgtcaccgccaaggaagttgttctgagcgaaaagccgctgatctcagaggagacagatttaatagagcctacactgctcgacgaactcatctgccacattggatccctggcttccgtgtatcacaagcccccaaacgcctttgtggaggggagccatggcattcaccggaaacatctacccattcaccacggttctaccgacgcaggtgactcacccgtgggaaccactaccgccacaaatcttgagcagccccaggtaatcccttcacagggggacttgctgggggatctactgaatctggacctcggaccccctgtcaacgtgccacaggttagttccatgcagatgggagctgtggatcttctaggcggtggccttgactcattgctgggatcggacctggggggtgggatcggcggatcccccgcggtaggccagagtttcattccatcttctgtgccggccacttttgccccttccccaactcccgctgtggtgagcagcggtctgaatgacctgttcgaattatcaaccgggattggcatggcccccggcgggtacgtggccccaaaggcggtctggctcccagccgtcaaagctaagggattggagatatctggaacctttactcataggcaaggccatatatacatggaaatgaacttcactaacaaagctctacagcatatgacggattttgccatccaatttaataagaatagctttggggttattcctagcaccccactggccatacacacccctctaatgcctaaccaaagtatcgatgtgagcttacccctgaacacactgggccccgttatgaagatggagcccttaaataacctgcaggtggccgtgaagaacaatatcgacgttttctactttagctgcctgattccacttaacgtcctgttcgtggaagatgggaaaatggagcggcaagtattcctagccacttggaaagacatccccaacgaaaacgagttgcagtttcagattaaggagtgccacctgaatgctgacacagtgtcatcaaagcttcagaataataacgtatataccattgccaaacgcaatgttgaggggcaggacatgctttatcagtccctcaagctgacaaacggaatatggattctggcagagttaaggatccagccaggcaatcctaattacacactgagtctcaagtgcagagccccggaggtgtcccagtacatatatcaggtttatgatagtatacttaagaactag

SEQ ID NO: 178127 - DNA, 2856 bp, Artificial Sequence
  Description of Artificial Sequence: Synthetic coding sequence
atgaccgacagcaagtacttcaccaccaacaagaagggcgagatcttcgagctgaaggctgaacttaacaatgagaagaaagaaaaaaggaaggaagccgtgaagaaggtcatagcggcaatgacagtggggaaagacgtcagctctcttttccccgacgtagtgaattgtatgcagactgacaacctagagctgaagaaactcgtgtacttgtacctcatgaactacgcgaaatcccaaccagacatggccatcatggctgtcaacagtttcgtgaaagattgtgaggaccccaacccgctgatccgggccttagctgtcagaactatgggttgtatccgggtggacaagataacagaatacctgtgcgaacccttgcgcaagtgcctgaaggatgaagacccttacgttcggaaaaccgctgctgtttgcgtcgctaagctgcacgatatcaacgcccagatggtcgaggaccagggctttctcgattccttgcgcgatcttattgccgatagtaatccgatggtggtggccaacgccgtggcagccctcagcgaaatctccgaatcccaccctaattccaatttactggaccttaacccccagaatattaataagctactgacggcgctgaacgaatgcaccgagtggggccagatttttatcctggactgtctcagcaactacaacccgaaggatgacagagaagcccagtctatctgcgagcgggtgacgccgcgcctgtcccacgccaactcggccgttgtgctaagcgctgtgaaagtgttgatgaaatttctggagctgttacctaaagattccgactactacaatatgctcctcaagaagctggctccgccactggtgactctgctgagcggcgagcctgaggtccaatacgtggcccttagaaacataaacttgatcgtacagaaaagacctgaaatcctaaagcaggagatcaaggtgttcttcgtgaagtataatgaccccatatatgtgaagctcgaaaaactggacataatgattcggctggcgtctcaggccaatatagcccaggtgctggctgaacttaaggagtatgcaacggaggtcgacgtggatttcgtgcgcaaggccgtgcgtgctattggtcgttgtgcgatcaaggtggaacagtcagctgaacgctgtgtgtccacgctcctcgatttgatccagaccaaagttaattacgtggttcaggaagcgatcgtcgtaattagggacatatttcgcaagtatcctaataaatacgagagcattattgcaacactctgtgaaaatctggactcactggacgaacctgatgcacgcgcggccatgatatggatcgtgggagagtatgctgaacgaattgataatgccgatgagctcttggagtccttccttgagggcttccacgacgagtccacccaggttcaacttactttattaaccgcgattgttaagctttttctgaagaagccttctgaaacccaggagctcgtacagcaagtgttatcactggcaacccaggactcagataacccagatctacgggaccgtggctatatctattggcgtctgctctccactgaccccgttaccgccaaagaggtcgtgctctcggagaagcccctcatcagtgaagagaccgacctgattgaaccgacactgctagacgagctaatatgtcacatcggaagcttagccagcgtgtaccacaagcccccaaatgcctttgtggagggcagccacggaatccacaggaaacacctgcctatccaccacggatctacggacgccggcgatagccctgtgggtaccacaacagccactaaccttgagcagcctcaggtcattccgagccagggagacttgctcggtgacttgctgaacctggatttgggaccaccagtgaacgtgcctcaggtttcatctatgcagatgggcgctgttgacctgctcggaggaggacttgattctttacttggctccgacctcggaggaggcatcggcggctccccagcggtcggacagagctttatcccaagttctgtcccggccaccttcgccccatccccaactcccgccgtggtttctagtggactaaacgatctgtttgaattgtctacgggcataggaatggcacctggcggttacgtcgcacccaaagctgtgtggctgcctgccgtgaaagctaaagggctagagattagcggaacatttactcacagacagggacacatatatatggaaatgaattttaccaacaaggcgctgcagcatatgaccgattttgctatccagtttaataaaaacagctttggggtgatcccatccacacctcttgccattcacactcctctgatgcccaatcaatctattgacgtctctttgcccctcaataccctcggacccgttatgaaaatggaacccttgaacaatctgcaggtagccgtcaagaacaacattgatgtgttctactttagctgcttgatcccgctgaacgtgctgtttgtggaggatggtaaaatggaaaggcaggtcttcctggccacttggaaagacatccctaatgaaaatgagcttcaatttcagatcaaagaatgccacctaaatgccgataccgtgagcagcaaacttcaaaataataacgtctacaccatcgcaaagagaaacgtagaggggcaagatatgctctatcagagcttaaagctcacgaatggcatatggatcctggccgagctccgtattcaacccgggaatcctaactatactctctccctcaaatgcagggctcccgaggtgagccagtatatctatcaggtctatgactctatcctcaagaactag

SEQ ID NO: 178128 - DNA, 2643 bp, Artificial Sequence
  Description of Artificial Sequence: Synthetic coding sequence
atgcagaccgacaacctggagctgaagaagctggtgtacctgtacctgatgaactacgccaagtcccagcccgatatggccattatggccgtaaactccttcgtgaaggactgcgaggacccgaaccctctgatcagagccctggcagtgagaactatgggctgcatacgggtggacaaaataacggagtacctgtgtgagcccctgcgcaagtgtttaaaggatgaagacccctacgttagaaagaccgcagcagtctgcgtagccaagctacatgacatcaacgcacagatggtcgaggaccaaggctttttggattccctgagggatctaatcgccgatagcaaccctatggtagtcgcgaacgcggtcgccgctctgagtgaaattagtgagagccatcccaactccaacctgctcgacctcaatccccaaaacatcaataagttgcttacagctctaaacgaatgtacagaatggggccagatctttatcctcgactgtctcagtaactataaccccaaagatgatcgtgaggcccagtccatctgtgagcgcgtgacaccgaggttgtcccacgcaaactctgccgttgtcctctctgcagtgaaagtactgatgaaatttctggagttactccctaaggatagcgactactacaatatgctgctcaaaaaactcgcgccacccctcgtaaccctcctgtccggtgagcctgaggtacagtacgtagcattgaggaatattaacctgatagtccagaagcggcccgagatattgaagcaggagatcaaagtgttcttcgtgaagtataacgatccgatttacgtaaaactcgaaaagcttgatattatgatcagattagcgagccaggcaaatatcgcgcaggtgttagccgaattaaaggagtatgctactgaggtggacgtggattttgtaaggaaagctgtaagggcaatcgggagatgcgccatcaaagtggagcagtctgctgagcgttgcgtctctactctgttggatctgatacagacaaaagtgaattacgtcgttcaagaagccatagtggtcatcagggatatattcaggaagtaccccaacaagtatgagagcataattgccacactgtgcgagaacctagactccctcgacgaaccagacgcacgggcagccatgatctggattgtcggtgagtacgccgagaggatcgacaatgcagatgaacttttggaatcattccttgaggggtttcatgatgagtctacacaggtgcagctgacattgttgacagccatagtgaagctcttcctgaaaaagcccagtgaaacacaggagctggttcaacaagtgctgtccctcgctacccaggatagtgacaatccagacttgcgcgaccgaggctatatatactggcggcttctctccacagatccagttacagccaaagaggtggtgctgagcgagaaacccctgatctcggaggagacagatttaattgaacccaccctgctggatgagttgatatgccacatcggctcattagcatccgtttatcacaagccccccaatgcctttgtggaaggctctcatgggattcacagaaaacacctgcccattcaccacgggtctacagatgccggtgactcccccgtcggcaccaccacggccaccaacctcgaacagcctcaggtgatccccagccagggcgacttactgggggatctcctgaacctggacctcgggccccctgtcaacgtgccccaggtgtcatccatgcagatgggagccgtcgatctgttaggaggtggcctagactccctggtcggacagtctttcatcccctctagcgtcccagccactttcgcccctagtccaacccctgctgttgtgtcctcagggttgaacgacctgtttgagctctctaccgggattggcatggccccgggcgggtatgtggctccgaaggccgtgtggctgcctgccgtgaaagcaaagggactagagatctccggcacgttcacccacaggcagggccacatctatatggagatgaacttcacgaacaaggcccttcaacatatgactgacttcgctattcagttcaacaagaactcatttggtgtgattccctcgacgcccctcgctatccataccccactgatgccgaaccagtccatagatgtctcattgccacttaatacactggggccggtgatgaagatggagcctctgaacaacctgcaggtcgccgtcaaaaataatattgatgttttctatttctcttgtctcatcccacttaatgtcctattcgtggaagatggcaaaatggagcgacaagtctttctggccacgtggaaggacatcccaaatgaaaacgaacttcaattccagattaaagaatgccatctaaacgccgatacagtgtccagcaaactgcaaaacaacaatgtgtacacgattgccaaacggaatgtggaaggtcaggatatgctgtaccagagccttaagttgacaaacggaatttggattcttgcggaactacgcatccagccgggcaatcccaattacactctgtccctgaagtgtagagctccggaggtcagtcaatacatctatcaagtgtacgacagcatcttaaagaactag

SEQ ID NO: 178129 - DNA, 2067 bp, Artificial Sequence
  Description of Artificial Sequence: Synthetic coding sequence
atgaagttcctggagctgctgcccaaggacagcgactactacaacatgttactgaagaagttggccccccctctggttaccctgctctctggagagccggaagttcaatatgtcgctctgcgcaatataaacctgatagtgcagaagagaccagaaatcctgaaacaggaaatcaaggtcttctttgtaaaatacaatgaccccatctatgtcaaacttgaaaagctcgacattatgatccgtctggcttcacaggctaacatcgcgcaagtactggctgagctcaaggaatacgcaactgaggttgatgttgattttgtgcggaaagccgttcgcgccatcgggagatgtgctatcaaagtggaacaaagcgctgaacggtgtgtgtctaccctgcttgacctcattcagaccaaggtgaattatgtggtgcaggaggccattgtggtcataagggacatatttcggaagtatccaaacaagtacgaatccattatcgccacactttgcgaaaatctggactctctggacgaaccagatgcacgcgccgcgatgatttggatcgtgggagaatacgcagagcgtattgacaacgccgatgaattgctcgagtcatttctcgagggtttccatgatgagagcacacaggtacagctgaccctcctgactgcgatcgtaaagttgttcctcaaaaaaccttccgagacacaggagctggtgcagcaggtcctcagcctggccactcaggactcagacaatcctgatctccgggaccgcgggtacatatattggcggttactgagtaccgatccagtgactgcaaaggaggtggtcttgagcgaaaagcccctgatatctgaagagacagatttaattgagcccacactattagatgagctgatctgtcacatcggaagcctcgcctcagtatatcataagccgcctaatgcatttgttgaagggtcccacgggattcacagaaagcacctgcctatccaccacggcagtactgacgccggggactcccccgtcgggacaacaacagctacgaacctggaacagcctcaggtcattcccagccagggcgacctcctcggcgatctgctgaatctcgacctcggtccgccagtcaacgtgcctcaagtgtcttccatgcagatgggggcagtggacttgctgggcggcggcctcgatagtctgctgggttcagacctgggcggtggcatcggcgggtcgccagcagtggggcagagtttcattccatcttctgtgcccgccacctttgcccctagccctacacccgccgtggtgtctagcggcctgaacgatctgttcgagcttagcaccggtattggaatggcccctgggggttacgtagcccctaaagccgtgtggctgccagctgtgaaagcgaaaggcctagagatctctggaacattcacccacagacagggacacatctacatggagatgaacttcaccaacaaagctttacaacacatgactgattttgcaattcagtttaataagaatagtttcggcgtgattccctctacgcctctggcaatccatacccccttgatgcctaaccagtctattgacgttagtctccctctcaacacattgggaccagtgatgaagatggaacctctgaacaatctgcaggtcgctgtgaagaacaatattgacgtgttttatttttcgtgtctgatccctctcaacgtacttttcgtcgaagacgggaagatggagcgccaggtttttctggcaacatggaaagacataccaaacgaaaatgagctgcagtttcagattaaggagtgccatctcaacgccgatacagtttctagtaagctgcagaacaataatgtgtacaccattgcaaagcggaacgtcgagggccaggatatgttataccagtccctgaagctgacaaacggtatctggattttggctgagctgcgaattcagccaggcaacccaaactacactctgtcactgaagtgtagagctcctgaagtcagccagtatatctaccaggtctatgattccatcctgaagaactag

SEQ ID NO: 178130 - DNA, 1308 bp, Artificial Sequence
  Description of Artificial Sequence: Synthetic coding sequence
atgatcggcggcctgttcatctacaaccacaagggcgaggtgctgatctcaagggtgtaccgcgacgatataggacggaatgcggtggatgcattcagagtgaacgtcatccacgcccgacagcaggtgaggtctccagtcacaaatatagcacggacatctttcttccacgtgaaaagatccaacatctggcttgccgcagtcaccaagcagaatgtgaatgcagccatggtattcgagtttctttataagatgtgcgacgtcatggcagcctactttgggaagatcagcgaagaaaatatcaagaacaacttcgtactgatttacgagctactcgacgagatcctcgatttcggctatccacagaactccgaaactggggctctgaagacctttataacccagcaggggatcaagtcacagcaccagacgaaagaggaacagagtcaaatcacatcccaagtcacagggcagattggatggcgccgggagggcatcaaataccgcagaaacgagctgttcctggatgtgctcgagtctgttaaccttctgatgtcccctcaaggacaggtgctgtcagcccacgtcagcggccgcgttgtgatgaaaagctacctgagcggaatgcccgagtgcaaatttggcatgaacgacaagatcgtcatcgaaaaacagggcaaagggacagctgatgaaaccagcaaatcaggcaagcagtctatcgccatcgacgattgtacatttcatcaatgtgttagattgtccaaatttgactctgaaagatccatcagctttattccacctgatggcgagttcgagcttatgcgttataggactaccaaagatattatactgccttttcgagtgattcccttggttagagaggttgggcggactaaacttgaagtgaaggtggtgatcaagagtaacttcaagccctctctgctggcacagaaaattgaggtgcgaattcctacaccactgaataccagcggcgttcaggtgatttgtatgaaaggaaaggcgaagtacaaagcatcagaaaatgccattgtgtggaaaattaagcggatggcaggaatgaaagaatcccagatctctgccgaaattgaactgctgcccacaaacgataaaaagaagtgggcccgaccacctataagcatgaatttcgaagtgccctttgccccgtctgggctgaaggtgcggtaccttaaggtctttgaaccgaagctcaattattctgaccacgacgtcattaaatgggtgcgctatatcggacgcagcggtatctatgagactagatgctag

SEQ ID NO: 178131 - DNA, 1302 bp, Artificial Sequence
  Description of Artificial Sequence: Synthetic coding sequence
atgatcggcggcctgttcatctacaaccacaagggcgaggtgctgatctctcgtgtgtacagggatgacatcggaaggaatgcagtggatgcttttcgggttaacgtcattcatgccagacaacaagtgcgctctccggtaactaacatcgccaggacctcattttttcatgtcaaaaggtctaatatatggctggctgccgtcacgaagcagaatgtgaatgctgcgatggtgttcgagttcctgtacaagatgtgcgatgtaatggccgcctacttcggcaagatttctgaggagaatattaaaaataattttgtattaatatacgagctgcttgacgagatcctggatttcgggtacccacagaattccgagacaggcgcgttgaagacctttatcacacagcaaggcatcaaatcccagacaaaggaggaacagtcacagattacctcccaggtgacaggtcaaatcgggtggaggcgtgaagggattaaatatcgacggaacgagctgtttctcgacgtgctggaatctgtgaatttactcatgagtcctcaagggcaagtcctgagcgcccatgtctccggccgagtggtgatgaaaagttatttgagtggcatgcccgagtgtaagtttggcatgaacgacaagatcgttattgagaaacagggaaaggggacagccgacgaaacgtctaaatccgggaagcagtctatcgctatcgatgactgtacttttcaccagtgtgtgcgccttagcaaattcgacagcgaacgctccataagtttcatccccccggatggcgagtttgagttaatgcgttaccgcaccactaaggacatcatcctgcccttcagagttattccactagtgcgggaggtgggcagaaccaagctggaggtgaaggttgtcattaagtccaatttcaagccttccctgttagcccagaagatcgaggtccgtatccccacccccctcaacacctccggagttcaagtcatatgcatgaagggcaaggccaagtacaaagcctccgaaaacgcgattgtctggaagatcaagcggatggccgggatgaaggagtcacagattagtgcggagatcgagcttctgcccactaatgataaaaagaagtgggctaggccgcccattagtatgaacttcgaggtgccatttgccccaagtggacttaaggtgcggtacttaaaagtctttgagcccaagctcaactacagcgatcacgatgtgattaaatgggttcggtacatcggtagaagcggaatctatgagacacgctgttag

SEQ ID NO: 178132 - DNA, 1302 bp, Artificial Sequence
  Description of Artificial Sequence: Synthetic coding sequence
atgatcggcggcctgttcatctacaaccacaagggcgaggtgctgatcagccgagtgtacagagacgacatcggcagaaatgctgtcgacgcttttcgtgtcaacgtgatacacgcacgacagcaggtcagaagcccagtgacgaatatagcacggacctctttcttccacgtgaaaaggtccaacatctggctggcagcggtaaccaagcagaacgttaatgcagccatggttttcgagttcttgtataaaatgtgtgatgtaatggcagcctacttcggaaagatatccgaggaaaatataaaaaataatttcgtcctcatctacgaattactcgatgaaatcctcgatttcggttacccgcagaatagtgaaactggagcgctgaaaactttcatcacacagcagggcataaagtcacagacgaaagaagagcagtcgcagatcacctcccaggtgaccgggcagattgggtggaggcgcgaagggattaaatataggcgcaacgaattgttcctggacgtcctggagagcgttaacttgttgatgtccccgcagggacaggtcctgagtgcccatgtgagcggccgggtcgtcatgaagtcatacctgtccggtatgccagagtgcaagttcggcatgaacgataagattgtgattgaaaaacaggggaaggggaccgccgatgagacaagtaaaagtggcaaacagtcgatcgccattgatgattgcacattccaccaatgcgttagactttccaaatttgattctgaacgcagtatttccttcattcctcccgacggggagtttgagcttatgaggtacagaaccacaaaggacattatcctgccattccgggttatacccctggtcagagaggtgggcagaacaaaactggaggtgaaggtcgtgatcaagagcaacttcaagccatcgctactcgctcagaagatagaggtgagaatcccgaccccgctgaatacctctggcgtgcaggtgatctgcatgaaagggaaggcaaagtataaggcctccgaaaatgccattgtatggaagattaaaagaatggctggaatgaaagaaagtcagatcagtgcagaaatcgaactgctcccgacaaatgataaaaaaaaatgggcgcggcctcccatctctatgaatttcgaggtaccattcgctccgtcaggacttaaggttcgctaccttaaggtcttcgagcctaaactgaactacagcgatcacgatgtaatcaaatgggtgcgttatattggaaggagcggcatttacgaaacccgctgctag

SEQ ID NO: 178133 - DNA, 342 bp, Artificial Sequence
  Description of Artificial Sequence: Synthetic coding sequence
atgatcggcggcctgttcatctacaaccacaagggcgaggtgctgatcagccgagtgtatcgggacgacattggaaggaatgccgtggacgcatttagggtgaatgtcatacacgcccggcagcaggtgaggtcccccgtcactaacatcgccaggactagcttcttccacgtgaagaggtccaacatctggctggccgctgtgactaagcagaacgtgaatgcagctatggtctttgaattcttatacaagatgtgcgatgttatggccgcctactttggaaagatttccgaggaaaatatcaaaaataacttcgtgctgatctatgaacttctggattag

SEQ ID NO: 178134 - DNA, 1263 bp, Artificial Sequence
  Description of Artificial Sequence: Synthetic coding sequence
atgatcggcggcctgttcatctacaaccacaagggcgaggtgctgatcagtcgtgtttatcgagacgatatcggacgtaacgcggttgatgccttccgcgtcaacgtgattcacgcgagacaacaagtccggagccctgtgactaatatatggctagcagcagtgacaaagcagaatgtcaacgcagccatggtatttgagttcctgtacaagatgtgcgacgtgatggcagcctacttcggaaagatctccgaagagaacatcaaaaataactttgttttaatttatgaactactcgatgagattcttgactttgggtaccctcaaaattctgagaccggcgccctgaaaacctttattactcagcaggggattaagagtcaaaccaaagaggagcaatcgcagattacatcccaagtaactggccagataggctggcgacgagaaggcatcaaatacaggagaaatgagctttttctggatgttcttgaatctgttaatctgctaatgtctccccagggtcaggtattgtccgcccatgtaagcgggagagtcgtgatgaaaagctacctatccgggatgcccgaatgcaagttcggcatgaacgacaagattgtcatcgaaaaacagggtaagggtacggcagatgaaacctcaaaatccggtaaacagtctatcgctatagacgattgtacttttcaccagtgcgttcgtctttctaaatttgacagcgaacgcagcataagcttcattcctcctgacggggaattcgaactcatgcgctatcgtacaacaaaggatatcattttgccctttcgggtgattcccctggtgcgggaagtgggacggaccaaattggaagtcaaagtagtgattaaaagcaacttcaaacctagtctgctggctcagaagatcgaagttagaataccaactcccctgaataccagcggagtgcaggtaatctgcatgaaaggtaaggctaaatataaagcgtccgagaacgctattgtgtggaagatcaaacggatggcggggatgaaggagtcccaaattagcgcagaaatcgagttactgccaactaacgacaagaagaaatgggctagaccccctatcagcatgaacttcgaggtaccctttgcacctagcggcctcaaggttaggtacctgaaagtgttcgaaccaaagctgaattatagcgaccatgacgtgattaaatgggtgaggtatatcgggcggtccggtatctatgagacccgatgttag

SEQ ID NO: 178135 - DNA, 1128 bp, Artificial Sequence
  Description of Artificial Sequence: Synthetic coding sequence
atgatcggcggcctgttcatctacaaccacaagggcgaggtgctgattagccgagtttatagagacgacataggcagaaacgccgtcgcggcttatttcgggaagatcagtgaagaaaacatcaagaataatttcgtactaatatacgaattgctggacgagatcctggatttcggatatccacagaatagtgagaccggggctctaaaaaccttcatcacacagcaagggattaagtcccagcatcaaaccaaggaggaacagtcccagataaccagccaggtgaccggacagatcggctggcgtcgcgaggggatcaagtacagacgcaatgagctgtttctggatgtgcttgaaagcgtaaatttgctgatgagcccccagggacaggtgctaagcgcccacgtgagtggtcgcgtggtgatgaagagctacttatccggaatgcctgaatgcaaatttggcatgaacgacaaaatcgtgatagaaaagcagggcaaggggacggctgatgagacgtctaaaagcgggaagcagtctatcgcaatcgacgattgcacttttcatcagtgtgtgcggctgtctaagtttgatagcgagcgctctatctccttcatccccccagatggggaattcgaactcatgcgctaccgcaccaccaaggacatcattcttccgttccgggtcattcctctggtgagggaagtgggtcgaactaaactggaagtgaaggtcgtcattaagtcaaacttcaaaccaagcctcctagcccaaaaaattgaagtgcggattccgacccccctgaacacaagcggtgtccaggtcatttgcatgaaggggaaggccaagtacaaagcgagtgagaacgctatcgtatggaagatcaagagaatggctggcatgaaggaaagtcagattagtgcggagattgagttgttgcctaccaatgataaaaagaagtgggcccggcccccaatctcgatgaattttgaagtcccttttgccccgtccggtctcaaagtgagatacctcaaagtgttcgagcccaagctcaattatagcgaccacgacgtaattaagtgggtaagatacatcgggaggtctggcatttatgaaacacgttgttag

SEQ ID NO: 178136 - DNA, 429 bp, Artificial Sequence
  Description of Artificial Sequence: Synthetic coding sequence
atgatccggttcatcctgatccagaaccgggccggcaagacccggttagccaagtggtacatgcaatttgacgacgacgaaaaacagaagctcatcgaagaagtccatgccgtggtcactgttcgggatgctaaacacacgaactttgtggagttcaggaattttaaaataatttatcgcagatacgcgggcttgtatttctgcatttgcgttgacgtgaatgacaacaacctcgcctaccttgaggctattcacaacttcgtggaggtgcttaatgagtacttccacaacgtttgtgagctggatttggtgttcaatttctacaaggtctacaccgtcgtcgacgaaatgtttcttgcgggggaaatccgcgagactagccagaccaaggtcctgaaacagctgctgatgcttcagtctttggagtag

SEQ ID NO: 178137 - DNA, 315 bp, Artificial Sequence
  Description of Artificial Sequence: Synthetic coding sequence
atgatccggttcatcctgatccagaaccgggccggcaagacccggcttgccaagtggtatatgcagtttgacgacgatgagaagcagaagctgatcgaggaggttcatgccgtggtgaccgttcgcgacgctaagcacaccaactttgtggaggtattaaacgagtatttccacaatgtctgtgagctcgatctggtctttaacttctataaagtatatacggtggtcgatgagatgtttctcgccggggaaataagggaaacctcacagacaaaggtgctgaaacaacttctgatgctgcagtccctcgagtag

SEQ ID NO: 178138 - DNA, 3285 bp, Artificial Sequence
  Description of Artificial Sequence: Synthetic coding sequence
atgagcagcaacagcttcccctacaacgagcagagcggcggcggcgaggcaactgagctcggtcaagaggcgacgtccaccatctccccctcgggcgcattcggcttatttagttccgatctcaaaaagaatgaggatctgaagcagatgctagaaagtaacaaagactctgcgaagctggatgccatgaagcgaattgtgggaatgatagccaagggaaagaatgcgtctgaactgttcccggctgtcgtcaaaaatgttgctagcaaaaatatcgagattaagaaacttgtctatgtctatctggttagatacgccgaagagcagcaggaccttgcactcctaagtatctccacttttcagagagccctcaaagatcccaaccaactcattcgggcatctgctctgagagtgctgagttctattagggtgccaattatcgttccaataatgatgttagccataaaggaggcctctgcagaccttagtccttatgtgaggaagaacgcagcacacgcaatccagaagctctatagcctcgatcccgaacagaaggaaatgttaatcgaggtgatcgaaaaacttttgaaggacaagtcaaccctcgtcgctggaagcgtagttatggcattcgaggaagtctgccccgacaggattgacctgatccacaaaaattatcggaagctctgcaacttgctggtcgatgtggaggaatggggacaggtggtaattattcatatgctgactagatacgctcggacccaatttgtttcgccttggaaagagggtgacgagttggaagacaatggcaaaaatttctacgagtccgatgacgaccagaaagaaaagaccgacaagaagaaaaaaccttatactatggatcccgatcatagactacttataaggaataccaagccactgctgcagtctcggaatgcagcagtcgtgatggcggtggcccagttatattggcacatatccccgaagagtgaagctggcatcatttcaaagtcactagtacggttattgcgcagtaatagagaagtccaatatattgtgttgcagaacatcgcaaccatgagcattcagcgcaaggggatgttcgaaccatacttgaagtctttctacgtccgttcaaccgaccccacgatgatcaagactctcaaactcgaaatccttactaatttggccaatgaggccaatatttctacccttctcagagagttccaaacatatgttaaaagtcaggataagcagtttgcagccgctaccattcaaacaattggacggtgcgctacaaatatcctcgaggttacagacacttgcctgaacggcctggtctgcctcctctctaaccgggatgaaatagtcgtcgctgaaagcgtggtcgtgattaagaaactgctgcagatgcagccggcgcagcacggagagataatcaaacacatggctaagctgctagattcaatcacagttccagtggcccgcgccagcattctgtggcttattggtgaaaattgcgagagagtacccaagatagccccagacgtgctgcggaagatggctaaaagttttacatcagaggacgaccttgtcaaattacagatactgaatctcggggctaaactgtatctgaccaacagcaagcagaccaagctactgacacaatacatcctgaatcttggcaaatatgaccagaattatgacataagagaccgcacaaggtttatacgccagctgatagtgcccaacgtgaagagcggtgccttgagcaaatacgccaagaaaattttcttagctcagaaaccagcacctctcttagaatctccttttaaagatcgcgaccatttccagcttggaaccctgtcgcacacactgaacataaaggccactgggtatctcgagctatcaaattggcctgaggttgctccagatccaagcgtgcggaatgttgaggtcatagagctggctaaagaatggaccccagcaggaaaggctaagcaggaaaatagcgctaagaaattttacagtgagagcgaggaggaggaagactcaagcgactcgtcatcagattctgaatctgagagcggcagcgagtcaggggaacagggggagagcggagaagaaggcgattcaaatgaggacagctccgaagattcttcttctgagcaagacagtgagagtggacgagagtccggactcgagaataaacggactgctaaacgtaacagcaaggcaaagggcaagtccgattcagaggacggtgagaaggaaaacgaaaagtccaaaacctcagattcctctaacgacgagtcctcctctatagaggactcatcatctgacagcgaatcagagagcgagcctgaatctgaaagcgagagccggcgcgtgaccaaggagaaagaaaaaaaaactaaacaagatcgtacacccctgactaaggacgttagcctactggatttagacgacttcaaccctgtctccacccctgtggccttgccaactccagccctctcccccagcctcatggccgatcttgaagggttacaccttagcacaagttccagtgtgatctcagtttctaccccagcctttgtgcccacgaaaacccatgtgctgttacacagaatgagcggaaagggactggcagctcattatttctttccccggcagccgtgcatatttggcgacaagatggtttctatccagattactctgaataacaccacagacagaaagattgagaacattcacatcggggagaaaaaattgccaatcggcatgaaaatgcacgtattcaaccctatcgactctctagaaccggaggggtcaatcaccgtttccatgggcatagacttttgtgactctacccaaactgccagtttccaactatgtacaaaggacgactgttttaatgtaaatattcagccccctgtaggcgagctcttgctccccgtcgccatgtctgagaaggatttcaaaaaggaacagggcgtgcttactgggatgaacgagacttcagcagtgattattgctgctccccagaacttcacaccaagtgtcatttttcagaaggtcgtcaatgtggctaacgttggggctgtaccctctgggcaggacaacattcatagattcgccgctaagacagtccattcgggcagccttatgctcgtgacggtggagctcaaggaagggtcgacagcgcagctgatcataaacaccgagaaaactgtaatcggcagcgtcctgctgcgcgaactcaagccagtgctgtctcaagggtag

SEQ ID NO: 178139 - DNA, 1698 bp, Artificial Sequence
  Description of Artificial Sequence: Synthetic coding sequence
atgagcagcaacagcttcccctacaacgagcagagcggcggcggcgaggccactgaactggggcaggaagcaacctcaacgatttccccaagtggcgcatttgggctgttcagttccgacctgaagaagaatgaggacctcaagcaaatgctggagtctaataaggacagcgccattaaggaggctagcgccgatctgagcccttatgtacgaaagaatgctgcccacgccatccagaagctatattccttagaccccgagcagaaggagatgttgatagaggtcatagagaaattactgaaggataagtctacactggtggccggctccgtggtcatggctttcgaagaagtctgtcccgacagaatcgacttaatccacaagaattacaggaagttgtgcaacctactggtggacgtggaggaatggggacaggtggtgattatacatatgctcactcgatacgccagaacccagttcgtaagtccatggaaagagggggacgagctggaagacaatggaaaaaatttttacgaatcagacgacgatcaaaaggaaaaaacagataagaagaaaaagccctacacaatggatcctgatcatcgcctactcatccgcaataccaagcccctgcttcaaagcaggaacgccgccgttgtcatggcggtggctcaactgtactggcacatttcgcccaagagtgaggcgggcatcatcagtaaaagtctcgttaggctcttaaggagcaatagagaggtacaatatattgtcctgcagaatatagcaaccatgagcatacagcggaagggaatgttcgaaccctaccttaagagtttttacgtaaggagtactgatcccacaatgataaagacactcaaactagagattcttacaaatttagctaacgaggccaacatctcaacactgttacgggaatttcagacctacgtgaaatctcaggataagcagtttgccgctgctactatccagacaatcggtagatgcgccacaaatatactggaggttacagatacctgcctgaatggactggtctgcctgttgagtaatagggacgagatagtcgtcgctgagtcggtggtggtgatcaaaaagttgttacaaatgcagcctgcccagcacggagaaatcatcaaacatatggccaagcttctagactcaattaccgtccctgttgctcgggccagtattctatggctgattggggagaattgcgagcgtgtgcctaaaatcgcccccgacgtgctgagaaagatggcaaagtcgtttacctccgaggatgacctggttaagttgcagatcctaaatttgggggcgaaattatatctgacgaatagcaagcagactaagttactgacacagtatatcctgaatctagggaagtacgatcaaaactatgacattcgcgacagaacgcgcttcattcggcagttgatcgttcccaacgtgaagtctggggcactttccaaatatgccaagaagatcttcctagcccaaaagcctgcgcccttactggaatcaccattcaaggacagagatcactttcagcttggcacactcagccacactctcaatatcaaagccacaggttacctagagctgagtaattggccggaagttgcaccggatccctccgtcagaaatgtagaggtaattgagctcgtagtgctgagtgagtag

SEQ ID NO: 178140 - DNA, 2403 bp, Artificial Sequence
  Description of Artificial Sequence: Synthetic coding sequence
atgagcagcaacagcttcccctacaacgagcagagcggcggcggcgaggctacggaactgggccaggaggcaactagtactatctcgccttctggggccttcggcttatttagcagcgacctcaagaaaaatgaggatctgaagcagatgttggagtccaataaagactcggcaaagctggatgcgatgaagcgcattgtcgggatgattgccaaggggaagaatgcctccgagctctttcctgccgtggtgaagaatgtcgcctcaaaaaacattgaaattaagaagctggtctatgtctacttggttcgatatgctgaggagcagcaggacctggcactactttctatcagtaccttccagagggctttaaaagaccccaatcagctgattcgcgcaagtgcactgcgggttctctccagcatccgggtgcccatcatcgtgcccatcatgatgctcgcaatcaaagaagcttcggccgacctttcgccatatgtccgtaaaaatgccgcacacgctatccaaaaactttattctctcgatcctgagcagaaagaaatgctgatcgaggtaatagagaagctgctcaaggacaaaagcacactggttgctggcagcgttgtgatggcctttgaggaagtatgcccagaccgcatcgatttaatccataaaaactataggaaactgtgcaatctgctagtcgacgtcgaagaatggggtcaggtcgtaatcatacatatgctaacccgctacgccaggacacaattcgtgtcaccttggaaggaaggtgacgagttagaggacaacggcaagaatttttacgaatccgacgacgatcagaaggaaaaaaccgacaagaaaaaaaaaccttataccatggaccccgaccaccggctcctgattagaaatacaaaaccgctcctccagtctagaaacgcggccgtcgtaatggcagtggcacagctgtattggcacatctcccccaagtccgaggccggaataatctctaagtccttggtacggctcttgcgctctaacagagaggttcagtatattgtgctgcaaaatatcgcaactatgtctatccaacggaagggcatgttcgagccatatctgaagtctttctacgtgcgttcaaccgatccgactatgatcaagacattaaagctcgaaatcctcaccaacctagctaacgaagccaacatcagcactctgctgcgtgagttccagacctacgtcaaaagccaggacaagcagtttgcagccgccaccatccagaccattggccggtgcgccaccaacatcttagaagtgaccgatacatgcctaaatggactggtttgcctgctctcgaacagggacgagattgtggttgctgagagcgtggttgtcatcaagaaactgctccagatgcagcccgctcagcacggagagattattaaacatatggctaaattgctggactctattactgtgccagtggctcgcgcctctatactgtggttgattggagaaaactgtgagagggtaccgaaaatagcaccagacgtgttgcggaaaatggcaaagtcatttactagtgaagatgacctggttaaactgcaaattttaaacctcggcgccaagttatacctgacaaactctaagcaaacaaagctgctgacccaatacattctgaacctcggaaaatatgatcaaaattacgacatcagagaccgcacaaggtttattaggcagttaattgtccccaatgtgaagtcgggagcactgagcaaatatgccaaaaagattttcctggcacaaaagcccgccccacttcttgagagtccatttaaggatcgggatcattttcagctggggactctctcgcatactctgaacattaaggctacaggctacctggagctatcgaactggcctgaggtggctccagacccatccgtgcgtaacgtggaggtcatagagcttgctaaagagtggacacccgccgggaaagccaaacaagagaacagtgcaaagaagttctacagtgagagcgaagaagaggaagactcctccgacagctcttctgactccgagagcgaatctggatctgagagcggcgagcagggagaatcaggcgaggagggtgactctaacgaagacagcagtgaggattcatcgagcgaacaagattccgagtctggccgtgagtccgggcttgagaacaaacgaacagcaaaacggaatagcaaggccaaagggaagagtgactctgaagatggcgagaaggaaaacgaaaagtccaaaacatccgacagttctaatgatgagagttctagcattgaagattccagcagtgactcagaatccgaaagcgaacccgaatccgagagcgaaagtcgaagagtcaccaaagagtag

SEQ ID NO: 178141 - DNA, 582 bp, Artificial Sequence
  Description of Artificial Sequence: Synthetic coding sequence
atgatcaaggccatcctgatcttcaacaaccacggcaagccccggctctcgaagttttatcagccctattcggaggacacccagcagcagattatcagagaaacttttcatctggtttccaaacgtgatgaaaacgtgtgcaatttcctcgaagggggcctgttgatcggcggttcagacaataaattgatttaccggcactacgctacactgtacttcgtgttctgcgttgatagtagcgagtcagaactgggcattctggatctgatccaggtgttcgtagagacactagacaagtgctttgagaatgtttgtgagctggatcttatcttccatgttgataaagttcacaatatcttggcagagatggtgatgggcggtatggtcctggaaacaaacatgaatgagatcgtgactcagatcgacgctcagaacaagctggaaaagagcgaagccggtctggctggggctcctgcgcgcgccgtgtctgctgtgaagaacatgaatcttccagagatccctagaaacattaatatcggggatataagtattaaagtgcctaatcttccgtcattcaaatag

SEQ ID NO: 178142 - DNA, 450 bp, Artificial Sequence
  Description of Artificial Sequence: Synthetic coding sequence
atgatcaagttcttcctgatggtgaacaagcagggccagacccggctctccaaatattacgaacacgtggacattaataagcggacactgcttgagaccgaggtgattaagagctgtctctccaggtcgaatgaacagtgctcattcatcgaatacaaagacttcaagctgatataccgccagtatgctgccctgttcatcgtggtcggcgtcaatgataccgagaacgaaatggctatctatgagtttatccacaattttgtagaagtccttgatgagtacttctctcgcgtgtccgaattggatgtatctttctttaacacagtcttccacagtacttggcagatgcacagtggcccatatcagaccaggagttgttcggtgacacaggccggagtgcaaagatgcgaccacggttcactgcaccccggatcacctgggctgaaatag

SEQ ID NO: 178143 - DNA, 408 bp, Artificial Sequence
  Description of Artificial Sequence: Synthetic coding sequence
atgatcaagttcttcctgatggtgaacaagcagggccagacccggttgtctaaatattatgaacacgtggatatcaataaacggacactgctagagacagaggttattaagtcatgcctttcgagatcaaatgaacagtgttcatttatcgaatacaaagatttcaagctgatttaccggcagtatgcagcactattcatagtggtcggagtgaatgataccgagaatgaaatggcgatctatgaatttattcacaattttgtggaagtgttagacgagtatttctctcgtgtggaacctattgacgagctccctaagatctgttctgccctggagcctcagcaaacatgtttctcacctgattcgtcatctttcaaaggcgccgctagtacgacacccatttactag

SEQ ID NO: 178144 - DNA, 2220 bp, Artificial Sequence
  Description of Artificial Sequence: Synthetic coding sequence
atgccctacctgggcagcgaggacgtggtgaaggagctgaagaaggccttgtgtaacccccacatccaggctgaccgcctcaggtaccgcaacgtaattcagagagttattaggtacatgactcagggcctggacatgtctggcgtgtttatggagatggtgaaagctagcgccaccgtggacatcgttcaaaaaaagttggtttatctctacatgtgtacgtatgcgccccttaaacctgatcttgctctccttgccattaataccctttgtaaagattgctccgaccctaaccctatggtccgcggccttgccctgcgatcgatgtgtagcctgcgtatgcccggggtgcaggagtatatccagcagcccattctgaacggactccgcgacaaagcctcttatgtaagaagggtggcggtcttggggtgcgctaagatgcacaatctgcatggcgactccgaggtcgatggggccttggtaaacgagctgtatagtttgctgagggaccaggaccctatcgtcgtcgtgaactgcttgcgctctcttgaagagatcctaaagcaggagggtggggttgtgattaataaacccatcgcgcatcacctgctaaaccggatgagtaaacttgaccaatggggccaggccgaggtgttgaattttctgctaaggtatcagccgcgctccgaggaggaactatttgatatactgaacctcctggactccttcttaaaaagtagttcgccaggcgtggttatgggggcaactaagctgttcctaatactggccaaaatgtttccacacgtgcaaaccgacgtcttggtgagagtaaagggtcctctcctggcagcctgttccagcgagagcagggagctctgtttcgttgcgctctgtcatgtaaggcaaatccttcattctctccccggccatttctcttcccattacaaaaagtttttttgctcatattcggaacctcactacatcaagctccagaaggtagaggtgctctgcgagctcgtgaatgatgaaaatgtccagcaggtcctggaggaattgagaggctactgcactgatgtgagcgcagactttgctcaggctgccatcttcgctattggcggcatcgcaaggacctacaccgaccaatgcgtccagattctgaccgaactgctgggtttacggcaggagcacatcacaacagtggtggtgcagacatttcgagatctggtgtggctttgtccccagtgtaccgaggcagtttgccaggcactgcctggctgcgaagagaacatacaagatagcgaggggaagcaggccctcatctggttgcttggcgtgcatggggaacggattcccaatgccccctacgtcctagaagacttcgtggagaacgttaaatccgaaaccttccctgctgtgaagatggaactcttgactgcgttgttgcgcctcttcttgtctaggccagctgaatgtcaggacatgctcggcaggttactgtattattgcatcgaggaggagaaggacatggccgtgcgagaccggggcctgttttactatagacttctactggttgggatcgatgaggtgaaaaggatactttgttcccccaaaagcgacccaactctggggctgctggaagatcccgctgaacgcccagtgaactcatgggcctctgacttcaatacgctggtgcctgtatacggcaaggcccattgggcaaccatctctaagtgtcaaggggctgagaggtgtgatccagaacttccaaagacaagtagcttcgctgcgtccggcccgctgatcccagaggagaataaggagagagtccaggagctgcccgactcaggagctctcatgttggtgcccaatcggcagctgaccgcggactacttcgagaagacctggctgtctctaaaagtggctcatcagcaggtgctgccctggagaggcgagtttcaccctgatactctgcaaatggcccttcaggtcgtcaatatccagacaatcgctatgtcacgggccggcagtcgcccatggaaagcatatctgtccgcacaggatgacaccggctgtcttttcctaaccgagctgctactggaacctggaaattcagagatgcagatctcagtgaagcaaaacgaagcccgaacagagactctgaattcgttcatctcggttttggagactgtgatcgggactatagaagagatcaaaagctag

SEQ ID NO: 178145 - DNA, 891 bp, Artificial Sequence
  Description of Artificial Sequence: Synthetic coding sequence
atgccctacctgggcagcgaggacgtggtgaaggagctgaagaaggctctgtgcaaccctcacattcaggctgatcgcctgagatacagaaatgtgattcaaagggtaatcaggatgccaggcgtgcaagaatacatccaacaaccaatcctaaacggccttcgggacaaagcatcttacgtgcgtcgcgtagccgttctgggctgcgccaagatgcacaatctccacggcgatagcgaggtggatggagctctggtcaatgaactatacagcctgctccgggatcaggaccccatcgtggtggtgaattgcctccgttctctggaggaaattctgaaacaggagggtggggtggtgatcaacaagccaattgcccaccacttactgaaccgcatgagtaagttggaccaatggggtcaggccgaggtgcttaattttctgctccgataccaacctaggagtgaagaggagctgttcgatattctgaatctcctagattcgtttctgaagagcagcagtccaggggtggttatgggggccactaagcttttcctcatactcgccaaaatgtttccccatgtacagaccgacgtgctggttagagttaaaggtcctctactagcggcttgctccagtgaatctcgggagctgtgtttcgtggccctgtgtcatgtaaggcagatcttgcatagtctacctggccatttttccagtcattacaagaaattcttctgcagctattccgaaccccactacataaaattgcagaaagtggaagtgctgtgtgaactcgttaatgacgagaacgtgcagcaagtgctggaggagctccgggggtattgcaccgacgtgagcgctgacttcgcccaggccgctatatttgccatatag

SEQ ID NO: 178146 - DNA, 909 bp, Artificial Sequence
  Description of Artificial Sequence: Synthetic coding sequence
atgccctacctgggcagcgaggacgtggtgaaggagctgaagaaggcactgtgcaacccacacatccaagccgaccggctcagatatcgcaacgtgatccagcgggtgatacgctacatgactcaaggattggatatgtctggtgtgttcatggagatggtcaaagcttccgctactgtggatatcgttcagaagaagcttgtttatctgtacatgtgcacatatgcgcctcttaaaccagacctggccctcctggctatcaacaccctgtgcaaagattgctctgatcccaaccctatggtccgcggactggcactgcgaagcatgtgtagtcttaggatgtctaaactcgatcaatggggccaggccgaggtactgaatttcctcctgcgctatcagcctcgctctgaggaggaattgttcgatatcctcaatctcctggactcttttctaaagagctcctctccaggggttgtcatgggggctaccaaactcttccttatcctggcgaagatgttcccacatgtccaaaccgatgttctcgtcagagtcaaagggccattgttagcggcatgcagctcagaaagtcgtgaactttgtttcgttgccctgtgccacgtgcgacagattctccacagtttgcctggccacttcagttcccattataaaaaatttttctgtagctacagcgagcctcactatattaagctgcaaaaagtggaggtcctctgtgaactggtaaacgatgaaaatgttcagcaggtgctggaggagctgcgaggctactgcacggacgtctccgccgactttgcccaagctgccatcttcgccattggtcgctgcctacttctcttcctgcttgaaaacctagatcagcccgccagaaagctgtggctggaagagccatag

SEQ ID NO: 178147 - DNA, 1716 bp, Artificial Sequence
  Description of Artificial Sequence: Synthetic coding sequence
atgccctacctgggcagcgaggacgtggtgaaggagctgaagaaggccctttgtaatccacacattcaagccgaccgattgagataccgcaacgtgatacagagggtgattaggatgtccaagttggatcagtggggccaagctgaggtgctaaacttcctgctgcgatatcagcctcggtctgaggaagagctcttcgacattctgaacttactggactccttcctgaaaagttcgtccccaggcgtggtgatgggcgccaccaagctgttcctcattcttgccaaaatgttcccccacgtgcagaccgatgtacttgtgagagttaagggccccctcctggctgcttgctcctccgagtcccgggaactgtgttttgtcgcattatgtcatgtcagacagatactgcacagtctgcctgggcacttctcctctcattacaaaaaattcttctgcagctattctgagccccactatatcaaactgcagaaggttgaggtcctttgcgaactcgtgaatgacgagaatgttcagcaggttttggaggaactgagggggtattgtactgacgtgagcgcagatttcgcccaggcagccatttttgccatcggggggattgcacgaacgtacactgaccaatgcgtacaaatcctcaccgagctgctgggtctgaggcaggagcacatcacaacagtggtggtgcagaccttcagagacttggtatggttgtgcccacagtgtaccgaggcggtctgtcaggccctgcctgggtgcgaggaaaatatccaggactctgaggggaagcaggcactgatttggcttttgggagtccatggggagaggataccaaatgcgccgtacgtcttagaggattttgtggagaatgtaaagtcagagaccttccctgccgtgaaaatggagctgcttactgccctgcttcggctcttcctctcccgccctgcagaatgccaggacatgctggggcgacttctctattactgcatcgaagaggagaaagatatggcagttagagaccggggactgttttattaccgcctcctccttgtgggtatagatgaggtcaagcggatcctgtgtagcccgaagagtgacccgactttgggactgctggaggatcccgcagagcgtcccgtgaatagctgggcaagcgatttcaacactctggtgcccgtctacggtaaggcacactgggcaacgatatccaaatgtcagggcgccgaacgatgcgatcccgaacttcctaaaacttcctctttcgccgccagtggacccctcatccctgaggaaaacaaagagagagtgcaggagctgccagattcaggggccctgatgctcgttcccaatagacagctcactgcggactattttgagaaaacttggctgtctctgaaagtcgcccatcagcaagtgttaccttggagaggggagttccacccggacacactccagatggccctgcaggtggtgaacatacagacgatcgccatgagcagagcgggatccagaccatggaaagcatatctttccgcccaggacgatacgggatgcctgtttcttaccgaactcttgcttgagcccggtaattcagagatgcagataagtgtcaagcaaaatgaggcacgcaccgagactctgaattcttttatttccgtcttggaaaccgtgatcggtacaattgaggagataaaatcctag

SEQ ID NO: 178148 - DNA, 2220 bp, Artificial Sequence
  Description of Artificial Sequence: Synthetic coding sequence
atgccctacctgggcagcgaggacgtggtgaaggagctgaagaaggctctgtgtaaccctcatatccaggcagacaggctgaggtatagaaatgttatccagcgcgtgattcggtatatgacccaaggtctggatatgagcggggtgttcatggagatggtgaaggcctcagcaaccgtggacattgttcagaagaagctcgtgtacctctatatgtgcacctatgccccactgaaaccagaccttgcgctgcttgccattaatacactgtgtaaagactgctctgatccaaatccaatggtccgaggcttggcattaaggagcatgtgtagcctccgtatgcctggcgtccaggagtacattcagcagcccatcctgaacgggctacgagataaggcatcctacgttcgccgagtagctgttctaggttgcgctaagatgcataatctgcacggagatagtgaggttgacggggctctggtgaacgaactgtactccttactgagagatcaagacccaatagtggtcgtgaattgtttaaggagccttgaggaaatactgaaacaggagggcggtgtggtgatcaataagcctattgctcaccatctgctgaaccggatgtcgaagttggaccaatgggggcaggccgaagtacttaatttcctcctgagatatcagcctagaagcgaggaggaactcttcgacattttgaatctgctagattcattcctgaaatcttcgtcacccggggttgtgatgggggcaaccaagctttttctgatcctggctaaaatgtttcctcacgtgcaaacagatgtcctggtcagggtgaaaggccctttgttggcagcatgtagcagcgaatcccgcgaactttgcttcgtagctctgtgccatgtcagacaaatactgcactctttaccaggacatttctcctcccactacaagaagttcttctgttcctactctgaaccgcactacattaaactacagaaagtggaggtgctgtgcgaattagttaatgacgagaacgttcagcaggttctcgaagagttgcggggctactgtactgacgtgtccgcggactttgctcaagcagccattttcgccataggagggatcgcacggacctataccgatcaatgcgtgcagattctaaccgaactgctcggtttaaggcaagaacacataactactgtggtcgtgcaaaccttcagggatctagtgtggctgtgtccccagtgcaccgaggccgtctgtcaggctctgcccggatgtgaggagaacatccaggactcggagggaaagcaagccctaatttggctgctcggagtgcacggagaacgtatacccaacgccccttatgtgctcgaggacttcgtcgagaacgtgaagtctgagacgtttccagccgtgaaaatggagctgctcaccgcactgctgcggttgttcctgagtaggccggcggagtgccaggatatgcttggtcgcttgttgtattactgcatcgaggaagagaaggacatggccgttcgcgaccgaggactgttctattatcggctgctgctggtcggtatcgacgaagtgaagcggattctatgctcaccaaaatcagatcctacacttggcctgctcgaagacccagctgagagacctgtaaacagttgggccagcgattttaacacgctggtccccgtctatggaaaagcgcactgggcgaccatttctaagtgtcagggagcagaaaggtgcgaccctgagctacccaaaacaagttccttcgccgcatccggcccccttatccctgaggaaaataaagaacgagtccaggaacttccagatagtggagccctcatgcttgttcccaataggcagctgactgctgactatttcgagaaaacatggttaagtctgaaagtcgcacatcaacaagtgctgccctggagaggcgaatttcatcctgacactctgcagatggctcttcaggtcgtgaatattcagacgatcgctatgtcacgcgcaggctcccgaccatggaaagcttacttgtctgcccaggacgacactgggtgtttgttcctgaccgagctgctgctggagcctggcaacagcgagatgcagatatccgtgaaacagaatgaggcgcggacagaaaccctgaactcgttcatttccgtgctggaaactgtgatagggaccatagaagaaatcaaaagctag

SEQ ID NO: 178149 - DNA, 789 bp, Artificial Sequence
  Description of Artificial Sequence: Synthetic coding sequence
atgccctacctgggcagcgaggacgtggtgaaggagctgaagaaggcgctgtgcaaccctcatatacaggcagaccggcttcggtaccggaatgtgatccagcgggtgattcggtatatgacacagggcttggatatgagcggagtgtttatggagatggttaaagcaagcgccaccgtggacatcgtgcagaaaaagctcgtgtacctctatatgtgtacatacgcacccctgaagcccgacctggcccttctcgccataaatacactgtgcaaagattgttcagatccgaatcctatggtgcgaggcctggctcttcgaagcatgtgttcacttcgtatgcccggcgttcaggagtatattcagcagcccatcctgaatggtctgagggacaaagcctcctacgtgcgaagagtggcagtcttaggctgtgccaagatgcacaacctgcatggtgactctgaggtagatggagcacttgtcaatgaactgtattccctcctgcgagatcaggaccccattgtggtagtgaattgtttgcgttctctggaagagattcttaagcaagaagggggagtggttatcaacaaacccattgcgcaccatttgctcaatagaatgtctaagcttgatcagtggggccaggccgaggtgctgaactttttgctgaggtaccagccccgttccgaagaagagctgtttgacatcctgaatctcctcgattccttcctaaaaagcagttcccctggcgtcgtgatgggagccaccaaactcttcctcatactctag

SEQ ID NO: 178150 - DNA, 528 bp, Artificial Sequence
  Description of Artificial Sequence: Synthetic coding sequence
atgccctacctgggcagcgaggacgtggtgaaggagctgaagaaggccctgtgcaacccacacattcaagcagacagactgcgatataggaacgtgattcaaagggtaattcgcatgtcaaaactcgaccagtggggccaggccgaggtcctgaatttcctattgaggtaccaaccacgaagcgaggaggagctttttgacattcttaacctgttggattcttttctcaaaagttctagtcctggggtagtcatgggagccactaagctgttcctgatccttgctaagatgttcccacatgtgcaaaccgatgtgttggtccgagtaaaggggccacttctggctgcctgcagttccgagtctcgggagctctgctttgtggccctgtgccacgtgaggcagatcttacactcattgccagggcactttagtagccattacaaaaagttcttttgctcgtactctgagccccactacatcaaactgcagaaagtcgaggttttatgcgagttggtgaacgatgaatag

SEQ ID NO: 178151 - DNA, 3414 bp, Artificial Sequence
  Description of Artificial Sequence: Synthetic coding sequence
atgagcgacatcgtggagaagaccctgaccgccctgcccggcctgttcctgcagaatcaacctggcggggggccagctgcagccaaagcaagctttagctctcggctgggttctttggtgagaggcatcaccgctttgacatctaaacatgaggaagaaaagctcattcagcaggagttgagctctctgaaggcaaccgtgtccgcccccaccaccacgctaaaaatgatgaaagaatgcatggtgaggttgatctattgtgagatgctgggatatgacgcatctttcgggtatatccacgcaataaaattggctcaacaaggaaacttgttggagaagagggtgggctacctggcagtctccctgtttctgcacgagtcccatgaattactgctcttactggtgaacaccgtcgtgaaggatttgcaatctacgaatctggtggaggtttgtatggcccttacagtcgtgagccagattttcccttgtgaaatgattccagctgtgctgccactcattgaggacaagctgcagcactccaaagagattgttcgaagaaaggcggtccttgctctgtataagttccatcttatcgcacccaaccaggtgcaacacattcacatcaagttccgaaaagcactgtgtgatagggacgttggcgtcatggccgcttcccttcatatctatctgcggatgataaaggagaacagctccgggtacaaggatctgactgggtccttcgtcacgattctgaaacaggtggtgggcggcaagctccctgtggaatttaactatcactctgtccctgcaccttggctgcagatccaacttctgcggattctagggctgctgggtaaggatgatcagcgcacaagcgagttgatgtacgatgtgctggatgaaagcctcaggcgagcagaactgaaccataatgtcacttacgccatcttattcgagtgcgtgcacaccgtgtatagcatctacccaaagtccgagctcctggagaaggccgctaaatgcattggaaaattcgtcctgagccctaaaatcaacctcaaatatctcggactgaaggctctcacttacgttattcaacaggaccctaccctcgccctgcaacaccagatgacgataattgagtgtttggaccacccggacccgatcatcaaacgggagacccttgagctactctatcggatcaccaacgcccaaaacattacagtgattgtacaaaagatgctggagtacctgcaccaaagtaaggaagagtacgttattgtgaaccttgtgggcaaaatcgccgagttggccgagaagtatgcccccgacaacgcttggtttatccagacaatgaatgccgttttctcagtcggcggggacgttatgcaccctgacatccctaacaacttcctcagactgctcgcagaagggtttgacgatgagactgaggaccagcagctgcgtctgtacgccgtgcagtcttacctgaccctactcgacatggagaatgtgttttatcctcaacggttcctgcaggttatgtcttgggttcttggtgagtattcttacctcctggataaggagacacctgaagaggtgattgctaaactgtacaaattgttgatgaacgattctgttagcagcgagactaaagcttggctcattgcagccgtgaccaaactaacctctcaagctcactccagcaatacagtggagcgactgattcacgagtttacaatttcgcttgatacctgcatgaggcaacacgctttcgaactcaagcacctgcacgagaacgtggagctgatgaagtccctcctgcccgtggatcggagctgtgaagacctggtcgtggatgctagcctgtcattcctggacggcttcgtcgctgaaggattgagccagggggccgccccctataaacccccccatcagaggcaggaggagaagctctcacaagagaaagtgctgaactttgaaccatatggcctctctttctcctcttctggttttaccggccggcaatctccagccggcatcagcctgggctctgacgtgtctggtaacagtgccgaaaccggccttaaggagactaactctttgaagcttgaggggattaagaagctgtgggggaaagagggctacctccctaagaaggaatccaagacgggagatgaatctggtgctcttcccgtaccccaggagtctataatggagaatgttgatcaggccatcacaaaaaaggaccaatcccaagtgttaacccaatcgaaggaggagaaggaaaaacagctactcgctagcagtctgtttgtcggattaggctccgagtccaccatcaacctcctgggcaaagctgacaccgtgtcgcacaagtttcgaaggaagtctaaggtcaaggaggcaaagtccggtgagacaacaagcacccacaatatgacctgctcgtcattttcctccctgagtaatgtcgcctacgaagatgactattactcaaatacactgcatgacaccggtgacaaagaattgaagaagttctctctgacaagcgaactgttggactccgaatctctgacggaactgcctctggtagagaagttttcctattgttccctgagcacaccgtcgctctttgctaacaataacatggaaatctttcaccccccacagtcaactgctgccagcgtagcgaaagagagcagcctggccagctccttcctggaagagacgacagagtacatccatagcaatgccatggaagtgtgcaataatgagacaatcagtgtgtccagctataaaatatggaaagatgattgcctccttatggtatggtccgttaccaataagagtggccttgagcttaaatcagcggatcttgaaattttcccagcagagaatttcaaagtcacagaacagcccgggtgttgcttgcccgtcatggaagcagaatctaccaagtctttccaatacagtgtgcagatcgaaaagccctttactgagggaaacctaacaggtttcatatcatatcatatgatggatacccacagcgcccagttggagttctcagttaatctgagcctgctagatttcatccgtccactgaagatctcatccgacgatttcgggaagctgtggctctccttcgcaaacgacgtgaagcagaacgtaaaaatgtctgagagccaggcagcactgccttcggccctgaagactttacagcagaaactgcggctccacattatcgaaatcatcggcaacgagggattgctagcctgtcagctgctccccagtatcccttgcctcctccactgcagagtacatgctgatgtgttggcactctggtttaggtcctcttgctcgacacttcctgattaccttctctatcagtgtcagaaagtgatggaggggtcatag

SEQ ID NO: 178152 - DNA, 1362 bp, Artificial Sequence
  Description of Artificial Sequence: Synthetic coding sequence
atgatcagccagttcttcatcctgagcagcaagggcgaccccctgatttacaaagactttcgaggagattccgggggcagagatgtggccgaactattctaccggaaactcactggcttgcctggagacgaaagccccgtcgttatgcatcaccacgggagacatttcatccacatcaggcactcgggtctgtacctcgtggtgactacgagtgaaaatgtcagcccctttagcttgctggaactgctgagtagactcgcaaccctcctgggggactactgcgggtccctcggggaaggcaccatcagtcgtaatgtggcacttgtatatgagcttctggacgaggttcttgattacggctacgtgcagacaacctcaacagagatgctgagaaattttatccagaccgaggccgtggtgtctaagccattcagcttgtttgacctgtcttcagtgggcctttttggagctgagacccagcagagcaaggttgccccctccagtgccgctagtcgccctgtcctctcatctagatctgatcagtctcagaaaaacgaggtcttcctggacgtggtcgagcggttgtccgtgttgatagccagtaacggctcactgttgaaggtggacgttcagggggaaataaggctgaaaagtttcttgcccagcggtagcgagatgagaattggattgaccgaggagttttgtgtcggcaagagcgaactaagggggtatggtcccgggattcgcgtagatgaagtttcctttcactcctcagttaatttagatgaatttgaaagccacaggatcctcagacttcagccaccacagggagagctgaccgtgatgaggtatcagttgtcagacgacctaccatcccctctaccctttcgattattcccatctgtacagtgggaccgtggctccggccgattgcaagtttacctgaaacttcggtgcgacttactgtcaaagagccaggcacttaacgttcgtctccacctccctctgcccaggggagtggtgagtctcagccaggaactgtcctcccctgaacaaaaggctgaactcgcggaaggtgctctcagatgggacctgccccgcgtacagggaggcagccagctttccgggttattccagatggatgtaccggggccacccggacctccttcccacggattatctactagtgcatccccactaggcctcggccctgcctccttatccttcgaactcccgaggcacacttgctcaggtctgcaggtccggtttctccgacttgctttccggccttgcggtaacgccaacccccacaagtgggtgagacatttatcacattcagatgcttatgtgatcagaatttag

SEQ ID NO: 178153 - DNA, 1362 bp, Artificial Sequence
  Description of Artificial Sequence: Synthetic coding sequence
atgatcagccagttcttcatcctgagcagcaagggcgaccccctgatttacaaggattttagaggggacagcgggggccgagatgtcgctgaactcttctaccggaaactgacggggctgcccggcgacgaaagccctgtcgtgatgcatcaccatgggaggcactttatccacatccgacacagtggactctacttggttgtcaccaccagcgagaacgtgagtccgttctcccttctggaattgctttctcgcctcgccaccttgctgggagattactgtggatccctgggcgaggggacgatcagccggaatgtggcacttgtgtacgagctgcttgacgaggtgttagactatggctacgtgcagacaacatccaccgagatgttgcggaactttattcagaccgaagcagtagtgtccaaaccgttctccctgttcgatctgtcttccgtaggattattcggcgcagaaacacagcaatccaaggtggccccttctagcgccgcatcacgtccagttctctctagccgctcggaccagagccagaaaaacgaagtgttccttgatgtggtggaaaggctatccgttttaatagccagtaacggatccttactaaaggtcgatgtccagggcgaaatacggctgaagtctttcctgccctcaggtagtgaaatgcgcattggcctgacagaagaattttgtgtgggcaagtccgaactgcgcggctacggtcccgggattcgggttgatgaagtatccttccatagcagcgtgaacctggacgagtttgagtcccatcgcattctcaggctgcagccccctcagggcgagcttacagtgatgcggtaccagctgagtgatgatctccctagccccctgcccttccgcttgttcccctccgtgcagtgggatagaggtagcggcaggctgcaggtttatttgaagctgagatgtgacctgttgtcgaaatcgcaggcgctaaatgtgagactgcatctgccattgcccaggggtgtggtctccctctctcaggagctcagttccccggagcagaaagcagaactggcagagggagccctgcggtgggatttgcctcgggtgcagggtggaagtcagcttagcggcctcttccaaatggacgtgccagggcctcctggtcctccctcccacggcctgtcaacttctgcctctcctctcggcttaggacctgcctctctatccttcgaactccccagacacacctgcagcggcctgcaagttaggtttcttaggttggctttcagaccatgtggaaatgctaatccgcacaaatgggtgaggcacctcagtcatagtgacgcttacgtcatccgtatatag

SEQ ID NO: 178154 - DNA, 1653 bp, Artificial Sequence
  Description of Artificial Sequence: Synthetic coding sequence
atgagcgccgcctggatccccgccctgggcctgggcgtgtgcctgctgctgctgccaggacccgctgggtccgagggcgctgcacccatcgccataacatgcttcacccgtgggctcgatattcggaaggagaaggccgatgtgttgtgcccagggggttgtcccctcgaggagttctctgtgtatggtaatattgtttacgcttctgtttcaagcatatgtggcgcggccgttcacagaggagtgatttctaatagtggtgggcctgttcgggtatattccctgcctggccgtgagaactactcatctgtggatgcaaatggtattcaaagccagatgctgtcgaggtggtccgcatcattcactgtgactaaaggtaagtcctctactcaggaagccaccggtcaggctgtctccaccgcccatcctcctacgggcaagcgtttaaaaaagacacccgaaaaaaaaactggcaataaggattgtaaggccgatatcgccttcctgattgacggttcctttaatattgggcagcgacggtttaacctccagaaaaacttcgtgggaaaggtggcattgatgcttggtattggcacggaggggccacacgttggacttgttcaggcgtcagagcatcccaaaattgagttctacttgaaaaatttcacatcggcaaaggacgtcctgttcgctatcaaagaagtaggcttcagaggcggcaatagtaacaccgggaaggcgctgaaacatactgcacagaaattctttaccgttgacgcgggagtgaggaaaggcattcccaaagtcgttgtggtgtttatcgatggttggcctagtgacgacatagaggaggccgggatcgtggccagggaatttggcgtgaatgtattcatcgtttctgtggctaagcccatccctgaggagttggggatggtgcaggatgttacgtttgtcgataaggcagtctgcagaaataacggattcttttcgtatcatatgcctaattggttcggcaccactaagtacgtcaaacccctagtccagaagctgtgcacacacgagcagatgatgtgtagtaaaacttgctataactccgtgaacatagcgttccttatcgacggtagcagttccgttggtgattcgaacttccgcttgatgctggagttcgttagcaacatcgcaaagacattcgaaatttctgatattggggctaaaattgcggccgttcagttcacctacgatcaacgcacggaattcagctttaccgactacagcactaaagaaaacgtgctggcggtaattaggaatatcagatacatgtctggggggaccgctaccggggacgcgatcagctttaccgtgcgcaatgtgttcggcccaatccgggagtcacctaataagaactttctggtcatcgttacagatgggcagtcgtatgacgacgtgcagggcccagctgccgcggcacacgacgcaggaattactattttttctgtcggcgttgcctgggcgcctttagacgatctgaaggacatggccagcaagcccaaagagtcacacgctttctttactagggaattcacaggcctggagcccatcgtctcggacgtgattaggggcatatgtagagattttctggaaagccagcaatag

SEQ ID NO: 178155 - DNA, 435 bp, Artificial Sequence
  Description of Artificial Sequence: Synthetic coding sequence
atgatcaagttcttcctgatggtgaacaagcagggccagacccggctttctaagtactacgagcatgttgatatcaacaagcgaacattactagagactgaggtgatcaaaagttgtctgtccagatcgaatgaacagtgttcatttattgaatacaaggacttcaaacttatataccgccagtatgccgccctcttcattgtggtgggcgttaacgatacagagaacgagatggctatttacgagttcatccacaattttgtggaggttctggacgaatacttctcccgggtcgttaaaggacacattatgttcaatcttgacaaagtacatattattctggatgaaatggtgctcaacggctgcatcgtggagacaaaccgggccaggatcctcgctcctctcctaattttagataagatgagcgagagttag

SEQ ID NO: 178156 - DNA, 435 bp, Artificial Sequence
  Description of Artificial Sequence: Synthetic coding sequence
atgatcaagttcttcctgatggtgaacaagcagggccagacccggctgtctaaatactatgaacacgtggatattaacaagaggactcttctcgaaaccgaggtgattaaatcctgcctgtccaggtccaatgagcagtgttcctttatcgagtataaggattttaagttgatttacagacagtacgccgcactattcatagtggtcggcgttaatgatacagaaaatgagatggccatttacgagttcatccacaactttgtggaggtgctggatgagtactttagtagagtctctgaactggatataatgtttaatttggacaaagtgcacatcattctagacgagatggttctcaatggctgtattgtcgagacgaaccgggccagaattctcgcccctctactcatactggataaaatgtctgagagttag

SEQ ID NO: 178157 - DNA, 27 bp, Artificial Sequence
  Description of Artificial Sequence: Synthetic coding sequence
atgatcaagttcttcctgatggtgtag

SEQ ID NO: 178158 - DNA, 297 bp, Artificial Sequence
  Description of Artificial Sequence: Synthetic coding sequence
atgatcaagttcttcctgatggtgaacaagcagggccagacccggctcagcaaatattatgagcacgtggacattaacaaaaggaccctattggaaacagaggttattaagtcctgcttgagccgatctaacgaacagtgcagcttcattgaatacaaggattttaaactgatttaccgccagtacgcagccctgttcatagtggtcggagtgaacgacacagagaatgagatggctatctacgaattcattcacaacttcgttgaggtcctggacgaatacttttctcgagtctag

SEQ ID NO: 178159 - DNA, 402 bp, Artificial Sequence
  Description of Artificial Sequence: Synthetic coding sequence
atgatcaagttcttcctgatggtgaacaagcagggccagacccggctgtcaaagtactatgaacacgtcgatatcaacaagcggaccttgctcgaaaccgaggttatcaaatcctgtttgtctcggtcaaatgagcagtgcagcttcattgaatacaaggatttcaaactcatatatagacagtatgcagcattgtttattgtggtgggcgtcaacgatactgagaacgaaatggctatttatgagttcatacataacttcgtggaggtgctcgacgaatacttcagtagggtttcagaactggacattatgttcaatctcgataaagtgcacattatcctagatgaaatggtgcttaacgggtgtatcgttgagaccaatagagccagaatactggcgtag

SEQ ID NO: 178160 - DNA, 4611 bp, Artificial Sequence
  Description of Artificial Sequence: Synthetic coding sequence
atgggcgtggtgaacttcgtgttccgggccagcgaggacctgcaggtgctggaaaactactcggacgcccctatgacacctaaacaaatcctccaggtaatcgaggcagaaggactgaaggagatgagtggaacaagtccactcgcgtgcctgaatgcaatgctgcacagcaatagcaggggcggagaaggcctgttctacaagctgcctggtaggataagcttgtttacgctgaagaaagacgcacttcaatggtctagacaccccgccacggtggaaggcgaagagccggaagataccgcagatgtggaaagctgtggatctaatgaggcctcaaccgtctccggagagaacgacgttagcctcgacgagacctcctccaacgcatcatgttcaacagagagtcagtcacgccccctgtcgaatccgcgcgacagctacagagcctcgtctcaggccaataaacagaaaaaaaagacaggagttatgctgccccgggtagtgctgacccccttgaaagtcaacggggctcacgtggagtcagcatcaggcttctctgggtgccatgctgacggagagagtggctctccaagcagctctagcagcggatcccttgctctgggttctgctgccatcagggggcaagcagaagtgactcaggaccccgcaccactgctgagaggattcagaaagcctgctacaggacagatgaagcgaaaccggggcgaagaaatcgacttcgagaccccaggttcaatcctggtgaacacgaacctgagagcgctgataaatagtcgcacattccacgcactgccaagtcactttcagcagcagctgcttttcctgctgcccgaagtcgataggcaggttggcacagatgggttgctacggctgtcatccagcgcactcaataatgagtttttcacacacgcagctcagtcctggagagagcgactcgcagacggagaattcacccatgaaatgcaagtgagaatccggcaagagatggagaaagagaagaaggtggagcagtggaaggagaaattctttgaggattactacggacagaagcttgggttgaccaaggaggagtcccttcagcaaaatgtgggccaagaggaggctgaaataaagtctggcctgtgcgtccctggggagtccgttagaatccaacgcggcccggccacacgacagcgggacggtcactttaagaagaggtcaaggcctgacttacgtactcgtgcgcgccgtaatctatacaagaagcaggaatctgaacaggcgggagtggccaaagacgctaaatccgtagcctcggatgtacctctgtacaaggacggtgaggccaaaacagacccagccggattgtcctcccctcatttgccggggaccagcagtgctgcccccgatctggaagggcccgaattccctgtcgagtccgttgccagccgtatacaggctgagcccgacaatctagcacgggcatccgcgtctcctgatcgcatacccagcctgccccaggagaccgtagatcaggaaccaaaagaccaaaagaggaagtcatttgaacaggccgcatccgcatccttccctgaaaagaaacccaggcttgaggatagacagtccttccggaataccatagagagtgtacacaccgaaaagccgcagcctacaaaggaagaacccaaggtgccccccatcagaatccagttgtcacgtatcaagccaccttgggtggtgaagggtcagcctacctaccagatttgtccaaggatcatccctactaccgaatcttcttgcaggggctggaccggcgccaggactctcgctgacataaaggccagggccttgcaggttaggggcgccagagggcatcactgccaccgtgaggccgccacaacggcaatcgggggggggggaggaccagggggagggggcgggggcgccacagacgagggcggagggaggggcagcagctctggcgatgggggtgaggcctgtggacaccccgaaccacgaggcggcccgtctactcccggtaaatgtaccagtgacctgcagcggacacagctgctccctccctaccccctcaacggagaacacacccaggccggcaccgcaatgtcccgagcccgtagagaggatcttccttctttaagaaaggaagaatcctgtctactgcagagagctaccgtgggactcactgacggtctgggtgacgcaagtcaactcccagttgcaccgacgggagaccaaccctgtcaggctttaccattgttgtcctcacaaaccagtgtcgccgagagactggtggaacagccacagcttcatcccgacgtccgcaccgagtgcgaatctggtaccacgagctgggagtcagatgacgaggagcaggggccaacggttcctgcagacaatggacctatactgagcctcgtgggggatgacaccctcgagaaaggaaccgggcaggccctggactcacaccccaccatgaaggacccagtaaacgtcactccaagttctacccctgagtctagcccgacggactgtctgcagaacagagcattcgatgatgaactgggtttgggtggtagctgtccccccatgcgggagagtgatacacggcaggagaacctgaaaactaaagctcttgtcagcaatagctcgctgcattggataccaattccctccaatgatgaagtggtgaagcaaccaaagcccgaatccagagagcacattccttccgtggaaccacaggtaggcgaagagtgggaaaaagcagcgcccaccccaccagctcttccaggcgacttaacggctgaggaaggactggatccactcgattcattgacttccctgtggaccgtgccttcccgcggagggagcgattcgaacggatcgtactgccagcaggttgacatcgagaagttgaaaattaatggagactccgaggcactgagccctcacggtgagagcacggatactgcatctgattttgagggccatctgacggaggattcatctgaggctgataccagggaggccgcagtaaccaagggctcatcggtcgataaagacgagaagccaaactggaatcaatccgctccgttgtccaaagtgaatggcgatatgagactagtgaccaggacagatgggatggtggccccccagtcctgggtgtcaagagtgtgtgctgtgcgccagaagattcccgactcactgttattggccagtacggaataccagccaagagcagtgtgtctcagcatgcctggatcctccgtggaggccaccaacccactcgttatgcagttgctgcaggggagtcttcctttggaaaaagtgctgcctccagcccatgatgactccatgtccgaatctcctcaggtgcccctgactaaggaccagagtcacggatctcttagaatgggatctctacacgggttgggaaaaaattcagggatggttgacggctcatctccatcctcactgcgagcccttaaggaaccccttctgcctgacagttgtgagaccgggaccggattggctcgcatcgaagccactcaggcccctggcgccccccaaaaaaattgcaaagcagtaccttccttcgattctctgcacccagtgaccaatcctattacatcctctaggaaactggaagagatggattccaaagagcagttttcctccttcagctgtgaagatcaaaaggaggtcagagcaatgagtcaagactccaactccaatgcggctccagggaagtcacccggggacttgaccaccagccgcacacccagattttcctctccaaacgtgatttccttcggaccagagcagaccgggagagcattaggggaccagagcaacgtgacagggcaaggcaagaagctgtttggcagtgggaatgttgctgccaccctgcaaaggccaaggcccgctgaccccatgccactgccggcggagatccctcccgtattccccagcggaaaactcggaccaagcacgaactcaatgtcaggaggtgtgcagaccccaagagaagattgggcgcctaagccccatgctttcgtgggctctgtgaagaacgagaaaacctttgtgggtgggcctcttaaagccaatgccgagaatagaaaggcaaccggacattcgcccttggaattggtcggccacctggaggggatgcccttcgtgatggatttgcccttctggaagctcccgagggagccaggaaagggactgagtgaacctctcgagccctccagtctgccttctcagttatccattaaacaggccttctatgggaaactgtccaagttacaactgagctctacaagcttcaattatagcagctcatcacccacattcccaaaaggtctcgcaggatccgtggttcagctgagccataaggcaaacttcggcgcctcccattccgcaagtctcagcttgcaaatgttcacggactccagtactgttgaatccatttctttgcagtgcgcctgctcgctgaaggctatgattatgtgccaggggtgcggtgctttttgccacgatgattgcatcgggccctctaaattatgtgtgctgtgcctggttgtccgttag

SEQ ID NO: 178161 - DNA, 4626 bp, Artificial Sequence
  Description of Artificial Sequence: Synthetic coding sequence
atgaaggacaagcagaagaagaagaaggagcggacctgggccgaggccgctaggctagtgctcgagaattattctgacgcacccatgacaccgaaacaaatcctgcaggtgatagaggccgaagggctgaaggagatgcggtctgggaccagtcccctcgcctgcctgaatgcaatgctgcactccaacagccggggaggagaagggttgttttataaattgcccgggcgtatctcgttattcactctgaagaaggatgctctgcagtggagtcgacaccctgctaccgtcgaaggcgaggaacccgaagataccgcagacgtggaatcctgcggctctaatgaagcctccaccgttagcggagaaaatgatgttagcctggacgagacctcaagcaatgcttcctgttctaccgagtcccagagcaggccgctatcaaatcctagagacagctacagagcctcatctcaggccaacaaacaaaagaaaaaaaccggcgtcatgcttccaagggtcgtactcacaccactaaaggtgaatggcgctcacgtcgaaagcgccagtgggttttccggctgtcacgctgacggagagtcaggtagtccatcctctagcagctcagggagcctcgctcttggatcagccgcaatccgtggtcaggcagaagtcactcaagatcctgcaccgctccttaggggatttagaaaaccggccacagggcagatgaagcgcaataggggcgaggagattgatttcgaaacaccaggctccatcctagtgaacacaaacctgcgggcacttattaactctcgtacctttcacgccctgcctagccacttccagcaacagctgctgtttctgctgccagaggtcgaccgccaggtgggaaccgatggtcttcttagactgtcgtctagtgcacttaacaacgagttcttcactcatgcagcacagagttggcgggagcggctcgcggacggcgaatttacgcacgaaatgcaggtaagaatccgacaggagatggagaaagaaaagaaagtcgaacagtggaaggaaaagtttttcgaggactactacggccagaagctagggttgacaaaggaagaaagtctccagcagaatgtcggacaggaggaggcagagataaagagcggtctgtgtgttcctggagagtccgtgcggattcagcgtggacccgccacgaggcaacgggacgggcacttcaaaaaaaggtccaggcctgacctgcgcacccgcgctcgaagaaacctgtataaaaaacaagaaagcgagcaagcaggagtcgccaaagatgcaaagtctgtggcgtcagatgtccctctgtataaagacggagaggcaaagacagatcccgcagggttatcctcccctcatctgccgggaaccagcagcgccgcaccggacttggaggggccagagttcccagtcgagtccgttgcctccagaattcaagccgaaccggacaatcttgcccgggccagtgcaagcccggatcggattcccagcctgccacaagagaccgtcgaccaggagcccaaggaccagaagaggaaatcgttcgaacaggccgcttctgcctccttccccgagaagaagcctcgtctagaggatcgccagagcttcagaaacaccatcgaaagtgtgcatacagagaaaccccaacctaccaaggaggaaccaaaagtacctccaattagaattcaactttctcgcattaagcctccctgggttgtgaaaggacagccgacctaccaaatctgccctcggattattcctacaaccgagagttcttgccgagggtggactggggcccgtaccctcgccgacataaaagcacgggcactacaagtaagaggggctcggggccatcattgtcaccgtgaggccgccacaacagccataggcggcggaggcggtcccggcgggggtggagggggcgccaccgacgagggtggaggccggggtagctctagtggagatggcggagaagcctgtggccacccagagccaagaggcggaccttctaccccgggtaaatgcaccagcgacctgcagcgcacccagcttttgccaccataccctctgaacggcgaacatacccaggcaggcaccgctatgtctagagcccgccgggaggacctgccgagtttacgtaaagaagagtcctgcctcctccagcgagcgaccgtgggactcaccgatgggctgggagatgccagccagctgcccgtggcccctacaggcgaccaaccctgtcaggctctgccattgctgtcctcacaaaccagtgtggctgagcgattagttgagcagccccagctccatcccgacgttcgaaccgaatgtgagagcggcacgaccagctgggaatcagatgatgaggagcaggggcctaccgtccctgctgataatggccctattctgtccctggtgggggacgatacgctggaaaagggaaccggccaggccctagactcacatccgaccatgaaagatcctgttaatgtgacccccagcagtacccccgagagcagtcccaccgattgcctccaaaacagagcattcgacgacgagctcggacttgggggcagctgccccccaatgagagagtcggatacgcgtcaggaaaacttaaaaacaaaagccctggtgtcaaacagtagcctgcactggatccccatcccaagcaatgacgaggttgtcaagcaacctaaacccgaaagcagggagcatatcccttctgttgagccacaggtgggcgaggaatgggagaaggcagctcccacgcctcctgccttacctggggatctgaccgccgaagaggggctggatccattggattctctcacgagcctatggaccgtgcccagcagaggcggatcggatagcaacgggtcctattgtcagcaagttgatatagagaagctaaaaattaatggggactccgaagccctctctccccatggggagtccaccgacaccgcatcggactttgaaggccacctgaccgaagattcatcagaggcagacacaagggaagctgcagtaactaagggcagttccgtggacaaggatgagaagcctaactggaatcaatcagcccctttgtccaaagttaatggagacatgcggctcgtgacaagaaccgatggaatggtcgctcctcagtcctgggtcagcagagtgtgcgcagtgagacagaaaatccctgactccttgttacttgctagcaccgagtaccagccccgagcagtctgcctgtctatgcctggttctagcgtcgaagccacaaaccccctcgtgatgcagctgctccagggctctctgcccctggagaaagtgctccctccggcacacgacgattccatgagcgagtcaccacaggtcccattgacaaaggatcagagtcacggttcactgagaatgggatccttgcatggtcttggcaagaactctggcatggtggacggaagctccccctctagcttacgcgctctgaaggagcccttacttcccgactcttgtgagacaggcaccggtctcgcccgtatcgaagcaacccaggcaccaggcgctcctcagaagaactgcaaagccgtgccctccttcgactccctgcaccccgtgacaaatcctattacgagctctaggaagctggaagaaatggacagcaaggaacaattctcgagcttctcttgcgaagaccaaaaagaagtgagggccatgtctcaggacagcaatagcaacgccgctccgggaaagagtcccggggatctgactaccagccgcacaccgaggttctcctcacccaatgtgatctctttcggaccagagcagactgggagggcactgggtgatcaaagcaacgtcacggggcaaggaaagaaactttttggcagcggtaacgtggcggctacgcttcagcgcccacggcccgcggacccgatgcccttacccgctgaaatcccgcctgtattcccatctggcaaattgggtcccagcactaacagtatgtcgggcggcgtgcaaacccctcgggaagactgggcaccaaaaccccacgcgttcgttgggagcgtcaagaatgaaaagacttttgtaggtggcccactcaaagccaacgctgagaatcggaaagctacagggcacagccccctggagctagtaggacatctggaagggatgcctttcgtcatggatcttcccttttggaagctgccgcgtgagcctggaaaagggctctcagaacccctggagccgtcttctctgccttcgcaattgagcatcaaacaagctttttacggaaagctctctaagctccagctgtctagtacaagtttcaactacagttctagctcacccactttccctaagggcctcgcggggtcagtggtccaactgtcccataaagcaaacttcggtgcttcgcactcagctagtctaagtctgcagatgtttacagattccagcactgtggagtccatctcattgcagtgcgcctgttcacttaaggcaatgataatgtgccagggatgcggcgccttctgccatgatgactgtattggaccttctaaactttgcgtgctgtgtctcgtcgtaagatag

SEQ ID NO: 178162 - DNA, 4626 bp, Artificial Sequence
  Description of Artificial Sequence: Synthetic coding sequence
atgaaggacaagcagaagaagaagaaggagcggacctgggccgaggccgcccgactggtgcttgagaactacagtgatgcaccaatgaccccaaagcagattctgcaggtgattgaggcagaggggctgaaggaaatgaggagtgggacctccccactcgcgtgtctgaatgctatgcttcattccaactctaggggaggtgaaggactcttctataagctgccgggcagaattagtctcttcactctaaaaaaggacgctcttcaatggtcaaggcaccctgcaactgtggaaggtgaggaacccgaggacactgccgatgtggaaagctgcggttctaatgaagcaagcactgtctccggggagaacgacgtgtcacttgatgaaacatcctctaatgccagctgtagcaccgagtcacaatcccgccctctgtccaatccccgtgatagctacagagcctccagccaagccaacaagcagaagaagaaaacgggtgtgatgctgcctcgggtagttctcactccactgaaggttaatggtgctcacgtcgaatcagcctcggggttcagtggttgccacgctgatggcgagtcgggctccccctcatcaagctctagcggctcactggcactcggctcggctgcaatccgagggcaggctgaggtgacccaagacccggctcctttactgaggggcttcaggaaacccgccaccgggcagatgaagcgtaataggggagaggagatcgactttgagaccccaggctccatcctggtgaacaccaatctgagggccctcataaacagtcggacattccacgctctgccaagccacttccagcaacaactgctgtttttgctccccgaggtggacagacaggtgggaaccgatggactgctgaggctgtcatccagcgccctaaacaacgaatttttcactcacgccgcccagtcgtggagggaaaggctggctgacggtgagttcactcacgaaatgcaagtcagaatcagacaggaaatggaaaaagagaaaaaggtcgaacagtggaaagaaaagtttttcgaggactattatggtcagaagctgggtctcacaaaggaggagtctctccaacagaacgtgggtcaggaggaggctgagattaaatccggtctttgtgtgcctggggagtctgtccggattcagcgagggccggcgaccagacagcgcgacggccactttaagaaaaggtctagacctgacctgcgaacccgagctaggcgcaacttgtataagaagcaggaaagcgagcaggcaggagtggcgaaggatgctaagtcagtggccagtgatgtccctctttataaggatggggaggctaaaacagaccccgctgggctcagcagcccacatttacctggtactagttcagcggcacctgaccttgagggccctgaattcccagtagagtctgtcgcaagtaggattcaggccgagccagacaacttggccagagcttcggctagcccggatcggatccccagccttcctcaggaaaccgtcgaccaggagcccaaggatcaaaagaggaagagcttcgaacaggcagcctctgcctctttccccgaaaagaagccgagattagaggacaggcagtcattcagaaatacaattgagtcggtacataccgagaagcctcaaccaacaaaagaggagccaaaggttcctccaatccgcatacaactctcgagaattaagcccccctgggtcgttaagggccagcccacataccaaatctgcccgagaattataccgacaactgaaagcagctgcagggggtggactggggcaaggacactggcagatatcaaagcccgcgcactgcaagttaggggagcccgaggtcaccactgccacagagaggcggcgaccaccgccataggcggggggggaggtcccggaggcggagggggaggggccactgacgagggcggaggccggggatcatcctccggagacgggggcgaagcttgtgggcacccagaaccgaggggcgggccctcaacacctggaaagtgtacctcagacctccaaagaacccagcttcttcctccatatccactcaacggtgagcacacacaggccggcactgcgatgagtcgcgctaggagagaggacctgccatctctccgtaaggaggagtcttgcctactgcagcgggcgactgttggcctgacagacggacttggagacgcctcccagctcccagtagcgcccacaggggatcaaccctgccaagccctgcccctgctaagttctcagacatctgtagctgaaagactggtggaacagccccagctccatccagacgtccggacggaatgtgagagcggcactacatcatgggagtcagacgacgaagaacaaggacccaccgtgcctgctgacaatggacctattctcagcttagtgggtgatgataccctagagaaaggcacaggccaggcactagacagtcacccaaccatgaaagacccagtgaacgtgactccttcatccacccccgaatcctcccctaccgattgcttgcagaatcgcgccttcgacgacgaactgggactggggggcagttgcccgcctatgagggagtcagacacaaggcaagagaatctgaagaccaaggcactggtctcgaattcgtcactccactggatccctattccttccaacgatgaggtcgtgaagcaacctaagcccgagtcccgcgagcatatccctagtgtcgagcctcaggttggcgaggaatgggagaaagctgctcctacacctcccgccctacctggcgacttgaccgctgaagagggactggacccattagatagccttaccagcctgtggaccgttccctctcgcggaggtagcgatagcaatggttcttactgccagcaggtcgacatcgagaagctgaagattaacggagactctgaggccctctcgcctcatggagagtcgaccgacaccgcaagtgactttgaaggccacctaaccgaggacagctccgaggcagacaccagggaggcagccgtcaccaaggggagttccgttgataaggatgagaagcctaactggaaccagtccgctcctctgtctaaggtgaacggagacatgcgtctggttactcgtactgacggaatggtcgctcctcagtcatgggtcagtcgagtctgcgccgtgcggcagaagatcccagactcgctgttgttagcatcaacagagtatcagccccgcgcagtgtgcttgagcatgcccggttcatcagtggaagcaacaaatccactggttatgcagctgctccaaggttccttgcctctggagaaggtcctaccccctgcacacgacgattccatgagcgaaagccctcaagtgcccctgaccaaagaccaaagccacgggtctcttcgaatgggctcactgcatggcttgggaaagaacagcggaatggtggatggtagctctccttcaagtcttcgagctttgaaggaacctcttctgcccgacagctgtgaaacaggaactggattagcacgtattgaggccacacaggcccccggtgctcctcaaaagaactgtaaagctgtccccagtttcgactccttgcatcccgtgacaaatccaataacgagttcacgtaagctcgaagagatggactctaaagagcagttttcctccttttcatgcgaggatcagaaagaagtgcgggccatgagccaggatagtaactcgaacgccgctcccggtaaatccccaggagacttaaccacctcaagaaccccacgtttcagttcacccaacgttatctccttcgggcccgagcagacaggccgcgcattgggagatcaaagcaatgttactggacagggaaagaaactcttcggttctggaaacgtggccgcaacacttcagaggcctcggcctgctgatcccatgcccctccctgccgaaattcctcccgtttttcccagtgggaaactcggaccttcaacaaattccatgagtggtggcgtccagacgccaagagaggattgggcaccaaaaccgcacgccttcgtcggttccgtgaaaaatgaaaaaacctttgtcggtggcccattaaaagcgaatgcagagaatcgaaaggctaccggacacagtcctctcgaacttgtgggacacctggaaggtatgcctttcgtcatggacctgcccttctggaaactgccacgcgagcctggaaagggactttccgaacccctcgagcccagctcactgccctctcagctgtccatcaaacaggccttctatgggaagctgtcaaagctgcagctctcaagcacttccttcaattactccagcagcagtcccacatttcccaaaggcctagctgggagcgtggtacagcttagccacaaagctaacttcggagcctctcatagtgccagccttagcttacagatgttcaccgatagtagcacggtggaatctatcagcttgcagtgtgcctgctctctcaaggctatgattatgtgtcagggctgcggcgcattttgtcacgatgactgtatcggcccttctaaactgtgtgtgctctgcctggttgtgagatag

SEQ ID NO: 178163 - DNA, 4389 bp, Artificial Sequence
  Description of Artificial Sequence: Synthetic coding sequence
atgctgagcttccccaacctgaaccaggtgctggagaactacagcgacgcccccatgactccaaagcagatactccaggtcattgaggcggaaggtctgaaggaaatgtcttcagggacctccccactggcgtgtctgaatgccatgctgcattcgaactccagagggggtgaaggcctgttttataagctgcctggccgcatcagtctgttcacgctcaagaaggatgctctgcagtggtcccgacacccagccactgttgaaggagaggaacctgaggataccgctgacgttgagtcttgcggtagcaatgaagcctctacagtttcgggtgaaaacgatgttagtctcgacgaaaccagcagcaatgcttcttgcagcactgaaagccagtccagaccactgtccaacccacgcgactcctacagagcatcgagccaggccaacaagcagaagaaaaagactggcgttatgcttccgcgagtcgtactcacaccactcaaagtgaatggcgcgcatgtggagtcggcctctggacagatgaaaagaaatcggggggaggaaattgattttgagacacccgggtcaattttggttaacactaacctcagggccctcatcaactcaaggacttttcacgcactgcctagccatttccagcagcagttgctgttcctacttcctgaggttgacaggcaagtgggaaccgacggccttctcaggctaagcagttctgctcttaacaatgaattcttcacccacgcagcgcaatcatggagagaaaggcttgccgacggggaatttactcacgaaatgcaagtccggattcgacaggaaatggaaaaagagaagaaggtggagcagtggaaagaaaaattcttcgaggattattatggtcagaaactgggactcactaaagaggagtctttgcagcagaacgtcgggcaggaagaggccgagataaagtctggattgtgtgtgcccggagagagtgtccggattcagcgggggcccgccactaggcagagggatgggcacttcaagaaacgcagccgccccgatctgcgcacaagagcgaggcgaaacctgtacaagaagcaggagagcgagcaagctggggtcgcgaaggatgcgaagagcgtcgcctccgacgtgcccctctacaaggacggagaagccaagactgacccagccgggctgtcttctccacacttgcccggcacatccagcgcagctcccgatctcgagggtcctgagttcccagtcgagagtgtggcatccaggatacaagccgaacccgataatcttgcaagggccagcgcctcccctgatagaatcccatcccttccacaagagaccgtggatcaggagcctaaggaccagaagcgaaagagttttgagcaggcagcgtcagctagcttccccgagaagaagccaagactggaggaccgccaatcattccggaataccattgaatcagttcacacggaaaagccacagcccaccaaggaagagcccaaagtgccacccattcgcattcagctgagccgcatcaagcctccttgggtggtcaagggacagcctacttatcagatttgtccgcgtataattcctactaccgagtcttcttgtcggggctggaccggggctaggactctggctgatataaaggcgcgcgctctccaggtacggggagctagaggccatcattgtcatagggaagcaactgacgaagggggtggacgcggatcttcttctggggacggaggtgaggcctgcggccaccccgagccccgcggcggtccatctactcccggcaagtgtacctctgacctacagcggacacagttgctccccccctatcctctcaatggggaacatacgcaggccggaacagcgatgtcccgcgcgcgcagagaggatctgcccagcttacggaaggaagaaagttgtctcctgcagagggctaccgtcggcctgaccgatggcctgggcgatgccagccaactgccagtggcacctacgggggaccagccctgtcaggccctgcccctcttatccagtcagactagcgttgcagaacgcctggtcgaacagccacagctgcacccagatgtgaggacagagtgtgaaagcggaaccaccagttgggagtctgacgatgaagaacagggacctaccgtgcctgccgataatgggcccattctatctctcgtgggggatgacaccctcgagaaggggacaggccaggctctggacagtcacccgaccatgaaagatcctgtcaatgtgacccctagtagtacccccgaaagcagtcccacagactgtctgcagaatagggctttcgacgacgagctgggcctcggcggcagctgcccccccatgcgcgagtcagacactagacaggaaaacctgaagacgaaggccctggtatcgaacagcagtctccactggattccaataccctctaacgatgaggtcgtaaaacaaccaaaaccggaaagcagggaacatattcctagcgtcgagccacaagtgggcgaggagtgggagaaagccgcacccacgccaccagccctgccaggcgacctcaccgcagaagaaggtctggatccccttgactccttgacatctctctggacagtaccttcaaggggtggcagcgattccaacgggtcgtattgccagcaagtcgacatcgagaaattgaagatcaatggcgattctgaggccctcagccctcatggggagagtacggatactgcatctgactttgaaggccaccttacggaagattcaagcgaggcagacacccgcgaggccgctgtgactaaaggatcaagcgtagacaaggatgagaaaccgaactggaatcaatccgccccactcagcaaagtgaacggggacatgagactggttaccaggaccgatggcatggtggcccctcagtcatgggtgtcacgtgtttgtgccgtgaggcagaagattcccgatagtctgctgctggcctctaccgagtatcaaccaagagcggtgtgtttaagcatgcccgggagcagcgtcgaggcgaccaatccactggtgatgcagttgctgcaagggagtctccccctggagaaagtcctgccaccagcccatgacgattctatgtctgagtcacctcaggtccccctaacaaaagaccagtcacacggcagtctgagaatgggatcactgcacggcctcggaaaaaacagtgggatggttgacggctcctcaccctcaagcttgcgcgccctgaaagagcccctacttcctgactcctgcgaaacagggactggcctcgcacggatcgaggccacccaggcaccgggtgcccctcagaagaattgcaaagcggtcccatcgttcgatagcctgcatcctgtcaccaatccaataaccagtagtcggaaactggaggaaatggattccaaggagcagttcagcagcttctcctgcgaggatcagaaggaagtacgggccatgagccaagacagtaattccaatgcggcccctggtaagagtccgggtgatctgacgacctcccggaccccccggttttcttctccgaacgtgatcagcttcggacccgagcagacagggcgggccctgggagatcagagcaatgtcacgggccagggtaaaaagctgttcggcagcggtaatgtggcagccactctccaacgaccgagaccagccgacccaatgccactgcctgctgaaattccgcctgtgttcccatccggcaaactgggtcctagcaccaacagcatgtccggcggggtgcaaacaccgcgggaggattgggcaccgaagccgcacgcttttgtggggagcgtgaaaaatgagaagaccttcgtcggtgggcctctgaaggccaatgcggaaaacagaaaggcaactgggcatagtcctctcgagctcgttggccaccttgaaggcatgccattcgtgatggaccttcctttttggaagttgccccgggaacccgggaagggcctatccgagcccttggaacctagtagtcttccctcacagctctccattaaacaagccttttatggcaagctctccaagctgcagttgagctccaccagcttcaactattcttcctcctccccaacctttcctaagggcttagcgggcagtgtcgtgcagctgtcccacaaggctaacttcggagcctcccattctgcttccctttccctgcagatgttcacggactcttccaccgtcgagtcaatatcccttcagtgcgcatgcagtctgaaggcgatgataatgtgccagggctgcggggctttttgccacgacgattgtatcggaccttcaaagctgtgtgtcctttgccttgtggttcgctag

SEQ ID NO: 178164 - DNA, 4626 bp, Artificial Sequence
  Description of Artificial Sequence: Synthetic coding sequence
atgaaggacaagcagaagaagaagaaggagcggacctgggccgaggcggcccgtctggtccttgagaactattccgatgcacctatgacgccaaaacagattctgcaagtcatagaggcggaaggtctcaaggagatgcggtccggcacttcccctcttgcttgcctcaatgccatgttgcactctaacagtagagggggtgaagggctcttctataaactccctgggcggataagtctgttcaccctcaaaaaggacgccttacaatggagccggcaccctgctacagtagaaggggaggagcccgaagacaccgccgacgtggaatcttgcgggagcaacgaggccagcaccgtaagcggagagaacgatgtgagcctggacgaaactagctctaacgccagttgctctacagagtcccaatcccggccactcagtaacccccgcgacagctaccgcgcatctagtcaggccaataaacaaaagaagaaaactggtgtaatgctacctagagttgtcttaaccccactcaaggtaaacggcgcacacgtcgaaagtgccagtggattctccggatgtcatgcagacggcgagtctgggtcaccctcctcgagttcgtcaggctccctagcccttgggtcagcagccataagagggcaggccgaggtcacccaagatcctgctccattgctgcgcggctttcggaaaccagccaccggacaaatgaagcgaaacagaggcgaagaaatagattttgaaactccaggctctattttggttaacacaaaccttcgtgccctgattaacagccgcacttttcatgctttaccttctcattttcagcagcagttgctgttcttactcccggaggtcgatcggcaggttggcacggacgggcttctgcgactgagcagttcagccttgaacaacgaattctttactcacgctgcacaaagctggcgtgaaagactcgccgacggtgagttcactcatgagatgcaagtcaggatccgccaggagatggaaaaggaaaaaaaggtcgagcaatggaaagagaagttcttcgaggactactatggacagaagctcgggctgactaaggaagaatcgctgcagcagaatgtgggccaagaagaggccgagatcaagtcaggtctctgtgtgccaggggagtccgttagaattcagcggggccctgcgacacgacagagagacgggcattttaaaaaacggtctcgacctgacctccgcacccgagctcgcagaaacctgtacaagaagcaggagagcgagcaggcgggcgtggcgaaggacgcaaaatcagttgctagcgatgtacctctctacaaggacggggaggcaaagacagaccctgctgggttatcaagtccgcacctccccggcacctcaagtgccgccccagatctggagggtccagaatttccagtggagtctgtcgcctctcggatccaagctgagccggacaatctggcccgcgcaagcgcttcccccgataggattccctccctaccacaggagaccgttgatcaggaacctaaggaccagaagcgcaaaagctttgagcaggctgcttcagcgagcttccctgagaaaaaaccaaggctggaggacaggcaatctttcagaaacaccattgaatccgttcacactgaaaagccccagccgaccaaagaggagccaaaggttccgcccatcagaattcagctaagccggataaaacccccttgggtggtcaaaggacagccaacatatcaaatttgcccaaggattatccctacgacagaatcgtcatgcaggggatggactggtgcaagaacccttgccgatattaaggccagggccttgcaagttcgcggcgcaagaggtcatcattgtcaccgagaggctgccaccaccgccattgggggtggtggagggcctgggggaggcgggggtggcgctaccgacgagggaggcggtagaggcagttcatctggggacgggggggaagcatgtggccacccagaaccacggggaggcccctctacacccggaaaatgcacaagcgacctacaacggactcaactcctgcccccttacccgctgaatggagaacatacccaggcggggaccgcaatgagcagggcacgcagggaggatctgccctcattgagaaaggaagagtcttgcctgttacaacgcgcaacagtggggctcacagatgggttgggggacgccagccagctgccagtggcacctaccggtgaccagccctgccaagcgttgccgctcctgtcttcccaaacatctgttgccgaaagactcgtggagcagccccagctgcaccccgatgtgaggacagagtgtgagagtggcacgacgtcttgggaaagcgacgacgaggaacagggccctaccgtgcccgcagacaacggacctattttgtcactcgtgggcgatgacacactcgaaaagggaacagggcaggcgctcgatagccaccccacgatgaaagatcccgtcaatgtgacaccttcctccacacccgagagcagtccaacagactgcctacaaaatcgggccttcgacgacgagctcggcctcgggggaagctgtcctcccatgcgcgaatcggataccagacaggaaaacctgaaaacaaaggcactagtgagcaattcctcactgcactggatacctatcccctcaaatgacgaagtggtgaaacagcctaaacctgagtctcgggagcatatcccttccgtggaacctcaggttggtgaggaatgggagaaggctgcaccgaccccccctgctttgccaggcgatttgacagcagaagaaggcctggatcctttagactccttgacgtccctgtggacagttccttcacggggcggaagtgactccaacggatcttactgtcaacaagtcgatatcgaaaagctcaaaattaatggagactcggaggctcttagtccccacggcgaatccactgacacggcgagtgatttcgaagggcacctgacagaggattcgtctgaagcagatacccgtgaggccgcagtaaccaaaggtagcagcgtagataaggacgagaagccaaactggaatcagtctgctcctctaagcaaagtgaacggagacatgcgcctcgtgacaaggacagacggaatggtagctccacagtcctgggtctcccgcgtgtgcgcggttcgccagaagattccagactcacttctcttagcaagcaccgagtaccagccaagagccgtctgcttgtccatgcccggatcatctgtggaggctactaaccccttggtgatgcagctcctccaaggctcgttacctctggaaaaagttctcccacccgcccatgacgatagcatgtccgagagtccccaggtcccactgaccaaggaccagtcccatgggtccctgcgcatgggaagcttacatggcctgggcaagaacagtgggatggtggacggaagcagcccgtcaagtctccgagcactcaaagaacctctgcttcctgattcttgcgaaacaggaacgggcctcgctaggatcgaagctacacaggctcccggcgccccgcagaagaattgtaaggccgttcccagcttcgattcactgcaccctgtaacgaacccgatcaccagctcgcgcaagctggaggagatggacagcaaggaacaattcagtagcttcagttgtgaggaccagaaggaggtgcgggctatgtctcaggattccaactcaaatgccgctccgggcaagagtccaggagacctcaccacctccaggacaccccgctttagctctcccaacgtgatttccttcggccccgaacagactggacgggcgctgggagatcaaagcaacgtgactgggcaaggaaaaaagctgttcggctccggcaatgttgccgccacactccagcggcccaggcctgccgatccaatgcctctgccagcagagataccgccagtcttccccagcggtaaactaggcccaagcacgaactccatgtccggcggcgtccagacaccgagggaggactgggcccccaagcctcacgcattcgtggggagcgtgaagaatgagaagactttcgttgggggacctctgaaagctaacgcggaaaataggaaagcaaccggacattcccctttggaactcgttgggcaccttgaggggatgccgtttgtgatggacctgcccttttggaagcttccacgcgaacctggaaagggcctttccgagccactcgaaccatccagtttaccgagccaactatcgattaagcaggccttttacggcaagctgtccaagctccagctgtcttccacctcatttaactattcttcatcgagccctacattccctaagggtctcgctgggagcgttgtccaactgagccacaaggccaacttcggggcttcccattctgccagtctgtccttacagatgttcactgactcctcaacagtggagtcaatcagcctgcagtgcgcatgcagcctgaaggccatgatcatgtgtcaaggatgcggggccttctgccacgacgactgtattggtcctagtaaactgtgcgtcttgtgcctggtagtcagatag

SEQ ID NO: 178165 - DNA, 225 bp, Artificial Sequence
  Description of Artificial Sequence: Synthetic coding sequence
tgatgggccgaggccgcccggctggtgctggagaactacagcgacgctcctatgacccccaaacagatcctccaggtgatcgaagcggaaggcttaaaggagatgcgctctggtacctctccactcgcctgcctaaatgcaatgcttcactcgaattctagagggggggaaggtttattctataaacttccaggaaggatttcactgttcacgctaaaggtctag

SEQ ID NO: 178166 - DNA, 258 bp, Artificial Sequence
  Description of Artificial Sequence: Synthetic coding sequence
atgaaggacaagcagaagaagaagaaggagcggacctgggccgaggctgccaggctggtcctggagaactattcagatgctcctatgactccaaagcagatactgcaagtcatagaagctgaaggactcaaagaaatgcgcagcggcacttcccctctggcatgtctgaatgccatgctgcatagcaattcgaggggcggcgaggggttattctacaagctgcctggtcgcattagcctgttcactctgaaggtgtag

SEQ ID NO: 178167 - DNA, 255 bp, Artificial Sequence
  Description of Artificial Sequence: Synthetic coding sequence
atgaaggacaagcagaagaagaagaaggagcggacctgggccgaggcggccaggctcgtacttgagaactattctgacgcacccatgacgccaaaacagattctgcaggtgatagaggccgagggcctcaaggagatgagcggcacatctcctctggcatgccttaacgccatgttgcactcaaactcacgtggcggagagggcctattctataaactgccgggccggatcagtctgttcacactcaagcgatag

SEQ ID NO: 178168 - DNA, 2757 bp, Artificial Sequence
  Description of Artificial Sequence: Synthetic coding sequence
atgaagcggaccaagtgcgccgacatcgacgtggagacccccgactccatactcgttaacacaaatctgagagcgttaattaacaaacacaccttcagcgtgttacctggagactgtcaacagagactgctgttactccttccagaagttgacaggcaggtgggcccggatgggctcatgaaattgaacggaagcgccctgaacaatgaatttttcacatctgctgcgcaaggttggaaggagcggctgtcagaaggggagtttacccctgagatgcaggtgcgcattagacaggaaattgagaaggagaagaaagtggagccctggaaagaacagtttttcgagtcctactatggtcagagctctggcctgagtctcgaagatagtaagaaattaacagcttctcctagtgatcccaaagtgaaaaagaccccggccgagcagccaaagtctatgccagtttctgaggcgagcctgatcaggattgttccggtggtgagccagtccgaatgcaaggaggaagcattacaaatgagcagccctggacggaaggaagagtgcgaatcccagggagaagtccagccaaatttcagcacctccagtgagccactcctgtctagcgccctgaatacccatgaactcagttctattctcccgataaagtgtccaaaggacgaggatctcctcgaacaaaaaccagtgacctctgcagagcaggaatccgagaaaaaccaccttaccaccgctagcaactacaataaatctgaatctcaggagagtcttgtcacttcacccagcaagccaaagagccctggggtagaaaaacccatagtcaaaccaacagcaggtgccggaccccaggagactaatatgaaagaaccactggccactctggttgaccagtcacctgagagcctgaaaagaaaatcatcgttgacgcaagaagaggccccagtttcctgggagaagcgacccagggtgacagaaaacaggcagcaccagcaaccttttcaggtttccccccagccgttcctgaaccgtggggatcgaattcaggtgcgcaaggtgcccccgctgaagatccccgtgtctcggattagccctatgcccttccaccctagtcaggttagtccgagagcccggttccccgtgtccatcacgagtcctaacaggacaggagccagaactcttgctgacattaaggctaaggcacaattggtgaaagcacagagggctgctgcagcagcggccgcagctgctgccgcagctgcaagcgtaggtgggactatccccggcccggggcccggaggaggacaagggcctggcgaaggcggcgaaggccagacggcacgggggggaagcccgggatccgaccgggtgtcagagacaggcaaaggacccaccctggaattggctggaacgggaagcagaggtggcaccagagagctgctcccctgtggccccgagactcagcctcagtcagagaccaagacaactccatctcaagctcagcctcacagcgtctctggggctcagcttcagcaaacccctcccgtgccgcctacacccgccgtttcgggagcgtgcaccagtgtgccctcaccagcccatattgagaagctcgataacgagaagctgaaccctacccgtgctaccgcgactgtggccagtgtgtctcacccccaggggcctagcagctgcagacaggaaaaggctcccagcccgacgggctttcagttagaggatattagcacatctcaacggttcatgctggggtttgccggccggcgcacgagcaagcctgctatggccggacattaccttctgaatatcagcacttatggccgcggaagtgagtcatttaggcggactcatagcgtgaaccccgaggacaggttctgtttgagctccccgaccgaggctctgaagatgggatataccgactgtaagaacgccactggcgagagcagctcatccaaggaggatgacaccgatgaagaaagcacaggggacgagcaggagagtgtaactgtgaaggaggagccacaggtttctcagagcgcagggaagggggatacctcaagtggacctcactcccgcgaaacccttagcacttctgactgccttgcctcaaagaatgttaaggccgaaatccctctgaatgagcaaactacgcttagtaaggaaaattacttatttactagaggacagacatttgacgagaagacgctggctcgtgatctgatccaggccgcccagaagcagatggctcatgccgtgcggggtaaggccatccgctcttccccggagttgttttccagcacagtgctcccgctgccagcggactccccaacacaccagccattactgctgcctccattgcagacacccaaattgtacggtagtcccacccagattggaccaagctaccgggggatgataaatgtctccacatcctcggacatggatcacaatagcgcagttcccggctcgcaggtgtcttcaaacgtgggagacgtgatgtctttctcagttaccgtgacgactataccggcaagccaggccatgaatccctcttcacatggacaaacaattcccgtacaggccttcagcgaagagaatagtatcgaaggcacaccaagcaagtgctactgcaggttgaaggctatgatcatgtgtaagggctgcggtgccttttgtcacgacgattgcatcgggccgagtaagctgtgcgtttcatgcctggtcgtcagatag

SEQ ID NO: 178169 - DNA, 4224 bp, Artificial Sequence
  Description of Artificial Sequence: Synthetic coding sequence
atgagccacaaggagatcctgcaggtgatccagcgggagggcctgaaagagataagcagtggaacttcgcccctggcttgtctcaatgcgatgctgcacactaacagtagaggagaggagggaatcttttataaggtgcccggcagaatgggagtctacacgctgaagaaggatgtccccgacggggtgaaagagttgtccgaaggcagcgaggagagcagcgacggccagagcgactcgcagagcagcgaaaattcaagttctagtagtgacggagggtccaataaggagggtaaaaagtcccggtggaagcggaaagtgagctcctcctccccccagagcgggtgtcctagtcccacaatcccggccggaaaagttatctctcccagccagaaacattcgaagaaggctcttaagcaggcgttgaagcagcagcagcaaaagaagcagcagcagcaatgcagaccctccattagcatttcatccaaccagcatctttccctcaaaaccgtgaaagcagccagtgattccgtccctgccaagccagctacttgggagggaaagcagtccgacggccagactggctccccgcagaatagcaactcgtctttctcttcaagtgtgaaggttgaaaatacattacttggcctcggaaaaaagtccttccaacgttctgaacggttgcacactagacaaatgaagcgcacaaaatgtgccgatattgatgtggagacccccgactcgatccttgtaaatacgaacctacgcgcactcattaacaagcacacgttctctgtgctccctggagactgccagcagcgcttgctcctgctgctgcctgaggtcgaccggcaggtgggaccggatgggttgatgaagctcaacggaagcgctcttaataatgagttcttcactagcgcggcgcaaggctggaaggaacgcctaagtgagggtgaatttactcctgagatgcaagtgcgaatccggcaggagatcgagaaagagaaaaaagtggagccatggaaggagcaattttttgagagttattatggtcagagcagcgggctgtctctggaagacagtaagaagcttactgcttccccctctgacccaaaggtaaagaaaactccagctgaacagcccaagagcatgcctgtgtctgaagcgtcgctgatccgcatcgtgccagtggtgagccagtctgaatgcaaggaggaggcacttcagatgagcagcccaggacgtaaagaagagtgcgaatcccagggtgaggtccagcccaacttctcgacgtcctccgagccccttctctcatcagctctcaacactcatgaactctcttctatccttccaattaaatgcccgaaggatgaagatcttcttgaacaaaagccagtgacctccgccgaacaagagagcgagaaaaatcacttaacaaccgctagcaactataataagtcagagtcgcaagagtccctggtgacaagtccaagcaaacccaagtctcccggggttgagaagcccattgtcaaacccactgcaggcgcaggcccccaggagacgaatatgaaagagcccttggccaccttggttgaccagtcgcctgaatccctcaagcgtaaatcatccctgacccaggaggaagcccccgtgagttgggagaaacgacctagagtgactgaaaatcggcagcaccagcagccattccaggtcagcccacagccattcttgaatcggggggatagaattcaggtccggaaggttcctcccctgaaaatccccgtgtctcgaataagcccaatgccctttcatccctctcaggtgagccccagagcacgattcccagtgtcgattacttctcccaatcggactggcgcaaggactctcgccgatataaaggctaaagcgcagttagtgaaagcacagagggcagcggccgccgcagccgccgccgcggcagcagctgccagtgttggcgggaccatacctggcccaggacctggaggaggccagggccctggcgaaggcggggaaggccaaactgcccggggtggtagtcccggcagcgaccgggtcagcgagaccgggaagggcccaacgctggaactggctggcaccggatctagagggggaacgcgtgagctactgccctgtggtcccgagacgcaaccacagagcgagacaaagactaccccttcacaggctcagccacactccgtgtcgggtgcacagctccaacaaactcctcccgtcccacccactcccgctgtcagtggtgcttgcacctcagtcccctctcccgcccatatagagaaattggacaatgagaagctgaatccaacacgggccactgcgacagtggcaagcgtgtcccatcctcagggaccctcatcctgtcggcaagaaaaagccccttccccgacaggcccagcactcatttctggcgcctccccggtacactgcgccgctgacgggaccgtcgagctcaaagctggccccagcaaaaatatccccaaccctagtgcctctagtaagacggacgcgagcgtccccgtggccgttacgccgtcaccactcacctctcttctgaccaccgccacactcgagaagctgcccgtgccgcaggtgagcgcaactactgcacctgccggctcagcccctcccagctcgactctacctgcagcttcgtccctgaaaacacctgggacttcactgaacatgaacggccccactctgagaccaacttcttcaatccctgcaaacaatcctcttgttacgcagctgctgcagggcaaggacgtgccaatggagcagattttgccaaaaccgctgactaaagtcgagatgaaaactgtcccactcaccgccaaagaggagcggggcatgggcgccctgatcgcaactaacactacagaaaacagtacccgagaagaggtgaatgagaggcagagccaccctgccacacagcagcaacttgggaagacactccagagcaaacagcttccccaggttcctaggcctctgcagctattctccgccaaagaactgagagactcgagcatagacacgcaccagtaccacgagggtttaagtaaagccacgcaggatcagatcttgcagactctcatccagagggtgagaaggcaaaatttactaagcgtggtgccccctagccagtttaactttgctcattcaggtttccaactcgaggatatctcgaccagccaacgtttcatgctgggctttgccggccgccggaccagtaagcccgcaatggctggacactacttgttaaacatctctacctatggtcggggctctgagtcatttcgaagaactcacagcgtcaaccctgaagatagattctgtctgtcatcacccacagaggcccttaagatggggtacaccgattgtaagaacgctactggagaatcttcaagcagtaaggaggacgatactgatgaagaatcaactggggatgagcaagagtccgtcactgtgaaagaagaaccacaggtttcgcagtcggctggaaagggtgatacctcgtctggtccccactcccgggaaactctctccacaagtgactgtttggcgtcaaaaaatgtaaaagctgagattcctctgaatgagcaaacgactctgtctaaggagaactatttgttcacccgaggccagacattcgacgaaaagaccctggcccgcgatcttattcaggccgcccagaagcaaatggcgcacgcggtacgagggaaagcaattcggagcagtcctgagttgttcagctccacagttctgccgctgccggctgatagtccgacacaccagccactgttgcttccacccttgcaaacaccgaagctctacggcagccccacacagatcggcccatcttatagaggcatgataaatgtctctacttcctctgatatggaccataatagcgccgttcccggcagccaggtatcctcgaatgttggggatgtcatgtctttctccgtgactgtgaccacaatcccggcttctcaagcaatgaacccctcatctcatggccagacaattcctgttcaagcctttagtgaagagaacagcatagagggtacaccctcaaaatgctactgccggctcaaggctatgattatgtgcaagggatgtggggctttttgtcacgatgactgcattggaccctccaaactatgtgtgtcttgcctcgttgtgcggtag

SEQ ID NO: 178170 - DNA, 2757 bp, Artificial Sequence
  Description of Artificial Sequence: Synthetic coding sequence
atgaagcggaccaagtgcgccgacatcgacgtggagacccccgactcaatcctcgttaacaccaatctacgagctctgatcaataagcatacctttagcgtactccccggtgactgtcagcagaggctgctgctcttactgccagaggtggataggcaagttgggcccgatgggttaatgaaattgaacggctccgccctaaataacgaattcttcaccagcgcggctcaaggctggaaggaacggctttccgaaggggagttcaccccagagatgcaggtaagaataagacaagagattgaaaaagaaaagaaggtcgaaccctggaaagaacaattttttgaaagttattatggccagagttctggcctgtccctggaagacagcaagaagctgaccgcctctcctagcgatcccaaagtcaagaagaccccagcagagcaacctaagtcaatgcccgtctccgaggctagcctgatccgtatcgtgccggtcgtctcccaaagcgagtgtaaggaagaagccttgcagatgtctagtcctggcagaaaggaagagtgcgaaagccagggtgaggtgcagcctaacttttcaactagcagcgaaccgctgctctcatctgcgctcaatacacacgaactctcaagcattctgccaattaaatgcccaaaggatgaggacttactggaacagaagcctgtgacttccgccgaacaggaatcagagaagaaccacttaaccacggccagcaattacaacaaatctgaatcacaggaaagcttggtcacttccccttccaagcctaagagccccggtgtggaaaagccgatcgttaagcccactgcaggagccgggccccaggagactaatatgaaagaacctctggccaccctcgtcgatcaatcccccgagagcctgaagcgcaagtcctcgctgactcaagaggaagccccagtatcctgggagaagcgccctcgagtgaccgagaatcgacaacaccagcaaccttttcaagtgtcccctcagccatttctgaatagaggcgacaggattcaggtcagaaaggtccccccattaaagattcccgtgagtaggatctcacctatgccctttcatcctagccaagtgtccccacgagcgcgtttcccagtcagtataacctcccctaacaggaccggggccaggaccctcgctgatatcaaagccaaagctcagctggtaaaagctcagcgcgctgctgctgcagctgctgcagctgctgctgccgccgccagcgtgggaggaacaattcctgggcccggacccggtggcggccaaggccccggcgaggggggtgagggtcagactgctcgcggggggtcccccggctcggatcgagtctcggaaacgggcaaaggacccacactggaattggccggcaccgggtcacgcggaggaacaagagaacttctgccatgcggacccgaaactcagccacaatcagaaactaagaccactccttctcaggcacagccccactcagtatcaggagcccagctccaacagaccccgccggtgccgcctacccccgccgtctccggggcttgtacttccgttcctagcccagcccacatagagaaacttgacaacgagaagcttaatccaaccagggcaacagcaaccgttgcatcggtcagtcacccgcagggacccagctcttgtcgccaggagaaggcccctagtcccacaggattccaacttgaagatatcagcacttcacaaagatttatgctcgggttcgctggacgcagaacctctaagccggctatggcaggacactacctgctcaatatcagcacttacggcagggggtcagagagttttcgccgtacacactccgtgaatccagaggatagattctgcctttcgtcccccacggaggcccttaaaatgggttacaccgattgcaaaaacgctaccggagagagctcatcaagtaaagaagacgacactgatgaggagtcaaccggcgacgagcaggagagtgtgacagtgaaggaagagccacaagtctctcagtctgcagggaaaggggatacaagctctggcccccacagtagagaaacattatcaacaagtgactgcctcgcctccaaaaatgttaaagccgagatccccctgaacgaacaaacgaccctgtctaaagaaaactatctcttcactcgcggccagacctttgatgagaaaaccctcgcaagggatctgatccaagctgcgcagaaacagatggctcacgcagtgagagggaaggcaatacgtagctcacccgaactattttcctccaccgtgctccctctcccggcggattcccccacacatcagccactgctcttgcctcccctgcagaccccaaagctctacgggtcccctacgcagatcggcccatcttatcggggcatgataaatgtcagcacatctagtgacatggatcacaactctgctgtccctggttctcaggtaagctcaaatgtgggcgacgtgatgtccttcagcgtaacagtcacgacaatcccggctagtcaggccatgaacccaagtagccacggacagactatccccgtgcaagcatttagcgaagaaaattcaatcgagggcacccctagtaaatgttattgcagactgaaggccatgatcatgtgcaaggggtgtggagctttctgccacgacgactgcatcggacccagtaagctgtgtgtgtcttgcctcgtggtaagatag

SEQ ID NO: 178171 - DNA, 4308 bp, Artificial Sequence
  Description of Artificial Sequence: Synthetic coding sequence
atgcgggagaagggccggcggaagaagggccggacctgggccgaggcagccaaaactgtcttggagaagtatccgaatactcccatgagccataaagaaattctgcaggtgatccagcgagaaggactgaaggaaatccggtcaggcaccagcccactggcctgcctgaacgctatgttgcataccaatagcagaggagaggagggaatattttacaaggtaccgggccggatgggtgtctatacccttaaaaaagatgtgcccgatggagttaaagagctctcagagggaagtgaggagtccagcgacgggcagtccgacagccaaagctccgagaattcctcctctagctcagacggcggttccaacaaggaggggaagaagagccgctggaagcggaaagtgtcatcatcaagcccccagtcaggctgtccaagtcctaccattcctgcaggaaaggttatcagcccgagtcagaaacacagtaagaaagcccttaaacaggctctaaaacaacaacagcaaaaaaagcagcagcagcagtgcaggccatccatatctatctccagcaatcagcatcttagcttaaaaaccgttaaagccgcaagcgattccgtgcctgccaagcccgccacttgggagggaaagcagtctgacgggcagactggctccccccagaattctaattctagcttttcttcctccgttaaggtcgagaacactctgctgggactggggaaaaaatcctttcaacgctccgaaagactgcacacgagacagatgaagcgcactaaatgcgccgatatcgacgtggagacgcctgacagtatcctggtcaacacaaacctccgggccttaatcaataaacatacctttagcgttctccctggagactgtcagcaaagactcctgctcctgctgccggaagtggataggcaggtggggccagatggattgatgaaattgaatggatctgctctgaacaacgagtttttcacctctgccgctcagggctggaaagaacgactctcagagggagagtttactccagaaatgcaggtgagaattcgtcaagagattgagaaggaaaaaaaggtggaaccatggaaggagcagtttttcgaaagttactacggccagtcaagcggacttagtctagaagattccaaaaagctcaccgcctctcctagcgaccctaaagttaaaaaaaccccggctgagcaaccaaagagcatgcctgtctccgaggcttcgctcataagaatcgtgccagtggtcagccaatcagagtgcaaggaggaagcactacagatgtcatccccaggtcggaaggaggagtgtgaatcacaaggcgaagttcagcctaatttctccacgtcaagcgagcccctcctgagtagtgccctgaatactcacgagctttcctccattttacctatcaagtgtcctaaagatgaggatttactggagcagaagcctgtgacatcggccgaacaggaaagcgagaagaaccacctcacgacggcaagtaattacaacaaatcagagtcacaggaatccctcgttacctccccaagcaagccaaagagtccaggcgttgagaagcccattgtgaaaccaaccgcgggagccggcccccaggaaactaatatgaaggagcctttagccacacttgtggaccagagtcctgagtcactgaagcgcaagtcatctctgactcaagaggaggccccggtcagttgggaaaagaggcctagagtgaccgagaataggcaacatcagcagcctttccaggtgagcccccagccatttttaaatcgaggcgacagaatccaggtgcgcaaggttccccccctaaagattccagtgtcccggatctctcctatgccctttcacccaagccaggtttctccaagagccagattcccagtatctattacttctccaaaccgaactggtgcccggactcttgccgacatcaaagctaaagcccaactagtcaaggcgcagcgcgcagccgctgccgctgctgccgctgcagctgccgcggcttccgtcgggggcaccataccaggcccaggtcccggcggcggccagggacctggcgagggtggcgagggacaaaccgccaggggaggtagtccaggttccgatcgggttagtgagaccggcaaggggcctacactggagctagcagggacaggtagcagaggaggtacacgtgagctgctgccatgtggccccgaaacccaaccacaaagtgagacaaaaacaacaccttctcaagcacagcctcactccgtgagcggcgcccagctccagcagaccccccccgtgccaccaactcccgccgttagcggggcttgcacttctgtgccgagccccgcccacatcgaaaagttggacaatgaaaagctaaatcctactagagctactgccaccgtggccagtgtttcgcatccgcaggggccctccagttgccgccaggaaaaggctccatctcccaccggtccagctctcatttcaggtgcatctccagtgcattgcgcggcagatggcacggtggagttgaaggctgggccaagtaaaaacatccccaacccttccgcttcaagcaagacagacgcatctgtacctgttgcagtgactccatctcccttgaccagcctgttaacgaccgcaaccctggagaagctgccagtccctcaggtgagtgcaacaacagccccagccgggagtgccccacctagctccacacttcctgcggcgagcagcttgaaaacgcccggtacctcattaaacatgaacggcccaaccctgcgacccacttcatctattcctgcaaacaatccactggtgacacagctgcttcaagggaaagacgtgccaatggagcagattctacctaaacccttgaccaaagtcgaaatgaaaaccgtcccactgaccgcaaaggaggagagagggatgggggctcttatagctaccaataccaccgaaaacagcacccgtgaggaagtcaatgagcggcagtctcatcccgcaacacaacagcagctgggtaagactcttcagtcaaagcagctgccccaggttccccgccccctgcagttgttttctgccaaggagctgcgagatagcagtatcgatacacatcaataccacgaggggctcagcaaggcaactcaggaccagatattgcaaacactgattcaaagggtccgcagacagaacctgctctcagtggtgccaccctcccagttcaatttcgcccactctggcttccagctggaggatatatcgacgagccagcgattcatgctgggctttgcaggccgacgaacctccaagccggccatggccggccactaccttcttaacataagtacttatgggcggggctcagagtccttcagacggacgcacagtgtcaatcctgaagatcggttttgtctatcctctcccactgaagcactgaagatgggatataccgactgcaagaatgccactggagaatcttcatctagtaaagaggacgacacggacgaggagagtaccggggacgaacaggagagcgtgacagtcaaggaagaaccccaagtgtctcagagtgcgggaaaaggtgacacttcttcaggcccacacagtagagagacattgtcaacgagcgactgcctcgccagtaagaatgtcaaggctgaaattccacttaacgagcagacgacacttagtaaggagaattacctgtttacaagagggcaaacatttgacgagaagacattagctcgggatctcatccaggccgcccaaaaacagatggctcacgcagtgaggggaaaagctattcgaagctcccccgagctcttttctagcacagttctgcccctgcctgcagattctccgacccatcagccgcttctccttcctcccctgcaaacccccaaattgtatggatccccgactcagatcggtccttcttatcgaggcatgataaatgtgtcgactagtagcgatatggaccataatagcgcggtcccaggaagccaggtctcttctaatgtgggggacgtgatgtccttcagtgtcactgttaccaccattcctgctagccaggcaatgaaccccagctcgcacggccaaacaatccccgtgcaggcatttagcgaggagaattccatcgaagggacaccgagtaaatgttactgtcggttaaaggcgatgatcatgtgcaagggttgcggggctttctgccacgatgattgcatcggaccgtccaagctctgcgtctcttgtctggtggtccggtag

SEQ ID NO: 178172 - DNA, 6747 bp, Artificial Sequence
  Description of Artificial Sequence: Synthetic coding sequence
atgaaggacaagcggaagaagaaggaccggacctgggccgaggccgctcgacttgctctggagaaacatccaaatagccctatgactgctaaacagattctggaggtgatccagaaagaggggctcaaagaaacatcagggacttcgcccctggcatgtttgaatgccatgctgcacaccaatactagaatcggcgatgggacattctttaaaatcccaggtaaatctggcctctacgcacttaagaaggaggaaagttcttgtccagccgatggaacactggatttggtatgtgaaagcgagttggacggaacagatatggcagaagctaatgctcatggagaagagaatggcgtctgctcaaaacaggtgactgacgaagcctcatccacgagggacagctctctaaccaacactgcagtccaatctaaattagtctctagctttcaacagcacaccaaaaaggctcttaagcaagctttaaggcagcagcagaagcggagaaatggtgtctccatgatggttaacaaaacagtgcctagagtggtgctgacacctctgaaggtttccgacgaacagagcgatagtcccagcggctccgagtctaaaaacggcgaagcagattcatctgataaggaaatgaaacatggccagaagtcgccaacaggaaagcagacatcacagcacctgaagcgtcttaaaaagagtggtttaggccatctgaagtggaccaaagctgaagatatagatatcgaaacaccggggagtatacttgtgaacacaaacctgcgggcactaattaacaaacatacattcgcaagcttaccccagcatttccagcagtatctgctgctgttgttacccgaggttgataggcagatgggctcagatgggattttgcggctctctactagcgcccttaacaatgaattctttgcttacgcagcccaaggctggaagcagcgtcttgcagagggagagttcactccagagatgcagctgagaatcaggcaggagatagagaaagaaaaaaagaccgaaccctggaaggaaaagttcttcgaaagattctacggagaaaagctagggatgtcacgggaggaatccgtcaagctcaccaccgggccgaataatgccggtgcccagtcttctagcagttgtggcacatccgggctgccagtgtctgcgcaaaccgccttggctgaacaacagcccaaatccatgaaatcccccgcttctccagaacctggcttttgcgcaaccttgtgcccaatggtggaaatcccaccaaaggacattatggccgagttggagtctgaggatatactcattccagaggaaagcgtcattcaagaggagatcgctgaggaagttgagaccagcatctgcgaatgtcaggacgagaaccacaaaactatcccagagttcagtgaggaagctgaaagtctcaccaactctcacgaagaaccacagattgccccccccgaagataatctggaaagttgcgtcatgatgaacgacgtcctggaaacattgcctcatatcgaagtgaagattgagggaaaatccgagagcccccaggaggagatgactgtggtcattgaccagctcgaggtttgcgactcgctgattcccagtactagtagcatgactcacgtcagcgatactgaacacaaggagtccgagaccgccgtcgagacttctactcctaagatcaaaacaggtagttctagcctcgagggccagtttccaaatgaaggcatcgccattgacatggagttacagtctgacccggaggaacaactgagtgagaacgcatgcatcagtgaaacctcattttcatctgagagtcctgagggcgcctgtacgagcctgccctctcctggtggagaaactcagagcacttctgaagaatcctgcaccccagctagcctcgagactaccttttgcagtgaggtaagctccaccgagaacactgacaagtataaccagcgcaatagcacagacgaaaattttcacgcatcacttatgtctgaaatatctcccataagtactagccctgaaatcagcgaggcatcccttatgagcaacctgccactcactagcgaggcctccccagtgagcaacctccccctcacgtctgagacgagccccatgagcgatctgccactcacatcagaaaccagctccgttagtagcatgctccttacatctgagacaaccttcgtaagctctctgcctctgccgagcgaaacctctccaatcagcaacagctccatcaacgaacgcatggcacaccagcaacgtaagtctcccagcgtttccgaggagcctctgtcaccgcagaaggacgaatcctccgcaaccgccaaaccattgggagagaacttaacctcccagcagaaaaatctctctaatacacccgaaccgataattatgtcaagctccagcatagcacctgaggcctttccttccgaggacctacataataaaaccctgtctcagcagacctgcaaatcacatgtggataccgaaaagccctatccggcctcaatccccgaacttgccagcaccgaaatgatcaaggtgaaaaaccacagcgttctgcagaggacagagaagaaagtgttgccttctcccttagaactctcagttttttcagagggaacggataacaaaggcaacgagcttccctctgccaagctgcaggacaagcagtatatctcgtcagtagataaagccccattcagtgaaggttctcggaataagacccataagcagggcagtactcagtctaggttggaaaccagccacacttccaaaagctcagaaccttccaagtcaccagatggcatcaggaacgaatcacgagacagtgagatctccaaacggaaaacggccgagcagcactccttcgggatatgcaaagagaagcgagctcgcattgaggatgaccagagtactcgcaatatcagttctagcagtccacccgagaaagaacagcccccgcgggaagaacctcgcgtccccccgcttaagattcaattgtccaaaatcggcccgcccttcatcatcaaatcccagcctgtgagcaagccagagagtcgcgcctctacgtcaacttcagtgtccggggggaggaacacaggagcccggaccctggccgatataaaggcccgtgctcagcaggcgagagcccagcgtgaggccgcagctgccgcggccgtggccgcagcagcttcgattgtaagtggcgcaatgggatctcccggtgaaggcggtaagactagaactctagctcatatcaaggaacaaacgaaggccaaactgttcgccaaacatcaggctcgcgcgcatctattccagacctctaaagagacacgactaccaccaccacttagttcaaaagagggaccaccaaacctggaggtgagctccaccccagagactaagatggaaggcagcacaggtgtgattatcgttaacccgaactgccgatctccgtcaaacaagtcagcccacctacgcgaaactactactgttctgcaacaatctctcaacccgagtaaactcccagagactgcaacggacttgagcgtgcacagtagcgatgagaatattcccgtctcccatcttagtgaaaaaatcgtgtcctcaacctccagtgaaaattccagtgtgcctatgctgttcaataagaatagcgttcccgtgtccgtgtgctctacagccatctctggagcaataaaagagcacccttttgtcagttccgtcgataagtccagcgtattgatgtcagtggattctgctaatactaccatcagcgcgtgtaatatctcgatgctgaagacaatccagggcactgatacgccgtgcatagctattatcccgaagtgtatagagtctacacccatcagcgctacgacagaaggctcttctatatctagtagcatggacgacaagcaattgctgatttctagctccagtgcttctaacctggtatccacccagtacacttctgttcctaccccaagcatcggtaacaatctcccaaatttatccactagtagcgtgctaatccccccaatgggaatcaacaatcgattcccatccgaaaaaatagccataccgggctcagaggaacaagctaccgttagcatgggaacaacagtaagagcagctttaagctgctctgattcggtggccgtgacggattccctcgtggcacatcccacggtagctatgttcacggggaacatgttgacaatcaattcatacgattcgccgccaaagctttcagccgagagtctggacaagaattcaggcccgcgcaaccgggccgataacagcggtaaaccccagcaaccacctggcgggttcgctccagccgcaataaaccgttccattccctgcaaagtgattgtggatcactccacaacactgaccagttcgcttagcctcaccgttagtgttgagagttctgaagcgagcctggacctgcaaggcaggccagtccggaccgaggcatctgtgcagccagtcgcctgtccccaggtgagcgttatcagcaggcccgagcctgttgccaatgaggggatagatcactctagtacatttatcgccgcctcagccgccaagcaggattctaagactctgcccgccacatgcacgtcattgcgggagttacccctggtcccggacaagcttaacgagcccacggcaccttctcacaactttgccgaacaggcaaggggccccgcgcctttcaagagtgaggctgacaccacttgctccaatcagtacaacccatctaatcggatttgttggaacgacgacgggatgcggtccaccgggcagccccttgtaacgcactcaggaagtagtaagcaaaaggaatatctcgaacagagttgccctaaggctataaaaacagaacatgcaaactacctaaacgtatctgagctgcatccaagaaatcttgtgacaaatgtggctctgcctgtgaagagcgaactgcacgaggcagataaaggtttccgcatggacaccgaagacttccccgggcccgaacttccccctcccgccgctgagggcgcaagctccgttcaacagactcaaaacatgaaagccagtacaagctccccaatggaggaggcgatcagcctcgctaccgacgccttgaaaagagtgcccggagccggctcttcaggttgtcgcctgtcatcagtcgaagccaataaccctttagtgactcaactcctgcagggtaacttacctctcgagaaagtgctgccccagcccaggcttggcgccaagctggagatcaaccggcttccactcccccttcaaacgacaagtgtgggtaagaccgcacccgaacggaatgtggagattccaccatcgtcaccaaaccctgatgggaagggctacctagctggaacactggcacccctgcagatgaggaagcgggagaaccatcccaaaaaacgagttgccaggaccgtgggagaacacacacaggtcaaatgtgaacccggcaaactgctcgtagagccagatgtgaagggggtgccatgcgtgatatcatcaggcatcagtcagctgggccattcgcaaccattcaagcaggaatggctcaacaagcatagcatgcagaatagaattgtacacagtcccgaggtgaaacagcaaaagcgcctgttaccctcctgttcctttcaacagaacctgttccacgtcgataagaatggtgggtttcacactgacgcaggcacaagccataggcagcaattctaccaaatgccagtggcagcacgcgggcccataccaaccgctgctttactccaggcatcgtccaagacacccgttggctgcaatgcctttgctttcaatcgtcacttggagcagaaaggcctgggcgaagtgagcttgtctagcgcacctcaccaactgagattagctaatatgctgagcccaaacatgccgatgaaggagggagatgaagtgggcggcactgcacatacgatgcccaacaaagccctggtgcatccacctcctcccccaccccctccccctcctcctccactggctctacctccacccccccccccccctcccccattaccaccgccactcccaaacgccgaggttcccagtgaccagaagcagccgcctgtaaccatggagacgactaaaagattgagctggccacagtccaccggaatctgctcaaacatcaaaagtgagcccctgagcttcgaggaagggctgtcatcaagctgcgaactgggcatgaagcaagtgagctacgaccagaatgagatgaaggagcagctcaaggcattcgcgctcaaatcagccgacttttctagttatcttctgtccgaacctcagaagccttttacccaattagctgctcaaaagatgcaggtgcagcagcaacagcagttgtgcggtaattatcctaccatccattttggcagcacatcttttaagcgggccgcgtccgcaatcgaaaaatctattggtatactcggtagcggctcaaaccccgctacaggcctctccggccaaaacgcccagatgcccgtgcaaaacttcgcggactcaagtaatgctgacgagttggaattaaagtgtagttgtcgtttaaaggccatgatagtgtgcaaaggctgcggtgctttttgccacgacgattgcattgggccgtcaaaactgtgcgtcgcttgtctggtggtacggtag

SEQ ID NO: 178173 - DNA, 2307 bp, Artificial Sequence
  Description of Artificial Sequence: Synthetic coding sequence
atgaacggcgacagccgggccgccgtggtgaccagccccccccccactacggcgcctcataaggagcgatacttcgaccgcgtcgacgagaacaacccagagtacctccgtgagcgcaacatggctcccgacctgcgtcaggactttaatatgatggagcaaaaaaagagggtaagcatgattctgcagtcaccagcgttttgtgaagagctggaatccatgatccaggagcagtttaagaaggggaaaaaccccactggactgttagcactccagcagatcgccgacttcatgacgacaaatgtacctaacgtttacccagccgcccctcagggcggtatggctgccctcaatatgtcgctcggcatggtaacccctgtgaatgatctaagaggctccgattccattgcctacgacaagggcgagaagcttctccggtgtaaactcgccgccttttacagactcgcagatctgtttggctggagtcaactgatttacaaccacatcactacccgggtgaacagcgagcaggaacattttctgattgtcccctttggcctgctttactccgaagtcaccgccagctccctcgtgaagataaaccttcagggggatatcgtcgatcgggggtcgacgaatctcggagtgaaccaagcaggattcaccctccactcagccatctacgcagcgcggccggatgtgaagtgcgtggtccacatccacacaccagctggcgctgccgtcagtgcgatgaaatgcggcctgctgccaatttctcccgaagccctgtctctgggagaggttgcataccatgactaccacgggattctggtggatgaagaggagaaggtgctgatacaaaagaacctgggccccaagagcaaggtgctcatactcaggaatcacggcctggtcagcgttggagaatctgtggaagaggccttttactacatccacaacttagtggttgcttgcgaaattcaggtgagaactcttgcttctgcaggcgggcctgacaacctcgtactgctcaatcccgagaagtacaaagcgaagtcccgctcacctgggagtcctgtaggcgaaggcacaggatccccacctaagtggcagatcggtgagcaggagtttgaagcgctcatgaggatgctggacaatctgggctatcggacgggctacccatatcggtaccccgctcttcgggagaaatccaagaaatattctgatgttgaagttcccgcttccgtcaccgggtacagctttgcctctgatggcgactcaggaacatgctctccactccggcattcctttcagaaacagcagagggaaaagacacggtggctgaattcaggccgcggggacgaggcttcagaggaggggcaaaacggctccagtccaaagtccaaaacaaaagtgtggaccaacattactcacgatcacgtaaaacccctgctgcaatcccttagttcaggagtttgtgttccttcttgcatcacaaattgtctgtggacaaaagaggacggtcataggacaagcacctctgctgtgccgaatttgtttgtcccgctgaacacaaacccaaaagaggtgcaggaaatgaggaacaaaattcgggaacagaacttgcaggacatcaagactgcaggcccccagagtcaggttctgtgtggtgtggtgatggataggtcccttgtccagggcgagctggtcaccgccagcaaggctatcattgaaaaggagtaccagccacacgtcatcgtatcaacaaccggccctaaccccttcactactctgactgatagagagctcgaagaatacaggcgggaggtcgagcgaaaacagaaaggcagtgaagagaacctggatgaggctagggagcagaaggagaagagccccccagaccagcccgccgtgcctcacccacctccatctacccccataaaactggaggaagacctggtgcccgagccaactacaggcgatgactctgacgctgcgaccttcaagcctaccctgccagacctgagccccgacgaaccatccgaagccctggggttcccaatgctggaaaaagaagaagaggcacataggcccccgagccctactgaagcccccacagaagcaagtcccgaacctgctccggatcccgctcccgtggcggaggaagcagccccttctgccgtggaagagggcgctgccgccgacccgggatctgacgggagcccggggaagtcaccaagtaaaaaaaaaaagaagttcaggaccccaagttttctcaaaaagtcaaagaagaagtccgatagttag

SEQ ID NO: 178174 - DNA, 1989 bp, Artificial Sequence
  Description of Artificial Sequence: Synthetic coding sequence
atgaacggcgacagccgggccgccgtggtgaccagccccccccccaccacggccccccataaggaacggtattttgaccgagtggacgaaaataatcctgagtatttgcgcgaaagaaacatggcacccgatctacgtcaggattttaatatgatggaacagaagaagcgggtgagtatgatacttcaatctcctgcattctgcgaggaattggagagcatgattcaggagcagtttaagaagggaaagaaccccacaggactgctggcgctgcaacagatagccgacttcatgacaaccaacgtgcccaatgtctaccctgccgccccccaagggggtatggcagcattgaacatgtcgcttggcatggtgacccccgtcaacgatctccggggaagcgacagcattgcctacgacaaaggagaaaaattgctgagatgcaaacttgccgctttttataggctggccgaccttttcggttggagtcagcttatctataatcatatcacaactagggttaacagtgagcaggagcactttctcatagttccatttggtctgctgtatagtgaggttactgctagttctctggtaaagatcaatctccaaggggacatcgtggacaggggttccaccaatttgggagttaatcaagcgggcttcacactacacagcgcgatctacgccgcacgccccgatgttaagtgtgtagtgcatattcacacgccagcaggcgccgccgtcagcgccatgaagtgtggcctgctgcccattagccctgaagcattaagtctaggcgaagtagcctaccacgattatcacggaattttagtagatgaggaggaaaaagtgttaatccaaaagaaccttggccctaaatccaaggtcctgatcctgagaaaccacggactcgtgtcagtcggtgagagcgtggaggaggcattctactatatccataacctggtcgtagcctgcgagatacaggtgagaaccttagcttctgctgggggtccggataatcttgtcctcctgaatccagagaaatacaaagctaaatcccgttccccaggctcccccgttggcgagggcaccggtagcccgcctaagtggcaaattggagaacaggagtttgaagcactcatgaggatgttagacaacttgggatatcggactggatacccctataggtacccagccctccgggagaagtctaagaagtattctgacgtcgaagtgcctgcatcggtgacaggctattcctttgctagcgacggagactccggaacatgttcgccgctgcgccatagctttcagaaacaacagagggagaaaaccagatggttgaacagcggtcggggagatgaagctagcgaggagggccagaatgggtccagcccgaaatcaaagactaagtggaccaaagaagacggccacaggacctcaactagtgccgtgccaaatcttttcgtccccctaaataccaaccctaaagaagtgcaagaaatgcgaaacaagattagagagcaaaatctgcaggacataaaaaccgcggggccccagtctcaggtcctgtgtggcgtggtgatggaccgatctctggtccaggacgcacctctgtccgattgtactgagacaatcgagggactggagttgaccgaacagacattcagccccgctaaatcattgtcttttcggaaaggcgaattggtgacagcaagtaaagccattattgagaaagaatatcaacctcatgtgattgtaagtaccaccggacccaatccttttacaacgctgactgaccgcgaactagaggaatatcgcagggaggttgaaaggaagcagaaaggttcggaggaaaacctggacgaagcccgggaacagaaagagaagtcaccgccagatcagcccgcagtgccccatccccccccttcaaccccaatcaaacttgaagaaggtgatggctgtgctagggagtacctgcttccttag

SEQ ID NO: 178175 - DNA, 1989 bp, Artificial Sequence
  Description of Artificial Sequence: Synthetic coding sequence
atgaacggcgacagccgggccgccgtggtgaccagccccccccccaccacagcgccgcacaaggagagatactttgatcgtgtagacgagaataaccccgagtaccttagagaacggaatatggcacctgacctgcgccaggacttcaacatgatggaacagaaaaagagggtcagtatgatcctgcaaagtcctgctttttgtgaggagctggagagcatgatccaggagcagtttaagaagggtaaaaatcccactggccttctggctctgcagcaaattgccgatttcatgaccactaacgtgcctaatgtctacccagcggcccctcaaggaggaatggccgccctcaacatgtcactgggaatggttactccagtcaacgaccttcgcggctcagattctatcgcgtacgacaagggcgagaagctgttgcggtgcaaattggcggcattttacagactagcagatctgttcggatggtcacagctcatttataaccatatcacaacgagggtcaacagcgaacaggaacatttccttatagtcccattcggactgctatactctgaggtaactgctagcagtttggtgaagattaatttacagggcgacatcgtggatcggggctctaccaatctgggggtcaatcaggccgggtttactttgcatagcgccatctatgctgcccgacccgacgtgaagtgcgtagtacatatacatactcctgccggggctgcagtgagtgctatgaaatgtggacttctgcccatctcacctgaagctctgtccttgggcgaggtagcctatcacgactatcacgggattctggttgatgaagaagagaaggtactgatccagaaaaatttgggaccaaagagtaaagtactgattttgcgaaatcacggacttgtttctgtgggggaatcagtggaagaagccttctattacattcacaacctcgttgtggcatgcgaaatccaagtgagaacgttagctagtgccggcgggccagataatctcgtacttttaaacccagaaaagtacaaagccaagtcacgatcccctggttcccctgttggggaggggactgggtcccccccgaaatggcagatcggcgagcaggagtttgaggcactgatgcgtatgctggataatctgggctacagaacaggctatccgtacaggtaccctgcccttcgagaaaaatccaagaagtattctgacgtggaagttccggcatcggtcaccggttatagcttcgctagtgacggcgactctggcacgtgctcacccttgaggcactcgtttcagaagcaacagagggaaaaaaccagatggctgaattccggtagaggagacgaggcttctgaggagggacagaacggttccagtccgaaaagtaaaaccaaggtctggaccaacattactcatgaccacgtcaagccattgctacagtccttgtcttccggagtatgtgtgccatcatgtataactaattgcctatggactaaggaggatggacatcggacatcaacgtcggctgttccaaatcttttcgttcccctgaacactaatcccaaagaagtccaggagatgaggaataagatccgtgagcagaacctgcaggacatcaaaactgcgggccctcagagccaggtgctctgtggagtcgtcatggatcggtcacttgttcagggcgagctagtcactgcctcaaaggctatcattgagaaggagtaccaaccacatgtcattgtatccaccacagggcccaacccattcacaaccctaacagatcgggagcttgaggagtacagaagagaggtcgagagaaagcagaagggcagtgaggagaacttggacgaagctcgggaacagaaagagaaatcgccgcctgaccagcccgctgtaccccatccacccccctcgactccaatcaaactcgaggagggagatggctgtgcacgggagtatctcctgccatag

SEQ ID NO: 178176 - DNA, 1203 bp, Artificial Sequence
  Description of Artificial Sequence: Synthetic coding sequence
atgaacggcgacagccgggccgccgtggtgaccagccccccccccacgaccgctccccataaggaacgatacttcgacagggtggacgagaataatcccgaatatctgagggagaggaacatggctccagatcttcggcaggatttcaatatgatggagcagaagaagagagtaagtatgatcctccaatctcccgccttttgcgaggaacttgagtctatgatccaggagcaattcaaaaagggcaaaaacccaaccggtctgctcgccctccagcagatcgctgactttatgacaactaatgtcccaaacgtctatcctgctgctcctcaggggggtatggccgctttaaacatgagccttgggatggttaccccagtaaacgacctacggggtagcgacagcatcgcctatgacaaaggcgagaagctcctccgctgcaagctggccgcattttaccggttagcagacctgttcggatggagccagttgatttacaaccatattaccactagggttaattcagagcaggagcattttttaatcgtcccctttggtcttttatattccgaagtcactgcttcatctcttgttaaaattaacttgcagggagatatcgtcgaccgcgggagcaccaatctgggggtgaaccaggccggctttactttgcactctgccatatacgccgcgcggccagacgtaaaatgcgtggttcatattcatacaccagcgggagctgctgtgtccgcaatgaaatgtgggttgctcccaatttctcctgaggcccttagccttggtgaggtggcttatcatgattatcatgggatcctggtggacgaggaagaaaaggtgctgatccagaagaacctggggccaaagtccaaagtcctgattctcagaaatcatgggctagtgtcagtcggtgaatccgtggaagaggccttttactacattcacaatctggtcgtggcatgcgaaatccaggttaggaccctggcttctgctggaggtccagataatctggtgcttctgaatccagaaaaatacaaagccaagtctagatccccgggatccccagtaggggagggcactgggtctccgccgaaatggcagatcggagagcaggaattcgaagcgctcatgcgcatgctggataacttgggctatcggacatccagctcaggccgcagacaggacggctag

SEQ ID NO: 178177 - DNA, 1989 bp, Artificial Sequence
  Description of Artificial Sequence: Synthetic coding sequence
atgaacggcgacagccgggccgccgtggtgaccagccccccccccacaaccgctccccacaaggagaggtactttgacagagtcgacgagaataacccggagtaccttagagagcgtaacatggcgccagatctccgccaggacttcaatatgatggagcagaaaaaaagagtgtcgatgattctccaatcccctgctttctgtgaagagctggagtcaatgatccaagagcaattcaagaaaggaaaaaaccccaccggcttgctggccctgcagcagatagctgattttatgaccactaatgttccaaatgtgtaccctgccgcccctcagggcgggatggcagcccttaacatgtctctgggtatggtgactcccgtaaatgatctcagaggatcagactcaatcgcctatgataagggtgagaaattgctaaggtgtaagctggccgctttctacagactcgccgacctttttggttggtctcagctgatttacaaccacattactacccgggtgaactccgaacaagaacacttcctcatcgtcccatttggcctgctatacagcgaggtcaccgcttccagcctggttaagatcaatctgcagggagatattgtggacaggggatccacgaacttaggcgtgaatcaggctgggttcacactgcatagcgctatttacgcggcccggccagacgttaagtgcgttgtccacatccacacccccgcaggcgctgcagtgagcgctatgaagtgtggtctcctgcccatctcacccgaagctcttagtttaggagaggtggcctatcatgattaccacggaatacttgtggatgaagaagagaaggtgttgatccagaagaacctagggccgaagtccaaggtgttaatccttcgtaaccacggactggtgtcagtgggagaaagcgtggaggaggctttttactatatccacaacctggtggtggcatgcgagatacaagtgcggactctggccagcgccggaggcccggataacctggtcttgttgaacccggagaaatataaagcaaaatctagaagtccagggagccctgttggcgagggaacagggtcgccaccaaagtggcagatcggcgaacaggagtttgaggcactaatgaggatgctggataacctcggctatcggaccggctatccttataggtacccggcattaagagagaaaagcaaaaagtactccgacgtcgaggtgccagcctcagtgactggttattccttcgcctctgatggcgatagtggcacatgctcccccctgagacattcgttccagaagcagcagcgcgagaagacccgctggctgaacagcgggagaggggacgaggccagtgaggaaggtcagaatgggtctagccccaaaagcaaaactaaggtgtggacgaacatcacacacgatcatgttaaacctttactccagagcctgtcctccggggtatgcgtgccctcttgcattaccaactgtttgtggaccaaggaggacggccataggacatcgactagtgccgtacctaatctgttcgtccctttaaataccaatccaaaagaagtccaggagatgcgtaataaaatcagggaacagaacctgcaggacattaaaaccgccggcccccagtctcaggtattatgtggcgtggtgatggatcggtcactagtccagggggagctggtgaccgcaagtaaagctattatcgaaaaggaataccaacctcacgtgatagtcagcacgacagggccaaaccccttcacaactctgaccgatcgggagctggaggaatacaggagagaggtagagcgaaagcaaaaggggagcgaagagaatctggacgaagctagggagcagaaggagaagagccccccagaccagccggctgtgcctcaccctccaccctccacaccaattaaactggaggagggagatgggtgcgctagggagtacctgctcccctag

SEQ ID NO: 178178 - DNA, 2214 bp, Artificial Sequence
  Description of Artificial Sequence: Synthetic coding sequence
atgaacggcgacagccgggccgccgtggtgaccagccccccccccactaccgctccgcataaggaacgctatttcgatcgggtggatgaaaacaatccagagtacttgagagagcggaacatggctccagacctgcgccaggatttcaatatgatggagcagaaaaagagggtgagcatgatactccagtcccccgccttctgtgaggagttagagagtatgatccaagagcagttcaaaaaggggaagaatcctaccggcctgctggcactgcagcagatcgccgattttatgactactaacgttcccaacgtctatccagctgcaccgcagggaggcatggctgccctgaacatgtcgttgggcatggtcacacctgtgaatgacctgaggggatcagattccattgcctatgacaaaggggagaagctactgcgctgcaaattagctgctttttaccggctcgccgacctgtttggttggtctcaactgatctacaaccatatcaccacccgggtgaacagcgagcaggagcacttcctaatcgtgccgtttggcctactctatagtgaggtgaccgcttcaagcctggtcaagattaacctgcagggcgacatcgtggaccgcggcagcacaaatttgggtgtgaatcaggcagggttcaccttgcactctgcaatttacgctgctaggcctgatgtgaagtgtgtcgtccatatacatacgcctgccggcgctgctgtgagcgcgatgaaatgcggactgctccctatcagtccagaggcgctgtccctgggagaagtagcctaccacgattatcatggcattttagtagacgaggaggaaaaagtgctgattcagaaaaaccttgggccaaaatccaaggtgctgatcctgcggaatcacggcttggtgtcagttggcgaaagtgtggaggaagcattctactacatccacaatctggtagtagcctgtgagatacaggtgcgaaccctggcctcggcggggggccctgataacctcgtgctgctgaaccccgaaaaatacaaagcaaaatcccgctctccgggatctcctgtgggcgagggcacaggaagtcctcctaagtggcagattggagaacaagagttcgaggcactcatgcggatgctggacaatctgggttaccggactggttacccgtatcgttaccctgccctacgcgaaaagagcaaaaaatattcagacgtggaggttcctgcatctgtgacgggatattccttcgcctccgatggcgactccgggacctgctcccctctccgtcacagtttccagaaacaacagcgagagaagactaggtggctaaactcagggagaggggatgaggcctctgaggagggacagaacggaagtagccccaaatccaaaaccaaatggacgaaggaggacggccaccgcacaagcacttccgccgtgcctaatctgttcgtgccacttaatactaatccgaaggaagtacaggaaatgcggaataagattcgcgagcagaatctgcaggatatcaagaccgccggtccgcagagtcaggtgttatgtggggtggtgatggatcgttcccttgtgcagggcgaacttgtaaccgctagcaaagctattattgagaaggaataccaaccacacgtcatagtttcaactaccggccccaaccccttcactactctgacagatcgggaattggaagagtataggagagaagtggagcggaagcaaaaggggagcgaggaaaacctggatgaagcacgcgagcagaaagaaaaatcccctcccgaccagcccgcagtaccccaccccccaccctcaacgcctatcaagctcgaagaggatttggtccctgaacctaccacgggagatgacagcgatgcagccacgttcaagcctaccctgcccgacttaagtcccgacgagccatccgaagcgctgggatttcctatgcttgagaaggaggaggaggctcacagacctcctagcccaacagaggcaccaactgaagcctcccccgagcccgccccagatcctgctccagtggctgaggaagccgccccctctgcagttgaggagggggctgccgcagaccctggatcagatgggagccccggaaagtctccatcaaagaaaaagaaaaaattcagaaccccctcttttctgaagaagagcaaaaaaaaatcagattcctag

SEQ ID NO: 178179 - DNA, 2214 bp, Artificial Sequence
  Description of Artificial Sequence: Synthetic coding sequence
atgaacggcgacagccgggccgccgtggtgaccagccccccccccactactgctccccataaggagcgctactttgaccgagtggatgagaacaaccctgaatatctgcgcgaacgcaatatggccccagatctaaggcaggattttaatatgatggagcaaaagaagcgggtgagcatgatcctgcagagtcccgcattctgcgaagagttggagtcgatgattcaggaacagttcaaaaagggcaagaaccctaccggtttgctggcactccagcaaatcgccgattttatgacaacgaatgtgcctaacgtctatccggccgcgccacaggggggtatggctgctcttaacatgtccctggggatggttaccccggtcaatgatctccgtggatccgactctatagcctacgacaagggagagaaactattacgctgcaagctagccgccttttaccggcttgccgacttgttcgggtggagtcagctgatttacaaccacattaccacccgagtcaacagtgagcaggaacactttttgatcgtccctttcggcctcctgtactctgaggttacggcaagctccctggtgaagatcaacctgcaaggagatatagtggaccgaggcagcacgaatctaggtgtgaaccaagcagggttcacgctccactctgccatctatgctgcaaggccggatgtgaaatgtgtggtgcacatccatactcctgcaggggccgctgtgtctgctatgaagtgcggtctgctgcctatctcccctgaagcgctgtctctgggggaagtcgcctaccatgattaccacggcatcctggtagatgaggaggagaaagtcctcattcagaaaaatctgggccctaagtccaaggtcctgattctcaggaaccatggccttgtatccgtgggggaatctgtggaagaggctttttactacattcacaacctggtcgtcgcctgcgaaatccaggtcaggaccctcgcttccgcaggcggtccagataatttggtcctgctgaatcctgagaagtataaggctaaaagcaggagcccaggcagcccagtcggcgaaggtactggctctcccccgaaatggcagatcggagaacaggagttcgaagccctgatgagaatgttagataacttgggctaccgtactggatacccttaccgttatcccgccctgcgtgaaaaaagtaagaagtattctgatgtggaggttcctgcttctgttaccggttactcttttgcttcggatggggactcgggtacttgctctccgctccggcactccttccagaagcagcagagagaaaagaccaggtggctgaactccggtagaggggatgaggcctctgaggagggacagaatggaagctcacctaagagcaaaacaaagtggacgaaggaagacgggcaccgcacttccacaagcgcagtgccaaatttgttcgtccctctcaacacaaatcccaaagaggtgcaggagatgagaaacaagattagggagcagaacctgcaggacattaaaacagcaggcccccaatcccaggtgctgtgtggggtcgtgatggatcgtagcctcgttcagggcgaactggtgacagcctctaaagccattatcgaaaaggagtaccagcctcacgtgattgtcagcacaaccggccctaatcccttcaccacgctgacagatagggaactggaagagtacagacgggaagtggagagaaaacagaagggttccgaagaaaatctggacgaagcacgagaacagaaggagaaaagccctcccgatcaacctgccgtgccccacccccccccctctactcctatcaagctagaggaggacctggtccccgagccgacaacaggggacgatagcgatgccgccacctttaagcctactcttcccgaccttagtccagacgagccatccgaagccttgggtttcccgatgttggaaaaggaggaggaggcccatcgcccccctagtcccactgaagctcctaccgaagcctcccccgagccagcaccagatccagcacctgtggcggaggaggccgcccccagcgcagtcgaagagggcgccgcagccgatcctgggtcagacgggtctccagggaaaagcccatcaaagaaaaagaagaagttcaggacacctagtttcctgaaaaaatcaaaaaaaaaatcagactcttag

SEQ ID NO: 178180 - DNA, 414 bp, Artificial Sequence
  Description of Artificial Sequence: Synthetic coding sequence
atgaacggcgacagccgggccgccgtggtgaccagccccccccccacaacggctccacacaaggaacgctacttcgaccgggtggacgaaaataacccagagtacctgagggagcggaacatggcccccgatctgagacaggatttcaatatgatggagcagaagaaacgggtctctatgatactgcagagccctgctttttgtgaggagctggaaagtatgattcaagagcagtttaaaaaggggaagaacccgaccggcttgctcgccctgcaacagatcgcggatttcatgacgaccaatgtgccaaacgtttatcctgcagctccccagggaggtatggccgccctgaatatgtccttgggaatggtcacaccagtcaatgatttgaggggctctgacagtatcgcgtag

SEQ ID NO: 178181 - DNA, 1899 bp, Artificial Sequence
  Description of Artificial Sequence: Synthetic coding sequence
atgaacggcgacagccgggccgccgtggtgaccagccccccccccactactgctccacataaagagagatatttcgaccgagtggatgagaacaacccagagtacctccgcgagaggaacatggctcccgaccttcgccaggatttcaacatgatggagcagaaaaagcgggtttccatgatccttcaaagtccggccttctgcgaggaactggagtccatgatccaggagcaattcaagaaggggaagaaccccaccgggctgcttgccctccaacagatcgccgatttcatgacgactaatgtgccgaacgtgtaccctgcagctccccagggaggcatggctgcactcaatatgtccctggggatggtgacaccagtgaacgatcttcgcggctccgatagcattgcgtacgataagggtgagaagcttctgaggtgtaaattagccgcattttatagattggccgacttatttgggtggtcccagctgatatacaatcatatcaccacaagagttaattctgagcaagaacactttctgattgtcccatttggtttgctatactctgaagtaacggcatctagccttgttaagataaaccttcagggtgatatcgtggatcgggggagtacaaatttaggggtaaaccaagcggggtttaccctgcactctgcgatttacgctgctagacccgacgtgaaatgcgtggtacacatccacacgccggctggcgccgcagtgtcagccatgaagtgtggcctgttgccaatctcccctgaggccttgtctcttggcgaagtagcctaccatgattaccacggcatattggtggacgaggaggaaaaggtcctgattcagaagaatctcgggcctaagtccaaggtacttatcctgcgcaaccacgggctggtttctgtgggcgagagcgtcgaagaagctttctactatattcacaatctcgtggtcgcatgcgaaatccaagtccggaccctggcttccgctggaggaccagacaacttggttctcctgaatccagaaaaatataaggcgaaatcccgcagcccgggaagtccagtcggagagggtacggggtctccccctaagtggcagatcggcgaacaggagtttgaggccctcatgcgaatgctcgataacctgggatatcgtaccggctatccatacaggtatcctgctctgcgggagaagtccaagaaatactcagatgtggaggttcccgcatcagtgaccggctattcttttgcctcagacggagactcagggacctgctcaccgctgaggcattccttccagaaacaacaacgcgaaaagactcggtggctaaactccggtcgtggtgacgaggcttccgaagagggccagaatggaagcagtcccaaaagcaagaccaagtggacaaaagaagacggacatcgaacctccacgtctgccgtgccgaatctgttcgttcccttgaacactaaccccaaggaggtgcaagagatgcgcaacaagattcgggaacagaatttgcaagacatcaagaccgccggaccacagtctcaagttctctgcggagtcgtcatggatcgctctcttgtacagggagagctcgtgaccgcttctaaagctatcatcgagaaggagtaccagccacacgtaatcgtgagcacaaccggtcctaacccctttaccacactgaccgaccgggaactagaggagtatagacgcgaagttgaacgcaaacaaaagggatctgaggaaaacttagatgaagctagagagcaaaaagaaaaatcaccccccgatcaaccagcagtgccccatccgcccccatcgacccctatcaagctggaagaagccggcgacggatgcgcgcgagagtacctcttgccttag

SEQ ID NO: 178182 - DNA, 1335 bp, Artificial Sequence
  Description of Artificial Sequence: Synthetic coding sequence
tgagtgctgatcctgcggaaccacggcctggtgagcgtgggcgagtctgtcgaggaagctttctactatatccataatctggtcgtggcatgcgagatacaagtccgcacactcgcatccgctggcggaccggataacctggtgctcctgaatccggagaagtataaggcgaagtctagatcacctgggtcgccggttggagaaggtacgggctccccccctaagtggcagataggagaacaagagtttgaagcattgatgagaatgttggataaccttgggtaccgaacgggatatccctaccggtaccccgcattgcgggaaaaatctaagaagtattctgatgtagaggttcccgcaagtgtcaccggatactccttcgcctctgacggggactctgggacatgcagcccgttaagacacagctttcagaagcagcagagagagaagaccagatggctcaattcaggtcggggcgatgaggccagtgaagagggccagaatggcagtagcccgaagtccaaaaccaaggtgtggacaaacatcacccacgatcacgtgaagcctctgctgcagtctctcagctcaggagtgtgcgtgccttcctgcatcaccaactgtctgtggaccaaagaggacggacaccggacgtccacctccgcagtcccaaacctcttcgttcctttgaacactaaccccaaagaggtgcaagaaatgagaaacaaaattcgggaacagaacctgcaggatattaagactgccggaccacagtctcaagtgttatgtggcgttgtaatggaccggtcacttgtccagggggagttagttaccgcatccaaagccatcatcgagaaggaatatcagccccacgtgatcgtgagcacaactggcccaaacccctttactactctgacggaccgcgaacttgaggagtaccggagggaggtggagcgtaaacagaaaggctcggaagaaaatctagacgaggcccgtgagcagaaggagaaaagtcctcctgaccagcctgccgtacctcacccgcccccgtccacacccatcaagctggaagaagatctcgttccggaacccaccactggcgatgatagtgatgctgccaccttcaagccgacccttccagatctgtctcccgatgaacctagcgaagcgctcggcttcccaatgcttgagaaagaggaagaagctcacaggcccccgagtcccaccgaagccccaactgaggcttcgccggaacccgccccagatccagcccctgtcgccgaagaggccgctccttcagcagttgaggaaggtgccgccgccgatcccggctcatag

SEQ ID NO: 178183 - DNA, 2181 bp, Artificial Sequence
  Description of Artificial Sequence: Synthetic coding sequence
atgagcgaggagaccgtgcccgaggccgccagccccccccccccccaggggcagccctatttcgaccggttctcagaggacgatccagaatacatgcgcttacgcaaccgcgccgctgacctcagacaggatttcaacctgatggaacagaagaagagggtgactatgatcctgcagtctccaagctttcgcgaggagcttgaggggctcatccaggagcaaatgaagaagggaaataacagttctaatatttgggcccttagacagatcgcagatttcatggcgtctacatcccatgcagtgtttccaaccagttccatgaacgtctctatgatgactccaattaacgacctccacactgccgattcactcaacttggcaaagggcgagcggctgatgagatgtaaaattagctcagtgtaccggctcctggacctgtatggatgggcacagttgtccgatacctacgtcacactcagggtgagcaaggaacaggatcactttcttattagtccaaaaggagtgtcttgcagcgaagttactgcctctagtctgattaaagttaacattctgggcgaagtggtggagaaggggtcctcttgttttcccgtcgacacaaccggattttgcttgcattcagccatttatgcagcaaggcctgatgtgagatgcattatacatctccatacccccgccacagccgcggtcagtgcgatgaagtgggggctgctgcctgtgagtcataacgctctcctcgtcggcgacatggcctactacgatttcaatggcgaaatggagcaggaggcggaccgtatcaatctgcaaaagtgccttgggcctacatgtaagatcctggtccttcgaaatcatggagttgtcgccctgggtgacactgtggaggaagcattctataaaatatttcatctgcaagccgcatgcgagatccaggtgtccgcgctttctagtgccgggggtgttgaaaatttgatactgctggagcaggaaaaacaccgcccgcacgaagtggggtctgtgcagtgggccggcagcacctttggtccaatgcagaaatccaggctgggcgaacatgaatttgaagccctgatgagaatgctagacaatctagggtatcgaaccggatatacataccgccatccttttgtacaggaaaaaacgaaacataagtcagaagtggagatcccggcaacagtgactgccttcgtcttcgaagaggacggggcccctgtcccggccttgcgccagcacgcccagaagcaacagaaagagaaaactcgatggctgaacacacccaacacgtacttgcgggtcaacgtcgccgatgaggtgcaaagatcaatgggatcgcccaggcccaagactacttggatgaaagccgacgaggtggagaaaagctcgagcgggatgcctataagaatcgaaaatcctaaccagttcgtccctctctataccgacccccaggaagttctcgaaatgagaaacaagatccgcgagcagaatagacaagacgtgaagagcgcagggccacaaagtcagctcctggcaagcgtgattgccgagaagtccaggtcccccagcacagagtcacagctcatgtcgaaaggagacgaagacacaaaggacgatagtgaagaaactgtgccgaacccattctcacaacttacagatcaggagcttgaagagtataagaaggaagtggagaggaagaaactagaactcgacggagaaaaagaaactgcgccggaggagccagggagccctgccaaaagcgctccagcctcacctgtccagtcaccagccaaagaagccgagaccaagtcacctcttgtgtccccctctaagtcattggaggaggggacaaagaagacagagacctccaaggcagctacaactgaaccagaaacaactcagcctgagggagtggtggtgaacggtagagaagaagagcaaaccgcagaagagatcctctcaaaggggttatctcagatgactacctctgccgataccgacgttgacaccagtaaagataaaactgagtctgtgactagcgggccgatgagcccagaaggtagcccgagtaaatctccctcaaaaaaaaagaagaaattccggacccctagttttctcaaaaagtctaagaagaaagaaaaagttgaaagctag

SEQ ID NO: 178184 - DNA, 297 bp, Artificial Sequence
  Description of Artificial Sequence: Synthetic coding sequence
atgagcgaggagaccgtgcccgaggccgccagccccccccccccccagggacaaccttacttcgacaggttttcggaggatgaccccgagtatatgcggctccgaaatcgcgcggccgacctccgtcaggactttaatctaatggagcagaaaaaacgcgtgactatgattctgcagagtccaagcttcagagaagagttggaagggctgatccaggagcagatgaagaaagaatacaagaaagaagtggagcgcaagaagcttgaactggatgcacctggatggtttagctcttag

SEQ ID NO: 178185 - DNA, 1764 bp, Artificial Sequence
  Description of Artificial Sequence: Synthetic coding sequence
atgagcgaggagaccgtgcccgaggccgccagccccccccccccccagggccagccttattttgaccgattctccgaggacgaccccgaatatatgcgcctgaggaatagagctgcggatttgaggcaggacttcaacctcatggaacaaaaaaaacgagtcacgatgatcttacagagcccctccttccgggaggaattggagggcctgatacaggaacagatgaaaaaggggaacaacagctcaaacatttgggccctgcggcagatcgctgacttcatggcatcaacgtcccacgccgtcttccctacatccagcatgaacgtatctatgatgacgccgatcaatgatctgcacacagctgatagcctcaatctggcaaagggagagcggctgatgcggtgcaagatcagtagcgtctacagattgctcgacctttacggatgggcccagttgtcggacacctacgttaccctgagagtaagcaaggaacaggatcactttttaattagtcccaaaggggtgtcctgcagcgaagtcactgcctcttctctgataaaggtaaatatcctaggagaagtggtcgagaaaggaagctcatgttttcccgtagacacaaccggattttgtctacatagcgccatatatgcagccaggcccgacgttcggtgcattattcacctacacaccccagccacagccgctgtttctgccatgaagtggggactattacccgtgtcccataacgccctgttagttggtgatatggcgtattatgacttcaatggcgagatggaacaagaagccgaccgcattaatctacaaaagtgcttggggcctacctgcaagatcctggtgctgcgcaaccacggagtggtggctctgggcgacactgtggaggaagcgttttacaagatttttcacttgcaagccgcatgcgagattcaagttagtgcacttagctccgcaggtggagtggaaaatctgatactgctggagcaggaaaagcacagaccgcatgaagtcggctccgtacagtgggctggctcaacatttggcccgatgcaaaaaagtagactgggcgagcatgagtttgaggcgctcatgcgaatgcttgacaatctgggataccggaccgggtatacatatagacatccctttgtccaagaaaagacaaagcacaaatctgaagtagagattccagcgacagtaacggcttttgtgtttgaagaagacggcgctcctgtccccgccctgcgtcagcacgcacagaagcagcagaaagagaaaacccgttggctgaacaccccaaatacttacctcagggttaacgtggccgatgaggttcagaggtctatgggtagtccacgccccaaaaccacatggatgaaagcagacgaggtggagaaaagttcttcggggatgccaatcagaattgaaaaccctaatcagtttgtccccctctacactgaccctcaggaggtccttgagatgaggaataagatacgcgagcagaacagacaggacgtcaaatccgcaggtccccagtcccagcttctggccagcgtgatcgcagaaaaatctcgatccccgtcaacagagagccagcttatgtcaaaaggcgacgaagacacaaaggatgactccgaggaaacagtccccaatccattttcccaattaacagaccaggagcttgaggaatacaagaaagaagtggagcgcaagaaattggaactggacgccccaggatggttcagcagctag

SEQ ID NO: 178186 - DNA, 2181 bp, Artificial Sequence
  Description of Artificial Sequence: Synthetic coding sequence
atgagcgaggagaccgtgcccgaggccgccagccccccccccccccaaggccaaccatatttcgaccgcttttctgaggatgatccagagtacatgaggctccgaaaccgtgctgccgatttgcggcaggacttcaaccttatggaacagaagaaaagagtgacgatgattttacagtctccgtcttttcgtgaggagctcgaaggactgattcaggagcagatgaaaaaaggtaataattcaagcaacatctgggcactccgccagattgcagacttcatggcttcaaccagtcatgcagtgttccctaccagttcgatgaacgtgagcatgatgacccctatcaacgacctgcatactgccgacagcctcaacttggctaaaggagaacggttaatgaggtgcaaaattagttctgtctatcgtctcctcgacctgtatggctgggcccagctgtctgacacttatgttacactccgcgtgtctaaggagcaggaccactttctcattagtcccaagggcgtgtcttgctctgaggtgactgctagctccctgatcaaagtgaatattctgggcgaagtcgtggagaagggttcctcctgcttcccagtggacaccaccggcttttgtctccattctgctatctatgccgcccgccctgacgtgagatgtatcatccatctgcacaccccggccacagctgccgtatccgccatgaagtggggtttactccctgtgagtcacaacgctcttctggtcggggacatggcttactatgactttaatggagaaatggaacaggaagctgacagaattaacttgcagaagtgcttgggccccacatgtaaaattttggttctccggaatcacggtgtggtcgctctcggcgacactgtggaagaggcgttttataagatatttcatctgcaggcagcctgcgaaatccaggtgtctgctctgtcttccgctggtggggtggagaatctcattctgttggagcaggagaagcatcgcccacacgaagttgggtcggttcaatgggctggttccacctttggccctatgcaaaaaagccggctgggcgagcacgaattcgaggctctaatgcgaatgcttgataacttaggatacaggaccggatacacataccgacatccatttgtacaggagaaaactaaacacaagagtgaagtggaaatccccgcgacggtgacagcattcgtgtttgaagaagatggggccccagtgccagctctccgtcagcacgctcagaagcaacagaaagaaaagacacgttggctgaacacaccgaacacttatctgcgcgttaatgtggcggatgaggtccagcgtagcatggggtcaccaagaccaaagacaacctggatgaaggcagatgaggtggaaaagtcgagcagtgggatgccaataaggattgaaaatcccaatcagtttgtgccactgtacacggacccgcaggaggtgctcgagatgaggaataaaatccgtgaacagaatcgtcaggatgtgaaatctgctggaccccagtctcaactgctcgcctcagtaattgccgaaaaaagtcgtagcccaagcacagagagtcagctgatgagtaagggtgatgaggataccaaggatgacagtgaggagacagtacctaatccgtttagccagctgacagatcaagagttggaggaatataagaaagaggtcgagaggaagaaactcgagctggatggcgaaaaggaaacggcccctgaggaaccgggtagtcccgctaagagtgctcctgcaagtccagtccagtctccagctaaagaagccgagaccaagtcacccctggtctctcccagcaaaagtttggaagagggtacgaaaaagacagagacctccaaagcagccacaacagaacccgaaacaacgcagcctgaaggggttgtggtgaacgggagggaggaagaacagaccgccgaggagatactctccaagggcctttcccaaatgaccaccagcgccgacactgacgtagatacatcaaaagacaagactgagagcgttaccagcggaccaatgtctcccgaaggatccccgagcaagtctcctagcaagaagaagaagaaatttaggaccccgtccttcctcaagaagtccaaaaaaaaagaaaaagtggaatcatag

SEQ ID NO: 178187 - DNA, 2181 bp, Artificial Sequence
  Description of Artificial Sequence: Synthetic coding sequence
atgagcgaggagaccgtgcccgaggccgccagccccccccccccccaggggcagccatatttcgacaggttctcagaagatgacccagagtacatgcggctgagaaatcgagctgcagacctgagacaggacttcaacttgatggagcagaagaagagagtgacaatgatactgcaaagtccctcattccgagaggagttggaaggcttaatccaggaacaaatgaagaagggcaacaattcttcgaatatttgggccctgcggcagattgccgacttcatggcctccacatcccacgctgtgttcccaacctccagtatgaacgtctccatgatgacgccgattaacgacctccacacggccgactcattgaacttggccaaaggcgagcggctgatgcgatgcaagattagttcagtctaccggctgctggacctgtacggctgggctcagctctcagatacctacgtgaccctcagggtgagtaaggaacaggaccacttcttgatttcaccaaagggcgtgtcttgcagcgaggtgactgcaagcagcctcataaaggttaacatcctaggggaggtagtggagaaggggtccagctgctttcctgttgataccacaggattctgtctgcacagcgccatctacgctgcccgaccagacgtccgctgcatcatccacctgcatacccccgccactgccgctgtgtctgcgatgaagtggggtctgttacctgtctctcacaatgccctgctggtcggcgacatggcctattacgattttaacggagagatggaacaagaagccgaccgtattaacttgcaaaagtgtttggggcccacgtgtaaaatccttgtcttgcgaaatcatggtgtcgtggcgttaggagacacagtggaagaggccttctacaaaatctttcatcttcaggcggcatgtgagatccaggtcagtgctctgagcagcgcaggcggagtggagaatctcattcttctggaacaggaaaaacatcggccacacgaggttggtagcgtgcagtgggctggttccacctttggcccaatgcagaaatctagactaggcgaacacgaatttgaggcgctgatgcgtatgcttgataacctgggctacaggaccggttacacttaccggcatccatttgtgcaggagaaaaccaagcacaaatctgaggtggagatacccgccaccgtgacagcgttcgttttcgaggaggacggcgcccccgtcccagccttgcggcagcatgcccagaagcagcagaaagagaagacaagatggttaaacacacctaatacatacctgcgggtgaacgtcgctgatgaggttcaacgctcgatgggctcccccagacctaagaccacttggatgaaggcagatgaggtcgagaagagcagttcaggaatgccaatcagaatcgaaaatcccaaccaattcgtcccactgtacacggatccccaggaggtgctggaaatgcggaacaagatcagggaacagaacaggcaagacgttaaatcagccggacctcaatcccagctgttggcaagcgtcatcgccgagaagagcaggtcaccctccactgagagtcaactgatgagcaaaggcgatgaggacaccaaggatgatagcgaggagaccgtgccaaatcccttttcccagctcacagaccaagagctggaggaatacaagaaagaagtggagagaaaaaagctggaactggacggcgagaaagagactgcacctgaagagccaggtagccctgctaagagtgcccccgcttctcccgtccagagcccggctaaggaggccgagaccaagtccccccttgtaagccctagtaagagtctggaagaaggcaccaaaaaaacagaaaccagcaaggcggcaacaactgagccagagactacacagccggagggtgtggttgtgaacgggcgggaagaggagcaaactgccgaagagattctctctaaggggctttcacagatgaccacgtcggcagatacggatgtggacacttcaaaagacaaaacagaaagcgtgacttccggcccaatgagcccagagggctcaccctccaagagtcccagtaagaagaagaaaaagttccgcactccttcctttttaaagaagtccaagaaaaaggagaaggtcgagagttag

SEQ ID NO: 178188 - DNA, 1680 bp, Artificial Sequence
  Description of Artificial Sequence: Synthetic coding sequence
atgagcgaggagaccgtgcccgaggccgccagccccccccccccccaggggcagccatatttcgaccggttttctgaagatgatcctgagtacatgcgcctgcggaacagagcagccgacctcagacaggactttaaccttatggaacaaaagaagagggtcacaatgattctgcaatctccttcttttagggaagaactggagggcctgatccaggaacagatgaaaaagggaaacaattcctccaacatctgggccctaaggcagattgccgatttcatggctagcacttctcatgctgtctttcctactagcagtatgaatgtgagcatgatgacccccataaatgacctgcatactgctgactctctcaatttggctaaaggcgagcgcctgatgcggtgtaaaatctcaagtgtttatcgtctgctcgatctttacggctgggctcagctcagcgacacctatgtaaccctgcgcgtgtcaaaggagcaagaccatttcctgatttcgccaaaaggagtgtcatgttcagaagtgacagcatcttcactcatcaaggtcaatatcttgggcgaagtggtggaaaaaggcagctcttgttttccagtggacacaaccgggttctgcctgcacagtgcgatatatgcagccaggcccgacgtgcgatgtatcattcacttacatacgccggccaccgccgctgtatctgcaatgaagtggggcttgttacctgtcagccataacgcccttctggtgggcgatatggcttactacgacttcaacggagaaatggagcaggaggccgatcgtattaatctgcaaaagtgcctgggccctacatgcaagatcttagtactccgaaaccacggcgtggtcgctctgggcgacacggttgaagaggccttctacaagattttccacctgcaggccgcctgtgaaattcaggtgtccgccttgtctagcgccggcggcgttgagaacctgatccttctagagcaggaaaagcaccggcctcatgaggtggggagtgtccagtgggccgggtcaacttttggccccatgcagaagagcagactgggggagcacgaatttgaggccctaatgcggatgctcgataatttaggctatcggacaggatatacgtaccggcatccattcgtacaagagaaaaccaaacacaagtctgaagttgaaattcctgctaccgtgacagcttttgtgttcgaagaagatggcgcccctgtccccgcgcttaggcagcacgcccaaaaacagcagaaggaaaaaaccaggtggctaaacactccgaatacatacctcagagtgaacgtggctgatgaggtccagagatcaatggggagcccgcgcccaaagacaacttggatgaaggctgatgaggtagagaaatcctcgtctggtatgccaatccgaatcgagaacccaaaccaattcgtcccgctgtataccgatccccaagaggtgcttgagatgcggaataaaatacgcgaacagaaccgccaggatgtcaaaagcgctgggccgcagagccagttgctggcgagtgtgattgctgagaaaagtcgcagcccagtagaacaacgcctccccctgacaggaggcgagacttgcttaccttccggcagctctgtccctggcgcgggattacaagacccctag

SEQ ID NO: 178189 - DNA, 681 bp, Artificial Sequence
  Description of Artificial Sequence: Synthetic coding sequence
atgagcgaggagaccgtgcccgaggccgccagccccccccccccccaggggcaaccctactttgatagattttcagaggatgacccagagtacatgagactccggaatcgcgcggctgatctcaggcaggacttcaatctcatggagcaaaagaaaagagtgactatgatcctgcagtcaccatctttcagggaggaactcgagggtctgatacaggagcagatgaagaagggtaacaactcctcgaacatctgggctctgagacaaatcgccgacttcatggccagcacttctcacgctgtgttccccactagctccatgaacgttagtatgatgacgcccattaatgacttgcacactgccgacagtctgaacctggccaaaggggaacgcttgatgagatgcaaaattagcagtgtatatagacttctggatctgtacggatgggcccaattaagtgatacctacgtgaccctgagagtgtcaaaggagcaagaccatttcctcatttctcccaaaggggttagctgttccgaagtgacagccagttccctcattaaggttaatattctgggggaggtggtggaaaaagggtcgtcctgtttcccagtggatacaacaggattctgtttgcattccgctatatacgctgcccggccggatgtgcgttgtattatctag

SEQ ID NO: 178190 - DNA, 432 bp, Artificial Sequence
  Description of Artificial Sequence: Synthetic coding sequence
atgagcgaggagaccgtgcccgaggccgccagccccccccccccccaggggcaaccctacttcgacagattctctgaggatgacccagagtacatgcgccttcggaaccgggccgcggatctgcgtcaggatttcaacctgatggagcaaaagaagagggtgaccatgattttgcagagccccagctttagagaagagcttgaggggttgatacaggagcagatgaagaagggaaacaattccagcaatatttgggctctgaggcagattgcagactttatggcttcgaccagccatgccgtcttccctaccagcagcatgaatgtgtccatgatgactcctattaatgatctccacacggctgactcactgaatctcgccaaaggcgaaagattgatgcggtgtaaaatttcaagcgtgtatcgcctctag

SEQ ID NO: 178191 - DNA, 1728 bp, Artificial Sequence
  Description of Artificial Sequence: Synthetic coding sequence
atgccccggcggcgggtgcccggcgccaactgcaagcccaccggcaaaatgtcagaggagaccgtgccagaagctgccagcccccctccgccgcaggggcagccttatttcgacaggttctcagaggacgacccagagtacatgcgactgaggaaccgagccgccgacctgcgtcaagactttaaccttatggaacagaaaaaacgtgtgaccatgatcctccagtccccatctttcagggaggagctcgagggtctaatacaggaacagatgaagaaaggcaacaactcatccaacatctgggcattacggcaaatagccgattttatggcctcaacatctcacgcggtgttccccacaagcagcatgaatgtttccatgatgacacctatcaatgatctgcatactgctgactctcttaatcttgctaaaggagaaagacttatgcggtgcaaaattagttccgtgtacagattgctggacctgtacggctgggcgcaactcagcgatacatatgttaccctgcgcgtatctaaagagcaggaccacttccttatttccccgaagggagtgtcctgttctgaggttaccgcttcatctctcattaaagtgaatatcctgggtgaggtagtagagaaaggtagctcctgctttccagtggacactacagggttttgtcttcacagcgcaatctacgctgcgcgccccgacgtgagatgcatcatccacctgcatacccctgcaaccgcggcggttagcgcaatgaagtggggcttgttacctgtgagccataacgccctgctcgtcggcgacatggcctactacgacttcaacggtgagatggagcaagaggcggacagaattaatctccaaaagtgcctaggcccaacctgcaaaatcctggtgctgcgtaatcatggggtcgtcgccctgggtgatactgtggaggaggcattctataagattttccatctccaggccgcctgtgagatccaggttagtgcgctatccagcgctggaggcgtggagaacctgatcctcctcgaacaggagaaacaccggcctcatgaggtgggatcagtccaatgggctgggtcgaccttcggccccatgcagaagtcgcggttgggtgaacatgagtttgaggcgctaatgcggatgctcgacaatttggggtacagaaccggttacacctatcgccaccctttcgttcaggagaagactaagcataaaagcgaagtagaaattccagccaccgtaacggcctttgtttttgaagaagatggcgctccagtgcccgccttacgacagcacgcccagaagcaacaaaaagaaaaaacacgctggctcaacacaccaaatacctatttgcgcgtgaacgtggccgacgaagtacagcggagtatgggcagtcctcgaccaaagaccacttggatgaaagctgatgaggtcgagaaatctagttccggaatgccaatccgcattgagaacccaaaccagtttgtccctctgtatacagatccccaggaggtgctcgaaatgcgcaacaagattagggaacagaataggcaagatgtcaagagtgcggggccccaatcccaactactggcatctgtaatcgccgagaagtcccgaagtcctgttgagcagcgactgcccctgaccgggggcgagacctgcctgcccagcggttccagcgttcctggagcaggcctccaagacccctag

SEQ ID NO: 178192 - DNA, 54 bp, Artificial Sequence
  Description of Artificial Sequence: Synthetic coding sequence
atgagcgaggagaccgtgcccgaggccgccagccccccccccccccagggatag

SEQ ID NO: 178193 - DNA, 846 bp, Artificial Sequence
  Description of Artificial Sequence: Synthetic coding sequence
atgagcgaggagaccgtgcccgaggccgccagccccccccccccccagggacaaccgtattttgataggttctcagaagacgatccggaatatatgcgcctgagaaatcgggccgccgacctacgccaagactttaacctaatggaacaaaaaaagagagtcacaatgattttgcaaagccctagcttcagagaggaattggagggtctgattcaggagcagatgaaaaagggcaacaactcctcaaacatctgggccctccgccaaatcgcagattttatggcttccaccagccatgccgtgttcccaacatcaagcatgaatgtcagcatgatgacgcctataaacgacttgcatacagcggactctttaaatctggccaaaggagagcgcctgatgcgctgcaagataagtagtgtgtataggctgctggatttatatggctgggcccagctctccgatacttatgtaacgttacgagtcagcaaggaacaggaccatttcctgatatctccgaaaggtgtttcctgttctgaggtgacggcttcatccctggtctctgaagtactggagatgcgcaataagatccgggaacagaaccgccaggacgtgaaaagcgcgggtccacaatcccaactcctcgcatctgtcatcgcagaaaagagtaggtccccttcgaccgagagccagcttatgtcaaaaggcgacgaggacactaaggacgactccgaagaaacagtgccaaacccgtttagccaactaactgaccaagaactcgaagagtacaagaaggaagtcgagagaaagaaactcgagctggatgccccaggttggttttcatcctag

SEQ ID NO: 178194 - DNA, 1932 bp, Artificial Sequence
  Description of Artificial Sequence: Synthetic coding sequence
atgagcgaggagaccgtgcccgaggccgccagccccccccccccccaggggcaaccttattttgatcgcttttccgaggatgacccggaatatatgcgactacggaaccgggctgcggatctgaggcaggacttcaacctcatggagcagaaaaaaagggttactatgatcttgcagagcccaagctttcgggaagagcttgagggattgattcaggagcagatgaagaaaggaaacaattcatcaaacatctgggccttacgacagattgcggactttatggcttctaccagccatgcagtttttcccacaagcagcatgaacgtgtcaatgatgacccctataaacgacctgcacactgcggactctttaaatctggcaaagggggaaagactaatgcgatgtaagataagctccgtctatcggcttttagacctttacgggtgggcccagctgtccgacacctatgtgacacttagggtgtccaaagagcaggaccattttctcatttctcctaagggggtctcctgcagtgaggtcacggcctccagtcttattaaagtgaatattctgggggaagtagtagagaagggctcgtcctgttttccggtggataccaccgggttttgcctccactccgccatctacgcagcaagaccagatgtaagatgtatcatccacctccacacacctgcaactgcagccgtctcggccatgaagtggggtctcttgcccgtttctcacaacgccttgcttgttggggacatggcttactatgactttaacggagagatggagcaggaagcggataggattaatttgcagaagtgcctcgggcccacctgtaaaatcctggtgcttcggaaccacggagtggtcgccctcggcgacactgttgaagaagccttttacaagatctttcatcttcaagccgcctgtgagattcaagtgtcagccctgagctcggctggaggagtggaaaacctaatcctgcttgagcaggaaaagcaccggcctcatgaagtggggtccgtccagtgggcaggcagcacgttcggccccatgcagaaaagcagattgggtgagcatgagttcgaggctctgatgaggatgttggataacctgggttaccggactggttatacataccgacatccgttcgtgcaggagaagaccaagcacaaaagcgaagtcgaaatccctgcaacagtgacggcctttgttttcgaggaggatggagcccccgtgcccgcgttgcgacagcacgcacagaaacagcagaaggagaaaacccgatggttgaatacacctaatacatatctgcgtgtcaatgtagctgatgaggtgcaaagatctatgggttcccccaggcctaagaccacttggatgaaggccgatgaagttgagaaatcttcttcagggatgcctatccgaattgagaatcctaaccagttcgtgccactctataccgaccctcaggaagttttggagatgcgaaataagatccgggagcagaatcgccaggacgtcaaatcggctggaccacagtctcaactgttagcttccgtgattgctgaaaagagccgatcaccatcaactgaatcacagttgatgtccaagggggatgaggataccaaagacgattccgaggaaacagtgcctaatcctttctctcagctgaccgaccaggagttggaggagtataaaaaggaggtggaacgcaagaagcttgaattggatgagacaggccaggaacgggagccagggtccggccctgccgtgtgcgaattcttttccgtcgcactgcacatttggagtaacatcctggagagaaagaaactgcctcaaaagagcctggcgcatctacagtcccttcacctgctcctgcagtgtcgtgcccagcggaggcggcagcgccaaagggccctgtag

SEQ ID NO: 178195 - DNA, 2025 bp, Artificial Sequence
  Description of Artificial Sequence: Synthetic coding sequence
atgagcagcgacgccagccagggcgtgatcaccacccccccccccccctccatgccccacaaagaacggtatttcgataggattaatgagaatgatccagagtacatccgggaaaggaacatgagcccagatctgagacaggactttaacatgatggaacagcgtaaaagggtgacacaaattctccagagccccgcattcagagaggacttggagtgcctaattcaggagcaaatgaaaaagggccataatcccactggactcctggccttacaacagatcgcagattatataatggccaattcttttagcggcttttcatcgcccccgttgtcgctggggatggtgactcctatcaatgatctgcccggtgccgatacttcaagctacgttaaaggtgagaagctaactcggtgcaaactggcctccctttatagactggtagatctgttcgggtgggcgcatttggccaatacctatatctccgtcagaatcagtaaggagcaggaccatataattatcatccctagagggcttagcttcagcgaagctaccgccagtaacctggtcaaggtgaatatcattggggaggtggtggaccagggttccacaaacctcaagatcgaccacactggatttagccctcatgctgccatttattcaacgcgccccgacgtgaagtgcgtgatacatattcacactttagccaccgcagctgtgtccagtatgaagtgtgggatactgcccatcagtcaagagtcgctactgctgggcgacgttgcttattacgactaccaggggtctcttgaagagcaagaggaacgtattcagctgcaaaaggtccttggacccagctgcaaggtccttgtgctgaggaatcacggcgtggtggccctgggcgagacgttagaggaggctttccattatatctttaacgtacagctggcatgcgagattcaggtgcaagccctcgccggcgcagggggcgtggataacttacatgtacttgacttccagaaatataaggcctttacttatacagtagcagcaagcgggggcggaggcgtgaacatgggctcacaccagaaatggaaggtgggagaaatcgagtttgagggactgatgcgtacacttgacaacctgggataccgtacagggtacgcgtaccgacatcccctcatacgagagaagccaagacacaagtccgatgtggaaatcccagccactgtaacggcattctcctttgaagatgacacggttcccctctcgcccctcaaatacatggctcaaaggcagcaacgtgagaaaacgcgctggcttaactctcccaacacttacatgaaggtgaatgtgcccgaggagtcccgtaatggagagaccagtccacgcacaaagataacctggatgaaagccgaggactccagcaaggtaagcggagggaccccaatcaagattgaagaccctaaccaattcgtcccacttaatacaaatcctaatgaagtgctggagaaacgtaacaagatacgcgagcagaaccgctatgacctgaagacagccggtcctcagtctcaactgctggctggaatagtggtagataagcccccatccaccatgcagttcgaggacgacgaccacgggccgcccgcgccccccaaccctttctcacacttaaccgagggtgaactggaggaatacaagcgtacaattgagaggaagcaacagggcttggaggagaaccacgagctcttttctaagagctttatcagcatggaggttccagtaatggtcgtgaacggcaaggatgacatgcatgatgtagaagatgaacttgctaagcgcgtgtctagactttctacctcaacgaccatcgagaacatcgagatcactatcaaaagtcctgagaagattgaggaggtgctctccccagaaggctcccctagtaaatccccctctaagaaaaagaagaagttcagaaccccctccttcctaaaaaaaaataaaaaaaaagagaaggtcgaagcgtag

SEQ ID NO: 178196 - DNA, 2121 bp, Artificial Sequence
  Description of Artificial Sequence: Synthetic coding sequence
atgagcagcgacgccagccagggcgtgatcaccacccccccccccccctcaatgcctcataaagaacgttattttgatagaatcaatgagaacgatcctgagtacattcgtgagagaaacatgagtccagacctgagacaggattttaacatgatggagcagcggaaacgagttacccagattctacagagccccgctttcagggaggatctggaatgtctgatccaggaacagatgaaaaaaggtcacaatcctactgggttgctggctttacagcagatagcagattatatcatggctaattcattctcaggcttctcctcccctcctctgagcttgggcatggttactccgattaatgaccttcccggcgcagatacttcctcttatgtgaagggcgagaagttaactcgttgcaaactggcctctctctaccggttggtcgaccttttcggttgggcacacctggctaatacctacattagtgtacgaatttcaaaggagcaagaccacatcatcatcattcctcggggcctgagcttcagcgaggctacagccagtaatttggtaaaagttaatatcattggcgaggtggtggaccagggctccaccaacttaaaaatcgatcacacaggcttttcaccccatgccgccatttacagcactcgtcccgacgttaaatgcgttatccatatccataccctcgcgactgccgccgttagttcaatgaagtgtggaattctccccatctcacaagagagcttactgctgggtgacgtcgcctattacgattaccagggatcgttggaggaacaggaggaaaggattcagctgcagaaggtgctgggacctagctgcaaagtcctggtgcttcggaatcacggtgtcgttgccctgggggaaaccctcgaagaggccttccactatatatttaatgttcaactagcttgtgagatccaggttcaggcactcgctggggccggaggggtggacaaccttcacgttctggactttcagaaatacaaggcgtttacttacaccgtggccgcttcggggggaggcggcgttaatatgggaagccatcagaagtggaaggtgggcgagattgaatttgaggggttgatgcgtacactggacaacttggggtacaggacgggatacgcctataggcatcctctcataagagaaaaacctcggcataaatcggacgtagagatcccagccaccgtaacggcattctcctttgaggacgataccgtcccgctgtccccccttaaatacatggcccagagacaacagcgagaaaaaactcgatggctgaactctccgaatacgtacatgaaggtgaatgtgccagaggaatcacggaacggcgagacaagtccgcgcactaaaatcacgtggatgaaggccgaggactcaagcaaggtctctggaggcacacctattaaaatcgaggaccccaatcagttcgtgccattaaataccaatcccaatgaggtattagaaaagcgtaacaagatccgcgagcagaaccggtacgatctgaaaaccgcaggcccacaatctcagttgctggccgggatcgtggttgataagccccctagcaccatgcagttcgaggatgatgatcatggcccccctgctccccctaacccattctcccacctgactgagggcgaactcgaagagtacaaacgtacaatcgagcgcaaacagcaaggacttgaggatgccgagcaggagctactgtccgatgatgcttcatctgtctctcagatccaaagtcagacccagtcaccccaaaacgtaccagagaaactggaagaaaatcacgagctgttctccaaaagcttcattagcatggaggtgcctgtcatggtagttaatgggaaggatgatatgcacgacgtcgaggacgagctcgcaaagagagtaagtcgtcttagcacttctaccaccattgagaacatcgagataaccatcaagagcccagagaagatagaagaagtcctttcacctgagggttctccaagcaaatccccatctaagaagaaaaagaaatttcgaaccccaagtttccttaaaaagaacaaaaagaaggagaaagtagaggcctag

SEQ ID NO: 178197 - DNA, 2025 bp, Artificial Sequence
  Description of Artificial Sequence: Synthetic coding sequence
atgagcagcgacgccagccagggcgtgatcaccacccccccccccccaagcatgccccataaagaacggtattttgaccgcatcaatgagaacgatcccgagtatatcagagagagaaacatgtccccagatttgaggcaagactttaacatgatggaacaaagaaagcgggtgacccagatcttgcaaagtcccgccttccgggaggacctcgagtgtctgattcaagaacagatgaagaaggggcataatcctacaggcctcctcgcactccagcagattgccgattatatcatggctaattccttctcaggattctcctcacccccgttaagtctgggcatggtaaccccaatcaacgacctccctggtgctgatacatctagttacgtgaagggcgagaagttaactagatgtaagcttgcaagcctttacagactggttgacctgtttggctgggcacaccttgctaatacctacattagcgttcgtataagcaaggaacaagatcatatcatcatcatcccccggggcctgtccttttccgaagctactgcatcgaatctagtgaaggtgaatatcataggcgaagtggtcgaccagggatcgactaatctgaaaatagaccacaccgggttttccccacacgctgctatatactccactcgacccgacgtcaagtgtgtaattcacattcataccctggccacagccgcggtgtctagcatgaaatgtggcatcctgcccatcagtcaagagtccctgttacttggtgacgtggcttactacgattatcaggggagtctcgaggagcaagaagagcggattcaactccagaaggttctcggaccgtcctgtaaagtgctggtgttgaggaaccacggtgtggtggccctgggagaaaccctcgaagaggcgttccactatatctttaatgtgcaactagcctgtgagatacaggtacaggccctggccggtgctggtggtgtggataacttgcacgtgttggattttcaaaagtacaaggcgttcacatacacggtcgcagccagcggtggaggaggggttaacatggggagccatcagaaatggaaggtaggtgagatcgagttcgaaggtttgatgagaactttggataatctgggttatcggacgggctacgcatatagacatcccctgattagagagaaacctaggcataaatccgacgtggaaattcccgctactgtgactgccttttcattcgaagacgataccgtgcccctgtccccacttaaatatatggcgcagcggcaacagcgtgagaaaacacggtggctcaactccccaaacacctacatgaaggtaaacgtcccagaggaatccaggaatggagagacctccccgcgcaccaagattacttggatgaaggctgaggactcaagtaaagtcagcggtggaacacctattaaaatagaggatcccaaccagtttgttcccctgaacacaaaccccaacgaggttctcgaaaaacggaacaagattcgggagcagaatcggtacgaccttaaaacagccggaccacagagccagctgctggccgggatcgtcgttgacaagcccccatcaacaatgcagtttgaagacgacgatcatgggcctcccgcgccacccaaccccttctctcatctcactgaaggagagctggaggaatacaaaaggacgatcgagcggaagcagcaaggacttgaggagaatcacgagctattcagcaagtcctttatcagtatggaagtcccagtaatggtggtcaatggcaaagacgatatgcatgatgttgaggacgaactcgccaaacgggtaagcagactttccacttcgactactattgaaaatatcgagataactatcaaaagccctgagaaaatagaagaagtgctgagccctgaaggaagcccctctaaaagccccagtaagaagaagaagaagtttcggacgccctctttcttgaagaagaataagaaaaaggaaaaggtggaagcctag

SEQ ID NO: 178198 - DNA, 543 bp, Artificial Sequence
  Description of Artificial Sequence: Synthetic coding sequence
atggccgacagcgagctgcagctggtggagcagcggatccggagcttccctgactttccaacccctggggtggtctttagagacatctcaccggtcctcaaagatcccgctagctttagagcggccatagggctgttggcaagacatctcaaggctacgcacggtggacggatcgactacatcgccggtcttgactctcggggctttctattcggaccctcgttagcccaagagctggggctaggctgcgttctgatcaggaagcgcggcaaactgccagggcctactctttgggcaagttactccctcgagtacggaaaagccgaattggaaattcagaaggatgcgctagaacctgggcagagggtggtggtcgtggatgatcttctcgcaaccggcggcacaatgaatgcagcatgtgagctgctgggtagactgcaggcagaagtgcttgagtgcgtgtcattggtggaactgacatccctcaaagggagagagaagcttgctcctgttcctttcttttcactgctccagtacgagtag

SEQ ID NO: 178199 - DNA, 405 bp, Artificial Sequence
  Description of Artificial Sequence: Synthetic coding sequence
atggccgacagcgagctgcagctggtggagcagcggatccggagcttccccgactttcctactccaggcgtggtgtttagggacatttctccggtcctgaaggatcctgcgtcttttcgcgctgccatcggcctcctcgcacgacatctcaaggccactcatggcggccgaatcgactatatcgctgggttggactctagagggtttttgttcggcccaagcctcgcccaggagctggggcttggctgtgtgctcatcaggaaaaggggtaagcttcctgggcccacactgtgggcctcatattctctcgaatatggcaaagctgagctagagattcagaaggacgccctggagcccggccagagagtggtcgtggtggatgacctgctcgctacaggcgtgtag

SEQ ID NO: 178200 - DNA, 555 bp, Artificial Sequence
  Description of Artificial Sequence: Synthetic coding sequence
atggacggcctgcggcagcgggtggagcacttcctggagcagcggaacctggtcactgaagtgctaggcgctctcgaggctaaaactggtgtggagaagaggtatctagccgccggtgccgttacgctgcttagtctctatctgctttttggctatggagcctctctcctgtgcaatctgattggcttcgtctacccggcttacgcctccattaaagctatcgaatctccatcaaaagatgacgacacagtgtggctgacttactgggtagtgtatgcccttttcggactggctgagttcttttccgatctcctcttaagttggttcccattttactatgtgggaaagtgcgcatttcttctgttctgtatggcgccaagaccctggaacggtgctcttatgctgtaccagcgtgtagtgcgcccattattcttacgccaccacggtgccgtggatcgaattatgaatgatctgagcggacgagctctggatgcagctgcaggaattaccagaaatgttaaaccgtcgcagacaccccagcccaaagataagtag

SEQ ID NO: 178201 - DNA, 6090 bp, Artificial Sequence
  Description of Artificial Sequence: Synthetic coding sequence
atggccagcagcgtggccccctacgagcagctggtgcggcaggtggaggctttgaaggccgagaatagtcatctgcggcaggaactacgggacaacagctcccacctaagtaagttggagaccgagacctctggaatgaaagaagtcttgaaacaccttcagggcaaacttgaacaagaagccagggtcctggtctccagcggccagaccgaggtgctggagcagctgaaggcactgcagatggatataaccagcctctacaacttgaaattccaacctcctacgctcgggccagaacctgctgcccgcactcctgaaggctcccccgtgcacggaagcggtcccagtaaggatagcttcggcgaactcagtagagccaccatcagattgctggaggagctggatcgggagcgatgtttcttgcttaacgagattgagaaggaggagaaggaaaagctatggtattattcacaattacaggggctgtctaagaggctagacgaactccctcacgtcgactatgagatgcataagatgacacgtgacccactgaacctcgccctccgacggtatgcaggtatgacgctcactaacttgaccttcggggatgtggcgaacaaggccactctgtgtgcgcgccgagggtgcatggaagctatcgtggcacagttggccagtgacagcgaggagctgcaccaggttgtctctagcatactgaggaatttgtcatggagggccgatatcaattccaagaaggtactgagagaagctgggtccgttactgcactggtgcagtgcgttcttagagccaccaaggagtcaacacttaagagcgtcctctccgccttgtggaacctaagcgcacattctactgaaaacaaagctgccatttgccaagttgacggcgctcttgggtttctggtaagcactctgacatacaagtgccagagtaacagtctggccattatcgaatctgggggcggtatcctgcgtaatgtgagttcactagtggctacgagagaggattatcgtcaggttctcagggaccataactgcctgcagacactgctgcagcatctcacctcccattccctaaccattgtgagtaatgcttgcggaacgctctggaatctgtccgctaggtctgctagggaccaggagctactgtgggacctgggtgccgtgggcatgctcagaaatctcgtacactctaagcataagatgatagctatgggttcagcagctgcactgcggaatctcctcgctcaccggcccgccaagcaccaagcagcagctaccgccgtttcccccggatcctgcgttccatcactgtatgtgaggaagcaaagagcgctggaggcagagctagatgcacggcacttggcgcaggcactggagcacctagaaaaacaaggcccgccggcagcggaagcggcgactaaaaagcctctcccacccttacggcacttggacggactcgcccaggattatgcttcggattcagggtgcttcgatgatgacgacgccccatcctccctggcggctgctgccgccaccggcgagcctgcttcacccgcagccctgagcctgttcctcgggagtccctttctgcaggggcaggctttggcccgaactcctcctactcggcgcggcgggaaggaggcagaaaaggatacctctggggaagccgctgtggctgccaaggccaaggccaaattagcccttgccgtggcacgcatcgaccagttggtggaagacatcagcgcactccatacctcttctgacgactccttctctctgagcagcggcgacccaggccaggaggctcctagagaaggtagggcacagagctgttcgccctgtagggggcccgagggcggtaggagagaggcaggttctagggcgcaccccctgctgaggcttaaggccgcacatgcatccctgtcaaacgattctttgaactcaggctcggcaagcgacggttactgcccacgggagcacatgcttccttgccctctcgctgccttagctagtcgaagagaggatccccgatgcgggcagccccggccatcccgcctggatctagacttaccgggctgtcaggccgagccgccagcacgggaggcaaccagcgccgatgcgcgcgtgcgcactatcaagctcagcccaacctaccagcacgtccccctcctcgaaggcgcctctcgggctggtgccgaaccactcgcgggtccagggatctcacccggagcccgcaagcaggcatggcttcctgccgatcatctttcaaaggtgcccgagaagctggctgctgcccccctatccgtggcctcaaaggccctccagaagctagccgctcaagaaggacctctaagcctgagtaggtgctcaagcttgtcatccctctcatcagccggcagacctggcccttcggaaggaggcgacctggacgattccgacagttccctggagggactggaggaagccggtccgtcagaagcggaactggatagcacctggcgtgcacctggggctacatctctgcccgtcgccatcccagcccccagaaggaatcggggcaggggattgggtgtcgaggatgctactccgagctcttctagcgaaaattatgtccaagagacacccctcgttctctctcgctgctcctccgtatcttctttgggtagctttgagtccccttccatcgcatcatctatcccttcggagccatgttctgggcaaggctcaggaaccatttccccatctgagctacctgacagtccaggacagacaatgcccccttctaggtctaaaacaccacctctcgctccagcgccccagggaccaccagaagctacccaattctctctgcagtgggagtcctatgtgaaacgctttttagacatcgcggattgccgcgaacggtgccgcctgcctagcgaacttgacgcaggcagcgtgcgcttcaccgtggaaaagcctgacgaaaacttcagctgcgcctcaagcctctccgctctggcgcttcacgaacattatgtgcagcaggatgtggaactcagattgctgccgagcgcctgtccggagagaggaggaggggcaggaggagcgggccttcactttgcaggccaccgcaggcgagaggagggaccagcccctaccggctcgcgcccacgtggcgctgccgatcaggagctcgaactcttacgagaatgcctgggcgccgctgtgccagcccgcctcagaaaagtggccagtgctttagtgcctgggcgccgggcgctccctgttcctgtctacatgcttgtgcccgcgccagcaccagcacaggaggatgactcttgcaccgacagcgccgagggtacccctgtcaacttcagcagtgccgcttctctgagcgatgagacactccaaggccctccccgcgaccagcctggggggccagccggccgacagcgcccgactggaagacccaccagcgcaagacaggcaatgggccatcgccacaaagcggggggggcaggccggagtgccgaacaaagtcggggagccggaaagaacagggccggattggagttgccgttgggcagaccgccctcagctcctgccgataaggatggcagtaagccaggcagaaccagaggggacggtgccctccagagtctctgcctgaccacccctactgaagaagccgtctactgtttctacgggaacgattcagacgaagagccgcctgccgccgctcccacaccgacgcaccgccggactagcgccataccaagagcatttactagggagcgcccacagggcagaaaggaggcacctgctccctctaaggccgccccagccgctccaccaccagctaggacccagccaagcttgattgcagacgagactccaccctgctacagcctaagcagtagtgccagttccctctcagagcccgaaccatccgaaccacctgcggtgcacccacgggggcgggagcctgcagttacaaaagaccctggccccggcggaggacgtgactctagcccctctccacgcgccgctgaagagctgttgcagcggtgtatttcatccgccctccccagaagaaggccacccgtttctggcctccggcggaggaagccaagggctacccgactggacgagaggcctgccgaagggagcagggagcgaggtgaagaggccgccggctctgatcgcgcaagcgaccttgattccgtagagtggcgcgccattcaagaaggggctaactcgatcgtgacttggctgcatcaagcggctgctgcaacccgcgaggcttcctccgaaagtgactccatcctgtccttcgtctctggtctgagtgtgggctcgaccctgcaacccccaaagcatcggaagggacggcaggccgagggggaaatgggatctgctcggcgccccgaaaaaaggggggcggcgagtgtgaagacctctggttctccaagaagccccgccggccctgagaagccaaggggcacacagaagacaaccccgggcgttcccgctgtgttgagaggcaggactgtgatctacgtaccatctcctgccccaagagctcagcccaaaggaacacctggacccagagctacgcctcgcaaggtggctcctccttgccttgcacagccagctgctcctgccaaagtcccatctccgggccagcagcgttcccggtcgttgcaccggccagctaagacatcagagctagcaacactgagccagccacccaggtctgctaccccgccggcccgtcttgccaagacgccatctagtagtagctcgcagacctcgcctgctagtcagcctttgccgaggaagcggcccccggtgacacaagcagcaggagcactgccaggacctggcgcgagccctgtgccaaaaacaccggcgcgcacccttctggcaaagcaacacaaaacgcaaaggtcccctgtgcggatcccttttatgcagcgccctgcccgcagaggaccccccccactggctcgggcggtgccagagcccgggcccagaggcagggccggcacagaagcaggccctggagcccggggtggccggctagggctcgtgagagtggcctcggccctttcctctggaagcgagtcttccgacaggtctggattccgacggcagctgacttttatcaaggagtctcccgggctgagacgccgtaggtcggaattgagctccgccgaatcggctgctagcgcccctcagggagcatcaccacgacgcggacgccctgctctgcccgccgtgttcctgtgcagtagtcggtgcgaagaacttcgtgctgccccgcgtcagggacccgctccagctcggcagagacctcccgctgcccgaccctcgcccggtgagaggcccgcccgacgcacaacctcagagtcaccttccaggctgccagtcagggctcctgctgctcggccggagaccgtcaaaaggtatgcgtcactgccgcacattagtgtggctcgtcgcccagacggggcggtgcccgctgcccctgcctctgcagacgcagcacgccgttcatccgacggagagccacggcctttgccccgagtggccgctcccggaaccacttggcggagaatccgcgacgaagatgtcccccatatactgaggagtaccctgcctgccacagcccttccgctgcgggggagtacgcccgaggatgcgcccgccggtccccctccaagaaaaacgtccgacgctgtcgtgcagacggaagaagttgctgcacctaagaccaactccagcacttcaccttctttagaaacgagagaacctccaggggccccggcgggaggccagctgagccttctggggagcgatgttgatggcccaagtcttgcgaaagcccctatcagcgcaccctttgtgcacgaaggactcggggtggctgtcggagggttccccgccagcaggcatgggtctccctcgaggtccgcgcgcgtgcctccatttaactacgtgccgtctccaatggtggtggccgcaacaactgactccgctgccgagaaggcacccgctacagcctccgcaacgttgctggagtag

SEQ ID NO: 178202 - DNA, 6912 bp, Artificial Sequence
  Description of Artificial Sequence: Synthetic coding sequence
atggccagcagcgtggccccctacgagcagctggtgcggcaggtggaagccctgaaagccgagaactcccaccttagacaggagctgagagacaactctagccatctctccaaactcgagaccgagacatctggcatgaaggaggtgctcaaacacctgcaggggaagttggagcaggaggcacgcgttctcgtgtcgagcggccaaacagaagtgctggaacagctcaaagccctgcagatggacattacctctttgtacaatctcaaattccagccccctaccttaggacccgagcccgcagccagaacacccgagggttctccagtgcacggcagcggaccttcaaaggactcctttggtgagctctcacgcgcaacaatacggctcctggaggaattagatcgggaaagatgctttctcctgaatgagatcgagaaagaagagaaagaaaagctctggtactatagtcagctccaggggctgtctaaacgcctggacgagctccctcatgtggaaacacagttctctatgcagatggatctgattcgacagcagctggaattcgaggcccagcacatcaggtctctgatggaggaacgcttcggtactagtgatgagatggtgcaacgcgcccagatccgagcctcccgcttggaacagatcgacaaggagctgctggaagcccaggacagggttcagcagactgagccacaggccctcttagcggtgaaatctgttccggtggacgaagaccctgagacggaggtgcctacacatcccgaagacggcacaccacaaccaggaaactcaaaagtggaagtagttttctggcttttatcaatgctggctacacgggaccaggaggacaccgcccgcactctgctggccatgtcatcatcaccggaaagttgcgtggctatgagaaggagtggctgtcttccactactgctccagatcctccatgggacagaagccgccgccggagggcgcgccggcgcccctggtgctcccggcgcgaaagacgctcggatgagggctaatgccgctctgcataacatcgtcttttcacagccagatcaggggttggcccgcaaggagatgagagtgcttcacgtattagagcagattagagcttactgcgaaacgtgttgggactggttgcaagccagagatggcggacctgaaggcggaggggccgggagtgccccgattcccattgagccacagatctgtcaggctacctgcgcggtaatgaagctgagcttcgatgaggagtaccgacgggctatgaacgagctggggggcctgcaagctgtggcagagctgctccaggtcgactacgaaatgcacaaaatgacacgcgaccccttaaatctggctctgaggagatacgccggtatgaccctaactaacctcaccttcggagatgttgcaaacaaggcaacgctgtgcgcacgacggggctgcatggaggcgatcgtagcccagttagcctcagactccgaagaactgcaccaagtggtgtccagtatcttaagaaatctgtcctggagagctgatattaacagcaaaaaagtgttgagggaggcgggatctgtgaccgcccttgtccagtgcgtgcttagggctactaaagaatctaccctcaagtccgtactgtccgcactgtggaacctatccgcacactccactgagaataaggcggcaatctgtcaagttgatggagcgttaggatttctggtctccacactaacctataagtgccaaagcaacagcctggctatcatagagtcaggggggggtattcttagaaatgttagttccctcgtggccacaagagaggactatcggcaagtattgcgagaccacaattgtcttcagacattattgcaacatctaacgtcccattcactcaccatcgtcagcaatgcttgtggaaccctctggaatctcagcgcaaggtccgcgcgggaccaagagttgctctgggacctgggggctgtcgggatgctccggaacctggttcacagtaaacataagatgattgccatgggttcagccgccgccctcagaaatctgctggcacatcgcccagcgaagcatcaggcagctgccactgctgtgtccccggggtcttgtgtcccatctttgtacgtgcgcaagcagagagccttggaggctgagttggatgcgcgccacctcgcccaagccctagagcacctggaaaagcagggtccacctgctgcagaagctgccacgaaaaaacctctgcccccactgaggcatctggacggtctggcacaggactatgcgtccgattcagggtgctttgatgacgacgacgccccatcttccctcgcagctgctgctgctacaggggaaccggcgtcacccgctgccctaagcttattcctcggcagtcctttcctgcaaggacaggctctggcaagaacacctcccacacgcaggggagggaaggaagctgagaaagatacatctggcgaggctgccgtcgccgctaaagccaaagccaaactggctctcgccgtggcacggatcgatcaactggtcgaagatattagcgccttacatacaagcagcgatgacagctttagcttgtcgtcaggagatccaggccaggaggccccgagggaggggagggcacagtcatgttccccctgccgcggaccagagggcggacgtcgggaggctgggagcagggcccatcccttgctgcgcctgaaagccgcccacgcctcattgagtaacgattctttaaattccggatcagcatccgacgggtattgtccccgggagcacatgctcccatgccccctcgcagccttggcatcccgtagggaggatccccggtgcggacagccccgaccaagcagactggatctcgacctgcccgggtgtcaggccgaaccgccggccagagaagccacctcagctgacgccagggtgcggactatcaagctgtccccaacataccagcatgtgcctctgctcgaaggcgcatctcgggccggagccgaacctctcgccggccctggcatttctccaggggcgaggaaacaggcttggctcccggcggatcacttgagcaaagtcccagagaagttggcggccgcacccctatctgtggccagcaaggccctccagaaactggccgcccaggaaggccccctgagtctgtcccggtgctctagtctctccagtttgagcagcgcaggccgccctggaccctctgaagggggagatctggacgacagtgactcatccctggaaggattggaagaagcaggaccgagcgaggctgagcttgattctacctggcgggctcccggcgcaacttcactccctgttgctattcctgccccgaggaggaacaggggtcgggggctgggagtggaagacgccactccatcttcttctagcgaaaactacgtgcaggagactcccctcgtgctgtctagatgtagttccgtgagctcgctggggagtttcgagtctccaagtatcgcgtcctcaatccccagcgagccctgtagtggccaaggctccggaactattagccctagtgaactccctgacagtcctggccagactatgcccccatcccggtcaaagacccccccgctggcccctgccccccaggggccacccgaggccacccagtttagcctgcaatgggagagttacgtcaaacggttcctggacatagccgattgtagagagaggtgtcgcctgcctagcgagctggatgcgggatccgtgcgatttactgtggagaagcctgatgaaaattttagctgcgcttcatcgctctcagcactggcactgcacgagcattatgtccagcaggatgtcgagcttcggctcctaccttctgcgtgccccgagcgtgggggtggagcaggtggagcgggcttgcactttgccggccatcgtcggagggaagaggggccagcccctaccggttctagaccgaggggggctgccgatcaggagttggaactgctccgggagtgtctaggcgccgctgtgccagctcgattacggaaggtggcgtctgctttggtccctggcaggcgtgccttaccagtgccagtatacatgctggtgccagcccctgcccccgcccaggaggatgattcatgcaccgactccgccgaaggcacccctgtcaatttcagttctgccgcgtctttatctgatgagaccctacagggcccacctagggaccaacctggcgggccagccgggcgtcagcgccctaccgggaggcctaccagtgcacgccaggcaatgggccatagacacaaggcgggtggcgccggaaggagtgctgagcagtcacgcggcgccggaaaaaaccgcgctgggcttgagttgcctctcgggagaccaccctccgctccggccgacaaagatggttcaaaaccggggaggacccgcggtgatggcgctctacagtcactttgtcttacaactcctacagaggaagccgtttattgtttttatggtaacgacagcgacgaggagcccccagcagctgcccccacccctacccaccggagaacctcagcaattccaagggcgtttacccgcgaacgtccacagggacgcaaggaggctcccgctccaagtaaagcggctccggccgccccgccccctgctcggacccagccatccttaattgccgatgagaccccaccatgttacagcctgtcgagcagtgcctcaagcctgagcgagccagagccctcagagccacccgccgtacacccacgcggaagagagcctgcggttactaaggatcctggtccaggcggcgggcgggattcatctcccagccccagggctgccgaagagctgctgcagcgctgcatatccagtgccctacctcgcaggcggccaccggtttcaggcctccggcgaagaaaacccagagctactcgcctggacgagaggcctgctgagggcagccgcgagcgcggagaggaagcagctggtagtgatcgtgcttctgacctggactccgtggaatggcgagcaattcaagaaggcgccaactctattgtcacctggctccaccaggcggccgccgccacacgggaggcttcatcggaatccgattcaattctatcgtttgttagcggcctctcagtgggatctacccttcagccacccaaacaccgtaaaggaagacaggctgaaggagagatggggtccgctcggaggccagagaaaagaggcgctgcatcagtcaagacttcagggtccccccgaagtcccgccgggccggaaaaacctcgcggaacgcaaaaaacgacgcctggcgtgcctgcggtacttaggggtagaactgttatttacgtcccctcacctgccccccgtgctcagccaaaaggcactcccggtccaagggccacccccagaaaggtggcccctccatgtctggcccagccagcggcaccggccaaggtacccagccctgggcaacagcggtccagaagtctacaccgtcccgccaaaaccagcgaactagctacactttcacagcctccacggagcgcaacaccgcctgcacgactcgcaaaaactccatcctcttctagttcccagacatcccctgcctcacaaccgctgccaagaaagcggcccccagttacccaggcagctggagcccttccagggccaggcgcatctcccgtccccaaaaccccagccagaaccctcctcgcaaaacagcataagactcagaggtcaccagttcggatacctttcatgcaacgacccgcgaggcgtgggccacctccactggcaagggctgtgccagagccaggaccacgaggcagagcagggaccgaagctggaccaggcgccagagggggcagactcggactggtacgggtcgctagcgccttaagctccggcagcgagagctcagacaggagcggattcagaagacagctgacatttataaaagagagtcctggcctgcgccgaaggcggtcagagctaagctccgcagagtcagcagcgagtgctcctcagggtgcctcccctagacgaggcaggccggcgctgcccgcagtcttcctctgttcttcccggtgtgaggaactcagggccgcaccccggcaaggcccagcccctgcccggcagcgacccccggccgccaggccgtcccccggggagcggccagcccggcggacaacgtcagagtcaccatcgcgccttcccgtgcgtgcacccgccgcccgcccagaaactgtcaagcggtatgcttctctgccacacatttcagttgctcggcggccggacggagctgtgccagctgccccagcttctgccgatgctgcgcgtcgaagctcagatggcgagccaagacccctgccccgggtcgctgctccaggtaccacttggcggcgtattcgtgatgaagatgtgccccacatcctgagaagcaccttacccgcaaccgctctaccactgcggggttccacacccgaagatgcccctgctgggcctccacccagaaagacctcagacgccgtagttcaaactgaggaagtggctgctccgaaaacaaactcctccaccagcccctcattggaaaccagggagccccccggagcccccgctgggggtcagctttccctcctggggtcagacgttgacgggccctccctcgccaaggctcctattagcgctcccttcgttcacgaaggactgggagtagcggtgggcggcttccctgcgtcgaggcatggatccccgtcccggtcggcccgcgtcccccccttcaactacgtaccctctcctatggtcgttgccgctacaaccgacagtgctgccgaaaaagcgcccgcaacagctagcgctaccctgttggagtag

SEQ ID NO: 178203 - DNA, 1545 bp, Artificial Sequence
  Description of Artificial Sequence: Synthetic coding sequence
atgagctggccccggcggctgctgctgcggtacctgttccccgcccttctcctccacgggttgggagaggggagtgcactcctgcaccctgatagccggagccacccgcgcagcctcgaaaaatctgcttggcgtgcattcaaggaaagccagtgtcatcacatgctgaaacacctgcacaacggggcgagaatcaccgtacaaatgccacctactatcgaaggccactgggtatcaacaggctgcgaggtccgctctggaccagagtttatcacacgtagctataggttctatcataacaatactttcaaggcatatcagttttattacggctccaaccggtgcaccaaccccacttatacactcattatcagaggaaagatccggctgcgacaggcaagctggattatccggggtggaacagaggcggactaccagcttcataatgttcaagtcatatgccacacggaagccgtcgccgaaaagctggggcaacaggtgaatcgaacctgtccggggttcctggctgatgggggtccatgggtgcaggatgtggcctatgatctttggagagaggagaatggctgtgaatgcacaaaggcagtgaacttcgctatgcacgaactccagctaatccgcgttgagaaacaatatctgcaccacaatttggaccacctggtggaggaactttttctgggagacattcacacagacgctacacagcgcatgttctaccgcccgagctcttaccaaccacccctacaaaacgcgaaaaaccacgatcacgcttgtattgcttgccgaattatttacagatcagatgagcaccatccccccatcttaccgccaaaggccgaccttacaattggccttcatggggaatgggtctcccagaggtgtgaggtgaggcccgaggttctgtttctgaccagacattttatattccacgacaataacaatacttgggaggggcactactaccattacagtgaccctgtatgcaagcatcctacattctcgatctacgcgagagggaggtattcgagaggcgtcctgtctagcagagttatgggggggacagaattcgtgtttaaggtgaatcacatgaaggtgacccccatggacgccgcaactgcgagcctgcttaacgtgtttaatggtaacgaatgcggcgccgaaggctcttggcaggtggggattcagcaggacgtgacacataccaacggttgcgtggcattaggtattaaactaccccacaccgagtatgagatctttaaaatggagcaggacgcccgaggaaggtatttgttgttcaacggacagaggcccagcgacgggagctcccctgaccgtcctgaaaaacgggcgactagttaccagatgccacttgtgcagtgcgcatcgtcatccccgcgcgcggaagacctcgccgaagactctggttccagcctttatggcagagccccgggtaggcatacgtggtcactactgctggccgcccttgcctgtctggtgcccttgttacactggaacatccggcggtag

SEQ ID NO: 178204 - DNA, 1698 bp, Artificial Sequence
  Description of Artificial Sequence: Synthetic coding sequence
atgaagcggcggtgcagctgcggcggcggcggcggccactgcagcagcgaacgtagacgcaccagacccgaagctgaggggcgagcgcgggcgcaactccccggccatcagattggagcccgaagggctggcggtccccgggcggggctggagatgtcttggccgcgcaggcttctactgaggtacctgtttccggccctgcttcttcacggactcggagagggttctgctttattgcaccccgattcaaggagccaccctcggtctctggagaagtccgcatggcgggccttcaaagaaagccaatgccatcacatgttgaagcatctgcacaatggcgctcgaattaccgttcaaatgccccccactatcgaaggccactgggtttccacaggatgtgaggtgcggtctggccctgaattcatcactcggagctacaggttctatcataacaacaccttcaaagcatatcagttttattacggatcaaaccgttgtacgaatcctacgtatacgctgatcatcaggggcaaaatccgcctcaggcaagcctcctggattatcaggggcgggacagaggccgactatcagttacacaacgttcaggtaatatgtcacactgaggctgtcgctgagaagctgggccagcaagtgaacagaacttgtccgggctttttagccgacggagggccttgggttcaggatgtggcttacgacctgtggcgagaagaaaacggatgtgagtgcactaaggccgtaaattttgccatgcacgaactgcaactcattagggttgagaagcagtatctgcaccataacctggaccacctcgttgaggaactgttcttgggggatatccataccgacgctactcagcggatgttttaccggccaagcagctaccaaccccctttgcagaacgcaaagaaccatgaccatgcttgtatcgcctgccgtattatctatcgcagcgacgagcaccaccctcctatcctaccaccaaaggctgacttgactatcggcctccatggggaatgggtgtcacagcgctgtgaggttcgtccagaggtgctttttcttacccggcactttatctttcacgacaacaacaacacatgggaagggcactactatcactactctgacccggtctgcaaacaccctacattttcaatatatgcccgtggacgctattcaaggggagtgctctccagcagagtgatggggggaacggagttcgtattcaaggtcaatcacatgaaagtaacaccaatggacgcagctaccgcaagcctgttgaacgtcttcaatggaaatgaatgtggggcggagggctcatggcaggtgggaatacagcaagatgttacgcacactaatggatgtgtggctctcggaattaagctgcctcacacggaatatgagatctttaaaatggagcaagacgcccgaggccggtatctgctgttcaatggtcagaggcctagcgacggcagctctccagatcggcccgaaaagcgggcaaccagctaccagatgcccttggtccagtgtgcgagcagctcccctcgcgctgaagacttagctgaggacagtggatctagcctgtatggaagagccccaggacgacacacttggtccttactgctggctgccctggcctgcctggtgccactgcttcactggaatattcgacggtag

SEQ ID NO: 178205 - DNA, 981 bp, Artificial Sequence
  Description of Artificial Sequence: Synthetic coding sequence
atgccccccagcatcagcgccttccaggccgcctacatcggcatcgaggtcctgatagcgctggtaagtgttccagggaatgtgctagtgatatgggctgtgaaggtgaatcaggctctgcgggatgctaccttttgtttcattgtcagcttggcagtggctgatgttgcggtaggagccttggttattccactggcaatcctgataaatatcgggcctcagacgtacttccacacctgtctgatggtggcgtgccccgtgcttatcctgactcagtcatccatactggcgctgctggctatcgcagtggaccgctatcttagggtgaaaatcccgctgcgctataagatggtggtcacacctcggcgtgctgccgttgctatagctggttgctggatcctaagcttcgtcgtgggattaacgccaatgttcggatggaataatttaagtgcagtggagcgggcctgggccgccaacggatcaatgggcgagccagtgattaagtgcgagtttgagaaggtgatctccatggaatatatggtgtattttaactttttcgtttgggtgctgcctcccctgcttcttatggtgcttatctacttggaggttttctacttgattcgcaaacaacttaacaagaaggtgagtgcttcttccggcgatccccagaagtactacgggaaggagctcaagatcgctaagtcgttggctttgatactcttcctcttcgccctgagttggctccctctgcatatccttaactgtattaccctgttttgcccctcgtgccataagcctagcattctcacctacatcgccattttcctgacacacgggaattccgctatgaatccgatagtttacgcctttaggattcagaagttcagagtcactttcttgaaaatttggaatgaccactttcgctgccagcctgcacctcctattgatgaggatttaccagaagagcgccctgatgattag

SEQ ID NO: 178206 - DNA, 981 bp, Artificial Sequence
  Description of Artificial Sequence: Synthetic coding sequence
atgccccccagcatcagcgccttccaggccgcctacatcggcatcgaggttctgatcgcccttgtaagcgttcccggtaatgttctcgtgatctgggctgtcaaagtcaatcaagccctcagagacgccaccttttgtttcatcgtgtctctcgcagtagccgacgtcgccgtcggagctcttgtgatacccctcgccattctcataaatatcggcccccaaacatacttccacacatgcctcatggtggcttgccccgtgcttattctcacgcaatcctctattcttgcactgctcgccatcgctgtcgacaggtacctcagagtgaaaatcccactccgttataagatggttgtaaccccccgtagggctgccgtggcaattgcaggttgctggatcttgtctttcgtggttggattgacgcctatgtttggttggaataatctgagtgctgtagagagggcatgggccgccaatgggagcatgggcgagcctgtgataaaatgtgaattcgagaaagttatcagtatggagtacatggtgtacttcaactttttcgtgtgggtgttaccccccctcctcttgatggtgctgatttatcttgaggtgttttacctgattagaaagcagctgaataaaaaagtcagcgcctcatcaggcgatccccagaagtactatggaaaggaacttaaaatcgcgaaatccctggccttgatcctgtttttgtttgctctgagttggctgccattgcacatcctcaactgcattactctgttctgcccttcttgccacaagccaagtatcttgacatatattgccattttcctgacacacggaaactccgcgatgaacccaatagtctacgcctttcgcatccaaaagtttcgagtcacatttctgaagatttggaatgatcacttccgttgccagcccgccccaccaatcgacgaggacctgcccgaagagcgaccggatgactag

SEQ ID NO: 178207 - DNA, 378 bp, Artificial Sequence
  Description of Artificial Sequence: Synthetic coding sequence
atgccccccagcatcagcgccttccaggccgcctacatcggcatcgaggtgttgatcgccctggtttctgtgcccgggaacgtactcgtcatttgggccgtgaaggtgaaccaggccctacgcgacgccacattttgttttatcgtgtcacttgccgtcgctgacgttgccgtgggggcactcgtcattccactcgcaatcctcatcaacattggcccccagacttacttccacacctgcctcatggtcgcctgccccgtgttgatcctcactcagagcagtatcctggccctgctggcaatagctgtagaccgatacttaagagttaaaatcccactgcgtcggatatctcagtgcatggcgagcaccaagtcctag

SEQ ID NO: 178208 - DNA, 981 bp, Artificial Sequence
  Description of Artificial Sequence: Synthetic coding sequence
atgccccccagcatcagcgccttccaggccgcctacatcggcatcgaggtgctgattgcacttgtgtcggttccggggaacgtgttagtaatttgggctgtgaaggttaatcaggctctgcgggacgccaccttctgtttcatcgtgtctctagcagttgccgatgttgcagtaggcgcgttggtaatcccactcgctattctaataaatattggccctcagacttatttccacacgtgcctcatggtggcatgtccggtgttgatcctgacccagtctagcatcttggccctcctggcgatcgccgtagatcggtacttgcgcgtgaaaataccgctcagatataaaatggtcgtcaccccacggagagccgctgtggccatcgcagggtgctggatcctttcgtttgtggtgggactgacaccaatgttcggttggaacaatctctccgctgttgagcgggcatgggctgcgaacggtagcatgggcgagccagtgattaagtgtgagttcgaaaaggtaatctctatggaatacatggtttactttaattttttcgtatgggtgctgcctcccctgttgttgatggttctgatctatcttgaggtgttctatctcatccgcaaacaactcaacaaaaaagtatccgcctcatccggagatccgcagaagtattatgggaaggaattgaagattgccaaatcactggccctcatactatttctgttcgctctatcctggctcccactgcacatcttgaattgtatcacattgttctgcccatcatgccataaaccttcaatcctgacctacatcgccatatttctgacccacgggaactccgcaatgaacccgatagtgtacgcctttcgcatccagaagttccgcgtgacttttctcaagatctggaacgaccactttagatgccagcctgcccctcccatcgacgaagacctgcccgaggaacgtcccgatgattag

SEQ ID NO: 178209 - DNA, 1239 bp, Artificial Sequence
  Description of Artificial Sequence: Synthetic coding sequence
atgcccatcatgggcagcagcgtgtacatcaccgtggagctggccattgccgtactcgccatcctcggaaacgtgttagtatgttgggcagtttggttgaatagtaatctgcagaacgtgacaaactatttcgtggtgagcctcgctgctgcagatattgccgtgggggtgctagccatcccttttgcaataaccatctcaacaggtttctgtgccgcgtgccacggatgcttgtttattgcgtgtttcgttctggtcctgacccagagtagtatcttctcgctgcttgccatcgccatcgatcggtacatagccatccgcatcccacttagatacaacgggttagtgactgggactagagccaagggcatcattgctatatgctgggtgctctcgtttgctatcggcctgacgcccatgctcggatggaacaattgtggacagccaaaggaaggaaaaaatcactcccagggatgtggtgaaggccaggtggcctgtttgttcgaggatgtcgtgccaatgaattatatggtgtactttaacttctttgcctgtgttctggtgcccctacttctgatgttaggggtctacctgaggatcttcctggcggcgcggagacaactcaaacagatggaatcccagcccttgcctggcgaacgggcccgttctaccctgcagaaagaagtccacgctgccaagtcgcttgctataatagtagggctgttcgctctgtgctggctgccccttcacattatcaattgctttacttttttttgccccgactgttcacacgcgcctctgtggctgatgtatctggctatcgtattatcacacactaactctgttgtgaatcccttcatctacgcctacaggatcagagagttcagacagactttccgcaagatcattcgtagccacgtactgcgacagcaggagccatttaaagcagctggtacgtccgcccgggtattggcagcccacggatcagacggcgaacaagtcagccttcggctgaatggtcacccacccggtgtgtgggctaatggttctgcgccacacccagaacggcggccaaatggctatgcattggggcttgttagtggcggcagcgcgcaggaatcccagggcaacaccggactccccgacgtggagctactgagccatgagcttaagggggtgtgccccgagccccccggactggacgatccgctagcacaggatggagcaggtgtaagctag

SEQ ID NO: 178210 - DNA, 1239 bp, Artificial Sequence
  Description of Artificial Sequence: Synthetic coding sequence
atgcccatcatgggcagcagcgtgtacatcaccgtggagctggccatcgctgtgttggctattttgggaaacgtgttagtgtgctgggccgtttggctgaattcgaatctgcagaacgtgactaattacttcgttgtgagtctggcagctgcagatatcgccgtgggagttcttgctatcccttttgctatcacaatctctactggattctgtgcagcttgtcacggttgcctgttcattgcatgttttgtcctggtcctcactcagtcatcaatcttttcactgctcgccattgctattgatcggtatatcgcgatcagaatccccctccggtacaatggactcgttactggcaccagggccaaaggtattatcgcaatttgctgggtgctctcatttgctattggtttgacccctatgttgggctggaacaattgtgggcagcctaaggaaggaaagaaccactcccagggatgcggggaggggcaggtggcttgcctattcgaagacgtggttcccatgaactacatggtgtatttcaatttttttgcgtgtgtgctggtgcccctcctcttgatgctgggcgtatacctgcggatattcttagcagcccgacgacagctgaagcagatggagtctcagccactgccgggcgaaagggcccgctcaacactacagaaagaggtccacgcagctaagagtctggctatcattgtcggattgttcgccttatgctggctccctctccatatcattaattgcttcactttcttctgtcctgattgttcccatgcgccgctgtggttgatgtatttggctattgtcctgtcccacactaacagcgttgtgaacccgtttatctacgcataccgcatccgcgaatttaggcagactttcaggaagatcattcggagccatgtactgcgccagcaggagcccttcaaggctgcaggaacttcagctcgcgtgctggctgctcacggctcagacggggagcaggtctctctgcgcttaaacggccaccctcctggcgtgtgggctaacggctccgcccctcatcctgaacgaagaccaaatggttacgcccttggccttgtaagcggcgggtctgctcaggaatctcagggcaacaccggcctccctgacgtggaactcctatcacatgagttgaaaggtgtatgcccagagcctccaggacttgatgacccgctagcccaggacggggccggggtgtcctag

SEQ ID NO: 178211 - DNA, 267 bp, Artificial Sequence
  Description of Artificial Sequence: Synthetic coding sequence
atgcccatcatgggcagcagcgtgtacatcaccgtggagctggccatcgctgtactcgccatcctgggtaatgtgttagtgtgctgggcagtgtggttaaatagcaatttacagaatgtgaccaattatttcgtggttagccttgccgctgcagacattgctgtgggagtgctagcgataccctttgctattaccatctccactggcttttgcgccgcttgccacggctgtctgtttattgcgtgcttcgtgctggtactgacttag

SEQ ID NO: 178212 - DNA, 195 bp, Artificial Sequence
  Description of Artificial Sequence: Synthetic coding sequence
atgcccatcatgggcagcagcgtgtacatcaccgtggagctggccatagcggtcttggccatcttaggtaacgtgcttgtatgttgggctgtctggttaaactccaaccttcaaaacgtcaccaactacttcgtggtgtccctcgccgccgccgatatcgccgtgggcgtgttggctatacccttcgcaatctag

SEQ ID NO: 178213 - DNA, 231 bp, Artificial Sequence
  Description of Artificial Sequence: Synthetic coding sequence
atgcccatcatgggcagcagcgtgtacatcaccgtggagctggccattgctgtgttggctatcctcggcaatgttttagtgtgctgggctgtctggctcaacagcaacctgcaaaacgtgacgaactattttgtggtatccctcgccgcggcagacattgcagtcggagtgctggccattccatttgctatcacaatatctaccggtttttgcgccgcatgtcacggctag

SEQ ID NO: 178214 - DNA, 1098 bp, Artificial Sequence
  Description of Artificial Sequence: Synthetic coding sequence
atgcccatcatgggcagcagcgtgtacatcaccgtggagctggccatagcggtgcttgcaatcctgggaaacgttctggtgtgttgggctgtctggcttaattcaaacctccagaacgtcaccaactacttcgtcgtgagcctagcggcggctgacattgcggtgggggtgctggcaatcccattcgccattacgattagcaccggtttctgcgctgcatgccacggatgtttatttattgcctgtttcgtgcttgtgttgacacaaagctctatcttctccctcttagccatcgctattgataggtatatagctatccgaatcccactgcgatataacgggcttgtcactgggaccagagccaagggcatcatcgctatttgttgggttctctcattcgccattggcctgaccccgatgctaggatggaacaactgtgggcagccaaaggagggcaagaaccatagtcagggatgcggagagggacaagtcgcgtgtctgtttgaggacgtcgttcccatgaactacatggtatacttcaatttcttcgcgtgtgtcttagtacctctgctattgatgctcggcgtctacctccgaatttttctggctgctcgacggcagttgaaacagatggaaagccagcccctccccggcgaaagggcaagaagtacacttcagaaagaagtccacgccgctaaatccctggccattatcgtggggctatttgccctatgctggctcccactgcatatcataaattgttttaccttcttttgtcctgattgttctcatgccccactctggctcatgtatctggccattgtgttgagccatactaactcagttgtgaacccgtttatttatgcgtaccgaataagggagtttagacagacttttcgaaagattatcaggagtcatgtgctgaggcagcaagaaccgttcaaggccgcaggcacctccgctagagtccttgctgctcacggatccgacggggaacaggtgagccttcgcctaaatggacatcctcccggtgtgtgggcaaacgggtcggctccgcacccagagaggcgccctaacggatatgccttgggcctctag

SEQ ID NO: 178215 - DNA, 1239 bp, Artificial Sequence
  Description of Artificial Sequence: Synthetic coding sequence
atgcccatcatgggcagcagcgtgtacatcaccgtggagctggccatcgcggtgctggccattctcgggaacgtgttagtgtgttgggccgtgtggctgaattcaaatcttcaaaatgtcacaaactattttgttgtttctctcgccgccgccgatatcgcagtgggggtcctggccatcccattcgcaatcaccatctcgaccgggttttgcgctgcttgtcatggctgcctgtttatcgcttgcttcgtgctagtgctgactcagtcaagcattttctctttgctcgcaatagccatcgatcgttacatagccatacggattccattacggtataatgggctggtaacgggcacacgggcaaaaggaatcatagcaatctgctgggtgctgtccttcgcaatcggcttaactcccatgctcggatggaataattgcggtcagccaaaagaaggaaagaatcactctcagggatgcggcgaaggacaggttgcctgcctgtttgaggacgttgttcctatgaactatatggtttactttaactttttcgcatgtgttttggtgcccctgctgctgatgttgggagtgtatctaagaatcttcctggctgcccgacgtcagctgaagcagatggaaagccagccattgcccggggaacgcgccagatcaaccctccaaaaggaagtgcatgcagccaagtccttggcgatcatcgtgggactgttcgccctgtgttggctaccactgcatattatcaattgtttcaccttcttctgtccagattgcagtcacgcccccctgtggcttatgtacctggcaatagttctcagccatacaaattccgtggtgaatccttttatatacgcctataggattcgagaattccgccaaaccttccggaaaatcatcaggagccacgtcctgcgccagcaggagccctttaaagccgctggaacgagcgcacgtgtgctggctgcccacggttccgacggcgaacaggtttcgctaaggctaaacggacatccccccggtgtatgggccaatgggtccgccccccaccccgagcgacggcctaatggttatgctctggggctggtttccggtggatctgctcaagagagccagggcaacactggcctgccagacgttgagttgctgtctcatgaacttaagggggtttgtcccgaaccccctggccttgacgatccgcttgcccaggacggtgcaggcgtgtcctag

SEQ ID NO: 178216 - DNA, 999 bp, Artificial Sequence
  Description of Artificial Sequence: Synthetic coding sequence
atgctgctggagacccaggacgccctgtacgtggccctggagctggtcatcgcggcgctttctgttgcaggcaatgtcctggtttgcgctgccgtggggacagctaacaccctgcagacgcccaccaattatttcttggtttctttggcagcagccgacgtggccgttggcttattcgctatcccatttgctatcacgatttctttgggattctgtacagacttctacgggtgcctgttcctggcatgctttgttctcgtcctgacgcagagcagcatattctccctgctcgctgttgccgtggacaggtacttagccatttgcgtaccactgcggtacaaaagcctggtaacaggaactcgcgctagaggcgtgatcgcggtgctctgggtgctggcatttggcatcggactcacacccttcctcgggtggaacagtaaagactctgccaccaataactgcacagagccttgggatggtacgaccaacgagtcgtgctgcctagtcaagtgcctcttcgaaaacgtggtgccaatgagttatatggtatactttaatttttttggttgtgtgctacctcctctgctaataatgctagtgatttatatcaagattttcttagttgcctgtcgccaacttcagcgaactgagctgatggaccacagccggactaccctccagcgggagattcacgccgcgaagagcctggcaatgattgttggaatctttgctctgtgctggctccccgtgcacgcagttaactgtgtgacactgtttcaacccgcccaaggcaaaaacaaacccaagtgggctatgaatatggctattttgttaagtcacgctaactccgtggtgaacccaatcgtttacgcttacagaaacagagactttaggtacaccttccacaagatcatatcaaggtacctgctgtgccaggctgacgtgaaaagtggaaatggccaggccggcgtgcagccagcactcggtgttgggctgtag

SEQ ID NO: 178217 - DNA, 957 bp, Artificial Sequence
  Description of Artificial Sequence: Synthetic coding sequence
atgcccaacaacagcaccgccctgagcctggccaacgtgacctacatcacaatggagattttcatcggcctttgtgcgattgtgggcaatgtactcgtcatttgtgtcgtgaagttgaatccgagcctccagactaccaccttctacttcatcgtttctctagcactggccgacatcgctgtgggggtgctcgtgatgcctttagctatcgtggtgtctctggggattactattcacttttactcttgcctgtttatgacctgtctactgttgattttcacacatgcgtctatcatgagtctgcttgccatcgccgttgaccggtatcttcgcgtcaaattaacggtgcggtacaaaagagtgactacccacagacgcatctggctggcactggggctctgttggctcgttagcttcttggttggattgacaccaatgtttggctggaacatgaaactcacaagcgaatatcacaggaacgtgacctttcttagctgccaatttgtgtccgtcatgcggatggactacatggtgtacttctcatttctaacgtggatctttatcccactggttgtgatgtgcgctatctacctggacattttttacattataaggaacaaactgagtctgaacctcagcaattccaaggaaacaggcgctttctacggtagggagttcaagaccgctaaatccctctttttggtcctgtttctgttcgcattgtcctggctccctctctccattatcaactgtatcatctacttcaatggagaggtaccccagctcgtcctttacatgggaatcctattgagtcacgcgaacagtatgatgaaccctatcgtgtacgcatataaaatcaaaaagtttaaggagacctatctgctcattctgaaagcttgtgttgtttgccatccgagtgatagcttggacacttccatcgagaagaactctgagtag

SEQ ID NO: 178218 - DNA, 537 bp, Artificial Sequence
  Description of Artificial Sequence: Synthetic coding sequence
atggagggcagccccgccggccccatcgagcagaaggaggcccggtgggaatcgagttgggaagagcaaccagactggactctgggctgcctgtcccctgagagccatacaaatcatgtggctctgagagatacgggaaaccagttgatcgttactatgtcatgtctgaccaaagaagacaccggttggtactggtgcggaatccagcgtgactttgctcgcgacgacatggacttcaccgaactgattgtaaccgatgataaggggacactagcaaatgatttctggagcggtaaagatctgtccgggaataagacccgtagctgtaaagctcccaaagtggtgagaaaggcagatcgcagcaggacttcaattctcatcatctgcatccttataaccggcttaggaattattagcgtgatttcacacctgacaaagagacggagaagtcagagaaacagacgggtcggaaataccttaaaacctttcagccgggtgcttactcccaaggagatggcccctactgaacaaatgtag

SEQ ID NO: 178219 - DNA, 1044 bp, Artificial Sequence
  Description of Artificial Sequence: Synthetic coding sequence
atgcccaacaacagcaccgccctgagcctggccaacgtgacctacattactatggaaatctttattggcctgtgtgctatcgtgggcaacgtactggtcatatgtgtggtgaaactgaacccttctttgcagacaaccaccttctactttatcgtctcgctggcacttgccgatattgccgtgggggtgctcgtgatgcctctggcgatcgttgtctcactgggaattactattcatttctactcctgcctgttcatgacctgcttgctccttatcttcacacatgcgtctatcatgtcactcctggccatagccgtggacaggtatcttcgggtgaagctcacagttcgttttcggattccaggcctgccaggatgtatcctgtcctttcaactgaaagtatgctttcttcccgtgatgtggctgttcattctcctgagcctggcactgatcagcgacgcaatggtgatggacgagaaggtgaagcgatcgtttgtcctggatacagcctctgctatctgcaactataacgcacactacaagaaccacccgaaatactggtgtagaggttattttagggactactgtaatatcattgccttctcgcccaactcaacaaaccacgtcgccctgagggataccggaaatcagttgatcgtgactatgtcctgtctcacaaaagaggatacggggtggtactggtgcgggatccagagagacttcgcacgagatgatatggacttcactgaactgatcgtgactgacgacaaagggacccttgcgaatgacttttggtccggcaaggatctctcggggaataaaacaagaagctgcaaagcccctaaggtggtgcgaaaggcagaccgcagccgaacatccattctcatcatttgcattctcatcacaggattaggcatcatttccgtaatctctcatctcactaagagaagacggagtcagcgcaaccggcgcgtggggaatacactcaagcccttctcaagagtgcttacgcccaaagagatggcccctactgagcaaatgtag

SEQ ID NO: 178220 - DNA, 801 bp, Artificial Sequence
  Description of Artificial Sequence: Synthetic coding sequence
atggagggcagccccgccggccccatcgagcagaaggaggcccggtgggagagctcttgggaagaacagccagattggacactcggatgcttgtctccggagagtcaatttcggatcccggggcttcctggctgcatcctatccttccaactgaaagtctgcttcctgccagttatgtggctcttcatcctgctctctctagctcttatctctgacgctatggtgatggacgaaaaagtgaaacgctccttcgttctggacaccgcctctgcgatttgtaattacaacgcacactataaaaaccaccctaagtactggtgtcgcgggtacttccgcgattactgcaatattatagcgttcagccctaattcaaccaatcatgtcgccctgagagacaccgggaaccagctgatagtgactatgagttgtttaacaaaagaggacaccggatggtactggtgcgggattcagagggattttgcgcgggacgatatggatttcacggagctcattgttaccgatgacaaagggacattggcgaacgacttctggagcggaaaagacctgtcaggaaataaaacccgatcatgtaaggctcctaaggtggtgagaaaggcagatagaagtcggacaagcattttgatcatctgtatactaattactggactgggcattatttctgtgatctcacatctgactaagagacggcgctcccaaaggaaccgacgggttgggaacactttgaagcctttctctagagtactcacgcccaaggagatggcacctacagagcagatgtag

SEQ ID NO: 178221 - DNA, 624 bp, Artificial Sequence
  Description of Artificial Sequence: Synthetic coding sequence
tgaccccaggccctgcagggcccccccagcagcaacgacgccatggttatggatgagaaagtgaaacggagtttcgttttggataccgcttccgctatttgtaattacaacgcacattataaaaatcaccctaagtactggtgccggggatacttcagagattactgcaacatcatagccttttctcccaattcaaccaaccacgttgcacttcgggataccggaaaccaactcattgttacaatgagctgcctgacaaaagaagatactggttggtactggtgcggcattcaaagagattttgctcgcgacgacatggatttcactgaactgattgtgacagatgataaagggaccctcgccaatgacttctggagcgggaaggatttatcaggcaataaaacccggagttgcaaagcgcctaaagtggtccgcaaagctgaccgcagccgcacatccatattgatcatatgcatcctgatcactggactgggtattatttccgtgataagccacctcactaaacgcagacggtcccagagaaatcggagagttggaaacacgctgaagccttttagtcgcgtgctgactccgaaggagatggctcctaccgagcagatgtag

SEQ ID NO: 178222 - DNA, 348 bp, Artificial Sequence
  Description of Artificial Sequence: Synthetic coding sequence
tgacccagcagccacgtggccctgcacagcaccctgctgggcagccattttagcacaaatcacgtggcactgcgagataccggcaatcaactgattgtcacaatgtcgtgcctgacaaaagaggacacgggctggtattggtgtggaatccaacgggactttgcccgagatgacatggacttcactgagctcatcgtgactgacgataagggtactctagctaatgatttctggagcggcaaggacttatccgggaataagacccgctcatgtaaagcaccgaaagtggtgcgaaaagcagaccgctccaggacttccatcctgataatctgcattttaattacatag

SEQ ID NO: 178223 - DNA, 519 bp, Artificial Sequence
  Description of Artificial Sequence: Synthetic coding sequence
ggccccatcgagcagaaggaggcccggtgggagagcagctgggaggagcagccggactggaccctggggtgcctgtcaccagagagccacaccaaccacgtggctctgagggacaccggaaatcaactgatcgtcacaatgtcttgtctcacaaaggaggataccggctggtactggtgcgggatacagcgggacttcgcccgtgacgacatggattttaccgagttgattgtcacagatgacaagggcacactggccaacgacttttggtcaggcaaggatctgtccgggaacaagaccaggtcctgtaaggcccctaaggtcgtgcgaaaggccgacagatcccgtacatccatattgattatttgcattttaattaccggtctggggatcataagcgtgattagtcacctcacgaagcggaggcgaagccaaagaaacaggcgcgtgggtaatacactgaaacccttttctcgtgtactgacacccaaagagatggccccaaccgaacagatgtag

SEQ ID NO: 178224 - DNA, 1092 bp, Artificial Sequence
  Description of Artificial Sequence: Synthetic coding sequence
atggcccagacccccgccttcgacaagcccaaggtggagctgcacgtccatctcgatggaagtatcaagcccgaaaccatcctctactacggtagacgtcgaggaattgctttacccgcaaacactgccgagggactactcaatgtaataggcatggacaaacccctcacattacctgactttttagccaagttcgactactacatgcctgccattgccgggtgtagagaagctataaagaggatcgcctatgagttcgttgagatgaaagccaaagagggagtggtatacgtagaggtccgctactccccacatttgctcgccaattccaaagtggagcccattccttggaaccaggccgagggcgatctgactccagatgaagtcgttgctctggtgggccagggcttgcaggagggcgagcgcgatttcggggttaaagcacgttctatcttatgctgtatgagacatcagccaaattggagtcccaaggtagtcgagttgtgcaaaaagtaccagcaacagaccgtggtggcgatcgatctggctggggacgagacgatccctggaagctctttactcccaggccacgttcaggcttaccaggaggccgtcaagtccggcatacaccgcaccgtgcacgcaggtgaggttggcagtgcagaggtggtaaaggaggcagtggacattttaaagactgagcggcttggccacgggtaccacactttagaagaccaagccttatataaccgcctgcgacaggagaatatgcacttcgaaatctgcccctggtcatcttatctcacaggagcctggaagccggatactgagcatgccgtcattaggctcaaaaatgaccaggcaaactatagtctgaatactgatgatcctctgatctttaaatcgacgctagatactgattatcagatgaccaaacgcgacatgggctttactgaggaggagttcaagcgcctgaatattaatgcagcaaagtcctcgtttctgcccgaggacgagaaacgggaacttttggatctgctgtacaaagcctacgggatgcccccatccgcatcagccggccagaacttgtag

SEQ ID NO: 178225 - DNA, 1731 bp, Artificial Sequence
  Description of Artificial Sequence: Synthetic coding sequence
atggccagcaacaaccactggttccagagcagccaggtgcccagctttgcccagatgctgaaaaaaaatctacctgtccaaccagccactaagactataacaacccctacaggatggtcctctgagagttacgggctgtcaaaaatggctagcaaagtgacacaggtcactgggaacttcccggagccactgttatccaaaaatttgtctagcatctctaaccccgtgcttccacctaaaaaaatccccaaggagtttattatgaaatataaaagaggagagatcaatccagtgagcgctctgcaccagtttgctcagatgcagagagtgcagctggatctgaaagaaaccgtgaccactgggaacgtaatgggaccatattttgctttctgcgcggtagtcgatggaatccagtacaaaacaggtctcggccagaataagaaggagtctcgttccaacgcggctaagctagcacttgacgaactgttgcagttagatgaaccagaacctcgaatactggagacaagcggtccgccaccttttcccgcagagccagtggtgttgtcagaactcgcctacgtgtccaaggtccactatgaggggcgccacatacaatacgcaaaaatatcacagatcgtgaaggaaagatttaatcagcttatcagcaaccgttccgaataccttaaatattcaagctccctggccgctttcatcatagaacgggctggacagcacgaggtggtcgccatcgggacaggtgagtacaattacagccaagacattaagcctgacggccgagttcttcatgatactcacgctgtggtcacagcaagacggtctttgctgcggtacttctataggcagctactgctgttctactcaaagaacccagccatgatggagaaatcgatattttgcaccgaacctacgtccaaccttctaactctgaaacagaatataaacatttgtctgtacatgaatcagcttccgaagggcagcgctcagattaagtcccagctccgcctgaacccacatagcatctccgcatttgaagccaatgaggaactgtgtctgcatgtagcggtcgaagggaagatatacctgaccgtttactgcccaaaggacggagttaatcgcatttcaagcatgtcctcatccgataaactgacaagatgggaagtactcggggtgcaaggcgccctgctcagccactttattcagcctgtctacatcagcagtattctcattggggacggcaactgtagtgacactcggggactggaaatcgccattaaacagcgcgttgacgacgccttaacgagtaagttgccgatgttttacctcgtgaacagaccacatatcagcctcgtcccgtcagcataccccctgcagatgaatctggaatataagttcctgagcctgaattgggctcagggcgacgtgtcccttgaaattgttgacgggctgtccggaaagattactgaatcttcaccctttaaatccggaatgtccatggcaagcagattgtgtaaggccgccatgctgtccaggtttaaccttttagctaaagaggccaaaaaggagctactcgaagctggaacgtatcacgccgccaagtgcatgagtgccagctatcaggaggccaagtgcaaactgaagtcctaccttcaacagcacggttacggctcctggatcgtgaagtctccctgcatcgagcagttcaacatgtag

SEQ ID NO: 178226 - DNA, 1698 bp, Artificial Sequence
  Description of Artificial Sequence: Synthetic coding sequence
atggccagcaacaaccactggttccagagcagccaggtgcccagcttcgcccagatgctgaaaaagaacctccctgtgcagcctgccacaaagacaatcactacgcccacaggttggagctccgagagttacggtctgtctaagatggcttctaaggtgacacaagtcacaggaaattttcctgagcctctgctcagcaagaatctgtcatctatctcaaatccagtgttgcctcctaagaaaatccctaaagagtttattatgaaatataaaaggggcgaaattaatcccgtgtctgcactgcaccaattcgctcagatgcagcgcgtgcagctcgatcttaaggagacagtgactacaggcaatgttatgggaccctacttcgccttttgtgctgtggtggatgggatccagtacaaaacaggcctgggccagaacaagaaggaaagccggagtaacgctgccaaattggccctcgacgagctcttgcaattggatgagcctgagcctcgcattctggaaacgtcgggaccgcctcctttcccagccgagcccgtcgtgttatctgagctggcctatgtctctaaagtacactacgagggcagacacatccaatacgcaaaaatctctcagatcgtcaaggaaaggttcaaccaactcatctccaatagatccgagtatttaaaatactctagctccctagccgccttcatcatcgagcgggctggacagcacgaggtagtcgccatcggtacaggcgagtacaattactcacaggacattaagccggacggacgagtcttacatgacacccacgccgttgtcactgctcggaggagcctgcttagtaaaaatccagcaatgatggaaaagtcaattttctgtaccgagcccactagcaatctgcttaccctcaagcagaatatcaatatatgcctatacatgaaccagctccctaagggcagtgctcaaatcaagtcccaactccgactgaatccccattctatcagcgccttcgaggcaaacgaagaactgtgtctgcacgtagccgtcgagggaaaaatctacctgacagtgtattgcccaaaagacggcgtcaacagaatatcttccatgagcagctctgataaattgaccaggtgggaagttcttggggtgcagggcgcacttttgagccactttatacagccagtctatatcagcagtatcttgataggggacggaaactgctcagatacaagagggctggaaattgccattaaacagcgcgtggacgacgccttaacttcgaagttgcctatgttctatcttgtgaatcgtcctcatatttccctagtcccctccgcctatcccctgcagatgaatctggagtacaagtttctgtctctgaattgggcccaaggggacgtgtcgctggaaatcgtggacggtctgagcgggaagatcacagagagctccccctttaagtctggcatgagcatggctagtcggctctgcaaggcagccatgctgtctagatttaacttgctggccaaagaagctaaaaaggagttgttggaagcaggaacataccacgcagccaagtgtatgtcagcaagctatcaggaagcgaaatgtaagctgaaaagctatttacaacagcacggatatggtagctggatcgttaaaagtccatgcatagagcaatttaacatgtag

SEQ ID NO: 178227 - DNA, 726 bp, Artificial Sequence
  Description of Artificial Sequence: Synthetic coding sequence
atggccagcaacaaccactggttccagagcagccaggtgcccagctttgcccaaatgctcaaaaaaaacctcccagtccagccagctactaagaccatcacgacaccaaccggctggagctctgagtcctatggtctgagtaaaatggcaagcaaagttacacaggttacaggcaatttcccagagccgctgttgtccaaaaacctttcctctatatccaatccagtcctgcctccaaagaagataccaaaggagttcattatgaagtacaagagaggagaaatcaaccccgtgtcagcgctgcatcagttcgcccagatgcaacgcgtgcagttagatctgaaagagacagtgactacaggcaacgttatggggccgtacttcgccttttgcgccgtggtggacgggatccaatataagactggcttggggcaaaacaaaaaagaatcccgcagtaatgcagccaagctggccctggatgagctgctgcagctggatgaacctgagccaagaattcttgaaactagtggaccaccaccttttcccgccgaacccgtagttcttagtgaactggcctacgtcagcaaggtccactatgagggccggcatattcagtacgcgaaaatctcccagattgtaaaagagaggtttaatcagctaattagtaaccgatcagaatatctgaagtactcttcaagcctggctgcattcattatcgagagatag

SEQ ID NO: 178228 - DNA, 471 bp, Artificial Sequence
  Description of Artificial Sequence: Synthetic coding sequence
atggccagcaacaaccactggttccagagcagccaggtgcccagctttgcccagatgctcaagaaaaacctcccggttcagcctgcgaccaagactattaccacccctaccggttggtcatcagagtcatatggcctgtccaaaatggcgagcaaggtgacccaagtgacggggaatttcccggaacccctgctgagcaaaaacctgtcatctatttccaacccagtcctgcccccaaaaaaaatccccaaagagtttatcatgaaatacaagcgaggagaaatcaacccagtgagcgcacttcaccagtttgctcagatgcaacgtgtacagctggatctgaaggagaccgtgactacggggaacgtgatgggaccttacttcgcgttctgcgccgtggtggacggcattcagtataagacagggttgggtcagaacaaaaaggagagcaggtcaaatgccgccaagtag

SEQ ID NO: 178229 - DNA, 1677 bp, Artificial Sequence
  Description of Artificial Sequence: Synthetic coding sequence
atgctgaagaagaacctgcccgtgcagcccgccaccaagaccatcactacccccaccggctggtcctccgagtcatacggactcagcaaaatggctagcaaggtgactcaggtgacggggaattttcctgagcccctgttgtctaagaatctgagctcaatcagcaatcctgtgctaccccccaaaaaaattccaaaggaattcattatgaaatacaagcggggggagattaatcccgtctctgcgttgcaccaatttgcacagatgcagcgagtgcaactggacctgaaagaaacagtcaccacgggaaacgtcatggggccttacttcgcattctgcgctgtcgtggatgggattcagtacaaaacagggttaggccagaataaaaaagagtccaggtccaacgctgccaagttggctctcgatgaattactgcagctcgatgagccggagccacgtattctggaaacttctggaccccccccctttcctgcggagccggtggtgctcagtgagctggcctatgtgagtaaggtccattacgaaggaagacatattcagtacgccaaaataagtcaaatcgtgaaagagaggtttaaccagctcatttccaatagatccgaatatctgaaatattcgagctcactcgctgccttcattattgagcgagctggccagcatgaggttgtagccatcgggaccggggagtacaattatagccaggacatcaaaccagacggaagagtcctgcatgacactcacgccgttgtcaccgcgagacggagcctgttacggtatttctaccgacagctactgcttttttactctaagaatcccgccatgatggagaaaagcatattttgtacagagcctacctccaacctgctcacactcaaacagaatatcaatatctgcctgtacatgaatcagctgccaaagggtagcgcacaaataaagtctcaactgcgtttaaatccacacagcatatccgcctttgaggccaacgaggaactatgcttacacgtggccgttgagggaaaaatctatctcactgtgtactgccccaaggatggagttaatagaatttcatcgatgagcagctcagacaaacttaccagatgggaagtgctgggcgtgcaaggggcactcctttcgcacttcattcagcctgtctatatcagcagtattttgatcggggatggaaattgttctgacacgcggggacttgagattgccatcaagcaacgcgtggacgatgctctgacgagcaaattacctatgttttaccttgtgaataggccacatatctctctggtgcccagcgcatacccactccagatgaacctggaatacaaattcttgagtctgaactgggctcagggggacgtgagtctggagatagtcgatgggctatcaggaaagatcaccgagtcttctccctttaagtccgggatgtccatggcaagcagattgtgtaaagccgcaatgctatcccgattcaacctactcgcgaaggaagccaagaaggagctcctggaggccggcacgtatcacgccgccaaatgcatgtccgccagctaccaggaagccaagtgcaagttgaagagctacctgcagcagcatggatatgggtcatggattgttaagagtccatgcattgagcagttcaacatgtag

SEQ ID NO: 178230 - DNA, 3810 bp, Artificial Sequence
  Description of Artificial Sequence: Synthetic coding sequence
atgatgagccccatctgcgaccagaccatcgacagccggctgaaggtggaaaaagctacttggtggggtcgcgtaggcggcggcagcagaccacattggcagagccctggtgtgaggccatgcccagaggaagttcaggaccccggatacagcctgtcaggctattatacacaccctttccagggatacgagcaccgccagctgcgctaccagcagcccgggccaggaagttcgccttcctccttcctgctgaagcagatcgagtttctcaaaggtcagctgcctgaagctcccgttatcggcaagcaaacaccaagcttacctcctagtcttccagggctgcggccccggtttccggtgcttctcgcctcaagcacaaggggtcgccaagtggatattcgcggcgtgcctcgaggcgtacatcttaggtcccaaggattacagcgtgggtttcaacacccttcacctagaggaagatcactgcctcagcggggcgtagattgcttatccagccactttcaggaactgagtatataccaggaccaggagcagcgtatccttaaatttcttgaagagttgggtgaggggaaggctacaactgcgcacgatctatctggcaagctggggacacctaagaaggagatcaatagagtgctgtatagcttggctaaaaagggcaagctgcaaaaggaggccggtaccccaccactgtggaaaattgcggtgtctacacaggcttggaatcagcattctggcgtagtccgcccagatggtcatagccaaggagcacccaactctgacccctctcttgaacccgaagacagaaactcgacttccgtttctgaggaccttctggagccctttatcgcggtatctgcccaggcgtggaaccagcactccggagtggttagacctgactctcacagccaaggatccccaaacagtgacccaggtctcgaacctgaggattcaaactctacatccgccctcgaggatcctctggagttcctagacatggcagaaatcaaagagaaaatctgcgattacctgtttaatgtcagtgacagctccgccctcaatctggctaagaacatcggactgactaaagcccgggacatcaatgctgttttaatcgatatggagagacagggagacgtgtaccgtcagggtacaacaccacccatctggcacttgactgataaaaagcgggagaggatgcagattaagcggaacaccaattctgttccagagacagcccctgctgcaatcccagaaaccaaaaggaatgccgaattcctgacgtgtaacattccgacaagtaatgcttccaacaacatggtgacgaccgaaaaagtcgagaacggccaagagcccgtaattaagctggagaacaggcaggaggccaggcccgaaccagctcgacttaaaccgcccgtccattacaacggtcccagcaaagctggttacgtcgatttcgaaaacggccaatgggccaccgatgacatccccgatgatctaaatagtattagagctgcccccggcgagtttcgggccatcatggaaatgccttcgttctacagccacggcttgcccaggtgtagtccgtataagaagctgaccgagtgtcagttgaagaatcctatatcgggactgctagaatacgcacagttcgcatctcagacctgtgagtttaacatgatcgagcaatctggcccacctcatgagccccgctttaaattccaagtagtcattaatggaagagagtttcctccggcggaagctggcagcaagaaggttgcgaaacaggacgccgccatgaaggcaatgactattctgttagaggaagccaaggcaaaggattctggaaagagtgaggagtccagccactactcaacagaaaaagagtcggaaaagactgcagagtcacagaccccaacccctagcgcgacgtctttcttctctggaaagtcccccgtgactacattactggaatgcatgcacaagctgggcaacagctgtgaattccgactcctgagcaaagaaggcccagcccacgaacctaaattccaatactgcgtggcagtcggagcacagaccttcccttccgtttctgccccttctaaaaaagtggccaagcagatggcagccgaggaagccatgaaggcgctccatggggaggccaccaactccatggccagtgacaaccagccagagggcatgatctccgagtcattagacaatctggaatctatgatgcccaacaaagtgcggaagattggtgaattggtgcggtatttgaatacaaaccctgtgggcgggctgctagaatacgccaggtcccacggattcgctgccgagttcaaactggtcgatcaaagcggccctcctcatgagcctaagtttgtatatcaggccaaggtgggaggccgctggttccccgcggtatgtgcccattccaaaaaacaaggaaaacaagaagcagcagacgccgcattgcgcgtgcttattggggagaacgagaaagccgaaaggatgggctttaccgaggtgactcctgtgacaggggcaagcctccggcgaactatgctcctactgagtagatcacccgaggcacagcccaaaactctgcccttaaccgggtcaacgttccacgatcagattgccatgctttctcatcgctgtttcaatactctgacaaattctttccagccctcactgctgggccgcaagatcttggcggctattatcatgaagaaggattcagaagatatgggcgtcgtggtctccttgggaaccggcaatcgctgcgtgaagggggattctctttcactgaaaggtgagactgtcaacgattgtcacgctgaaatcatcagtcgccgcggatttatcaggtttctgtacagtgagctcatgaagtacaattctcagacagccaaggattctatctttgaaccagcgaagggaggcgagaaactgcagatcaaaaagaccgttagtttccacctgtacatctctacggcaccatgcggagacggggcactgtttgataagagctgtagcgacagagccatggagtcaaccgagagtcgccactaccccgtttttgaaaatccaaaacagggcaagttgcggacaaaggtcgaaaacggtgaagggaccatcccagttgagagctcagatatcgtcccaacctgggacggcattcggttgggcgagcggttgcggaccatgtcctgctccgacaaaattttacggtggaacgtgctaggcttgcagggcgcattactcacccattttctgcagccgatttacctcaagtcagtcacactgggctacctatttagtcaggggcacctaacacgcgcaatctgttgccgggtcactcgtgacggctctgctttcgaggacggcctgcgccatcccttcatcgtgaatcaccctaaagttggaagagtttccatctatgattctaagcgccagagcggaaagacaaaggagaccagtgttaattggtgcctcgctgatggttatgacctggagattctggatggtactagagggaccgtcgatggcccccggaacgagttgtcccgagtcagcaaaaaaaatatcttcctgctgttcaagaaactgtgttcattcagatatcgacgagatctcttacgactgtcttacggagaagccaaaaaggccgccagggactacgaaaccgccaaaaactactttaaaaagggtctgaaagatatggggtatggcaattggatctcaaagccacaggaagagaaaaacttctatctttgccctgtgtag

SEQ ID NO: 178231 - DNA, 159 bp, Artificial Sequence
  Description of Artificial Sequence: Synthetic coding sequence
atggccaacgagcacaccctgatccaccccgccagcatcgaggacccgctcgaggctaggccgatgtccgacgaggatcccgaagatgaggacgccttaccggctcggtggaaaaaggaaatgggccgaaaacgtaagcgcacgattgcaacattgtag

SEQ ID NO: 178232 - DNA, 2106 bp, Artificial Sequence
  Description of Artificial Sequence: Synthetic coding sequence
atggacatcgaggacgaggagaacatgagcagcagcagcaccgacgtcaaagaaaatcggaacctggacaacgtgagtcccaaagacggttccacccccggccctggtgagggaagtcagttaagtaacggtgggggaggcgggcccggcagaaaaagaccgctggaagaggggtctaatgggcatagtaagtaccgcctgaagaagagacgcaaaacacctggacctgtcctgccgaaaaatgccttgatgcagctgaatgagatcaaacccggtctacagtatacactcctttcccagactggcccggtccatgcaccactgttcgttatgtccgtggaagtgaacggccaggtgttcgaaggcagcggccccacaaagaaaaaggccaagcttcacgcggcagagaaggctctgcgttcgtttgttcagtttccgaatgcctccgaagcccatctcgcaatggggcgaacactgagcgtaaataccgattttactagcgaccaagccgatttcccagatacactgtttaacggttttgagacgcccgataaagccgagcctcctttttacgttgggtcaaacggagacgacagcttctcaagcagcggagacttgagtctctcagctagccccgtgcctgcctctcttgcccagccaccactgccggtgttgccgcccttcccaccacccagcggcaaaaatcctgtgatgattctgaatgagctgcggcccgggttaaagtacgacttcttgagtgaatcaggcgaatctcatgcaaagtccttcgtgatgtccgtcgtggttgatggccagttttttgaaggaagcggccgaaataagaagctggccaaggctcgggccgcccagagcgctctggccgctattttcaatcttcacttagaccagaccccatcgaggcagcccatcccttcagaaggcctacagctgcatctacctcaggtgcttgctgacgctgtgtcacgccttgtcctcggaaaatttggtgacctaacagataacttctctagcccacatgcccgtaggaaagttttagctggcgtcgtgatgactacaggtacggacgtcaaggacgccaaggtgatctccgtgtcaaccggaacaaagtgtatcaacggggagtatatgagtgatcgaggcctagctctgaatgactgtcatgccgaaattatctcaagacgtagtctcctcagattcctctatacccagttagaactctacctgaataataaggatgaccagaaaaggtccatttttcagaagtcagagagggggggattcagactgaaggagaacgtgcagttccacctgtacatcagcacttcaccctgtggtgatgccagaatcttttctccccatgaaccaatcctggaggagccagcagataggcaccccaacaggaaggccagagggcaactcaggaccaagatcgagtctggggagggtacaattccagtgcgctcgaacgcctctatccagacatgggatggcgttctgcaaggcgagagactgctgacaatgtcctgcagcgataaaatagccaggtggaatgtggtgggcatacagggcagcctgctgtcgatttttgttgagcctatttacttcagtagtatcattctggggagcctgtaccatggagatcacctgtcccgtgccatgtaccagaggatatccaacattgaggatctccctccactctacaccctgaataaacccttgctctccggaattagcaacgcagaagctcggcagcctgggaaagcccccaattttagcgtcaactggaccgtgggtgacagtgccatcgaggtcattaatgccactactggaaaggacgagttgggccgcgcaagtcggctttgcaaacacgccctgtactgtaggtggatgcgagttcatggcaaagtcccaagccacctgctcaggagcaaaatcactaagcccaacgtgtatcacgaatcaaagctcgccgccaaagagtatcaggctgccaaggcaaggctattcactgccttcattaaggctggtctgggcgcatgggtagagaagccgactgagcaggaccagttctccctcaccccatag

SEQ ID NO: 178233 - DNA, 2226 bp, Artificial Sequence
  Description of Artificial Sequence: Synthetic coding sequence
atggacatcgaggacgaggagaacatgagcagcagcagcaccgacgtaaaagagaacaggaacctggataacgtctcacccaaggatggatctactcccggtcccggcgagggatcacagctgagtaacggggggggagggggacctggtaggaagcgccccctcgaagaaggttcgaacgggcatagtaagtaccggctgaagaagcggcgaaagactcctggccctgtgctgcctaagaatgctctcatgcagctgaacgaaataaagcctggtcttcaatacactcttctgagccagaccgggcccgtgcacgctcctctctttgtgatgtcggtggaagtgaacggccaggtgtttgaaggctcgggccccacgaaaaaaaaggccaaacttcatgccgccgagaaagcactgagaagcttcgtccaattcccaaatgcatctgaagctcacctagctatgggaaggactcttagcgttaacaccgatttcacgtcagatcaggctgacttccctgacactctcttcaatgggttcgaaactcctgacaaagccgagcctcccttttacgttggttcaaatggagatgacagtttttctagcagtggagatctctcactgtcagcgtctcccgtgcccgcctcactcgctcaaccaccattaccagtacttcccccatttccccccccctctggtaaaaaccccgtaatgatcctgaatgagttgcgccccggcctgaaatatgactttctcagcgagtccggggagagtcacgcgaaatcattcgtgatgtctgtggtcgttgacggccagttcttcgagggcagcggtagaaataagaagctagccaaggcccgggctgcccagtctgcacttgccgctatcttcaacttgcatctcgatcagactccatcccggcaacccatcccctcagagggtctccagctccacctcccccaggtcctggcggatgcagtgtcacgcttagtcttgggcaaatttggggatcttacagataacttcagctctcctcacgcccggcggaaggtgctggccggtgtggtgatgacaacaggtacagatgtgaaggatgccaaagtaatatctgtatcaacagggaccaaatgtattaatggcgagtatatgtccgacaggggcctggccctaaacgactgtcatgctgagataatatctcgccggtctctgcttagatttctttatacccagctcgaactctatctgaacaataaagatgatcagaagcgcagcattttccaaaagagtgaacgaggaggtttccgcctaaaggaaaatgtgcaattccacttgtatatctcaacaagcccctgtggggatgctcgcattttcagcccacacgaacccattttagagggttctcgatcttatacgcaggcaggcgtgcagtggtgtaaccatggatccctccagccaagaccgcccggcctcctatccgatccaagtacttcaaccttccaaggcgctgggacgacggagcccgcagacagacaccctaatcgtaaggcccgtgggcagctgcggactaagatcgagtctggggagggtaccattcctgtgaggtctaatgcgtccattcaaacatgggatggcgtcttacagggagagcggctgctgaccatgagttgttccgacaaaatagcccggtggaatgtcgttgggattcagggtagcctactgtcaatctttgtggagccaatttattttagttccataatcctggggagcttatatcatggggaccatctgagccgagctatgtaccagagaatctcgaatattgaggacctccctccattgtatacactgaacaagcccttgctctcagggatttctaatgccgaggccagacaaccggggaaggcaccaaacttctcagtgaattggacagttggagatagtgcaattgaggtgattaacgccactacggggaaggatgagctgggtagagccagtaggctctgcaaacatgcgttatactgcagatggatgcgtgtacacggtaaggtgccatcccatctgcttagatccaaaattacaaaaccaaacgtgtatcatgagtcaaagttagccgccaaagaataccaggcagctaaagcaaggctgtttacagcatttattaaggcaggcctgggagcttgggtggagaaaccaacagagcaggatcagttctctctgacaccttag

SEQ ID NO: 178234 - DNA, 2145 bp, Artificial Sequence
  Description of Artificial Sequence: Synthetic coding sequence
atggacatcgaggacgaggagaacatgagcagcagcagcaccgacgttaaggagaataggaacctggacaatgtttcccccaaagatgggtccactccgggccccggagagggctctcagctctctaacggaggcgggggcggcccaggaagaaagcgcccactggaggagggcagcaatggtcacagcaagtataggctcaagaaaaggaggaaaacgcccggccccgtacttccaaaaaacgctctgatgcagcttaatgagattaagcctggcctgcaatatacgctcctatcacagactgggcctgtgcatgctcctctctttgttatgagtgtagaagtgaacggacaagttttcgagggctcgggcccgactaaaaagaaggcgaaattgcacgccgctgagaaagcactgagatccttcgttcaattccctaacgcctcagaggcccacctcgccatgggtcggaccctctcagtcaacactgattttaccagcgaccaggcggatttccccgacaccctgtttaacggcttcgagactcctgataaagcagagcccccattctatgtgggatcaaatggggatgattcgttctcctctagcggcgatctctcactgtccgcatcccccgtgccggccagtctggcccagcccccgttaccagtcctcccccctttccctccaccttcaggtaaaaatcccgttatgatcctgaacgaacttcggccgggtctgaaatacgactttctgtcagagtccggcgagtctcacgcaaaatcattcgtgatgtcagtggttgtagatggccagttttttgaggggtccgggcgtaacaagaaattagcaaaagcccgcgcggcccaatccgccctagccgctatttttaatctccatctggatcagactccttcccgacagccaataccgtcagaggggcttcagctgcacctgcctcaagttctcgctgacgcagtcagtaggttagtccttggcaaattcggagatctgacggacaatttttcgtcaccgcacgctcgtagaaaggtgctagcaggcgtcgtgatgaccaccgggacagacgttaaggatgctaaagtcatctcggtgagcaccggtacaaaatgcattaacggtgaatacatgagcgacaggggtctggccctgaacgactgccacgctgaaatcatctcaagaaggtccctgctgcggtttctgtatacacagctcgaactctatttgaataataaagatgatcagaagagatccatattccagaaaagtgagagaggcgggttccgcttgaaagaaaacgtccagtttcatctctatatctctacctctccctgtggggatgctcgtatcttctctccacacgagcctatcctcgagggctccaggtcctacacacaggcaggggtgcagtggtgtaaccatggttctttacagccacggcctccgggcctgctcagcgacccaagcacttcaaccttccaaggcgctgggacaacagagcctgccgacagacacccaaatcgaaaagcccgaggacagttgagaacaaagattgaatccggcgaggggacaattccggtgagatccaacgcatctattcagacatgggatggggtgttgcagggcgagaggttgttaaccatgtcctgtagtgacaagatcgctaggtggaatgtcgtgggtatccagggcagcctcttgtcaattttcgtggagcccatttatttttccagcattatcttggggtccctctatcatggcgatcatctgtctcgagccatgtatcagcgaatatctaatatcgaggatttgcctccactatacaccctgaacaaacccctgctctctggtatcagcaacgccgaagccaggcagccagggaaagcccccaacttttctgttaattggacggtgggagattccgctatcgaagtgattaatgcaaccaccggaaaggatgagctagggcgggccagtcgcctttgtaaacacgccctttattgccgctggatgagggtgcatggcaaggtgccttcacacctcctccgcagcaaaatcactaaaccaaatgtctaccacgagagcaaactggctgccaaggaatatcaggccgccaaggtgcattag

SEQ ID NO: 178235 - DNA, 39 bp, Artificial Sequence; identical to SEQ ID NO: 72041
  Description of Artificial Sequence: Synthetic coding sequence

SEQ ID NO: 178236 - DNA, 426 bp, Artificial Sequence
  Description of Artificial Sequence: Synthetic coding sequence
atggacatcgaggacgaggagaacatgagcagcagcagcaccgacgtgaaggagaaccgcaacctggacaatgtgtctcctaaggatggctccacacctggcccaggggaagggagccagcttagtaacggcggcggggggggcccaggtagaaagcggcctcttgaggaagggagcaatggacactccaaataccggctgaaaaagcgacggaagacccctgggcccgtccttcctaaaaacgcactcatgcaactgaacgagataaaacctggcctccagtacacactactctctcagaccggtcccgtgcacgcacctttgttcgtcatgagtgtggaggtgaacggccaggtttttgagggctccggcccgaccaaaaagaaagccaagctgcacgcagccgaaaaggccctgcgaagctag

SEQ ID NO: 178237 - DNA, 2226 bp, Artificial Sequence
  Description of Artificial Sequence: Synthetic coding sequence
atggacatcgaggacgaggagaacatgagcagcagcagcaccgacgtgaaagaaaacagaaatttagacaacgtgagtcctaaggatggctctactccaggtccgggcgaaggctcacaactgagcaatggtggcggaggcggtcctggcaggaagcgccctctcgaggagggatccaacggccattctaagtacaggctgaaaaagagacgaaaaacgccaggcccagtgctcccaaaaaacgcgctgatgcagctgaacgaaattaagcccggacttcagtatacgcttctgtcccaaactggcccggtacatgcacccctgtttgtgatgtcagtcgaagtcaacggtcaagtatttgaaggatccgggccaaccaagaaaaaggccaaactccacgctgcagagaaggctctcagatcatttgtgcagtttccaaacgcttctgaagctcacctggcaatgggacgaaccctgtcagtaaatacagacttcaccagtgaccaggcagactttccggataccttgttcaacggattcgagaccccagacaaggccgaaccgccattttacgtcggaagcaacggcgacgatagtttttcgtcctcgggagatctctctctgagcgcgtcccctgtgccagcatctctggcacagccaccgctgcctgtacttcccccatttcctcccccaagtgggaaaaatcctgtgatgattctgaacgagctgagacccgggctgaaatatgatttcttgtctgaaagcggagaatcccatgccaagtcttttgtgatgtctgtagtcgtagatggccaattttttgagggctctggcagaaacaagaagcttgctaaagcacgcgctgcccagagtgctcttgccgcaatttttaaccttcacctggaccagaccccaagcaggcagcccataccttcggagggtctccagctgcatttgccccaagttttagctgacgctgtgagtcggttagtgctgggaaagttcggcgacttgaccgacaacttctcctctccacacgccagaaggaaagtcctcgcaggtgtcgtgatgaccaccggtaccgatgttaaggatgcaaaggtgatttcagtcagcacgggaactaagtgcatcaatggggaatatatgtctgataggggcctggctctgaatgattgtcacgctgagattatcagccgcagatcactgctcaggttcctgtacacacagctcgaactgtatctgaacaacaaggatgatcagaaacgtagtatctttcagaaatcagagaggggcggatttcggctgaaggaaaatgtacagtttcacctttacatctccacgagcccatgcggcgatgcacgcatttttagcccccatgagcccatcttagaaggtagtcgctcctatactcaagcaggcgtgcagtggtgcaatcacggtagtctccagccacggcctcctggtctgctctctgatccttcaacttcaactttccagggcgccggaactactgaacccgctgatcggcaccctaaccggaaggcgcgcggtcagctgagaacaaaaatagagagcggggaaggcaccatccccgtcaggtcaaacgcctctattcagacctgggacggggtgcttcagggggaaaggctgctgacaatgtcctgctccgataagatagctaggtggaacgtggtcggaattcagggatctttgctgtccatctttgtggaacccatctatttcagcagcattatcctgggctctctttatcatggggatcacctaagtcgggctatgtaccagcggatctcaaacatcgaagatttgccacccttgtataccttaaataaacctctcctgagcgggatatctaacgccgaggcgagacagcctggcaaggctccgaattttagtgtgaactggaccgtgggggactcggctatcgaagtgatcaatgctactaccgggaaggatgaacttggccgagcatcaagattgtgcaaacacgcactgtactgccggtggatgagagtgcacggcaaagtaccaagccacttgcttcgatccaaaatcacaaaacccaacgtctaccacgagagtaaattggctgctaaagagtaccaagccgcaaaggcccggctgttcaccgccttcattaaagcaggcttaggagcctgggtggagaaacctactgagcaggaccagttcagcctcactccttag

SEQ ID NO: 178238 - DNA, 2226 bp, Artificial Sequence
  Description of Artificial Sequence: Synthetic coding sequence
atggacatcgaggacgaggagaacatgagcagcagcagcaccgacgttaaagaaaatagaaatctggataatgtatcacccaaggacggctccactcccggccctggggaagggtcacagctgagcaacggcggaggagggggccctgggaggaagcggccccttgaagagggaagtaatggacactccaagtaccgcctgaagaaaagacgaaagactccaggaccggttttgccaaaaaatgcactcatgcagttaaatgaaatcaagcctgggctgcaatataccttgctcagtcagacagggcccgtgcatgccccgctatttgtgatgtcggtggaagtcaacgggcaggtgtttgaaggctctgggccaaccaaaaagaaagccaagctgcacgccgccgagaaggcactgagatcttttgtgcagtttccaaatgcaagcgaggctcatctggctatgggtaggaccctgagcgtgaacaccgacttcacgtcggaccaggccgattttccagacaccctctttaacggcttcgagactccagacaaagctgagcctccattctacgtggggagcaacggggatgatagcttctccagttcaggagatctgtccttgagcgcctctccagtgcccgccagtctggctcagccccccctgcctgtgctcccaccttttccgccaccatccggcaagaaccccgttatgatccttaatgaacttagaccaggcttaaagtatgatttcctgagtgagtcgggtgaaagccacgccaagtccttcgtgatgtccgttgttgtagacggacagttttttgaaggctccggacgcaacaagaagcttgccaaggcaagggcagcacagagtgcactcgccgccatcttcaatctacatctcgaccaaaccccctcaagacaacctatcccaagcgaaggactacaattgcacctgcctcaggtgctggctgatgccgtgagccgcctggtgctgggaaagttcggcgacctgaccgacaacttctcgtcccctcatgctcgacgcaaggtattggcaggagtcgttatgaccactggaaccgatgtgaaagacgccaaagtaatctctgtgtctactgggacaaagtgcattaacggcgaatatatgtcagaccggggtctggccctgaatgattgccacgcagaaattatcagccgccgatctctgcttcgttttctgtatactcagctcgagctgtacctgaacaacaaggatgatcagaagcgttcaattttccaaaagagcgaacgaggcggattcaggctgaaagaaaacgttcagtttcacctgtacatctcaacctcgccttgcggggacgcgcggatcttttctccccatgagcccatcctggagggatctagatcatacactcaagccggtgtacagtggtgcaatcacggctcccttcaacccagacctcccggacttctatcagacccttcaacctctacttttcagggcgcagggacgacagagcctgcagaccgacatcctaaccggaaagctagaggtcagcttaggacgaagatcgagtctggagagggaacgattcccgtgcgcagtaacgcctccatacagacctgggatggagtgctgcagggggaacgactgctgacaatgtcttgttctgacaagatcgcaaggtggaatgttgtgggcatacaaggttctctcctgtctatcttcgtggagcccatttacttttcctctattattctgggatcactctatcacggcgatcatctgtcccgagcgatgtaccaaaggatctctaacatagaggacctgccacccctctacacacttaacaagcctctactttccggcatttccaacgccgaagctcggcaacccggcaaagctcctaactttagcgtcaattggaccgtcggggactccgcaatcgaggtcattaatgcaactactgggaaggatgaactcggtcgcgccagcaggttgtgtaaacacgcactgtactgccggtggatgcgagtgcacgggaaggtgcctagtcacctcctgagaagcaagataactaaacccaacgtttaccatgaatctaagctggcagccaaggaataccaggccgccaaggctcggctgttcaccgccttcataaaggccggtcttggcgcatgggtcgagaaacccactgaacaggaccagttctctttgacaccctag

SEQ ID NO: 178239 - DNA, 2097 bp, Artificial Sequence
  Description of Artificial Sequence: Synthetic coding sequence
atggacatcgaggacgaggagaacatgagcagcagcagcaccgacgtcaaagaaaacagaaacctcgacaacgtctcccccaaggacgggtccactccaggcccaggcgagggcagccagttgagcaacggaggtggcgggggacctggtcggaagaggcctctggaagaagggagtaatggccattctaagtatcgcctgaaaaaacgcaggaagacaccaggaccagtattgcctaaaaacgcactgatgcagctgaacgaaattaaacccggcttgcaatataccttgctcagccagacaggcccagttcacgcacccctgttcgtgatgtcggtggaagtcaatggtcaggtgttcgaggggagtggacccacaaagaagaaggcaaagctgcatgccgcggagaaagccctcaggagtttcgttcagttcccaaacgcgagtgaggcgcacctggcaatggggaggaccttatctgtgaacacggacttcacatccgaccaagccgacttccctgacaccctctttaatgggtttgaaacaccggacaaggccgagccccctttctacgtcggctccaatggggacgactcattctcttcaagtggtgatctgagcctcagcgcatcccccgtgcctgccagccttgcccagccgccattgcctgtcctgcccccatttccccccccatctgggaagaatccggtaatgattctcaatgagttgcggcctggcttaaaatatgatttcctgtcagaaagcggggagtcccacgccaaaagcttcgtgatgtcagtggttgtcgacggccagtttttcgagggcagcgggcgcaataaaaagcttgcaaaggcccgcgcagcccagtctgcactggcggcgatttttaacctccatctcgaccagacaccatcacgacaaccaatcccctccgagggtctgcagctgcatttgcctcaggtgcttgccgatgccgtctcaaggctcgtgctaggcaagtttggcgatcttacagacaatttttcatccccccacgcccggcgcaaagtcctggcgggggtggttatgacaaccggtacagacgtcaaagacgctaaggtgatttccgtttctaccggtacaaagtgtattaacggggaatacatgtccgacaggggcctagccctgaatgactgtcacgctgagattatttccaggcgttcactgctgcggtttctctatacccaactcgaactctacctgaataacaaagatgatcaaaagcgctccatattccaaaaaagtgagcggggtggcttccgactgaaagaaaatgtacaattccacctgtacatatccacttctccatgcggagacgccaggatcttctcacctcatgaacccatcttagaggggagccgcagctatacacaggcaggggtgcaatggtgtaatcacggcagtctgcaaccaagaccaccaggcctgctgtctgaccctagcacttcaacatttcagggagctggtactacagagccagctgataggcaccccaaccggaaagcaaggggacagctgagaaccaagattgaatctggggagggtacgatacctgtcaggagcaatgcatccatacagacttgggatggagtgttgcagggtgaacgtctccttaccatgagctgtagtgacaagattgctcgatggaatgtagttgggatacagggctccttgctgagcatctttgtggaaccaatctatttttcatctataattcttggctccctctaccacggagatcatctgtccagggcaatgtatcagcggataagtaatatcgaagacctgcctcctctctacactctgaacaaacccctcctcagtggcatctccaatgcagaagctagacagcccggaaaggcccctaatttttctgtcaactggactgtcggcgactcagcgattgaggtgataaatgcaacaactggcaaggacgagctggggagagcatctagactctgtaagcacgcattgtactgccgctgggcctgtgcgagacaaggctccctccccctgaccaccttacaggactaccaggctcagcgcgtgccttag

SEQ ID NO: 178240 - DNA, 426 bp, Artificial Sequence
  Description of Artificial Sequence: Synthetic coding sequence
atgagccaccggatggagggcgtgggccagctgcccgccagctacaggcataaccgacccttactctccggcgtgtctgacgctgaggcccgacaacccggtaaatctccaccgttcagcatgaattgggtcgttggatccgctgacctcgagattattaacgctaccaccgggcggcggtcctgtggcggcccgagccggttgtgcaaacacgtcttatcagcccgttgggcgaggctttacgggcgcctgtcaaccagaaccccttccccaggcgacacacctagtatgtattgtgaagccaagctgggggcccacacctatcaatccgtgaagcagcagctatttaaggcctttcaaaaagctggattgggcacctgggttcgcaagccccctgaacagcaacagtttctgcttactctgtag

SEQ ID NO: 178241 - DNA, 747 bp, Artificial Sequence
  Description of Artificial Sequence: Synthetic coding sequence
atgggcctgtggagccccgtgcccggcaacagcgtgccccgggcccctgtgatggccggcctcggactgggacattcccagggcgcaccccaagggccacatgacggtaaaactgaccggtcatccggacccggaaggagacgcactgagaggactcgactcccagggctgctcgggggcgctccactgacagccggtagtccacacaggtggaacgtgctgggattacagggcgccctgctctctcacttcgtggagcctgtgtatttacagtcaattgtggtgggctcgcttcaccacacaggacaccttgcgagagtcatgtcccaccggatggaaggagtcggccagctcccagctagctatcgacacaataggccgttactgtctggagtgagcgatgccgaagcgaggcaacctggaaaatcccccccattttctatgaattgggtggtggggagcgcggaccttgaaattatcaacgccactacaggccgccggagctgtggcggcccaagcaggctctgtaagcacgtgttaagcgcccgctgggcaagattgtatgggagactatcaacacggacaccttctcccggagacacaccctcaatgtactgtgaggcaaaacttggagctcacacctatcagagtgtgaagcaacaattgttcaaggcgtttcagaaagccggcctgggaacttgggtaagaaaaccaccagagcaacagcagttcctacttacactttag

SEQ ID NO: 178242 - DNA, 2220 bp, Artificial Sequence
  Description of Artificial Sequence: Synthetic coding sequence
atggccagcgtgctgggcagcggccggggcagcggcggcctgagcagtcaactcaaatgtaaatccaaacgcaggaggcgcaggagaagcaagcgaaaggacaaggtaagcatcctttcgaccttcctggcaccttttaagcacctgagcccaggaatcaccaacacagaggacgacgacacactgagtacctcatctgctgaagtaaaagaaaacaggaatgtgggcaacctggccgctagaccaccaccctctggtgaccgggcccgtgggggcgcccctggagccaagcgaaaacggccgctggaggagggcaatggcgggcacctctgtaaactccagctggtttggaagaaactgtcgtggagcgtggctcctaaaaacgctctcgtccagctccatgaacttcggccagggttgcagtatagaacggtttctcagaccggacccgtgcacgctccagtgtttgccgtggcagtggaagtaaacggattgacctttgaggggacaggccccacgaaaaagaaggcaaagatgagggcagccgaactggcactgcggagcttcgttcagtttcctaacgcctgtcaggctcacttggctatgggcggcgggcccggcccgggtacagattttaccagcgaccaggccgactttcctgatacactatttcaggaattcgagcctcctgcaccccggcccggtctagccgggggccgcccaggcgacgctgccctgctgtccgcagcctatggaagaaggcggctgctgtgccgggctctggacctggtcggtcctacccccgctactcctgccgcgcccggagaaaggaatcctgtggtgctcttaaataggttgcgcgccgggcttcgctatgtctgccttgccgaaccggccgaacgaagggcccggtcattcgttatggccgtgagcgtggacggccggacatttgaaggttctggcagaagtaaaaagttggcacgtggtcaggccgctcaggccgcactgcaggaacttttcgatatccagatgcccggccacgcgcctgggagggcccggaggacccccatgccacaggagtttgctgactcaattagtcaattggtgacccagaaatttcgcgaagtgactactgacctcactcccatgcacgcccgtcataaagcacttgcagggattgttatgaccaaaggcctggacgcacgacaggctcaagtcgtggcattgagcagcggaactaagtgcatttctggcgaacacctgagcgatcagggtctcgtagttaacgactgtcacgcagaagttgtggccagaagggcctttctgcatttcttgtacacacagctcgagctacacttgtctaagcgacgagaagactctgagagaagcatcttcgtacgactgaaggaggggggttaccgcctgcgggagaacatactattccacttgtacgtgtcgacatctccatgcggtgatgcccgtctccattccccgtatgagatcacaaccgatttacactcttccaagcacctcgttcggaagtttcggggccatctgcggacgaagatcgaatctggcgagggtaccgtgcccgttcgggggccttctgccgtgcaaacgtgggacggagtgttgctgggtgagcagttgatcaccatgtcttgcactgataagattgccaggtggaacgtattggggttgcaaggagccctgctgtcccacttcgttgagccagtctatttgcagtccatagtcgtgggttcattgcaccacacagggcacctggcaagagtgatgtcccaccggatggagggggtgggccagctccccgcaagctaccgtcacaaccgtcccttgttatccggagtcagcgacgcagaggcacgccaacctggcaagagccccccatttagcatgaactgggtagttggcagcgcggatctcgagataattaatgcaactactggccgccgaagttgtggagggccaagtcggctgtgcaaacatgttcttagtgctcgctgggctagattgtacgggcgattgtcaacacgcacaccttccccgggcgatacccccagcatgtactgtgaggcaaagcttggcgctcacacctaccaatcagtgaaacaacagttgtttaaggctttccaaaaagccggcttggggacctgggtccggaagccccccgagcagcagcaattcctgctcaccctttag

SEQ ID NO: 178243 - DNA, 1509 bp, Artificial Sequence
  Description of Artificial Sequence: Synthetic coding sequence
atgtggaccgccgacgagatcgcccagctgtgctacgagcactacggtatacgtctgccaaaaaaaggtaaaccagaacccaaccacgagtggaccctgcttgcagctgttgtgaagatccagtctccagctgacaaagcctgtgacacccccgataaacccgtccaggttacaaaggaggtggtctcaatggggacaggtacaaaatgtataggacaaagtaagatgcgaaaaaacggcgatatcctgaacgattcccacgctgaggtgatcgctcggcggtcttttcaaaggtatctcctgcatcagttgcaactcgcagcaactctcaaagaggattcaatcttcgtgcccggcactcagaagggcgtgtggaaactcagaagggatcttatctttgtattttttagcagtcataccccatgtggggacgccagcattattccaatgttagaattcgaggatcagccttgctgtcctgttttcagaaactgggctcataattcttcagtggaagcatcttcgaacctggaagcaccagggaatgagcggaagtgcgaggacccagactctcccgtgactaagaaaatgaggctcgaacctggaacggctgcccgggaagtaaccaatggggcggcccaccatcaaagtttcggaaaacagaaatcaggcccaatttctccagggattcattcgtgtgatctgactgtcgagggactcgcaacagtgacacgcatagcaccggggagcgctaaagtgatcgatgtgtatcgcaccggtgctaagtgtgtgcccggagaagccggggacagcggtaaaccaggagccgcatttcatcaggtgggacttctgcgggtcaagcctggccgaggggatcgaacacgctcaatgtcttgtagtgacaagatggctagatggaacgtgctggggtgtcagggtgcgctcctcatgcatctccttgaagagcctatttacctttctgccgtggtcatcggcaaatgtccttatagtcaggaagccatgcaacgcgctctgatcggacgctgccagaatgttagtgctctgccaaagggctttggggtacaggagctgaagatactgcagagtgaccttttgtttgaacagagccgcagtgccgtccaggccaagagagcggacagccccggccgtttggtgccatgcggcgccgccatctcctggtctgctgtccccgaacagcctctggatgtcacagcgaacggttttcctcagggcaccactaagaagaccattggatccctgcaggcaagatcacaaatttctaaagtagaactcttccgttcttttcagaaattactgagccgaatcgcacgggacaagtggccacactctttacgggtgcaaaaacttgatacttatcaggagtacaaggaagcagcctcttcctaccaggaggcatggagtacacttcgcaagcaggtgttcggctcatggattaggaacccccccgactaccatcagtttaagtag

SEQ ID NO: 178244 - DNA, 1422 bp, Artificial Sequence
  Description of Artificial Sequence: Synthetic coding sequence
atgtggaccctgctggccgccgtggtgaagatccagagccccgccgacaaggcgtgcgatacacccgacaaacccgtgcaggtgactaaagaggtcgtctcaatgggcaccggaactaagtgtattgggcagagcaagatgcgaaagaacggtgacattctcaacgattcccacgcggaggttatcgcccgccggagtttccagcgctacctgctccaccaactgcaactggcggcaaccctcaaagaagatagcattttcgtgcccgggacacagaaaggcgtatggaaattaagaagggatctcatatttgtcttctttagtagccacacaccttgtggggacgcctcaatcatccctatgcttgagtttgaagaccagccctgctgcccagtgtttcgtaattgggcccacaacagttctgttgaggcaagctccaacttagaggcaccagggaacgaacgcaagtgcgaggatcccgattcaccagtcacaaaaaaaatgaggttagagcccgggaccgccgcccgtgaagtcacaaacggggcagcccatcaccagtcattcggaaagcagaaaagcggccccatcagtccaggtatccactcatgcgatctgaccgtggaggggttagctacagtgacgcggattgctccagggtcagccaaagtgatcgacgtctatagaacaggcgctaagtgcgtgcctggggaggctggagattcgggcaaacccggagcggctttccatcaggttggcctgctgagagtcaaacccggcaggggggacaggactagatctatgagttgttcagacaaaatggcgcgttggaacgtcttgggctgccagggtgcactcctgatgcacctgctcgaagagccaatctacttgagtgctgtagtcatcggcaaatgcccctacagtcaggaggcaatgcaaagggctctcattggaagatgccagaatgtgtccgccctgccaaagggcttcggcgtgcaagaactgaaaatcctgcagagcgacctcctgttcgagcagagccgatccgcggtgcaggctaaaagggccgactctccaggccgcctggttccatgcggggcggcaattagctggtctgctgtgccagaacagccactagacgttactgcgaatggatttccacagggcaccaccaagaagaccattggctctctccaggcgcgctcccagatatctaaggttgaacttttccgctcatttcagaagctgctgtctaggatcgcccgagacaagtggcctcattccttgagggtgcagaaactggacacgtaccaagagtacaaagaggccgctagttcttaccaggaggcgtggtccacactccgcaagcaggtgttcggaagctggatcaggaatcctcccgactatcaccagttcaaatag

SEQ ID NO: 178245 - DNA, 1089 bp, Artificial Sequence
  Description of Artificial Sequence: Synthetic coding sequence
atggccgccgccgaggaggagcccaagcccaagaagctgaaggtggaggcaccccaggcattgagggaaaacatcctcttcggaatgggaaaccccttgctggatatctcggccgtggttgacaaagactttctggataaatattctctgaaacccaacgatcagatcttggccgaggacaagcacaaggagctcttcgatgaacttgtgaaaaaatttaaggtcgagtaccatgcgggcgggtccacccagaactcgattaaagtcgcccaatggatgatacagcaaccacacaaggctgctaccttttttggctgtattgggattgataagtttggcgaaatcctgaagcgaaaagcagccgaagctcacgttgacgcacattattatgaacagaatgagcagcctactggaacctgtgccgcatgtatcacgggagataaccgttccctgatagcaaaccttgcagctgccaattgctataaaaaagagaagcatcttgatctggaaaagaactggatgctggttgaaaaagcacgcgtgtgttatattgcaggtttcttcctaaccgttagtcccgagtcggtccttaaagtggcccaccacgcctctgaaaacaatcgtatatttaccctgaacctgtcagcacctttcataagtcagttctataaggagagccttatgaaggttatgccttatgtggacattctatttggcaacgaaacagaggctgccacgtttgctcgggagcaaggtttcgagacgaaggatattaaggagattgctaaaaagacacaagctttgccgaagatgaacagcaaaaggcagcggattgttattttcacacaggggcgggacgacaccattatggctaccgaaagcgaagtgactgcctttgccgtgctcgaccaggaccagaaagaaatcatagataccaacggcgctggtgacgccttcgtcggcgggtttctatcacagcttgtcagcgataagcctcttacagagtgtattagggctggacattatgcggccagtataatcatccggaggacaggctgcacattcccagagaaacccgattttcactag

SEQ ID NO: 178246 - DNA, 1038 bp, Artificial Sequence
  Description of Artificial Sequence: Synthetic coding sequence
atgaccagcgtgcgggagaacatcctgttcggcatgggcaaccccctactggacattagtgccgtggtggataaggatttcctggacaagtattctttaaagcctaacgatcagatattagctgaggataagcataaagagctgttcgacgagctagtgaagaagtttaaagtagagtatcatgcaggcggctctacacaaaactccatcaaagtggcccagtggatgattcaacagcctcataaggcagctacctttttcggatgcatcggaatcgacaagttcggagaaatcctgaaacggaaggccgcggaagcccatgttgatgcgcattactacgaacagaacgaacagcccactggaacgtgtgccgcctgtatcaccggtgataatcgtagcctgattgctaatctggccgctgctaattgttataagaaggagaaacatctggacctggagaagaactggatgttggtcgaaaaagccagagtgtgctatattgccggctttttcctaacggtgtccccagagagtgttctgaaggtggcacaccatgcctcagaaaacaatagaatttttacactgaatctttccgctccattcatctcacagttctataaagagtcattgatgaaggtcatgccctatgtggacattctgttcggaaatgagacggaggccgcgacattcgccagagaacaaggttttgaaacaaaggacatcaaggaaatcgccaagaagactcaggccttaccaaagatgaacagcaaacggcagaggatcgtgatttttactcaggggcgagacgacactatcatggcaaccgagtccgaggtgactgcctttgccgtgctcgatcaggatcagaaggagattattgatacgaatggggccggcgatgcctttgtcggcggctttctttcacagctggtgagcgacaaacctttgacagagtgcatcagggcgggtcattacgctgcatccatcatcattcgccgtactggttgcacttttcccgaaaagcctgactttcattag

SEQ ID NO: 178247 - DNA, 918 bp, Artificial Sequence
  Description of Artificial Sequence: Synthetic coding sequence
atggccgccgccgaggaggagcccaagcccaagaagctgaaggtggaggctccacaggccctccgagagaatatcttatttgggatggggaaccccctgttggacatttccgctgtcgtggacaaagactttctggataaatactctttaaagcccaatgatcaaatactcgccgaagacaagcacaaggagctcttcgacgagctggtgaagaagtttaaagtggagtatcacgctgggggaagcacacagaacagtatcaaagtggcccagtggatgatacaacagccacacaaggccgcaacattcttcggttgcatagggatcgacaagttcggggagattctaaagcgaaaagcagccgaagcccatgttgatgctcactactacgaacagaatgaacagcccaccggaacttgtgcagcctgcatcacaggagataaccgttcccttatcgcgaacttagccgctgcaaactgttacaagaaggaaaagcacctggatttagagaagaattggatgcttgtcgagaaggctcgggtgtgttatatcgcagaggcggcaacttttgcccgtgagcagggctttgagaccaaggacattaaggagattgcgaagaagacccaggcactgccgaaaatgaactctaagcgccaacggattgtgatcttcacacaaggccgggatgataccattatggccacggaatcggaagttacggccttcgccgtgttggaccaggaccagaaagagattatagacactaatggtgctggtgacgcctttgtgggaggtttcctgagtcaactcgtgtcagataagcctttaacagagtgtatcagagccggacattacgccgcctctatcatcatccgacgtacagggtgcacgttccctgagaagcccgactttcactag

SEQ ID NO: 178248 - DNA, 984 bp, Artificial Sequence
  Description of Artificial Sequence: Synthetic coding sequence
atgaccagcgtgcgggagaacatcctgttcggcatgggcaacccccttcttgacatcagcgctgttgtcgacaaagacttcttagataaatttgacgaactcgtcaagaagtttaaagtggaataccacgccggcggctcgacacagaattccataaaggtcgcgcagtggatgatccaacaaccacacaaagccgcaacttttttcgggtgcatcgggatcgacaaattcggagaaattttgaagagaaaggccgctgaggcccacgtagatgctcattactacgaacagaacgagcaaccaacagggacctgtgccgcctgcattacaggggacaatcgtagcctcattgccaatctggccgccgcgaattgttacaaaaaagaaaaacaccttgatttagagaagaattggatgctcgtggagaaggcccgcgtttgctatattgcagggttcttcctcaccgtgagtccggagtccgtgctcaaggtggcccaccacgcgtcagagaacaaccgaatcttcaccctcaacctgtccgccccgtttatcagccagttctacaaggagagcctgatgaaggtgatgccttatgtggacattctgtttggtaacgagacagaagccgcaacttttgcgagagagcaaggctttgagaccaaagatattaaggaaatcgccaaaaaaactcaggcactccctaagatgaatagtaaacgacaacgaatagtgatttttactcaggggcgggacgatacaattatggccacagagtctgaagtaactgcattcgccgtacttgatcaagaccagaaagaaattattgacacaaacggcgccggtgatgccttcgtgggggggttcttgagccaattggtttccgacaaaccgctgacagaatgtatacgagcaggccattacgcagcctccatcatcatccggcggaccggttgcacctttcctgagaaacccgattttcactag

SEQ ID NO: 178249 - DNA, 2244 bp, Artificial Sequence
  Description of Artificial Sequence: Synthetic coding sequence
atgcccctgttcaagctgcccgccgaggagaagcagatcgacgacgcaatgcggaatttcgctgaaaaggtttttgcgtctgaggtcaaggatgagggcggacggcaggagatatcgcctttcgacgtagacgaaatctgtccaattagccatcatgagatgcaagcacatatattccacctcgaaaccctcagcacctcgaccgaagcgagacgaaaaaagcgcttccagggtcgtaaaacggtaaatctatcgattcctctgagtgagacctcttccacaaagctctcccatatcgatgagtatatcagttcctcccctacttaccagactgtcccagattttcagcgcgtccaaatcaccggagactatgcaagcggcgtgaccgtggaagacttcgagattgtatgtaaaggtctttacagagctttgtgcatcagagagaaatatatgcaaaagtcatttcagagattcccaaagaccccgtccaagtacttaagaaacatcgatggagaagcctgggtggccaacgagagtttttatccagtgttcactcctcccgtgaaaaaaggagaggatccattcagaaccgataatttgcccgaaaacctcggctatcacctgaaaatgaaggacggtgttgtgtacgtctaccctaatgaggctgctgtcagcaaagatgagcccaagccgctgccctaccctaatctggacacattcctggatgacatgaactttcttttggcactgatagctcaagggcccgtgaaaacctatacccatcgcagattgaagttcctatcctcaaaattccaggttcaccagatgctgaacgaaatggatgaactcaaggaactcaagaacaatcctcatcgggacttttacaattgtaggaaagtagacacccacatccacgcagcagcttgtatgaaccagaagcaccttctgcgattcattaagaaaagttatcagattgacgcggatagggtggtgtactctacaaaggagaagaatctcactttgaaggaactgtttgccaaactcaaaatgcacccctacgatctgaccgtagacagtctggacgttcacgctggccgccagacattccaaaggttcgataagttcaacgacaaatacaaccccgtcggtgcgtccgagctgcgagacctgtacctcaagaccgataactacatcaatggcgagtacttcgccacaatcatcaaagaggtgggggcagacctcgtggaggctaagtaccagcatgccgagccaaggttatctatctacggccgcagccctgacgagtggtctaagttgtcatcatggttcgtgtgtaaccggatccactgtcccaacatgacgtggatgattcaagtgccccgtatttatgatgtgtttagatcaaagaacttcctcccccattttggcaagatgttggaaaacatcttcatgcctgtctttgaagcaaccataaatccccaggcggaccctgaactgtcagtgtttctgaagcatatcactggatttgattccgtggacgacgagagtaagcattctgggcacatgttctcctctaagtcccctaagccacaagaatggactcttgagaaaaatccctcctatacatattacgcttattatatgtatgccaatattatggtgctcaactcccttaggaaagaaaggggcatgaatacttttttgttcagaccccattgtggagaggctggcgcgttaacacacttgatgacggcctttatgattgctgatgacatcagccacggactcaatctcaagaaatctcctgtactgcaatacctgttctttctagctcagatcccaattgcgatgagccctctgtctaacaatagtctgtttctggagtacgcaaaaaacccattcctggacttcttgcaaaaaggcctgatgatctctcttagcacagacgaccctatgcagtttcacttcaccaaagagcctctgatggaggaatatgccatcgccgcacaggtgttcaaattgtcaacttgcgacatgtgtgaggtggctcggaattccgtgttacagtgtgggattagtcacgaagagaaggtgaaattccttggagataattacctcgaggaaggaccggctggcaatgacataagaagaactaacgtggcccagatacggatggcatatcgctacgagacttggtgctatgagctgaatctgattgccgagggcttgaagagtacggagtag

SEQ ID NO: 178250 - DNA, 2343 bp, Artificial Sequence
  Description of Artificial Sequence: Synthetic coding sequence
atgaacgtgcggatcttctacagcgtgagccagagcccccacagcctgctgtcactgttgttttactgcgctatcctcgagtctaggatctctgcgacgatgccactttttaagctgcccgccgaggaaaagcaaatcgacgatgcaatgcggaatttcgccgagaaagtgtttgcctcagaagtgaaggatgagggtgggcggcaggaaatctcacctttcgacgtggacgagatttgcccgatttcccaccatgagatgcaggcacatatcttccacctggaaacattatcaacaagcaccgaagctcgccggaagaagagatttcaaggcaggaagacagtgaacttaagcatcccactctccgagaccagcagtactaagctgtcgcacattgatgagtacatcagcagcagccctacgtatcagactgtgcccgattttcagcgggtgcagattacaggagactatgctagtggcgtgactgtggaagatttcgaaatcgtatgcaagggtttgtatagagctctgtgcatccgagagaaatacatgcaaaaatcttttcagcgcttccccaagacgccgagcaagtatctacgtaacattgatggagaggcctgggtggctaacgaatctttttacccagtgttcaccccccctgtgaagaagggtgaagatcctttcaggacagacaatctgccagagaacttaggctaccatctaaagatgaaggacggcgtagtgtacgtttatcccaacgaggccgcagtctcgaaggacgagcccaagcctctgccatacccaaatttggatacgttccttgacgacatgaatttcttattggcacttatcgcccaaggtcccgtgaagacctacacgcaccgtcggctgaaatttctgtcttccaagttccaggtccaccagatgttgaatgagatggacgagctgaaggagctaaagaacaaccctcaccgggatttctataattgtcgaaaagtggatacacatattcatgccgccgcttgtatgaatcagaagcacttacttcgcttcattaagaaatcctaccagattgacgctgatagggtggtgtactctaccaaggagaaaaacttgactctgaaagagctgtttgctaaactgaagatgcatccctacgacctcactgtcgattccctcgatgtgcacgccgggaggcaaacatttcagcgctttgacaagtttaacgataaatataacccggtcggcgcctcggaactgcgagacctgtatctgaagactgataattacattaatggcgagtacttcgctacaatcataaaagaggtcggcgccgacttggtcgaggctaagtatcagcacgccgaaccacggctgtctatatatggtcgctcacccgacgagtggtccaaactgagttcttggttcgtctgtaacagaatacactgtcccaatatgacatggatgatacaggtcccccgcatctacgatgtgtttcgtagtaagaattttctgccccactttgggaagatgctagagaacatttttatgccagtctttgaggccacaatcaacccacaggcagaccccgagctgagtgtatttctgaagcatatcactgggtttgattcggtcgatgacgagtcaaagcattcaggccatatgtttagtagtaagagcccaaaacctcaagaatggaccttggaaaagaacccttcctatacttactatgcctattatatgtacgcaaacattatggtcttgaactcactcaggaaagagcgggggatgaacacattccttttcagaccgcactgtggggaggctggggcactcactcacctgatgaccgccttcatgattgctgacgatattagtcatggattgaacctgaaaaagtcacctgtccttcagtatttgttctttctggcacagattcctattgcgatgtcaccactttctaataactctttatttctcgaatacgctaagaacccatttctggacttcctccaaaagggactgatgatcagcttatccaccgacgatcccatgcagttccacttcaccaaggagccactaatggaagaatatgccatagccgcccaggtctttaaactttccacctgtgacatgtgcgaagtggccaggaactcagtgttgcaatgcgggataagtcacgaagagaaggtgaagttcttaggtgacaattacttggaggaaggaccagccgggaacgatatccgcagaacaaatgtggcccagatccgaatggcatatcggtacgagacatggtgctatgagctgaatctgatcgccgaggggcttaaatcaactgagtag

SEQ ID NO: 178251 - DNA, 2331 bp, Artificial Sequence
  Description of Artificial Sequence: Synthetic coding sequence
atgaacgtgcggatcttctacagcgtgagccagagcccccacagcctcctgtcccttcttttctattgtgcaatcttggaaagccggattagtgctaccatgcctttgttcaagctgccagagattgatgacgcgatgcggaacttcgctgagaaggtctttgcatctgaggttaaagacgaaggcggccgccaggaaatttctccattcgacgtcgacgagatctgccctataagtcatcacgaaatgcaagctcatatctttcacctggaaacactgtctacgagtaccgaggcgcgacgcaagaagagattccagggacgcaagaccgtcaacttgtctatcccactatcggaaacatccagcacgaaactgtcacatatagacgaatatatttcaagctcgcctacctatcagactgtacccgatttccagagggttcagataacaggggattacgcctccggagtgacggtggaggactttgaaatagtatgcaaggggctctaccgggctctgtgcatacgcgagaaatacatgcaaaagtcttttcagaggtttcctaagaccccatctaagtacttgcgaaacatcgacggcgaagcatgggtggctaacgagtcattttatcccgtgtttacaccacctgttaagaagggcgaggacccttttcgcactgacaatctgcccgagaacctcgggtatcacctgaaaatgaaggacggcgtggtttacgtgtatcctaacgaagcagccgtctcaaaggatgaacctaaaccattgccataccctaaccttgacaccttcctagacgacatgaattttctcctggctctcatagcacaggggccagtcaagacctacacccacagaagactaaagtttttgtcctcgaaatttcaggtccatcagatgctgaatgagatggacgaactgaaggagctgaaaaataatccccatcgcgacttctacaactgcaggaaagtagatacgcatatccatgccgcagcttgtatgaatcagaagcatttactaaggttcattaaaaagtcataccaaatcgatgctgaccgggttgtgtactccacaaaagagaagaatctaacccttaaagagctgttcgcaaaactgaagatgcacccgtacgatctaaccgtagactctctggatgtccatgccggtcgccagaccttccagaggtttgacaagttcaatgacaaatataatccagtgggggccagcgaactgagggacctgtaccttaaaactgataattatattaacggagagtacttcgccacaattatcaaggaagtgggggccgatctcgttgaagccaaataccagcatgccgaaccccgtctgagcatttatggtcgatcgcccgatgaatggtctaagctttcgagctggttcgtctgcaatcgcattcactgccctaatatgacttggatgattcaagtccctagaatatacgacgtgttccgaagtaaaaattttctgccccatttcggtaagatgctggaaaacattttcatgcccgtgttcgaggcaacaattaacccacaggccgacccggaactatccgttttcctgaaacatatcacaggattcgattccgtagacgatgaaagcaaacattctggccacatgttcagcagcaagagccctaagccccaggaatggactcttgaaaagaatccctcttacacatactacgcatactatatgtacgcaaatatcatggtgctcaatagcctcagaaaggagaggggcatgaacactttcctgttcagaccgcattgcggtgaggctggcgctttgactcatcttatgacagcctttatgatagcagacgacatttcccacggcttgaacctcaagaagtccccagtgctgcagtacctgttctttctggcccaaatcccaatcgccatgtctcctctgtcaaataatagtcttttcctggagtatgcgaaaaatccgtttttagatttccttcagaaagggctaatgatcagcctgtctacagacgatccgatgcagtttcatttcaccaaggagcccttgatggaggagtacgcgattgcggctcaggtgttcaagctttccacatgcgacatgtgcgaagtggcaaggaactccgttcttcagtgtgggatctctcacgaagaaaaagtaaaatttctgggagataattacttagaggagggccccgccgggaacgatataaggcggaccaatgtagcccagatccgcatggcctatcggtatgaaacctggtgctatgagctgaatctaatcgccgagggcttaaaaagcaccgagtag

SEQ ID NO: 178252 - DNA, 2640 bp, Artificial Sequence
  Description of Artificial Sequence: Synthetic coding sequence
atgcggaaccggggccagggcctgttccggctgcggagccggtgcttcctgcaccaatccctgcctctgggcgccggtagaagaaaaggactggacgtagccgagccagggccctctaggtgccgctccgattcccctgctgtagcagcagtggtgcccgccatggctagctatcccagcggaagcggtaagcctaaggcaaagtatccattcaagaagagagcctcgctgcaggcatccaccgcagctcccgaagctaggggaggtctcggagccccacctctgcagtccgcacgaagccttcctgggcctgcaccttgtttaaagcatttccccttggacttgcggacgagtatggatggaaagtgtaaggaaatcgccgaagaattattcaccaggtctctggccgagagtgaactgcgttctgcaccctatgagttcccagaggagtctcctatcgaacagttggaggagagaagacaacggctggagcgccagataagccaggatgtcaaactggaacctgatattttacttcgggccaagcaggattttttaaagacggacagcgactctgatctgcagctctacaaagagcagggggagggccaaggtgaccggtccctcagggagagggacgtactggagcgagagtttcagcgcgtgaccatctccggcgaagagaaatgcggggtgccttttacagatctgctcgatgcagcgaagagcgttgtcagggctctgtttatccgggaaaagtacatggcccttagtctgcaatcattctgtcctacaacgaggaggtatttgcaacaattggctgaaaagccattagagacaagaacatatgaacagggaccagacactcccgtttctgcggatgctcctgttcatcctcctgctctggagcagcacccgtacgaacattgcgagccctctacaatgcctggtgatttgggcctgggcctgcgaatggtccgtggagtagtgcacgtttacacccgccgggaacctgatgagcactgctctgaggtcgaactgccatacccggaccttcaagagttcgtagcagacgtaaatgtcctcatggcgcttatcatcaacgggcccattaagtcgttctgttacagacggcttcagtacctatcctcgaagtttcagatgcacgtgctgctgaacgagatgaaggaactggccgctcagaaaaaagtgccccatcgggacttctataatatcagaaaagtggacacccatatacatgcttccagctgcatgaatcagaagcaccttctgcgtttcatcaagcgcgccatgaagcgacacctggaggagattgtccatgtggaacagggcagagaacagaccctacgggaggtgttcgaatctatgaacctgactgcttatgacttgagtgtcgatacgctggacgtgcacgccgatagaaacacatttcatcggttcgacaagttcaatgccaagtacaacccaattggcgaatcagtgctgagagagattttcataaaaactgataatcgagtgagtggaaagtatttcgctcatataatcaaggaggtgatgtcggacctggaagaatccaaataccagaatgcggagcttagactgtcaatctacggaaggtccagggacgaatgggataaactcgcacggtgggccgtgatgcatcgagtccattcgcccaacgtccggtggttggtccaggtccccaggctgtttgacgtctacaggaccaaagggcagttagctaactttcaggaaatgctcgagaacatattcctgccattgtttgaggccaccgtccatccagcgagtcaccctgagctgcacctttttctggagcacgtagacggctttgattctgtggacgatgaaagcaagcccgagaaccacgttttcaatctggagtctccactcccagaagcgtgggtggaggaagataaccccccatatgcttattacctttattacacgtttgcaaatatggcaatgctgaaccatcttagacgccagcgaggcttccacacattcgtgctgcggccgcactgtggcgaagcaggacccatacaccacctcgttagcgcgttcatgctggccgaaaatattagccacgggctcctgctcagaaaagctcctgtgcttcagtacctttactacctcgcacagatcggcatagcgatgtcccctctgtccaacaattcactttttctgtcctaccaccgcaatccactgccggagtatctctctagggggttaatggtaagtctaagtacagatgatcctcttcagttccatttcaccaaagaacctttaatggaagaatatagcatcgcgacccaggtgtggaagctttccagctgtgacatgtgtgagttagcaagaaatagcgtgttaatgagtggattttcccataaggtgaagtcccattggctagggcccaactacactaaagaaggcccggagggcaacgacatacggaggacaaatgtccctgatatcagggttggctaccggtatgagaccctctgccaagaattggccctgattacacaagccgtgcaatcggagatgctggagaccatccctgaggaagcagggatcactatgagcccaggcccccagtag

SEQ ID NO: 178253 - DNA, 2397 bp, Artificial Sequence
  Description of Artificial Sequence: Synthetic coding sequence
atggccagcgaggcccggggcggcctgggcgccccccccctgcagagtgctcgaagcctaccaggtcctgcaccttgcttgaaacacttccccttggacctaagaacttctatggatggaaaatgtaaagagatcgcggaggagctgtttacacgatcactggccgagagtgagctgaggtccgccccatacgagtttcccgaagaatcgcccattgaacagctggaagagagaaggcagcgcctggaacgccaaatctcacaggatgttaaactagaacctgacattctgctcagggcaaagcaggacttcctaaaaaccgacagtgactccgacttgcagctgtacaaagaacagggcgagggacagggggatagaagtctgagagaacgtgacgtcctggaaagggagttccaaagagtgaccatctccggggaagagaagtgtggcgtgccattcacagatctgctggatgctgcaaagagtgtggtgcgagccctgtttattagggagaaatacatggccctgtccctgcagagtttctgccctaccacccgtagatacctgcagcagctggccgaaaaaccactggagacaagaacgtacgagcaggggcctgacacgcctgtcagcgccgatgctcccgttcacccgcccgccctggagcagcacccttatgagcactgtgagcccagcacaatgcctggcgatcttggccttggtctcagaatggttcggggcgttgtccatgtgtacacgagacgcgaacccgacgaacattgtagtgaagtagagcttccatatccagatctccaggaattcgtagccgatgtgaatgttcttatggcactcatcattaacgggcccattaagagcttttgctacagaagactgcagtacctctctagcaaattccagatgcatgtcctgctgaacgagatgaaagaactggctgctcagaagaaagtgccccatcgagatttttataacatacgtaaagtggatacccatattcatgcatcttcttgcatgaaccagaagcacctgctccgctttataaagagagccatgaagcgccatctcgaggaaattgtacacgtagagcagggcagagagcaaacattgagagaggtgtttgagagtatgaatttgactgcatatgaccttagcgtggatactcttgacgtccatgctgacagaaatacttttcatcggttcgataaatttaatgccaaatataaccctataggagagtctgttttacgcgaaattttcattaagaccgataaccgggtgagtggcaagtatttcgctcacattataaaggaagtaatgtccgacttggaggaatctaagtaccaaaacgcagagctgaggctgtcaatctatggaaggtcccgggacgagtgggacaagcttgctaggtgggccgtcatgcatagggtgcatagtccgaacgtgcggtggctggtccaagtccccaggctctttgacgtctatcgcaccaagggacagttagccaactttcaggagatgctcgagaacattttccttcccctgtttgaagctactgtccatccagcaagccatcctgagcttcacctgtttctcgaacatgtggatgggtttgacagcgtggatgatgagagcaagcccgaaaaccacgtattcaatctggagtcccccctccccgaagcatgggttgaagaagacaacccaccttacgcctactacctctattacacttttgccaacatggcaatgctgaaccacttaagacggcaaaggggattccatactttcgttctacgtccacattgcggggaggcaggtcccattcatcacctggtgtctgcctttatgctcgccgaaaatatcagtcatggccttctgctacgcaaggctcctgtgctccaatatttgtattacctggctcagatcggaatagccatgtcccccctcagcaacaattccctattcttgagttaccaccggaatccacttcccgagtatctgagcagaggactcatggtctccctctcaaccgatgatccattacagtttcatttcaccaaagagcctcttatggaagagtacagcatcgccacacaagtgtggaaactcagtagctgtgatatgtgtgagttagcccgtaactccgtcctcatgagcgggtttagccacaaggtgaaatcccactggctcggcccgaattacactaaggaaggacctgaaggaaatgacatcagacgcactaacgtgcccgacatcagagtaggctatcggtatgagacactgtgtcaggaactcgctctgattacccaggctgtccaaagtgaaatgctggaaaccattcccgaagaagcagggatcacgatgtcccctggcccccagtag

SEQ ID NO: 178254 - DNA, 2415 bp, Artificial Sequence
  Description of Artificial Sequence: Synthetic coding sequence
atgtggcagagccaggcccccgccggcgccgcccagaccccccccctgtctccaccctggtcccaaccatggcaccccatccatctcgctctggcctcaccacgaccaaacatcccactgcggtcaggtccagcatgccgccctcccctgcagctgcaggaactattcacaagaagcctggccgaaagcgaactccgatccgctccatacgaatttcctgaagagagtccgatcgagcaactggaagagaggaggcagagactcgaacggcagatatcgcaggatgtaaagctcgagcctgacattttgctaagagcgaagcaagactttttgaagacagatagcgacagcgatctgcagctgtataaggagcagggggaaggacagggtgaccgatccctcagagaacgcgacgtgttagaacgtgaattccaaagagtgacaattagcggggaggaaaaatgcggggtgcctttcacagatctcctagatgcggctaagagtgtggtgcgcgccctgtttatccgcgaaaagtatatggctctgtctcttcagagcttctgtccaacgacccgccgctacctgcagcaacttgccgagaagcctctggagaccaggacgtatgaacaggggcctgatacccccgtgagcgccgacgctcctgtgcatccacctgcactggaacagcatccatacgagcactgcgagccatctactatgcccggtgaccttgggctgggccttcgcatggttcggggcgtcgtgcatgtgtacacgaggagagaacccgatgagcactgcagtgaagttgagctcccatacccagatctgcaggaattcgtggcggacgtgaatgtgcttatggctcttatcatcaacggacccataaaatcattttgttatcggagactgcaatatttgagttcaaagttccagatgcatgtgctcctgaatgaaatgaaagaactggcggcccaaaaaaaagtgccccacagggatttctataacataaggaaggttgacactcatattcatgcgtccagctgtatgaatcagaagcatcttctccggtttatcaagagggccatgaaacgtcacttagaggaaattgtgcacgtagagcagggcagagagcagaccctcagggaggtctttgagagcatgaacctaactgcctacgacctaagcgtcgatactttggacgtgcacgccgataggaataccttccacagattcgataaattcaacgcaaagtataatcccatcggcgagagcgtgctgagggagatattcattaagactgacaatagggtgtctggtaagtacttcgctcacatcataaaagaagtgatgagcgacttggaggaaagcaagtatcagaatgccgaattacgactgagcatttatggaaggtctcgagatgagtgggacaaactagctcgctgggctgtgatgcatagggtccactcccctaacgtcagatggctcgtgcaggtgcctagactttttgatgtgtaccgcacgaagggtcagttagctaacttccaggaaatgttggaaaacatctttctacctctgtttgaggctacggtgcatcccgcatcacaccccgaactccatctgttcttagagcatgtcgacggctttgactctgtggacgacgaatctaaacccgagaaccatgtgttcaacttagaaagccctctgccggaagcgtgggttgaagaagacaacccgccctacgcctactacctgtactacacatttgccaatatggccatgctgaaccatctccggcgtcagcgcgggttccatacttttgttcttaggcctcactgcggggaggccgggcccatccatcatctggtgagcgcttttatgctcgccgaaaacatttctcatgggctgttattgaggaaggctccggtcttacaatacttatattatctcgcccaaattgggattgccatgtcacctctgtccaacaacagtttgtttctgtcctatcataggaacccacttcccgagtacctcagcagaggcctcatggtcagcctgagcaccgacgacccactccagtttcatttcactaaggagccactgatggaggaatattctatagctacccaggtgtggaagctctccagttgtgacatgtgtgaactggcgcggaactccgtcctgatgtctggcttcagtcataaggttaaatcccactggctgggcccgaattatacaaaggagggccccgaaggcaatgatatccggaggacaaatgttccagatattagagtcggttaccgctatgagacactgtgtcaagaattggcgctgatcacccaggctgtgcaatcagaaatgttggaaaccattccggaggaggccgggattactatgtctcctggtccacagtag

SEQ ID NO: 178255 - DNA, 2283 bp, Artificial Sequence
  Description of Artificial Sequence: Synthetic coding sequence
atgctgaccttcctgcccagcccccaggagctgttcacccggagccttgcagagtcagaacttaggagtgcaccttacgagtttcccgaagagagtcccattgaacagctggaagagcgcagacagcggctggagagacagatctctcaagatgtaaagctagagccagacattctgcttcgggccaagcaggatttcctgaaaactgacagcgactccgacctacagctgtataaagaacaaggggaaggtcagggcgaccgctcacttcgcgagcgcgatgtgctggaaagggagtttcaaagagtgacgatcagcggtgaggagaaatgcggtgtgccattcacagatctgctggatgctgctaaaagtgtggtacgagcactgtttatccgagaaaagtatatggctctttccctgcagagtttctgccctacgacccggcgctacctgcagcagctcgctgaaaagcccttggagacacgcacctacgaacaggggccagatactcccgtctctgctgacgcccctgtgcatccccccgcgctggaacaacacccatatgagcactgcgaaccctccacaatgcctggggatttggggctcggcctccggatggtgaggggcgttgtgcacgtttatacgaggcgcgaacctgacgaacactgttcagaagtggagcttccttatccggatttgcaggaattcgtggctgacgtgaatgtcctgatggcccttattataaatggaccaatcaagagtttctgctatcggcgtctccagtatctctcttccaagttccaaatgcatgtcctactgaatgagatgaaggaactcgccgcgcagaagaaagtcccacatcgcgacttttataatatcaggaaggttgatacccacatacacgccagctcttgtatgaatcagaagcacctcctgcgcttcataaaacgggctatgaaaaggcacctggaggaaatcgttcatgtggagcagggcagggagcagacattgagggaggtgtttgagtctatgaatctgactgcctacgatctgtccgtcgacaccctcgatgtccacgctgatcgtaacacatttcatcgctttgacaaattcaatgccaagtacaaccccatcggcgagtcggtgctgcgcgagatctttatcaagacagataaccgtgtgtcaggcaaatactttgctcatattataaaagaggtaatgtctgacctggaagagtcaaaatatcagaatgcggagctcagactgtctatttacgggaggtcccgtgatgagtgggacaaattggcccggtgggctgtgatgcaccgcgttcattccccgaacgtccgatggctggtgcaagtgcctcgactgtttgacgtgtaccggaccaagggacaactcgccaacttccaggagatgctggagaatatcttcctaccactgttcgaggcaaccgtgcaccctgcatcccaccccgaactccacctgttcctggaacatgtggacgggtttgacagtgttgatgacgagtctaagcctgaaaatcatgttttcaacttggagtctccactcccagaagcttgggttgaggaggacaatcccccgtatgcgtattacctctactacaccttcgcaaacatggcaatgttgaaccatcttcggcgacaaaggggctttcacacatttgtcctgcgcccacattgcggggaggccgggcctattcaccaccttgtgtcagcctttatgctggctgagaatattagccatggattactgctacggaaagccccagtcctccagtatctttattacctggcccagatcggaatcgctatgagccccctgtcaaacaactccctctttctgagctaccatcgaaatcctctgccggagtatctttctagaggcctgatggtgtctctctccacggatgaccccctgcagtttcacttcactaaggaacctttgatggaggagtatagtattgctactcaggtatggaaactctcgtcatgcgacatgtgcgagctagcccgaaattctgtgctgatgtcgggcttcagccacaaggtgaaatctcactggctcggacccaattacacaaaggagggacctgagggcaatgacatcaggcgtacaaatgtccccgacataagagtcgggtaccgctatgagactctgtgccaggagcttgctctcatcacacaagccgttcagtcagagatgctcgaaacgattcctgaggaggccggcatcaccatgtcccctggaccccagtag

SEQ ID NO: 178256 - DNA, 6 bp, Artificial Sequence
  Description of Artificial Sequence: Synthetic coding sequence
atgtag

SEQ ID NO: 178257 - DNA, 2640 bp, Artificial Sequence
  Description of Artificial Sequence: Synthetic coding sequence
atgcggaaccggggccagggcctgttccggctgcggagccggtgctttttgcaccagagcctgcccctgggcgccggtaggcgtaagggcctggacgtggcagaacctggtcctagcaggtgcagatctgatagccccgccgtggctgctgtggtgcccgcgatggcctcttacccaagtggctccgggaaacctaaagccaaatacccctttaagaagagagccagcttacaggcctctacagctgctcctgaagcaagggggggccttggagctccccccctgcagtccgcccgctcattgccgggcccagccccttgccttaagcatttcccacttgacctacgaacaagtatggacgggaagtgcaaagagattgcggaggaactgttcaccaggagtctggccgagtctgaattacgtagcgcgccgtacgagtttccagaggaatcacctattgaacagctggaagaaaggcgccagcgtcttgaacgacagatttctcaggacgtgaagctggagcctgatatccttctacgagctaagcaagactttcttaagacagatagtgactctgacttacagttatacaaagagcaaggcgagggccagggagacaggtccctgagggagagggatgttctggagcgcgagttccagcgggtcaccatttcaggtgaggagaagtgtggagtcccattcacggacctgctagatgcagccaaaagcgtcgtcagagccctattcataagagagaagtatatggctctgagtctgcagagcttctgccctactacaaggaggtacctgcagcagctggcagagaagccgctggaaacccgaacctatgaacagggtcctgatactcctgtttccgccgacgctcccgtgcatcctcccgcgctggaacagcatccctacgaacactgtgaaccttctactatgcctggcgatctgggattgggcctaaggatggtacggggcgtggtgcacgtgtatacccgcagagaacccgacgagcactgctcagaggtggagctgccctatcctgatctacaagagtttgtggccgatgtaaatgtgctgatggctctcatcatcaacgggcctatcaagtcattctgttatcggcggttgcagtatttgagtagcaagtttcagatgcatgtgctcttgaacgaaatgaaagaactggccgcccagaaaaaggttccccatagggacttttataatatccgaaaagtggacacgcatattcatgcctcctcttgcatgaaccaaaaacaccttctccggttcatcaagcgcgcgatgaagagacatttagaggagatcgtccacgttgagcaggggagagaacaaacccttcgggaggtatttgagagcatgaatctgacagcatacgatctgagcgttgataccctggatgtacacgcggatcgcaataccttccacagattcgacaaattcaacgccaaatacaatccaattggcgaatcggtgctcagggagatttttattaagactgacaaccgtgtctccggaaagtacttcgcccacataatcaaggaagtgatgtccgaccttgaagaatcaaaataccaaaatgctgaattacgattgagtatttatggtagatcgagagatgaatgggataagttggcccgatgggctgtcatgcatagagtacatagcccaaacgtgagatggctggttcaggtgcctcgcctgttcgatgtctataggacgaaaggacagctggccaatttccaagagatgcttgagaatattttcctccccttgttcgaggcgacagtacaccctgctagtcaccccgagttacatctgtttctggagcatgtggatgggttcgattcagttgacgacgagagtaagccagagaatcacgtctttaatctggaaagtcccttgcccgaggcatgggtggaagaggacaacccaccctatgcttattacttgtattatacctttgctaatatggcaatgttgaaccatttacgcagacagaggggctttcatacctttgttttacggccccactgtggcgaagcaggaccaattcaccacctggtttcagctttcatgctcgccgaaaatatctcacacggcctactgcttcgtaaggctccagtgcttcaatacctgtactatctggctcaaatcgggatagcgatgtcccctctgtctaataatagccttttcttgtcctatcataggaaccccttgcccgagtatttgtcaagaggattaatggtaagcctgtctacagacgatccactgcagtttcatttcaccaaagaacctttgatggaggagtactccatcgccacgcaggtatggaagttaagctcttgtgacatgtgcgaactagcgagaaattctgttttaatgagcggttttagtcacaaggtgaaaagccactggttgggccccaattataccaaagaaggccccgaagggaatgacatacgcaggacaaatgtgcctgatatccgggtcggctacagatatgagacactgtgccaagagcttgctttgatcacccaggcagtccagagcgaaatgctggaaacaattcctgaggaggccgggatcacaatgtctcccggaccacaatag

SEQ ID NO: 178258 - DNA, 312 bp, Artificial Sequence
  Description of Artificial Sequence: Synthetic coding sequence
atggccagcgaggcccggggcggcctgggcgccccccccctgcagagcgctcgcagcctccccggacctgccccgtgtcttaagcatttccccttggatctgagaacaagcatggacggtaaatgcaaggaaattgctgaggagctgttcacgcggagcctggcagaatctgagctgcgctccgccccctacgagtttccagaagaatcaccaattgagcagctggaggagcgacggcagagactggaacgccagatttcccaagacgtgaagctggagcctgacattcttttacgcgcaaaacaggactag

SEQ ID NO: 178259 - DNA, 2304 bp, Artificial Sequence
  Description of Artificial Sequence: Synthetic coding sequence
atgccccggcagttccccaagctgaacatcagcgaggtggacgagcaggtgcgcctgttggccgagaaggtgtttgcaaaggtgctacgcgaagaagactctaaggacgcccttagcctgtttaccgttccagaagactgccctatcggacagaaggaggccaaagaacgagagctgcagaaggaacttgcagagcagaagtccgtggagactgccaaacgcaaaaaatcatttaagatgattagaagtcagtccctgtcccttcagatgccacctcagcaggattggaaggggcccccggccgcctcgccagctatgtctcccaccacacccgtggtaaccggggcaacctcattaccaacacctgctccttatgcaatgcctgagttccagcgagtaaccatatccggcgactattgcgctggtatcacactcgaagactacgaacaggccgccaagagtctggccaaagcgctgatgatccgggagaagtacgccaggctagcatatcaccggttcccccgaatcacgtcacagtacctgggccatcccagggcagacacagcccccccagaagagggcttgcccgacttccacccgccacccctgccccaggaagacccatattgccttgatgatgccccccctaatttggattacctggtgcatatgcagggagggatcctctttgtgtacgacaacaaaaagatgctggaacaccaggagccccactctctcccctaccccgatctcgagacatacaccgttgacatgagccacatcctggctctgataaccgacgggcctacgaaaacatactgtcacagacgcctgaatttcctagaatcaaagttcagtctccacgagatgctgaacgaaatgtctgaatttaaggagctgaagtctaatccgcacagggacttttacaatgtccgaaaagtcgatactcatattcatgctgctgcttgcatgaaccagaaacatctccttaggtttattaagcacacctaccagacggagcccgatcgtaccgtcgctgaaaaaagaggcaggaaaatcacactgcgccaggtgttcgacggactccacatggacccttacgaccttacagttgacagcctggacgtgcacgccggccggcagacatttcaccggtttgacaaattcaattctaaatacaatccagttggagcctcggagctgcgcgatctgtatttgaagacggaaaactatctcggcggcgagtacttcgcgaggatggtgaaggaagtggctagggagctcgaagaaagtaagtaccagtacagcgagcccaggctgtcaatttatgggaggtccccagaggagtggccgaatctggcctactggttcatccaacataaagtgtattctcctaacatgcgttggataattcaagtgcctaggatttacgacattttcagaagtaaaaagctcctccccaattttggaaaaatgctcgagaacatttttctgcccctgttcaaggccacaatcaaccctcaggaccatcgagagttgcatctgtttttgaaatatgtgacgggatttgattccgtggatgatgagtccaagcactctgaccatatgttctccgacaagagtcctaacccagacgtgtggacgagcgagcaaaatccgccatattcctactatctgtattatatgtacgctaacatcatggtgttgaacaatctgagaagagagaggggcctatccactttcctttttcgccctcattgcggcgaggccgggtccataacacatctcgtcagcgcttttctcaccgccgacaatatttcacatggcctgctgctgaagaagagcccagtgctgcagtatctgtactacctggctcagatccccattgctatgtcccctttgtcaaacaacagcttgttcctggaatactccaaaaatcccttaagagagtttcttcataaaggcctgcacgtttctctgagtaccgacgaccccatgcagtttcactatacaaaagaggccctaatggaggaatacgccatcgcggctcaggtgtggaagttgagtacgtgtgacctgtgcgaaatagccaggaactctgtactgcagtcaggactgagccaccaggaaaaacagaagttcctgggccaaaactattacaaggagggccccgagggcaatgatatcaggaagacgaatgtggctcagattagaatggcctttagatatgagacgctgtgcaatgaactgagctttctttcagacgctatgaaatctgaagagataacagccctcacaaattag

SEQ ID NO: 178260 - DNA, 2331 bp, Artificial Sequence
  Description of Artificial Sequence: Synthetic coding sequence
atggccctgagcagcgagcccgccgagatgccccggcagttccccaagctcaatatcagcgaagtggatgagcaggtgcgtctcctcgccgaaaaagtgttcgccaaggtcctgcgggaggaagactctaaggacgccctgagtcttttcacagttcccgaagactgtccaatagggcagaaagaagctaaggagcgcgagttacagaaagaactggccgagcagaagagcgtggagaccgcgaaacgaaagaagagctttaagatgattcggtctcagagcttgtccctgcaaatgcccccacagcaggactggaaaggtcctccagccgcgagtccagccatgagtccaacgacaccagtagtcactggggcgaccagtctgccgactcccgctccatatgcaatgccagaatttcagagagttacaatttccggcgattactgcgctggaataacgctggaagactacgagcaggctgccaagtctttggccaaagcattgatgatccgtgagaaatacgccagacttgcctaccatcgattccctaggatcacaagtcagtacctaggccatccccgggcagatactgcacctcctgaggagggcttgcccgacttccatccacctcccctccctcaggaggatccctactgtcttgatgatgctcccccaaatctggactacctggtacacatgcaaggcgggatcttgttcgtatacgataataaaaaaatgcttgaacatcaggagccccactccctgccctatcctgatctggagacgtacaccgtggatatgagccatatcctggcactgatcacagacggcccaacaaaaacctattgtcaccgcaggctgaatttcctggagtctaaattcagcctacatgagatgctcaatgagatgagtgaattcaaggaattaaagagtaatcctcaccgggatttttacaacgtcaggaaagtggacacacacatccatgctgccgcctgcatgaaccagaaacatcttttgagatttatcaagcatacttatcagaccgagccagatcgcactgtcgctgagaaaagggggcgaaaaatcacgttgaggcaggtgtttgatggactgcacatggacccttacgatctgacagtggactcgttggacgttcatgctggccgacagacctttcaccggtttgacaaattcaactctaaatataaccctgttggagccagcgagttgcgtgatctgtacttgaaaaccgagaattatctaggaggtgaatatttcgctcgcatggtgaaggaagtggcacgggaactggaggagtcaaagtatcagtattctgagcccaggctttcaatttacggccgttccccagaagaatggcccaacctcgcgtactggttcatccagcacaaggtgtacagccccaatatgaggtggattatccaggtacccagaatctatgacatattccgttcaaaaaagctactgcctaacttcggaaagatgctggaaaacatcttcttaccattgttcaaggctaccatcaatccccaggaccacagggagctgcacctgtttctgaagtacgttaccgggttcgacagcgtggatgacgagagcaagcacagtgaccacatgttttctgataaaagccccaacccagatgtctggactagtgagcaaaaccccccttactcgtattacctgtactacatgtatgctaacatcatggtgctaaataacttacgccgcgagagagggttgagtacctttttattccggcctcactgtggcgaagcgggctccatcacccacttagtgagtgcctttttaaccgccgacaatatctctcacggcctgttactcaagaagagccccgtcttacagtacttgtactatttggctcagattcccattgccatgtctccactcagtaataattcgctgttcctggagtattccaaaaatcccctgagggaattcttgcataaaggtctccacgttagccttagcaccgatgatcctatgcagttccactacactaaggaagctctgatggaagagtacgcgattgcggcccaagtgtggaagcttagcacttgcgatctctgtgaaatagctaggaacagcgttctgcagagtggtctgtcgcatcaggagaagcaaaaatttctcggtcagaattattataaggaaggtcctgaggggaacgacatcaggaaaaccaacgtggcccagatcaggatggccttccgctacgagaccctgtgtaatgaacttagctttttgtccgacgccatgaagtctgaggaaataaccgctcttaccaactag

SEQ ID NO: 178261 - DNA, 1827 bp, Artificial Sequence
  Description of Artificial Sequence: Synthetic coding sequence
atgatccgggagaagtacgcccggctggcctaccaccggttcccccgcattacaagccagtacctggggcatccgcgagcggataccgcaccacctgaagaaggcttgcctgattttcaccctccacccctgcctcaagaggacccatattgtctagacgacgcccccccaaacctggattaccttgtccacatgcagggtgggatcctctttgtctacgacaacaaaaagatgttggagcatcaggaaccacactccctgccctaccctgatctggaaacttacacagttgatatgagtcacatcctcgccctgattacggatggcccgacaaaaacttactgtcatcgccgtctaaacttccttgaatccaagtttagcttgcacgaaatgctgaatgaaatgtctgaattcaaagaactgaagtccaatccacaccgagatttctacaacgtgagaaaagtagatactcatatccacgccgccgcatgtatgaatcagaaacacctcctgcggttcataaaacacacctaccagactgagcccgatcggaccgttgcagaaaaacgggggagaaaaatcacactacgccaggttttcgatggactgcatatggacccttatgatctgactgtggactccctggatgtccatgcgggccgccagaccttccaccgctttgataagtttaatagcaaatacaaccccgtcggggccagcgagcttagagacttatatctgaagacagagaattatctgggcggcgaatactttgctcggatggttaaagaggtggccagggaactggaggaatctaagtaccagtattctgaaccacggctcagcatctacgggagaagtccagaggaatggcccaacctggcctactggtttatccagcacaaagtgtattccccaaacatgcggtggataatccaagtgccccggatctacgatatatttcggtccaagaaactgttacctaattttggcaagatgctggagaacatctttcttcccctcttcaaggcaacaattaatccccaagaccacagagaactccatctctttctcaagtacgtcacaggcttcgacagtgtggacgacgaatctaagcattccgaccacatgttcagcgataaaagccccaaccccgatgtgtggaccagcgagcaaaaccccccttactcttactatctttactatatgtacgcgaatatcatggtcctcaacaatttgcggagggaaagagggctcagtacgttcctgtttcgcccccactgcggagaggcaggaagcataacacatcttgtgtctgcctttcttacagccgacaatatcagtcacggactgcttctcaaaaagagcccagtgttgcagtacctttactacttagcccagattcccatcgctatgtcaccccttagtaacaatagcctgtttctggaatattctaaaaaccccctgagggagtttctccacaagggactgcacgtctctttgtccactgacgaccctatgcagttccattacacaaaagaagcgctgatggaggaatacgccattgctgcccaggtatggaagctgagcacgtgcgacctgtgtgagatcgctagaaatagcgtcttacagtccggcctgtcccaccaagagaaacagaaatttctaggtcagaattactacaaagagggaccagagggcaatgacatcagaaaaaccaacgtcgcccagatccggatggcattccggtacgaaactctgtgtaacgagctcagcttcctcagcgatgccatgaagagtgaggagattaccgccctaacaaattag

SEQ ID NO: 178262 - DNA, 804 bp, Artificial Sequence
  Description of Artificial Sequence: Synthetic coding sequence
atgccccggcagttccccaagctgaacatcagcgaggtggacgagcaggttcggctgttggctgaaaaggtcttcgccaaagtccttagagaagaagatagcaaagacgctctgtcactgtttaccgtgcccgaggattgtcctatcggccagaaagaggcgaaggaaagggaactccagaaggagctcgctgaacagaaatccgtcgaaacggcaaagcggaagaagtctttcaaaatgatcaggtctcagagcctgagtctgcagatgcccccgcagcaggactggaaaggtccaccagccgcgagtccggccatgagcccaacaacgcctgtcgtaactggagccactagcctgccgacgcctgcgccctacgccatgcccgaattccagcgagtgaccatttccggggactattgcgccggcatcacactggaggactatgagcaagccgcgaaaagcctcgccaaggcgctcatgataagggagaagtatgcaaggctggcctatcataggttccctcggataacctcccagtacctcggacatccaagggcggataccgccccacccgaggaggggctgccagactttcacccaccacctttacctcaggaggatccttactgcctggatgatgctccgcccaacctggattacctggtgcacatgcagggcgggattctcttcgtatacgataacaagaagatgctggagcaccaagaacctcactcccttccataccccgacctggaaacatacactgttgacatgtcacatattctggcgcttatcactgactag

SEQ ID NO: 178263 - DNA, 2325 bp, Artificial Sequence
  Description of Artificial Sequence: Synthetic coding sequence
atggagcccggcagcgccgagatgccccggcagttccccaagctgaatataagcgaagtggacgaacaggtccggttattggcagaaaaggtgttcgcgaaggtactgagggaagaagatagtaaagacgcactgtccctgttcaccgtaccggaggattgccccataggacagaaagaggccaaagaaagggagcttcagaaggagctggccgaacagaaatctgtagaaactgcaaagagaaaaaagtctttcaagatgatccgatcccagtcactttccctgcagatgcccccccaacaggactggaagggccctccagctgccagcccagccatgtccccaaccacacccgtcgtgaccggcgccacctccctgcccactcccgcgccctacgccatgccggagttccagcgtgtgacaatttcaggtgactattgtgctggaattactctagaagactatgaacaggctgcaaagagcctggcaaaggcgttgatgatccgagagaagtacgcacggctggcttatcaccggtttccccgtataacgagccagtatctgggtcatccccgggctgatactgcaccccccgaagaagggctacctgactttcatccgccaccgctgcctcaggaagacccctattgtctggacgatgctccacccaacttagattatctagtccacatgcaggggggcatcctcttcgtttacgataataagaagatgcttgagcaccaggagccacattcactcccctatcccgatctagaaacgtatacagttgatatgtctcacatcttggctctcatcactgatggaccaacaaagacatattgccaccggagactcaacttcctcgaaagcaagtttagcttgcacgaaatgctgaacgagatgagcgagtttaaagaacttaagtctaacccacatagggacttctataatgtgcgcaaggtagacacacatattcatgccgcagcgtgcatgaatcagaaacacctgctcagatttatcaagcacacataccaaactgaacccgaccggacagtggcagagaagcgcggtcggaagatcactctgcgtcaggtgtttgacgggctgcatatggatccctacgacctgacagtcgacagtctcgatgttcatgccggtcgacagacctttcaccgattcgacaaatttaactctaagtataacccggtgggcgctagtgaactgcgggatctctacctaaaaacagagaattacctagggggcgagtacttcgctcgcatggtgaaagaagtggctcgggaactggaagaatctaagtaccagtacagcgaacccagattgtctatctacgggagatcccctgaggagtggccaaatctggcttattggtttatccagcataaggtctacagtcccaacatgagatggattattcaggttccaagaatttacgacatttttaggtctaagaagctgctccccaacttcggtaagatgcttgagaacattttcctccctttgttcaaagccactatcaaccctcaggatcacagagagttacatttatttttgaagtacgtgactggcttcgattcagttgacgacgagtccaaacattcggaccatatgttctctgataagagccctaaccctgatgtctggacatccgagcaaaacccgccctattcttattacctgtactacatgtatgctaacataatggtcttgaacaatctgcgccgcgaaagagggctcagcaccttcttattcaggccccactgtggagaggccggcagcataacccaccttgtgtccgctttcctgactgctgataatatatcccacggattgctcttgaagaagagcccagtcctgcagtatttatattatctggcccagatccccatagccatgtcccctctgtcaaacaacagcctgtttctggagtatagcaaaaatcctttgcgtgagttcctccataagggtctgcatgtctctttgagcaccgacgatcccatgcagttccattacactaaagaggctctaatggaggagtacgccatcgcagcgcaagtctggaaactgtctacttgcgacctctgcgaaattgcaaggaacagtgtgctccagtccggattgtcacaccaggagaagcaaaaatttctaggacagaattactataaagagggcccagagggcaacgatataagaaaaaccaacgttgcccaaattcgtatggcctttagatatgaaacgctttgcaacgagctgtccttcctgagcgacgctatgaagagcgaggagatcactgccctaaccaattag

SEQ ID NO: 178264 - DNA, 2304 bp, Artificial Sequence
  Description of Artificial Sequence: Synthetic coding sequence
atgccccggcagttccccaagctgaacatcagcgaggtggacgagcaggtacgacttctggcggagaaagtgtttgcaaaggttctgcgcgaggaggacagtaaagacgccctatcgctattcacagtccctgaggattgtcccatcggccagaaggaggcaaaggagcgagagctccagaaggagctggcagagcagaaatcagtggaaactgcaaaacgcaaaaaaagtttcaagatgatcaggtcgcagtctctctctctgcagatgcctcctcagcaggactggaagggcccccctgctgcgtctcccgccatgtcacccacaaccccggtcgtgaccggcgccacctctcttccaaccccagcaccttacgccatgcccgaatttcagagggtgactatcagtggagattactgcgcaggcatcaccctggaggactatgagcaagcggcaaaaagcctcgcaaaagccctcatgatcagagaaaagtatgccagactcgcgtatcaccgattcccaaggatcacaagccagtacttgggccatcctagggcagacactgccccacccgaagaagggctgccggattttcatcctccccctctgcctcaggaggacccgtactgcttggacgacgccccccctaacctcgactacttagtgcacatgcagggtggaatcttgttcgtatacgacaataagaaaatgctggagcaccaggaaccacactcgctcccttaccccgaccttgagacctacactgtagacatgtcgcacatccttgccttaatcaccgacggcccaaccaagacttactgccatcgaagactgaactttctagagtctaagttctccttacatgaaatgctcaacgagatgagtgaatttaaggagctaaagagcaaccctcatcgggatttttacaacgtgcggaaagtggatactcatatccacgccgcagcctgcatgaaccagaaacacctactacgcttcattaagcatacgtaccagaccgagccagatcgtaccgtggctgagaagagaggccgcaagataaccttgcgacaagtcttcgatggacttcacatggacccatacgatttgacagtggactcactcgacgtgcatgctggccgccagacatttcacaggttcgacaagttcaactccaagtacaaccccgtcggagcttctgaattgagggacctgtacttgaaaacagagaattatctggggggcgaatacttcgctcgcatggtcaaggaagtagctcgggaactcgaagagagtaaatatcaatatagcgagccacgcctgagcatttacgggcgatctcccgaggagtggccaaacttggcctactggttcattcagcacaaagtctactcgcccaacatgagatggataattcaggtgcctcgcatttacgatatatttcgctccaaaaaacttctgccaaatttcgggaagatgttggaaaacatcttcctgccactgtttaaggccaccatcaacccacaagatcatagggaactccacttatttctcaagtatgtcaccggattcgacagcgtcgacgacgaatctaagcattcagaccacatgttctcggacaagtctccaaatccagatgtctggacttccgagcagaatccgccatatagctactacttgtactacatgtacgcaaacattatggtgctgaataacttgcgtagagaacgtgggcttagtacattcctgttccgcccacactgcggtgaagctggcagtatcacgcatctggtgtccgcttttctgacagctgataacattagtcatggcctcttgctcaaaaagtctcctgtgctgcagtatctgtattacctcgcacagatcccaatcgctatgtcccccttgtcaaacaattctttgtttttggagtactccaagaatcctctgagggaattcctacacaaaggcttgcacgtttccttgtcaactgacgacccgatgcagtttcactacaccaaagaagcactaatggaggaatatgctatcgcagcccaggtctggaagctgagcacatgcgatctttgcgaaatcgctcgcaactcggtgctgcagtcgggcctctctcatcaggaaaagcagaaattccttggacaaaactattataaggaggggcccgaggggaacgatatccgaaagactaatgtggctcagatcagaatggccttccgctatgaaaccttgtgcaatgagctgagcttccttagtgacgccatgaagagtgaagaaattacagccctgaccaactag

SEQ ID NO: 178265 - DNA, 336 bp, Artificial Sequence
  Description of Artificial Sequence: Synthetic coding sequence
atgccccggcagttccccaagctgaacatcagcgaggtggacgagcaggtgagactgttagctgaaaaggtcttcgctaaggtactgcgcgaggaggacagtaaggatgcactgtcactgttcactgttccggaagattgtccgatcgggcagaaagaggccaaagagagggaactacaaaaagagcttgctgaacagaaatccgttgagactgctaaaaggaagaagtcattcaaaatgattcgatcacagtcattatctctgcaaatgcctccacaacaggattggaagggcccccccgctgcttccccggctatgtcacctactaccccatag

SEQ ID NO: 178266 - DNA, 426 bp, Artificial Sequence
  Description of Artificial Sequence: Synthetic coding sequence
atggcccggcccctgtgcaccctgctgctgctgatggccaccctggcaggagcactggcatcttcaagcaaggaggagaaccggatcatccccggcggtatatatgacgctgatctgaacgacgagtgggttcaacgggccctgcactttgccatttctgagtataacaaagctaccgaagacgagtattaccggaggccccttcaggttctgagggcgcgggagcaaacatttggaggggtaaattacttttttgatgtcgaggtgggtagaaccatctgtacaaaatcccaaccgaacctggatacctgtgctttccacgagcagccagagctccagaaaaaacagttatgcagcttcgagatatacgaagtgccctgggaggatcgcatgtccctggtgaactcccgctgtcaggaggcctag

SEQ ID NO: 178267 - DNA, 1215 bp, Artificial Sequence
  Description of Artificial Sequence: Synthetic coding sequence
atgcccggcctgatgcggatgcgggagcggtacagcgccagcaagccacttaagggagctcgcatcgctggttgtctccatatgacagtcgaaaccgctgtgctgatagagactctggtgacgcttggcgccgaagtgcagtggagctcctgcaacatttttagcacccaagaccacgctgccgccgctatagcaaaggcaggcatcccagtctacgcatggaagggagaaactgacgaagagtacctgtggtgtatcgagcaaacactgtacttcaaggatggccctctaaatatgattctggacgatgggggtgacctgaccaacttgatccacactaagtatccccagctgttgcccggcattaggggaatctccgaagaaactaccactggggtgcataacttgtataagatgatggctaacggaatcctaaaagtcccggcgattaacgtcaacgactccgtaacgaaaagtaagttcgataacctatacggctgccgtgagagtctgatcgacgggattaagagagctaccgatgtaatgatagctggtaaagttgcagtagtagccggatatggagacgtgggcaagggttgtgcccaggctctccgtggctttggcgctcgggtgattattacagaaattgacccgatcaatgcactccaggctgccatggaggggtatgaggtcaccaccatggatgaagcttgccaggaaggaaatatcttcgtgacaactacaggatgcatcgacataattctcgggagacacttcgagcagatgaaagatgacgcgatcgtgtgcaatattggtcactttgacgtggagattgacgtcaagtggttaaatgagaacgctgttgagaaggtaaatataaaaccacaggtggacagataccggctgaaaaatggacgcaggatcatcctgctggctgaaggccggcttgttaatctgggctgcgcgatggggcacccatccttcgtgatgtccaacagctttacgaaccaggttatggcccagatagagctatggacgcatcccgataagtacccggttggggtgcatttcctgcccaagaaactggatgaggctgtggctgaggcgcatcttggcaaactcaacgtgaagcttacgaagcttactgagaagcaggcccaatacctcgggatgagttgtgacggccctttcaagcctgaccactatagatattag

SEQ ID NO: 178268 - DNA, 798 bp, Artificial Sequence
  Description of Artificial Sequence: Synthetic coding sequence
atgttcgtgagcaagcggcggttcatcctgaagacctgcggcaccactttgctacttaaggcactggtgccgttgctgaagctcgccagggactatagtggctttgacagtatccagtccttcttctatagccggaagaacttcatgaagccctcccatcaaggctatcctcatcggaattttcaagaggagatagaatttttgaacgccattttccccaacggggcagcctattgcatgggaaggatgaatagcgactgctggtatctctatacccttgacttcccggagagtagagtgatatcccagcccgaccaaaccctggaaatcttaatgtccgagctagatcccgctgttatggaccaattctacatgaaagacggggttacagccaaggacgtgacgcgcgaatccgggatcagagatctgattcctggttcagtcattgacgccacaatgtttaatccctgcgggtattccatgaacggtatgaagagtgatggaacctactggactatccacatcactccagaaccggaattctcttatgtgtccttcgagacgaacctgtcccagacctcttacgacgatctgattcggaaggtggtcgaggttttcaagcccggcaaattcgtgacgaccctctttgtgaatcagagcagcaagtgcagaacagtgctcgcctcgccccaaaagattgaaggtttcaagaggctcgactgtcaaagtgcgatgtttaacgactacaattttgtatttactagtttcgctaagaagcaacagcagcagcaaagctag

SEQ ID NO: 178269 - DNA, 918 bp, Artificial Sequence
  Description of Artificial Sequence: Synthetic coding sequence
atggaggccgcccacttcttcgagggcaccgagaagctgctggaggtgtggttcagcaggcagcagccagacgcaaaccagggatccggggacctgcgcacaatacccagtgagagctcaatgtttgtgagcaagcgccggttcattctcaagacctgtggcaccacccttctgttgaaggcactagtccccctgttgaagctggctagagattacagtggttttgatagcatccagtccttcttctactcgcgcaagaatttcatgaaaccaagtcaccagggctacccccatcgcaacttccaagaagaaattgaattccttaacgccatcttcccaaacggagccgcctattgcatggggcgcatgaactccgactgctggtatctgtataccctggattttcccgaaagccgagtgatttctcagcctgaccagaccctcgaaatcctaatgtcagaacttgaccctgctgtgatggaccagttttacatgaaggacggtgtgaccgcgaaggacgtgacccgcgaatctggtattcgagatcttattccggggagtgtcatcgatgctacaatgttcaacccatgcgggtattcaatgaatggaatgaaatcagacgggacctactggacgattcatattacccctgagcctgagttctcttacgtcagttttgagaccaacttatcccaaaccagttacgatgatcttataagaaaggtggtggaagtctttaagcccgggaaattcgtcacaacactctttgtaaatcagagttcaaagtgcagaaccgtacttgcttccccacaaaagatcgaagggtttaaaagattggactgtcagtcagccatgtttaacgactacaacttcgttttcacatcatttgccaaaaagcagcaacagcaacagagctag

SEQ ID NO: 178270 - DNA, 561 bp, Artificial Sequence
  Description of Artificial Sequence: Synthetic coding sequence
atgggccggatgaacagcgactgctggtacctgtacaccctggacttcccagagagccgagtcatctctcaaccggatcagacattggagattcttatgtccgagctggatccggcagtcatggaccagttttacatgaaagacggcgtaacggccaaagacgtaaccagggaatcaggcatccgggatttaattcccggaagcgtgatcgatgctactatgtttaacccttgcggttatagtatgaatggaatgaagagcgacgggacctattggacgattcacatcactcctgagccagagtttagctacgtgtcctttgaaaccaatctctcacaaacgagttatgacgatctgatccgcaaggtggttgaggtgtttaaacctggcaagttcgtcaccacactcttcgtgaatcagtcttctaagtgcagaaccgtcctggccagtcctcagaaaatagagggattcaagcgtctggattgccagtcagcaatgttcaacgactataacttcgtgttcacgtcattcgccaagaagcagcagcagcaacagagctag

SEQ ID NO: 178271 - DNA, 1005 bp, Artificial Sequence
  Description of Artificial Sequence: Synthetic coding sequence
atggaggccgcccacttcttcgagggcaccgagaagctgctggaggtctggttcagcagacagcagcccgacgctaatcagggaagtggcgacttgcggacaattcctaggtctgaatgggacatcttgctgaaagacgtccagtgttcaattatcagtgtgacaaagacagacaagcaggaagcgtacgtcctctcggaatcaagcatgtttgtaagcaagcgtcgattcattctgaagacatgcgggacaacccttttgttgaaagctttggttcccctgttaaagctggcacgtgactatagtggcttcgatagcatccagagctttttctactcacgaaaaaatttcatgaaaccctcccatcagggctaccctcataggaatttccaagaggagattgagtttctgaatgccatctttcccaatggtgccgcttactgcatggggcgaatgaactctgattgttggtatctgtataccctcgactttcccgaatcacgcgtaataagccagccagatcagaccttggagattttgatgtctgagcttgacccggctgtgatggatcaattctacatgaaggatggggtgacagcaaaggatgtcacgcgcgagtcaggtatccgtgacctgatacccggttctgtgatcgacgccaccatgttcaatccatgcggctactccatgaacgggatgaagtctgacggaacatactggacgattcacattaccccagaaccagagttctcttatgtgagcttcgaaactaatctaagtcagactagctatgatgatcttatccgaaaagtggttgaagtgtttaaaccgggtaagttcgtgactacgctcttcgttaatcaatcctcaaaatgcaggacagtgctggccagccctcaaaagatcgaaggctttaagcgcttagactgccagagcgcgatgttcaacgattacaattttgtgtttacttcctttgcaaagaaacagcagcagcagcagagctag

SEQ ID NO: 178272 - DNA, 645 bp, Artificial Sequence
  Description of Artificial Sequence: Synthetic coding sequence
atggaggccgcccacttcttcgagggcaccgagaagctgctggaggtatggttttctaggcagcagccagacgcgaaccagggctcaggtgacctccgtacaatccctcggtacctttacactctcgattttcctgagagtcgggttatttcccagcctgaccagaccctggagatcctgatgtccgagctagaccctgccgtgatggaccagttctatatgaaagatggggtgactgcaaaagatgtgaccagggaatctggaatcagggatttgatcccaggtagtgtgatcgacgctactatgttcaacccgtgtggctatagcatgaatggtatgaagtcggacggcacgtactggaccatacacattacccccgaacctgaattttcttatgtatccttcgaaacgaacctgtctcaaacttcatacgatgatctcatcagaaaagtcgtcgaggtgttcaagcccggaaaattcgtgacaaccctcttcgtgaatcagtcaagcaagtgccggaccgtactagccagtcctcaaaagatcgaggggttcaagagactcgactgtcagagtgcgatgttcaacgactataacttcgtgttcaccagctttgccaagaaacagcagcagcagcagagctag

SEQ ID NO: 178273 - DNA, 3360 bp, Artificial Sequence
  Description of Artificial Sequence: Synthetic coding sequence
atggccggcgccccccggggcggcggcggcggcggcggcggcgccggggagcctggcggtgctgaacgagctgcgggtacgtcacgccggaggggcctaagagcgtgtgacgaagaattcgcctgcccggagttggaggccttattccggggctatacactcagactggaacaggctgccacactgaaggcactggccgtgctcagtctgttggcgggggctctggcactggccgaactcctgggtgcacctgggcccgccccaggcctcgctaaaggttcacaccccgtccactgcgtactctttcttgctctgcttgtggtgaccaatgtgcgctcgttacaagtcccgcagctgcaacaggtgggccaacttgccttgttattctccctcacattcgccttgctgtgttgtccctttgcactaggcggacccgcccgtggcagcgccggcgccgctggcggtcccgccacagctgaacaaggagtatggcaattactactggtcaccttcgtctcgtatgccctactgcccgtccgctctcttctggcaatcggcttcgggctggtagtcgccgctagccatttgctggtcacagccacgctggtgccagccaagaggccgaggttgtggcgtaccttaggcgccaatgcattgctgtttgtgggggtcaacatgtacggtgtgttcgtcaggatactgaccgagcggagtcaacgcaaggccttccttcaggcgcgtagttgtatcgaggatagactgaggctggaggatgaaaacgagaaacaggaacggctgctcatgagtctcctgccgagaaatgtggcgatggagatgaaggaagattttctcaaaccccccgagcggattttccacaagatctacatccagcgacacgacaatgtgagcattctgttcgctgacattgtggggttcaccggcctggccagccagtgcactgcccaggagttggtgaagctgctcaatgagttatttggtaagtttgatgagctggcaaccgaaaaccactgccggcgcattaaaatactcggcgactgctactattgcgtgagtggtctcacccaaccgaagacggaccatgcacactgctgcgtcgagatgggactggacatgattgacaccataacgagcgtcgccgaggcaaccgaggtggacttgaatatgagggtaggactccacaccggccgcgtcctttgtggcgttctcggtctgagaaagtggcagtacgatgtgtggtccaacgatgtaacattagcaaacgtaatggaagccgcaggacttcccggcaaagtgcatattaccaaaactaccctggcttgtttgaatggggattatgaagtcgagccggggtatgggcacgagcggaatagctttctgaaaacacataatatcgagaccttttttatagtgccatcacatcgcagaaagattttccctggcttaatcttgtctgatattaagcctgccaagaggatgaaattcaaaacggtgtgctatcttctggtacagcttatgcactgccggaaaatgttcaaggccgaaatccccttctcaaacgtaatgacatgcgaggatgacgataagcggagagcgctgcggacggcaagcgaaaagctgcggaacagaagttcgttctctaccaacgtggtgtacacaacccctgggacacgagtgaacaggtatatctctcgcctacttgaggccagacagacagagcttgaaatggctgatttgaacttcttcactctcaaatataaacatgtcgaacgagagcagaagtatcaccaacttcaggacgagtactttacttccgcggtggtactgaccctgatcctcgccgctttgttcggcctggtttatctgctcatcttccctcagagtgttgtggtcttactgcttttggtgttttgtatctgttttctagttgcttgcgtgctctacttgcatataacccgagtccagtgcttccccggttgcctgacaatacaaattaggaccgtgctttgtattttcattgtcgtactcatctacagtgtcgcgcagggatgcgtcgtgggctgtctgccctgggcgtggtcctctaagccaaatagtagtctggtggttctttcgtccggcggtcaacgcacggccctccctacactcccatgtgaatcgacgcaccacgccctactgtgttgcctcgttggaacacttcctctggctatattctttcgggtctcctcgctgccgaaaatgattctgctgtctgggcttactacttcctacatcctggttcttgaattaagtggatacactcgaaccggcggcggcgccgtgtctggacgctcctacgagcctattgtggccattcttctgttctcctgtgccttagctcttcacgctcgtcaggtcgacatccgattgaggcttgactacctgtgggcagcgcaggcagaagaggagagggaggatatggaaaaggtgaagcttgacaaccggaggatcctcttcaatcttctgcctgcacacgtggcacagcacttcctgatgtcgaaccctcgaaatatggacctctactatcaatcctactcacaggtgggggtgatgttcgcgtcgatcccaaatttcaatgatttctatatcgaacttgacggcaacaatatgggcgtggagtgtcttaggttgctcaatgaaatcatagcagatttcgacgaactgatggaaaaggatttttacaaagacattgaaaaaattaagactattggttctacctacatggccgccgtgggcctcgctccgacctccggcacgaaggctaagaagagcatttcgtcccacctctcaactctcgccgattttgctattgaaatgttcgatgttcttgatgaaatcaactaccaatcctataacgacttcgtgctcagagtggggattaacgtcggcccagtagtcgccggcgtgatcggggcccggagaccgcagtacgacatatggggaaacaccgtgaatgtggcttcccggatggactccacaggcgtgcaggggcgcattcaggttaccgaggaggtgcacagattgctgagacgatgcccttaccacttcgtgtgtcgggggaaggttagcgtgaaggggaagggtgagatgttgacctattttctggaggggcgcacggatggaaatggctcccagattcggagcctgggtctagatcgaaagatgtgccctttcggccgcgctgggctgcagggcagaagaccaccggtgtgccccatgccaggcgtgtctgtcagggccggactgcccccgcactctcccgggcagtatctgccaagcgccgccgcaggcaaggaagcctag

SEQ ID NO: 178274 - DNA, 3174 bp, Artificial Sequence
  Description of Artificial Sequence: Synthetic coding sequence
atggccggcgccccccggggcggcggcggcggcggcggcggcgccggggaacccggtggtgccgagcgcgccgccggcaccagtcgacggcgcggcctaagggcctgcgatgaggagttcgcctgtccagagttagaggcacttttccgaggctacactttaagactggagcaggctgctactctgaaagctctcgcagtgctcagccttcttgcaggggccctcgccctggcggagctcttaggcgctcccggaccggccccaggtctcgccaagggtagccatccagtacattgcgtgttgttccttgctctgctggttgtcacgaatgtgcgatctttacaagtcccccagcttcagcaagtgggccagctcgcgcttctgtttagcctcacttttgcgctgctctgctgccccttcgccctgggcggccctgcccgggggagcgccggtgcagcaggcgggcccgcgaccgccgagcagggggtgtggcagcttctgctggtaacatttgtcagctatgcgcttcttccagtgcgaagcctcttggcaataggtttcggtctcgtcgtggcagctagtcacctcctagttacagctactctcgtccctgcaaagcgaccacgcctctggcgtaccctgggcgcaaacgctttactgtttgtgggagtcaacatgtacggagtctttgtgcgaatactcaccgagaggtcccagcgaaaagcattcctacaagcaaggtcctgtatcgaggatcgactgcgactggaggatgaaaatgagaagcaggaaaggctcctcatgagcctgctgccccgcaatgtcgccatggaaatgaaagaagattttttgaaaccccctgagcgcatctttcataagatctacatacaaagacatgacaatgtatccatcctgtttgccgacatcgtgggtttcacgggtttggcctctcaatgcacggcccaggaactggttaaactgttgaacgaactttttggtaaattcgatgagctcgcaaccgaaaatcattgtaggcgcataaaaatccttggcgattgttattactgtgtgagcgggcttactcagccgaagactgatcatgcccactgttgcgttgaaatgggcctggacatgattgataccatcacctcagtagctgaggccacagaggtggatctgaacatgcgggtgggcctccatacaggaagagtgctctgtggagtactcggcttgcgtaaatggcagtacgacgtgtggtctaatgatgtgaccctggcgaacgttatggaagcagctggtttgcccggcaaagtacacatcaccaaaaccaccctggcttgcttgaatggggattatgaagtggaaccaggatatgggcacgagcggaactcattcttaaagacacataatattgagactttctttattgtcccttcccatcggaggaaaatcttcccaggcctgattctgtcagacataaaacccgccaagcgcatgaaattcaagacagtatgctacctgcttgtgcagttgatgcattgtaggaagatgttcaaagccgagattcccttctccaatgtgatgacctgtgaggacgacgacaaacgccgcgcacttaggacagctagtgaaaagctaagaaatagaagctccttctccaccaacgtggtctatacaactccaggaacaagggtgaaccgatatatctcccggcttctagaggcccgccaaacagagctcgaaatggctgacctgaatttcttcaccctcaaatacaaacatgttgagagagaacagaagtatcatcagctccaggacgagtatttcacttccgccgttgtcctaaccctcattctagccgcattgtttgggctggtctacttactcatatttccccaatctgttgtggttctcttactgcttgtgttttgcatctgctttttggttgcatgcgttctgtacctacatataactagagtgcagtgttttcctggatgtctgactatccagatccgaaccgtcctgtgtatattcatcgtcgtgctgatatactcagtcgcccagggctgtgtcgtgggctgtctgccttgggcctggtcttcaaagcctaactcctccctggtggtgctttcttctggaggccagaggaccgccctgcccactctgccttgcgaatcaacacaccatgccttgctatgttgtctggtgggaaccctgccattggccatttttttccgggtcagcagcctccctaagatgatcctcctgtccggccttaccacctcgtatattctggtcttggagctgagcgggtacaccaggacagggggtggcgctgtcagcggccggtcttatgaacctattgtggccatcctcctcttcagttgcgcgctggcgttacacgctagacaggtagacataaggttgcggttagattacctttgggctgcccaagcagaagaggagagagaggacatggagaaggtcaagcttgataacagacggatattattcaacttgcttcctgctcatgtagctcagcactttctcatgtctaatcctagaaatatggacttatactaccaatcttactctcaggtcggcgtgatgtttgcatctatccccaactttaatgatttctacatcgaactggatggaaataacatgggagtggagtgtcttcggctcctgaacgagatcatcgccgatttcgacgagttgatggaaaaggacttttataaagatattgagaaaatcaaaaccatcggttccacctacatggccgcggtcggcctcgctccgacatctgggacaaaggcaaaaaagtccattagtagtcatctgtccaccctggctgatttcgcgatcgagatgttcgacgtgctggatgaaatcaactaccaaagctataatgacttcgtactgagagtgggcatcaacgtcggtccggtggtcgccggcgttatcggggcacgcagaccgcagtatgatatttgggggaatacggtaaacgtcgctagtcggatggatagtacgggagttcagggccggattcaggtgacggaggaagtacaccgtcttctgagaaggtgtcccccactgtgcgttcccaggcagtcgcagtgtcaggggcaaaggagggatgttgacatcctgtccaggagacaggactag

SEQ ID NO: 178275 - DNA, 3276 bp, Artificial Sequence
  Description of Artificial Sequence: Synthetic coding sequence
atgtggcaggaggccatgcggcggcggcggtacctgcgggaccggagcgaagaggccgctggcggtggagacggacttcccagatctagagattggctgtacgagagttactattgcatgagccaacagcatccactgattgtcttcttgctcctcattgtgatgggcagttgcctggctctactcgctgtgtttttcgccctggggctggaagtggaagaccatgtagctttcctaatcaccgttcctactgccctcgcaatattctttgcaatcttcatcctcgtctgcattgagagcgtgtttaaaaaacttctgagattgttctctctcgtcatctggatatgcctcgttgccatggggtacctcttcatgtgcttcggcgggacggtgagcccttgggaccaggtgtcctttttcttgtttattatcttcgtcgtgtatactatgctgcccttcaacatgcgagatgccattattgcatcagttctgacttcctctagccataccatcgtgctcagcgtctgtctgtccgctacacccggtggcaaagagcatctagtgtggcagatcctggcaaatgttattattttcatttgcggcaatctggccggagcctatcacaaacacctgatggagttggcccttcaacagacatatcaggacacctgcaattgtatcaagagtagaataaagctggagttcgaaaaacggcagcaagagcgattattgttatctttactccccgcacacatagcaatggaaatgaaggccgagatcatccagcgactgcagggtcctaaagccggacagatggagaatacgaataacttccataatctatatgtgaaacgccataccaacgtgtctatcctctacgccgatatcgtcggattcacccggctggcttcggactgttctccaggagagctggtgcacatgctgaacgagctgttcggcaagttcgaccagatagcaaaggaaaacgagtgtatgcgcataaagattttgggagactgttactactgtgtgtccgggctgcccatctctctaccaaaccacgctaagaactgcgtgaaaatgggactggacatgtgtgaagctataaagaaggtacgggacgccacgggagtggatatcaatatgcgcgtaggcgttcattccggaaatgtgttatgtggggtcatcggtcttcagaaatggcagtatgatgtttggagccatgatgtgactctcgccaatcacatggaggccggcggggtgcctggacgggtgcatattagctccgtgactctggagcacctcaacggagcctacaaagtagaagaaggcgatggagacatccgcgacccttacctcaagcagcacctggtgaagacctactttgtgattaacccgaagggggagcgcagatctccccaacatctgttccgtccgaggcacaccctggacggcgcaaagatgcgcgcatcggtcagaatgacacgatatctggagtcctggggcgccgcaaagcccttcgcccacctacaccatcgagattcgatgacaaccgagaacggcaaaattagtacgacagatgtacctatgggtcagcataacttccagaaccggacacttcggacaaaatctcaaaagaagagattcgaggaggagctgaatgagcgcatgatccaagcaatcgacggtatcaatgctcagaagcagtggcttaagtctgaagatattcaaagaataagcttgctattttacaataaggtgctggagaaggagtatagagccactgctcttcccgcttttaagtactacgtgacttgtgcatgcttaatattcttctgcatcttcattgtccagatactggtgctgcccaagacttccgtcctgggaatcagcttcggagccgcctttctcttactcgctttcatcctcttcgtctgctttgctggccaactactacagtgtagtaaaaaagctagccccctcctcatgtggctgcttaaaagttccggaatcatcgccaaccggccctggccacggatctctttaacgattattacaaccgcgatcatcctgatgatggccgtttttaatatgttctttttgagtgactccgaggaaaccatccccccaacagcaaatactaccaatacctctttcagtgcctccaataatcaggttgccatcctccgggctcaaaatctgttctttctgccttacttcatatatagctgtattctgggcctgatttcatgtagcgttttcctccgggtaaactatgaacttaagatgctcatcatgatggtggcactggtcggctataacacaatcctcttacatacacacgcccatgtgctgggggattattcccaagtcctgtttgaaaggcctggcatctggaaagacctgaaaacaatgggcagcgtgagcctgagcattttttttatcacgttacttgtgctgggccgccagaacgagtactattgtcgcctcgacttcctatggaaaaataagtttaaaaaggagcgcgaggagattgaaaccatggaaaatctgaatcgagttctattggaaaatgtgctccccgctcatgttgccgagcacttcttggccaggtctctgaagaacgaggaactgtaccatcagtcatacgattgtgtgtgcgtgatgttcgcatcaatccctgattttaaggaattctacaccgagagcgacgtgaacaaggaaggtcttgagtgcctgagactcctgaatgaaatcatcgccgattttgatgacctcctgtctaagcccaaattctccggcgttgaaaaaatcaagactattgggagcacttatatggctgccactggcctgtccgcggtcccctctcaggaacactctcaggagcccgagagacagtatatgcatatcggaacaatggtcgagttcgcgttcgccctcgtcggcaaactggatgctattaacaagcattcctttaatgactttaagctcagagtcggaataaaccatgggcccgtcattgcaggtgtaatcggcgcccagaagccccagtatgatatctggggcaataccgtgaatgttgcctcccgcatggacagcacaggcgtactggacaagattcaggtcacggaagagacaagtctggtactgcagacactaggctatacttgcacatgccgcggcattattaatgttaagggaaaaggtgaccttaagacttatttcgttaatactgaaatgagtcgcagcctgagccaatcaaacgtggcaagttag

SEQ ID NO: 178276 - DNA, 612 bp, Artificial Sequence
  Description of Artificial Sequence: Synthetic coding sequence
atggagaacctgaaccgggtgctgctggagaacgtgctgcccgcccatgtggcagagcatttcctcgcccgctctttaaagaacgaggagctgtatcaccagtcttatgactgcgtttgcgtcatgttcgccagcattccagacttcaaggagttttacaccgagagcgatgtgaacaaagagggccttgaatgtcttagattactgaatgaaatcatagccgactttgatgacctgctcagcaagccaaagtttagtggagtcgagaagattaaaacaattggatccacctacatggcagccactggccttagcgccgtcccctcacaggaacattcacaggagcccgagcggcagtacatgcatatcggcactatggtggagtttgcattcgctctggtaggaaagctggacgctatcaacaagcactctttcaacgattttaagctgagggtgggagtgaccgaggaaacttctttggtgcttcagacccttggatatacctgcacatgtagaggcatcattaacgtaaagggaaagggcgatttgaaaacctattttgtaaatacagaaatgtctaggtccctgtctcaaagcaacgtggcctcttag

SEQ ID NO: 178277 - DNA, 2736 bp, Artificial Sequence
  Description of Artificial Sequence: Synthetic coding sequence
atggacctgcggtgggcccgggacctgcacctgcgggaggccagcagatccgttgccttcaccactctgcggttgggcgcagtgactaccgggctactaacctttagagaaccaggcgataaggaaaagagtgggaaaggtctaggaaagcggtggcgaatccaaagagaagaaagccaggaacggctgcttctaagcctactgcctgcgcacattgccatggagatgaaagcggaaattatacaacggttacagggacccaaggccggtcaaatggaaaatactaataattttcataacctgtacgttaaaaggcacactaacgtgtcaatcttatatgccgatatcgtcgggtttacccgcctggcgagcgattgttccccaggcgagctcgtgcacatgctgaacgagcttttcggcaagtttgaccaaattgcgaaggagaatgaatgcatgagaattaaaatactcggtgattgctattattgcgtcagcggactgcctattagccttcctaatcacgccaaaaactgcgttaagatggggctggacatgtgcgaagccatcaagaaggtgcgggatgctacgggcgttgatatcaatatgcgcgttggggtacactcggggaacgtcctttgtggtgtgatcgggctacagaagtggcagtatgatgtttggtcccatgacgtcaccctggcaaatcatatggaagctggtggggtgcctggacgcgtacacattagcagcgtcaccctggaacacctgaatggagcttataaagtcgaggaaggagatggagacatccgagatccatacctcaaacagcacctggtgaagacctattttgtcattaatccgaaaggagaacgaaggtcgcctcagcatttatttagacctcgacataccctcgatggggctaaaatgcgggccagtgtccgaatgaccaggtacctcgagtcttggggcgcagcaaaaccattcgctcacctacatcaccgggatagcatgactacggaaaatgggaagatctcgaccactgacgtgcctatgggccagcacaattttcagaaccgtactttgcggaccaagagccaaaagaagaggttcgaggaagagctaaacgagaggatgatccaagccatcgatggaataaacgcccaaaaacagtggctcaaatcagaggacattcagcggatctctctgctgttttacaataaggtcctggagaaggaataccgcgcaacagcactccccgcttttaagtactacgttacttgtgcctgccttatctttttttgtatcttcatcgtgcaaatcctagtgctgcctaagacttccgtgttaggcatttcctttggcgcagcttttttactccttgcctttatcctctttgtatgcttcgccgggcagcttcttcagtgctcgaaaaaggcctcccctttgctcatgtggttgcttaaatccagcggcattattgccaatcgtccttggccaagaatttcattgactataataactacagctatcatcctgatgatggcagtgtttaacatgttttttctgtcagacagtgaagaaacaatcccacctaccgctaatactaccaacacgtcgttctccgccagtaataatcaggtggcaattcttcgagctcagaacctctttttcctgccttattttatttatagttgtattctcgggcttatatcttgtagtgtcttcctgcgggtcaattacgaattgaaaatgctgattatgatggtcgctctggttgggtataacacaatcctattgcacacccacgcccacgtacttggcgactactctcaggttctatttgaacgtcccggtatctggaaggatctcaaaacaatgggttcggtctccctgagtatctttttcattaccttgctcgtgctaggccgccagaacgagtattactgtcgccttgatttcctttggaagaataagttcaagaaggagcgggaggagatcgaaactatggaaaaccttaatagggtgctgctggaaaacgtgcttccagcacacgttgctgagcattttctggctagaagcctgaaaaacgaggaactctaccatcagtcttatgattgcgtgtgtgtgatgttcgcatctatcccagattttaaggaattttacaccgaaagtgatgtcaataaggagggcctggagtgtttaagactgctcaatgaaatcatcgctgatttcgacgacctcctgagcaaacccaagttcagcggggtcgagaagatcaaaaccattggatcaacctacatggcggcaactggactctccgcagtaccgtcacaagagcattcccaagagcctgagcgacaatatatgcatatcggcaccatggtagaattcgccttcgcactggttgggaagcttgacgccattaacaagcacagtttcaacgacttcaagctgagggtaggcattaaccatggcccagtgatagcaggggtaatcggagcacaaaagccgcaatatgacatttggggaaacacggtgaacgtagcctccaggatggacagcacgggcgtcctggataagatccaagtgactgaagaaaccagcctagttctgcagaccctcggatatacctgcacttgccgagggatcataaatgtgaagggcaagggggacctcaaaacttacttcgtgaacaccgaaatgagcaggagcctgagccagagcaacgtcgcctcctag

SEQ ID NO: 178278 - DNA, 2775 bp, Artificial Sequence
  Description of Artificial Sequence: Synthetic coding sequence
atgctgcccttcaacatgcgggacgccatcatcgccagcgtgctgacatcatcctcccacactatcgtattgtccgtttgcctctcagccactcccggggggaaagagcacctggtgtggcagatactggcgaacgttattatcttcatttgtgggaacctggccggcgcttatcacaagcatctgatggaactggccctgcagcagacctaccaggacacctgtaactgcatcaaaagccgaattaagctggagttcgagaagcgccaacaggaaaggctcctactcagcctgttgccagcccacattgcaatggaaatgaaggccgagatcattcaacgcctacagggaccaaaagccgggcagatggaaaacaccaataacttccacaacctgtacgtcaagcggcacactaatgtttctatactttacgctgatattgttggctttactcgactggctagcgattgctcaccaggggagttggtgcacatgctgaatgaactctttggcaagttcgatcagatcgctaaagagaatgagtgcatgagaataaagatcctcggagattgctattattgcgtctctgggctccccataagtctgcctaatcatgctaaaaattgtgtcaagatgggtctcgacatgtgcgaggccatcaaaaaggtgagggatgctacaggagtggatattaatatgcgtgttggagtccacagcggaaatgtactatgtggcgtaataggcctgcaaaaatggcagtatgacgtctggtcccatgacgtgaccctcgctaaccatatggaggcagggggcgtgcctggaagagtacatatttccagcgttactctagagcatctcaacggggcatacaaggtggaggagggcgatggggatattcgtgacccgtatctgaaacagcaccttgtcaaaacatattttgttatcaatcctaaaggtgagagacgcagtccacagcatctcttccgcccccgacacaccctggacggcgctaaaccctttgctcacttgcatcaccgggactctatgacaaccgagaacgggaagatatcaacgacagacgtacccatggggcaacataatttccagaataggactctgaggactaaatcccaaaaaaaaaggtttgaggaggaattaaacgagaggatgatccaggccatcgatggaataaatgctcaaaaacaatggctgaaatccgaggacattcagagaataagcctgctcttctacaacaaggtcctagagaaggagtaccgggccactgcgttgccagccttcaagtattacgtgacatgcgcctgcctgatattcttttgtatctttattgtccaaattctcgttctgcccaagacaagcgttctgggaatctcctttggcgccgcatttctgctcttagcctttattctgttcgtgtgttttgccggccagttgctgcagtgcagcaagaaagcctctcccctcctcatgtggttattaaaatcatcaggaattattgctaatcgcccgtggccccggatttctctgaccatcatcacgacagctataatcctgatgatggctgtttttaacatgttcttcctgtccgattctgaagaaaccatcccccccactgctaacacaacaaacacctcgttcagtgccagtaataatcaggtggccatactgcgcgcacagaacctgttcttcctcccatattttatttatagctgtattcttggcttaatttcctgctcggtctttctccgcgtgaactacgagctgaagatgttgatcatgatggtggcgctcgtgggatacaatacaatactactccatacgcacgctcacgtcctgggggactacagtcaggtgttattcgagcgacctggaatctggaaggatctgaagacaatggggtcagtatcactgtccatcttttttatcacgctgctcgtgctgggaaggcagaacgaatactattgtcgcttggactttctttggaagaataaattcaaaaaggagcgtgaagaaattgagacaatggaaaacttaaatagggtcctgttggagaacgtgctgccagctcatgtcgccgagcatttcctcgctcggtctctcaagaacgaagaactgtaccaccagtcctacgattgcgtgtgtgttatgttcgcctctattcctgatttcaaggagttttacacggaatccgacgtcaataaggagggattggagtgcttgagactgcttaatgagattatagccgattttgacgacctgctctcaaaacctaagttttccggtgtggagaagatcaagactatcggtagcacatatatggcggcgacgggcctgtccgctgtgccgtcacaggagcacagccaggagcccgagcgacaatacatgcatattgggactatggtagagtttgccttcgctctagtgggtaagctggacgccatcaacaagcattcctttaacgatttcaagctgagggtcggtatcaatcatggacccgtgattgctggcgtaatcggcgcccagaaacctcaatacgacatatggggaaacacagtgaatgtggcgtcgcgaatggactccaccggagtgctcgacaaaatacaggtgaccgaagaaacatcgctggtacttcaaacccttggctacacttgtacttgccgggggatcataaacgtcaagggcaaaggggatctgaagacctactttgtgaatactgaaatgagtagatctctgtcgcaatctaacgttgcatcatag

SEQ ID NO: 178279 - DNA, 3435 bp, Artificial Sequence
  Description of Artificial Sequence: Synthetic coding sequence
atgccccggaaccagggcttcagcgagcccgagtacagcgccgagtactcagccgaatattcagtctccttaccttcagatccagataggggcgtgggccggactcacgaaatcagcgtgaggaactcagggagctgcctgtgcctgccaaggttcatgagattgacattcgtccctgaatcactggagaacttgtaccaaacttattttaagcggcagcgccatgagacgctcctggtcttagtcgtcttcgccgcactctttgattgttatgttgtggtgatgtgcgcggttgtcttttccagcgataaactggcctccctggccgtggcggggattggtttagtcctcgacatcattctttttgtcctatgcaaaaaggggctactcccagaccgcgtcacacgccgcgtacttccatatgtcttatggctgctgattacagcgcagatattttcttacctgggtctcaatttcgctagggcgcatgctgcgtcagacactgtggggtggcaggtcttcttcgtctttagcttcttcatcacactgccactttctctgtcaccgatcgtcatcatcagcgtggtcagttgcgtggtgcatacgctggtgctgggcgtgaccgtggctcaacagcagcaggaggaattgaagggcatgcagctactgcgcgagatactggccaacgtattcctgtacctgtgtgccatagcagtcgggatcatgtcatattacatggcagaccggaagcaccggaaggccttcctggaggcacggcagagtttggaagtgaaaatgaacctggaggaacagagccagcaacaggagaatctgatgctctccatactgccaaagcacgtggctgatgaaatgcttaaggacatgaagaaggatgagagccagaaggatcagcagcagttcaatactatgtatatgtatcggcacgaaaatgtgtccatattgtttgctgatatcgttggctttactcagctgagcagtgcctgttctgctcaggaattggtgaaactcctcaacgagttgttcgctcgcttcgataaactggccgctaaataccatcagctgcgtattaaaatcttgggagattgttactactgtatttgcggtctgcccgattaccgggaggatcatgcagtgtgttccattctcatggggctggctatggtggaggccataagctatgtgcgggaaaagacaaaaacaggggtggatatgagggtgggggtgcacaccggcactgtcttgggaggcgtgctgggccagaagcggtggcaatacgatgtctggagtacagacgtgaccgtcgccaacaaaatggaagcaggaggtatcccaggcagggtgcatatcagccagtcaaccatggactgccttaagggagaattcgatgtagagcctggggacggaggatcacggtgcgactacctcgaagagaaaggtattgaaacttacctgatcatcgcatcaaaaccagaagtaaaaaagaccgcaacccagaacgggttaaacgggagcgctcttcccaatggagcacctgcgagcagcaaaagcagctctcccgcgctgatcgaaacaaaggaacccaacggatcagcccacagcagcggaagcactagtgaaaagccagaggaacaggacgctcaggctgataacccaagcttcccaaacccccggagacgcctgaggttgcaagatcttgcagacagggttgtggacgcctctgaggatgagcacgaactgaaccaactcctcaacgaagccctgcttgaaagggagagcgcccaagttgtgaagaaacgaaacaccttcctcctgagtatgcgctttatggaccctgaaatggagaccaggtatagcgttgaaaaggagaagcaaagtggcgcagcattctcctgtagctgtgttgtcctactgtgtaccgctttagtggagattttgatcgacccatggttgatgacgaattacgtgacctttatggtgggggagatcctgctcctgatacttacaatctgtagcctagctgctatttttccccgtgccttccccaaaaagttagttgcctttagtacatggatcgaccgtaccagatgggctcggaacacttgggctatgctcgccatctttattctggtgatggctaacgtcgtcgacatgctgtcttgtctgcagtactatacggggccttccaatgctaccgcagggatggagacagaaggatcttgtctggagaacccaaagtattacaattacgtggctgtgctgtctctcattgctacgattatgctggtccaagtttcacacatggtaaagctcacgttgatgctgctcgtggccggagcagtggctacaattaatctttacgcatggaggccagtgttcgacgagtatgatcataagcgattcagagaacacgatttgccaatggtagccctagagcagatgcaaggctttaatcccggtctgaacggcactgatagattgccgttggtgccatcaaaatactccatgactgtgatggttttcctgatgatgctatcgttttactatttctctcggcacgttgaaaaacttgcgcgaactctgttcctatggaagatagaagtacatgaccagaaagaacgggtgtatgaaatgcgtcgttggaatgaagcgctcgttaccaacatgctgccagagcacgtcgcccgccacttcttagggtcaaaaaagcgggatgaggagctctatagccagacttatgacgaaatcggggtcatgttcgcctccctgcccaacttcgctgacttttataccgaggagtcaatcaacaatggcggtatcgagtgcctcaggtttctcaacgagatcatctctgacttcgacagcctactggacaatccaaaattcagggtgatcacaaagatcaaaaccataggctctacctatatggccgctagcggcgttactccggatgttaacacgaacggtttcgcttcatcaaacaaagaggataagtctgaaagagaacggtggcaacacttggccgacctcgcggacttcgctcttgctatgaaggataccctgactaacattaataaccagtctttcaacaatttcatgttgcggattggaatgaataagggtggtgtcttagccggggtgattggggcgagaaagccgcactatgacatttgggggaacaccgtgaacgtggcaagccggatggagagcaccggggtaatggggaacatccaggtggtagaggagactcaagttatcctgcgcgaatacggcttcagattcgttcgtcggggtcccatcttcgtcaaagggaaaggcgaactgttgaccttcttccttaagggtagagataagctggcaacattccctaatggaccatcagtgacactgcctcaccaggtcgttgataattcatag

SEQ ID NO: 178280 - DNA, 3360 bp, Artificial Sequence
  Description of Artificial Sequence: Synthetic coding sequence
atgccccggaaccagggcttcagcgagcccgagtacagcgccgagtactcagctgagtattcagtgtccctgccgaggtttatgcgtctgacgttcgttcccgagtcgcttgagaacttgtaccagacatatttcaagagacagagacatgagacgctgctggttttggtcgtatttgctgcgctgttcgattgttacgtggtcgtgatgtgtgccgtcgtgttttcaagcgataaactcgcaagccttgcggtggcagggatcggtctagtgctggacatcattctcttcgtgctgtgtaaaaagggcctgttgcctgatagggtcacaagacgtgttctaccctatgtcctctggcttctcatcaccgctcagattttcagctatctgggtttgaatttcgctagggcccacgcggcttcggacaccgtggggtggcaggtttttttcgtgttctcattttttatcacattgcctttgagcctcagtccaattgtgatcatctccgttgtgagttgcgttgtgcatactctggtactgggggtgaccgttgcacagcagcaacaggaggagctgaagggcatgcagctgctccgggagatcctagcaaacgtcttcctctacctttgcgctatcgccgtcggcatcatgtcatactatatggccgatcggaagcaccgcaaggcctttctggaggcgaggcaatcccttgaagtgaagatgaacctggaagaacaaagtcagcagcaggaaaatctaatgctctctatcctgccaaaacacgtcgccgacgagatgctgaaggatatgaagaaagacgagagccaaaaggatcagcaacagtttaatacgatgtacatgtaccggcacgaaaacgtgtccatcttgtttgcagatatcgtaggatttacccagctcagctccgcatgttctgcacaggagctagtcaagctgctgaatgaactgttcgctcggtttgacaagctggccgcgaaataccaccagcttcgcattaaaatattgggcgactgctactattgcatctgcggcctgcctgactatcgcgaggatcatgccgtgtgctcgatactgatgggcctcgcaatggtggaagccatctcttacgttcgggaaaagacaaagaccggcgtcgatatgagagttggggtgcataccggaacagtgctcggcggggtcctgggccagaaacggtggcaatacgatgtttggtcaacagacgtgactgtggccaacaagatggaggccggaggtataccgggtagggtccacataagtcagtctaccatggattgtctgaagggcgaattcgacgtggaacccggggacggaggtagccgctgtgactacttggaggagaagggaatcgagacctacttgataatcgcgagtaaacctgaggtcaaaaaaactgcaacacagaacggcttgaacgggagcgctctgcctaatggtgcgcctgcatctagcaaaagtagctctccagcattgatagagactaaggagccgaacgggtctgctcacagtagtggatcaacctccgaaaaacccgaggagcaggacgcccaggcggacaaccccagttttccaaatccccgccggagactcagactccaagacctcgctgatcgcgtcgtggatgcctctgaggacgagcatgaactgaatcagttactgaacgaagcactgcttgagcgcgaatcagcccaggtggtcaagaagcgaaacaccttcctcttgtccatgagattcatggaccccgagatggaaacacgatattcagtggagaaggagaagcagagcggggcagctttctcatgttcctgcgtggtgctactctgtaccgctctcgtggaaatattgattgatccctggctgatgactaactacgtaacctttatggtaggcgagattctgctccttattctgaccatctgctcactcgcagccatcttcccaagagcatttcccaagaagctggtggctttcagcacctggatcgatcgcacacgttgggcccggaatacatgggccatgctggccatatttatcctggtaatggccaacgtcgtggatatgctgagttgcctgcagtactataccggcccatcgaacgctactgccggtatggagacggaggggagttgccttgagaacccaaaatactacaattacgtagcagtcctttccctgatagcaacaattatgctggtgcaggtgtctcacatggtgaagttgacacttatgctgcttgttgccggagctgtggcaactattaatctctacgcttggcgtcccgtctttgacgagtacgatcataaaaggttccgagaacatgacctacccatggtggctttggaacaaatgcaaggatttaacccagggctgaatggaaccgatcgcctacctcttgtgccctctaaatattctatgaccgtgatggtgttcttgatgatgctgtccttttattatttttccaggcacgtggaaaaactggctcggaccctctttctgtggaaaatcgaagtccacgaccagaaagagcgagtatacgagatgcgacggtggaatgaggccctggttacaaatatgcttccggagcatgttgcccgacactttctgggttcaaaaaagcgggatgaagaactttacagccaaacctacgatgagataggggtcatgttcgccagtctgcctaatttcgcagatttttacaccgaggagtccatcaacaatggcggtatcgaatgcctgaggtttctgaatgaaataatttcagactttgatagtctgctggataatcctaagttccgggttatcacaaagattaaaactattgggagcacctatatggcagcaagcggcgttacaccggacgtcaatactaatggtttcgccagcagcaataaggaagataagagcgagcgggagagatggcaacacctggcggacctcgcggacttcgcgcttgcgatgaaggacacactgacaaacattaacaatcagagtttcaataattttatgctgagaataggaatgaacaaggggggggttctcgcaggagtcatcggagctagaaagccgcattacgatatctggggaaataccgtgaatgtggctagccgcatggaaagcacaggggtcatgggtaacatccaggttgtggaggagacgcaggtcatccttagagagtatggattccgttttgtaaggcgtggccccatatttgtgaagggcaagggggagttgcttacgtttttcttgaaaggcagagacaagctcgcaaccttccctaacggcccttctgtcacattgccacaccaagtggtggataactcttag

SEQ ID NO: 178281 - DNA, 339 bp, Artificial Sequence
  Description of Artificial Sequence: Synthetic coding sequence
atgccccggaaccagggcttcagcgagcccgagtacagcgccgagtattctgccgagtattccgtcagcctgccatccgatccagatagaggcgtgggtcggacgcatgaaatttcagttaggaattccggctcttgcctctgtctgcctcgctttatgcgcctaacgtttgtcccggaatctctagagaacctctaccaaacatattttaagcgccagagacacgagaccctgctggtgctcgtagttttcgccgctctgtttgattgttatgtagttgtgatgtgtgccgtggtcttctctagcgacaagctcgcaagtctcgcagttgcaggatag

SEQ ID NO: 178282 - DNA, 3234 bp, Artificial Sequence
  Description of Artificial Sequence: Synthetic coding sequence
atggcccggctgttcagcccccggcccccccccagcgaggacctgttttatgaaacctactactcactgtctcagcagtacccactactgcttctgttgcttggaatagtgttatgtgcacttgcggccctcctcgctgttgcctgggcgagcggacgagaactaaccagcgacccaagcttcttgacgaccgtgctgtgcgcccttggcggcttcagcctgctgctaggactggcaagccgggaacagaggcttcaacgttggaccagacctttaagtggactcgtgtgggtagctcttctggcattgggccacgccttcctgtttacaggaggagtggttagcgcgtgggatcaggttagctactttctctttgtgatattcacggcttatgcaatgctcccattggggatgcgagacgccgccgtcgctgggcttgcgtctagcttgtctcacctgctcgtgctgggcctctatttgggcccccaaccagatagccggccggccctcctgccacaactggcggccaatgctgtactatttctgtgtggtaacgtagctggcgtgtatcataaggctctgatggaacgggctctgcgcgcaacctttagagaagctctgtcctctctgcactctagacgaagactggacactgaaaagaaacaccaggagcatctgctcctgtcaattcttcccgcttacttggctagagaaatgaaggccgaaataatggcacggcttcaggccgggcagggctctcgcccagagagtactaataattttcattctttgtatgtgaaacgccaccagggagtgtcagtcctctatgctgacatcgtcggcttcaccagactggctagcgaatgttctccaaaggaactcgttctgatgctgaacgagctgttcggaaagtttgaccagatagcaaaagaacacgagtgcatgcgcattaaaatactcggcgattgttactactgcgtgtccggcctcccccttagcctgccagatcacgccattaattgcgtgaggatgggactggatatgtgcagggctatccgaaagctgagggctgcgacgggggtcgatataaacatgcgcgtgggggtccactctgggtctgtgttgtgcggggtgattggcctgcaaaaatggcaatacgatgtctggtcccacgatgttaccctcgcaaatcacatggaagccggtggcgtaccaggccgagtgcacataaccggcgctacattagcactgctggccggcgcttacgcagtcgaggacgcgggcatggaacatcgcgacccatacttacgcgagctgggagaacccacctatttggttatcgatcccagggctgaagaggaggatgagaaaggaaccgccgggggccttctatcatctctggagggactgaagatgcgcccatcactgctgatgacccgttacctggaaagttggggcgcggccaagccctttgcgcatctctctcatggcgactcgccagtgtcaacatccacaccactacctgaaaagaccttagctagtttctctacccaatggtcactggaccgtagcagaacacctcgaggcctagacgacgagctcgacactggagacgccaaatttttccaagtcatcgaacagctgaactcccagaaacagtggaagcaatcgaaagacttcaacccccttactctgtacttcagagagaaagaaatggagaaggagtacagattatcagccattcccgcttttaaatactatgaagcatgcacattcctggtctttttatccaattttattatccaaatgctggtgactaatagacctcctgctctggccataacctacagtatcacttttctgctgtttttactcattctatttgtctgttttagcgaagatctcatgcggtgtgtgctgaaaggccctaagatgctccactggctgccagcattgtcgggcctggtagcgactagacccggtctaagaattgctcttggcaccgcaaccatcctgttggtcttcgcaatggccatcacttcactcttttttttcccgacgagctccgactgcccctttcaggcccccaatgtgagctccatgattagcaacctgtcttgggaactccccggctcccttcctctgatctccgtgccttactccatgcattgctgcacactggggttcttatcctgttccctctttctccacatgtctttcgaacttaaactgcttctcttgttgctctggctcgcagcttcctgttcactgttcctgcatagccacgcttggctcagcgagtgtcttatagttaggttgtacctcggacctctggacagtagacccggagtgctgaaggaacctaagctgatgggggccatctcctttttcattttctttttcaccctgctggttctcgcacggcagaatgaatattactgcagactggactttttgtggaagaagaaactgcgccaggagagagaagagaccgagactatggaaaatctgactcgtctcctcctcgaaaatgtgctgcccgctcacgtggctccacagttcataggacagaataggagaaacgaggacctgtatcaccagtcatatgagtgcgtgtgtgtccttttcgcctcggtccccgatttcaaggagttttactcagagtctaacatcaatcacgaaggtctcgagtgtctacgcctgctgaatgaaatcatcgctgatttcgatgagttgttgtcgaagcctaaattttctggcgtcgaaaagatcaagacaatcggaagcacttatatggccgcaactggtttgaacgccacctctggccaggatgcacagcaggacgcagagagatcttgtagccatctggggacgatggttgagtttgcggtcgcgctgggctccaaactcgacgtgattaataaacattcatttaataacttccggctgcgagtcggtctcaaccatggccctgttgttgctggagttatcggagcccagaaaccccagtatgacatttgggggaatacagtgaacgtagcatcaaggatggagagtaccggtgtccttggtaagattcaggtaacggaggagacagcctgggcactgcagtctctcggctacacatgttattcccgtggggttataaaggtgaaaggtaagggccagctttgcacttactttttgaacacggaccttacacggacaggcccaccatccgctactttgggatag

SEQ ID NO: 178283 - DNA, 1260 bp, Artificial Sequence
  Description of Artificial Sequence: Synthetic coding sequence
atgagccggggcacccgggagagcgcctgctgcatgctgaccagctgggccagccgtggctggccagccagtgtccctctccggagttggtgttcatgtagcatgtctagcctggccagttctacccggctcccccgcaagctgagggccgccacaggcgtcgacatcaacatgcgcgtaggagtgcactccggatctgtcttatgcggtgtgattggcctgcaaaaatggcaatatgacgtgtggtcacacgacgtgacactggccaatcatatggaggcgggaggagtgccaggaagagtacacatcaccggggccaccctggccttgttggctggagcttatgcagtagaggatgccggcatggaacacagagacccttaccttagggagttgggcgaacctacttatctggtgatcgatcctcgcgccgaggaagaggatgagaagggaactgcagggggcctgctgtcgtcactcgagggactgaaaatgaggcccagcctgctgatgactagatatttagagagctggggagctgcaaagcctttcgcccatctgagccacggagacagtcctgtgagtacttcaacccccctgcctgaaaaaacactagcttctttctccacccagtggtccttggatcggagtcggacccccagaggtttggacgacgaacttgatacgggtgatgccaaatttttccaggtaattgaacagctcaactctcagaaacagtggaaacaaagtaaggacttcaatccactgactttgtattttcgggagaaggagatggagaaggaatatagactgtctgccatccccgccttcaagtattatgaagcctgcacctttctggtgttcctctcaaacttcattattcaaatgctggtcacaaatagaccaccggcactcgccattacatatagcattaccttcctcctatttctgctcattctctttgtatgctttagcgaagatctaatgagatgtgttctgaaagggcccaagatgctccactggttacccgcactttctggtctagtggccaccaggccaggcctgaggattgctctgggcactgctacaatcctcctggtgttcgctatggcgattaccagcttgttcttcttcccgacatctagcgactgcccgttccaggctccaaatgtctcttcaatgatttctaatctcagctgggagctgcccggctctctgcctcttataagcgttcccgtgagtgttccaacatgtccgtag

SEQ ID NO: 178284 - DNA, 3234 bp, Artificial Sequence
  Description of Artificial Sequence: Synthetic coding sequence
atggcccggctgttcagcccccggcccccccccagcgaggacctgttctatgagacctattattcactcagccaacagtacccactactactcctgctcctgggcatcgtcctatgtgcattagccgcgcttttggccgtcgcttgggcctccggccgcgagttaaccagcgacccctcttttcttacgactgtgctgtgtgctctaggcggctttagcctgctgttaggattagcgtccagagagcagcgcctgcagagatggactcgccccctaagcggcttagtgtgggtcgcgttactcgccttgggccacgcctttctgtttactgggggtgtcgtttctgcgtgggaccaggtgagttattttctgtttgtgatttttactgcctacgctatgctacctttgggtatgcgcgatgccgccgtggccgggctggccagcagcctctcccacctcctggttttagggctgtacttaggaccacagcctgatagtcggcctgcgctcctcccgcagctggcagccaatgccgtgctgtttttgtgtggtaacgtggcgggcgtttaccacaaggccttgatggagcgcgcgttgagggcgacctttcgcgaggccttgtcctcgctacatagcaggcgccggctagatacagaaaagaagcatcaagaacatcttctcctttccattctgccagcctacctggcaagggagatgaaagcggaaatcatggcccggctgcaggccggccagggctctcgacccgaatccactaataattttcattcactctacgtcaaacgtcaccagggggtttctgtcctctacgcagatatagtcgggttcactcgactcgcatctgagtgctctccaaaagaattagtgctgatgctgaatgagctcttcggcaagttcgatcaaatagcaaaagagcacgagtgcatgcgcattaaaatacttggggactgctactactgtgtgagtgggctccccctcagtctcccagatcacgccattaactgtgtgcggatgggcctggatatgtgcagagcgattcgaaaattgagggccgcgacgggcgtcgatattaatatgcgtgtcggtgtgcattcaggatcagtactgtgcggcgtgatcggattgcagaaatggcagtatgacgtctggtcccacgacgtcactcttgctaatcacatggaggcaggaggggtccctggacgggttcacattactggtgcgaccctggctctgctggcaggtgcctacgccgtcgaggatgctggtatggagcacagggatccctatctgcgggaactcggagaaccgacctatttagtgattgatccacgcgcggaggaggaagacgaaaagggcaccgctggcggactgcttagctcactggagggcttgaagatgagacctagcttgctcatgacaaggtatctggagtcctggggcgccgccaagcctttcgcccatctgtcgcatggagatagccctgtttcgacctccacccctctgccagaaaagaccctggcttctttcagtacgcagtggagccttgatagaagcagaacgcccaggggactggatgacgaactggatactggcgatgctaaatttttccaagtcattgagcagctgaactcccagaagcagtggaaacagtcgaaggactttaaccctctgaccttatacttcagagaaaaagagatggaaaaagaatacagattaagcgcaattcctgcctttaagtactacgaggcctgcaccttcctggtgtttctgagtaatttcattattcagatgctcgttaccaaccgacctcccgcgctcgctatcacttatagcattaccttcctcttatttttgctgatcctgttcgtgtgcttttcggaagacctgatgaggtgtgtgctgaagggccctaaaatgctacactggctgcccgcgctgagcggcctggtggccactcggcctggattaagaatcgcgctcgggaccgcgacaattctgctcgtgtttgcaatggcaatcacatccctcttttttttccctaccagcagcgactgcccgttccaggccccaaacgtgtccagcatgattagcaacctgtcgtgggagttgccagggtccctacctctaatctcagtgccctactcgatgcattgctgtacattggggtttctgagctgtagtctgtttctccatatgtcgttcgagttgaagcttctattattattactgtggctggccgctagctgttctctctttctccactcacacgcctggctgagcgagtgtcttatcgtgcgactgtacctaggccccttagatagccgcccaggagttctcaaggaaccaaaactaatgggcgcaatctctttcttcattttctttttcaccctgcttgtgctggcccggcagaacgagtactactgtcggctagattttctatggaaaaagaaactccgacaggagagagaagagaccgaaaccatggaaaatctcaccaggctgctgctggaaaatgtgctgccagcacatgtggcgccgcagttcatcggacagaataggcggaatgaggacctgtaccaccagagttacgagtgtgtctgcgtactctttgccagcgtccccgactttaaagaattttattccgagtcaaatataaatcatgaaggcctggagtgtctccgactgctcaatgaaatcattgccgacttcgacgaacttctgagtaagcctaaattcagcggggtcgagaagatcaaaaccatcggctccacctacatggccgcaaccggccttaacgcaacgagcggacaggatgcccagcaggacgccgagaggagttgcagccacctcggcaccatggttgagttcgcggtggcactggggagtaaactcgacgtgataaataaacactcctttaacaattttaggctgcgggtcggacttaatcacggcccagtcgtcgctggagtgataggggctcagaagccacagtatgatatttggggaaacactgtgaacgtggcatcgcgcatggagtctaccggagttttgggaaagattcaggtgacagaggagaccgcctgggcactgcagagtctggggtacacctgttacagccgtggggtcatcaaggtgaagggcaaagggcaactttgtacctattttctgaacaccgatctgaccagaaccggcccaccaagcgccaccctgggctag

SEQ ID NO: 178285 - DNA, 3234 bp, Artificial Sequence
  Description of Artificial Sequence: Synthetic coding sequence
atggcccggctgttcagcccccggcccccccccagcgaggacctgttctacgaaacatattatagtctgagtcagcagtatcccttgctgctgctgctgctgggcattgtgctgtgcgctctggctgcattgctggccgtggcatgggcgtccgggagagaattgacatccgatccatccttcctgacaactgtgctgtgcgcgttaggcggcttttctctgctgctggggttagccagtagggaacagcggctgcagagatggacccggccattgtccggcctggtgtgggtcgcccttttggcacttggacacgcttttctcttcaccggaggcgttgtgtccgcttgggatcaggtttcttatttcctttttgtgatctttacagcctacgccatgctgccccttggaatgcgggatgcagctgttgccgggctggcaagcagcttgtctcatctgttagtccttggcctctacctcggtcctcagccagattctcggcccgccctgctgccccagcttgctgctaatgccgtcctctttctgtgtggcaatgtggccggagtgtaccacaaggcactgatggagcgagccctgagagccacattcagagaggccttgagcagtctccattcacgcagaaggctggacaccgaaaagaagcaccaggaacacttgctcctgtcgatcctgcccgcctatctggcccgggagatgaaggcagagatcatggcccgactgcaggccgggcagggcagcaggccagagtcaaccaacaattttcactcactctacgtaaagaggcatcagggcgtgtctgtcctctacgcggacatagtcggctttacacgccttgcctctgagtgttcccctaaggagctcgtgctcatgctgaatgaactcttcgggaaattcgaccaaatcgctaaggaacatgaatgcatgagaatcaaaatcttgggggattgttactattgcgtgtctgggctgcctctgtccctgccagatcacgcaatcaattgcgtgcgcatgggactcgacatgtgtcgcgccatccgcaagctcagagccgccactggggtcgatatcaatatgcgggtgggggtgcactccggcagtgtcttgtgcggagtgattgggttacagaaatggcagtatgacgtatggtcccacgatgtgaccttggctaatcacatggaggccggcggagtgcccggaagggtgcatattaccggggccacactggccctgctagccggagcctacgcggttgaggacgccggcatggagcaccgagatccctatctgagagagctcggggaaccgacttatttggtgatcgatcctagggcagaggaggaggatgagaagggcacggcaggaggtctccttagctctctggaaggcttgaagatgaggcctagtctcctgatgacacgatacttagagagctggggagctgccaaaccgttcgctcatctgtcacatggtgatagccccgtctccacaagcacacccctgccagaaaagactctggcctcattttcgacccagtggagcctggatagaagtcgtacaccaagaggcctggacgacgaactcgataccggcgatgccaagttcttccaggtcattgaacagctgaactcccaaaaacagtggaagcagagcaaagactttaacccattgacgctctactttcgggaaaaagagatggaaaaagaataccggctgtctgcaatccctgctttcaagtactatgaagcatgcaccttcttggtgttcctgtccaatttcattatccagatgctggtgacgaaccggccaccggcgcttgcaattacatacagtattacatttctacttttcctgttgattctatttgtctgtttctcagaggatctgatgcgctgtgtattaaagggtcccaagatgctgcactggcttcctgcgctgtccggtctggtcgcaacgcgacctggattgaggatcgcgctcgggacagccaccatcctcctcgtctttgccatggcaatcacttctttgttttttttcccaactagttcagactgcccatttcaggcaccaaacgtgagtagtatgatcagcaacctgtcttgggagctacctggcagtctaccacttatcagtgtgccctacagcatgcattgctgtacccttggattcctatcatgttcactttttctccacatgtcatttgagctgaagctgctgcttctcctcctttggttggccgcatcctgctctttgttcctgcactcacacgcctggctttcagagtgtctgattgtcaggctgtacttggggccactggattcacgccctggcgtgctgaaggaaccaaaactgatgggcgcaatctctttctttatcttctttttcacactgctggtgctggcccgccagaacgaatactactgccgcctagattttctttggaagaaaaagctgcgccaagagcgcgaagaaaccgaaactatggaaaatctgaccaggttactgctagaaaacgttcttccagcgcacgtggccccacagttcatcgggcagaaccgacgtaatgaggacctgtaccaccagagctacgaatgcgtttgcgttctgttcgccagcgttccagattttaaagagttttactcagaaagtaatattaatcacgaaggcctcgaatgcttgagactgctgaacgagatcattgccgatttcgatgagcttctgagtaagccaaaatttagcggtgtggagaagataaaaacgattggcagcacgtacatggccgctaccggcctcaacgcaacgagcgggcaggatgcccagcaggacgctgagagatcttgcagtcacctgggaacgatggtggaattcgcagtcgcgttgggctccaagcttgatgttatcaataagcacagtttcaataattttcgcctgagggtgggacttaatcacggcccagtggtcgcaggggtgatcggcgcgcaaaaacctcagtacgacatctggggcaacacagtgaacgtggcaagtcggatggaatcaactggggtgcttggtaagattcaagtgacagaagagaccgcctgggcacttcagtcgcttggctacacctgttatagccgcggggtcatcaaagttaagggcaagggccagttgtgcacgtatttcctcaataccgacctgactagaactggaccgcccagcgcaactctgggctag

SEQ ID NO: 178286 - DNA, 348 bp, Artificial Sequence
  Description of Artificial Sequence: Synthetic coding sequence
atggcccggctgttcagcccccggcccccccccagcgaggacctgttctacgagacctattatagcttgtcccagcaataccctttgctactcctgctgctggggattgttctgtgcgcactggccgccttgcttgcagtggcatgggcctccggaagggagctaactagcgaccctagttttctgactaccgtgctgtgtgcccttggggggtttagcttgttgctcggcctcgcgtcccgggaacaaaggctgcagagatggaccaggcccctgtccgggttagtgtgggtggcccttctggctcttggccacgcctttctctttacaggaggcgttgtatcttag

SEQ ID NO: 178287 - DNA, 2736 bp, Artificial Sequence
  Description of Artificial Sequence: Synthetic coding sequence
atgaagagccagaaggagggctgctgcagccggggcgacctgagcattcaaaccggcccaggaggggagtgggctcctagacgacttgtcagcaacgtgctgatttttagctgcactaatatagtcggggtgtgcacccattaccctgcagaagtctcacagcggcaagcgttccaggagaccagagagtgtattcaagccaggctgcacagccagagagaaaaccaacaacaggaacggcttctactgtccgtgttgcctcgccacgtggctatggaaatgaaagctgatatcaatgccaaacaagaagatatgatgtttcacaaaatctacatccagaagcacgacaacgtgtcaattcttttcgcagacatcgaggggttcacttccttggcatctcaatgcactgcccaggagctcgtgatgacgttaaatgagctgttcgccaggttcgataagctcgctgctgagaatcattgccttaggattaagatcttgggagactgctactactgtgtctcaggccttccagaagctagggcggatcacgcccattgctgtgtggagatgggcatggacatgattgaggccatttctttggtgcgggaggtgaccggcgtgaacgtgaatatgcgggtgggaatacacagtggacgcgtccactgcggagtactcgggttgagaaagtggcaattcgatgtctggtccaacgacgtgactctcgctaaccacatggaagcgggaggaaaggctggacgcatccacatcactaaggcaactttgaactacctcaatggagactacgaggtcgaacctggatgcgggggtgaacgaaacgcttatctgaaggaacattcaatcgaaaccttcctgattctgcgctgcactcagaaacggaaggaggagaaagcgatgatagccaaaatgaaccgtcaaagaaccaattccatcggacataacccccctcattggggagccgagagacctttctacaaccatctagggggaaatcaggtgagcaaggagatgaagcgcatgggctttgaggatcccaaagacaaaaacgctcaggaatctgcaaacccggaagacgaggtggatgaatttctcggtagggccattgacgctaggtctatagacagactgagaagcgaacatgtgaggaaattcctcctaactttcagagaacccgatctggaaaagaagtacagtaagcaggtcgacgaccggtttggcgcttatgtggcatgcgctagtctggtcttcctgttcatatgtttcgtccagattacaatcgtgcctcacagcatcttcatgctctctttctatttgacttgttcattattattaaccctcgttgtgtttgtttcagtcatctactcctgtgtaaaactgtttccttccccactccagaccctgagccgtaagattgtgcgatccaagatgaacagcaccctcgtaggggtgtttaccataacactcgtcttcctggcagctttcgtgaatatgtttacctgcaacagtagagatctacttggatgcctggcccaggaacacaatattagcgcctcccaggtgaacgcgtgtcatgttgcagaaagcgccgtgaattactccctcggagatgaacagggcttttgcggcagcccttggcctaattgtaacttcccagaatacttcacctactccgttctgctcagtttactcgcctgttctgtgtttttacaaatctcctgtatcgggaaacttgtgctaatgctggctatcgagctgatctatgtactgatcgttgaggtgccaggcgttacgctctttgataacgcggacctgctggtcaccgctaacgccattgatttcttcaataatggtacatcccagtgtcccgagcacgcaaccaaggtggcgctcaaggtagtgacccccatcattatctctgtgtttgtgctcgccctctacctgcacgcacagcaggtggaatctaccgcaagacttgacttcctgtggaaactgcaagcaaccgaagagaaggaggagatggaagaactgcaggcatataatcggcgactcctccacaacatcctccctaaagatgtggctgcccactttttggctcgcgagcgaagaaacgatgagctgtactaccagtcctgcgagtgtgtggcagtgatgttcgcatcaattgctaatttcagtgaattctacgttgaactggaggctaataatgagggagtggaatgcttgcgactattaaatgaaattatagcggacttcgacgaaatcatttccgaggacaggttccgccagctcgagaaaattaagaccatcggctccacatatatggccgccagcggattgaacgactccacatacgacaaggttgggaagacacacattaaagcattagcagattttgcaatgaaattgatggatcaaatgaagtatataaatgagcactcatttaacaattttcaaatgaagattggcctgaacatcggccctgtggtcgctggcgtaataggggctcgcaaacctcagtacgatatttgggggaacacagtcaacgtggcgtctcggatggacagtacaggcgtgcctgaccgaattcaggtaacaacagatatgtaccaagtgctcgcagcaaatacatatcagctggagtgccgcggggtggtaaaagtgaagggcaaaggcgaaatgatgacctatttcctcaacgggggccctccactgagctag

SEQ ID NO: 178288 - DNA, 3786 bp, Artificial Sequence
  Description of Artificial Sequence: Synthetic coding sequence
atgagcggcagcaagagcgtgagcccccccggctacgccgcccagaagaccgccgcacccgcgccgcgggggggccccgaacaccggtctgcatggggtgaagctgattcacgagcaaacgggtacccccacgcaccaggtggctccgcccggggctcgacaaagaagccgggtggagccgtgaccccacagcagcagcagaggctcgcaagtcgatggagatccgatgacgatgacgacccaccactgtctggcgacgacccactcgccgggggctttggattctcttttaggagtaagtctgcttggcaggagagaggcggggatgactgcggaaggggctcccgaaggcagcgtaggggagcagcaagcggcggatccaccagggccccacctgccgggggaggcgggggttctgctgccgcagctgcgtctgctggaggaaccgaggttaggccccgctcagtcgaggtcggcttagaagaaaggcggggcaagggacgcgctgcagatgagctggaggccggagcagtagaaggaggtgagggaagcggcgacgggggcagttccgccgatagcggttccggagcgggccccggtgccgtgttgtcgctgggagcatgctgcctggctttactccagatcttcagatcaaagaaatttcccagtgataagctggagagattgtatcaaaggtattttttccgattgaaccagtctagtttgaccatgctcatggccgtgctagtgctcgtgtgcctagtcatgttggcattccacgccgcaaggccgccattacagttgccctacttagccgtgctcgcggcggccgtcggcgtgattctgataatggcagtgctgtgtaatcgagcagccttccaccaagaccatatgggactggcttgctatgctctgatcgctgtggtactggccgtccaggtcgtgggccttctcctgccacagcctaggagcgcttcagagggcatctggtggacagttttctttatctacactatctacaccctgctgccagttaggatgcgggccgcagtgctgtccggtgtgctgctgtccgcactgcacctcgccattgccctcagaactaatgcccaggatcaatttttgttaaagcagttggtttccaacgtactgattttcagctgcaccaatattgtgggggtgtgtactcattacccagctgaggtatcacaacgtcaggccttccaagagacccgagagtgcatccaggctcgattgcactcccagagagagaaccagcaacaggagcggctgttgctcagcgtgctccctcggcatgtggctatggagatgaaagccgacatcaacgccaagcaagaggacatgatgtttcataagatctatatccaaaagcatgataatgtgtcgatcctgttcgctgacattgaaggcttcacatccctcgctagccaatgcacagcccaggagttggtcatgaccctgaacgaactattcgcacggttcgataaacttgccgccgaaaatcattgtttgaggatcaagatcctgggagattgttactactgcgtatctgggcttcccgaggcgcgggccgaccatgcacattgctgcgttgaaatgggaatggatatgattgaggctataagcctggtgcgagaggtgaccggcgtgaacgtcaacatgcgagtggggatccatagtggtcgggtgcattgcggcgtgctgggtttgagaaaatggcagttcgatgtgtggtcaaacgacgtgaccctagccaatcacatggaggctggcggtaaagctgggaggatccacatcaccaaagcgacacttaattacctgaatggggattacgaggtcgaacctggatgtggcggggaacgcaatgcctacctaaaggagcactcaatcgaaacattcctgatcctccgctgtacccagaaaagaaaggaggagaaagccatgatcgcaaaaatgaacagacagcgtactaacagcatcggtcataaccctccgcactggggggctgagcgcccgttctataaccatctgggcggaaatcaagtgtctaaagaaatgaagcgaatgggctttgaggatcccaaggacaaaaatgcccaggagtcagcaaatcccgaagacgaggttgacgagttcttaggaagagccattgacgctagaagcattgaccgcctgaggtctgagcacgtacgcaagttcctcttgacgttcagggagccagatctagagaagaaatattccaaacaagtcgatgatagattcggcgcgtacgtggcctgcgcgtctctggtgttccttttcatttgctttgttcagattaccatcgtaccacattccattttcatgctgtccttctatctgacatgcagtttgctgctgaccctggtcgtctttgtttccgtcatctactcatgcgttaagctatttcctagccccctgcagaccctgtctcgcaagatcgtgcgatcaaagatgaattccaccctggtgggcgtcttcacaattacactggtgttccttgcggcatttgtcaacatgtttacttgcaatagccgcgatcttctggggtgtctggcccaagaacataatatcagcgcctcacaagtcaatgcctgtcatgttgcagagtccgctgttaactacagcctgggcgacgagcagggcttttgtggctctccctggcccaactgcaatttcccagagtacttcacttacagcgtgctgctgtcactactggcgtgcagcgtgttcctgcagattagctgcattggtaaactagtcctgatgttagcaatcgagctgatctacgtgcttatcgtggaggtcccgggcgtgacattgttcgataatgccgacctgctggtgacggctaacgcgatagatttttttaacaatggaacatcccaatgcccagagcatgcaactaaagtggcactaaaagtggtgacgccaattattataagcgtgttcgtgctggcgttatatctgcatgcccaacaggtggagtctactgcgcgcctggattttctgtggaagttacaggcgacagaagaaaaggaagagatggaagagctgcaggcttataataggaggctgctgcacaacatattgccaaaggacgttgccgcccactttctggcccgcgagcgccggaacgacgagctatattaccagtcctgcgagtgtgtagcagttatgttcgccagtattgccaatttcagtgaattctacgtggagttggaggccaataatgagggtgtggaatgcctgagactcctaaacgagatcatcgcagactttgacgaaattatttcggaggaccggttccggcaacttgaaaagatcaagacgataggatcgacctacatggctgctagcggtctgaacgacagcacatatgataaggtcgggaaaacacacattaaagctctagctgatttcgccatgaagctgatggatcagatgaagtacattaacgaacacagcttcaataactttcagatgaaaattggcctgaatatcggccccgtcgtggccggtgtgattggggctcggaagcctcaatatgacatttggggaaacaccgttaacgtggcttctcgcatggattccactggggtccctgataggattcaggtgacaacagatatgtaccaggtactggccgcaaatacctaccaattagagtgtaggggagtcgtaaaggttaaaggaaagggcgaaatgatgacctattttctgaacggaggtccccccctgtcctag

SEQ ID NO: 178289 - DNA, 2760 bp, Artificial Sequence
  Description of Artificial Sequence: Synthetic coding sequence
atggcccccagccggttccggacccagctggagctggtgagcaacgtactcatctttagctgcacaaacatcgtcggcgtgtgtacacattaccctgcagaggtttcccagcggcaagcctttcaggagacccgggagtgcattcaggctcgcctgcactctcagcgggagaatcagcagcaagagcgccttctgttatcagtgctgcctcgacacgtggctatggagatgaaggctgacatcaatgccaaacaggaagatatgatgtttcataagatctatatccaaaaacacgataacgtgagcattttgtttgcagacatcgagggtttcacttcacttgcatcgcagtgcaccgctcaggagctcgtgatgacccttaatgagttgttcgcacgatttgataagctggcagcagagaatcattgcctgcggatcaaaatcctaggtgattgctactactgcgttagtggtctgccggaggcccgagccgatcacgcccattgctgcgtggaaatgggcatggacatgattgaagccatatccctggtgagagaggttaccggcgttaacgtaaacatgagagtcggcattcattctggccgggtgcactgtggcgttttgggactgcgtaaatggcagtttgatgtttggagtaatgatgtgacactggccaaccacatggaggcaggtggaaaagctggccggatccatatcactaaagccacgctcaattatttgaacggggattacgaagttgagcccggttgcggcggagagcggaacgcctacctgaaggagcactctattgagacatttcttatactccggtgcactcagaagagaaaagaggaaaaagccatgattgcaaagatgaaccggcagcgaactaatagtatcggtcataacccccctcattggggagccgagcggcccttctacaaccatttaggcggtaaccaggtgagtaaggagatgaaaaggatgggctttgaagacccaaaagataagaatgcacaagagagcgctaatcctgaagacgaagttgacgagttcttggggcgagccattgatgctaggagcatcgacaggctgcgcagtgaacatgtcagaaagttcctgttgacattcagagaaccggacctagaaaaaaaatattctaagcaggtagatgatcgatttggggcatatgtcgcctgcgcctcccttgtgttcctctttatatgcttcgtgcagattacgatcgtgccacatagtatatttatgctgagtttttaccttacctgctccctgctcctcacactggtggtgttcgtgagtgttatctactcatgcgtcaagttattcccctctcctcttcagacactctccaggaagatcgttcgcagcaaaatgaattcaacccttgtgggagtattcactatcacactggtttttcttgctgcattcgtgaacatgtttacctgcaactccagggacctccttgggtgccttgctcaggaacacaatatttcagctagccaagtaaacgcctgccatgtggctgaaagcgccgtgaactattctctaggcgatgaacagggattctgtggttccccttggcccaattgcaattttcctgagtacttcacctatagtgtgctgctgagtctcctggcttgcagcgttttcctgcagatatcatgtattgggaaactcgtactgatgctggccattgaactaatttatgtcctgatagtcgaggtgccgggcgtgaccctgtttgacaacgccgacctgctcgtgactgccaatgccatcgacttcttcaacaatggaacgtcccagtggtccctatgcgaaaacctgcgccacaggcgaatggaagctggtacatacttccctagcggtgtcaaggaacaaagtccagagcacgctaccaaagtggcattgaaagtagtgactcccattattataagtgtgttcgtgttggccctttacctgcacgcccagcaggtagagtcgaccgctagactcgattttttgtggaaactccaggcaactgaagagaaggaagagatggaagaactgcaggcctataaccgaaggttactgcacaacattcttcctaaggatgtggccgcgcatttcctcgcacgggagcgcaggaacgacgagctgtattaccagtcgtgtgagtgcgtagccgtaatgtttgcgagtattgccaatttctcagaattttacgtggagcttgaggcgaataatgaaggggttgagtgccttcgattgttaaatgagatcatagctgattttgatgagattatatcagaagacagatttcgccagctggaaaagataaaaaccatcggctcgacctatatggccgcatctggtctgaacgactcaacctatgataaggtgggcaagacacacatcaaagctctggcggattttgctatgaagctcatggatcagatgaagtatataaacgaacactctttcaacaacttccagatgaaaatcggcttgaatataggcccagtggtcgccggggtgatcggtgctcgcaaacctcagtacgacatctgggggaatacagttaacgtggcgtccaggatggattccacgggggtcccagatcggatacaggtgactactgacatgtatcaggtcctggcagccaacacctaccagctcgagtgcagaggagtggttaaagtgaaaggcaaaggggagatgatgacttactttctcaacggagggccaccactcagttag

SEQ ID NO: 178290 - DNA, 3507 bp, Artificial Sequence
  Description of Artificial Sequence: Synthetic coding sequence
atgagctggttcagcggcctgctggtgcccaaggtggacgagcggaaaactgcctggggcgaacggaatggacagaagcgttcacgcagacgggggacgcgcgctggcggcttctgtactccacgatacatgagctgtctccgggacgctgagccgcccagtcctacaccggccggcccgcctaggtgtccatggcaagacgacgccttcatccggcgtgggggccctggcaaaggcaaggaactgggcctgcgcgccgtggccctcggattcgaggacaccgaagtgactactacagccggaggcacagccgaggtcgcgccagatgcagtgccacgctccggacgatcctgttggagaaggttagttcaagtgtttcagtccaagcagtttaggtctgcaaagctcgagcgcctgtatcaaagatacttcttccagatgaaccagtcctcactgaccttactaatggccgttctggtcctgcttaccgctgtgctgttagcctttcatgcggctcctgcccggccacagcccgcatacgtggccctgttagcatgcgctgccgccttatttgtgggcctgatggtcgtctgtaaccgccactcatttaggcaggactccatgtgggtcgttagctacgtggttttgggtatacttgcagcagtccaggtgggcggtgcgttggccgcagatcctcgcagtccctctgctggcctttggtgcccagtattttttgtgtacattgcctatactctactgcctatccggatgcgcgcagccgtcctcagcgggctcgggctgagcacactgcatctgattctcgcttggcaactgaaccggggggatgcgtttctgtggaaacaattgggtgctaacgttttgcttttcctgtgcaccaatgtaattggaatctgtacccactaccccgccgaagtatcgcagcggcaggcattccaggagacccgcgggtacattcaggcccgcctgcatttacagcacgagaatcggcaacaggagagattgcttttgtccgtcctgccacagcatgtcgccatggagatgaaggaggatattaataccaaaaaggaggatatgatgttccacaaaatatacattcagaaacatgataacgtgagcatccttttcgcagatatcgaggggttcaccagtcttgcttcccaatgcacagcacaggagcttgtgatgaccctgaatgagctttttgcccgctttgacaaacttgcagcagaaaatcactgtctgcggataaagatcctcggcgactgctattattgtgtcagcggccttccagaggcaagagctgaccatgcccactgctgcgtggaaatgggcgtggacatgattgaggcaatttccctggtccgcgaagtaactggggtgaatgtgaacatgcgcgttggaatccactccggccgggtccactgtggagttctcgggctcagaaagtggcagttcgatgtgtggtctaacgatgtgactctggccaaccatatggaggcaggaggccgagcaggacgcatccacatcacccgagcgacactgcagtatctgaacggcgattacgaagtggaacctgggcgtgggggcgagcgtaatgcctacctgaaagagcaacatattgagacattcctgattcttggagcgtctcagaagaggaaagaagagaaggctatgctggcaaaactccagagaaccagggctaattctatggagggtctgatgccccggtgggtcccggaccgggcattcagccgcacaaaggattctaaggcatttagacagatgggcatagacgattccagcaaggacaatagaggcacacaggatgctctaaaccctgaggacgaggtggatgagtttctctcccgagccatcgacgcacgatcgatagatcagttaagaaaggatcatgtaaggcgcttcctgctgacatttcagcgcgaggatttagagaagaagtacagcagaaaggttgaccctaggttcggtgcttatgttgcgtgtgccctccttgttttctgcttcatatgctttatccaacttttaattttcccccattcaaccttgatgttgggcatttatgcaagtatcttcctgttactgctgattactgtcctgatttgtgcggtctatagctgtggatctctcttccccaaggcactccagaggctctcgcggagtattgtgagatccagagcacattcgacagctgtagggatcttctccgttctgcttgtgtttaccagtgctatagcaaacatgttcacttgcaatcatactcctatccgatcgtgcgctgctcggatgctgaacttgaccccagcagacatcacggcctgtcatctgcaacagcttaattatagcctgggtttggatgcccctctctgcgaggggaccatgccaacctgctcgtttccagagtacttcatcggaaacatgctgcttagcttactagcaagctccgtcttccttcatatttcaagtatcggcaagctggccatgatctttgtcctggggctgatctacctggtgctgctgttgctcggtccgccagctacaatcttcgacaactatgatttgctgctgggcgtgcatggcctggcaagttccaatgaaacattcgatggactggattgtcccgcggccggaagggtcgccttgaaatacatgacccctgttatattattagtgttcgctctggccttataccttcatgcccaacaagtggaatctactgcccgtctggatttcctctggaagctccaagccacgggtgaaaaggaggaaatggaggagctccaggcgtacaataggcgcctcctgcacaacatcctgccaaaggacgttgctgctcacttcctggcgagagaacgtaggaatgacgaactttactatcagagctgtgagtgcgttgccgtgatgttcgcctcaatcgctaactttagcgagttttacgttgagttggaggcgaataacgagggtgtggagtgtctgcgcctactcaacgagatcatagcagatttcgatgagattataagcgaggagcggttccgtcagttggagaagataaaaaccatcggatctacctacatggcggctagtggcttgaacgcaagtacatacgaccaggtaggaagatctcatatcactgcactggccgactatgctatgcggctgatggagcagatgaaacatattaacgaacattcattcaataactttcagatgaaaatcgggttaaatatgggtcctgtcgtggccggcgtgatcggtgcacgaaaaccacagtatgatatatggggaaatacggtgaacgtgtcgtcccgcatggattctaccggggtccctgatcggatacaggtaacaacagacctttaccaagtgttagcggccaagggctaccagctagagtgcaggggagtcgtgaaagtgaaggggaagggggagatgaccacttatttcctgaatggcggcccatcctcctag

SEQ ID NO: 178291 - DNA, 3348 bp, Artificial Sequence
  Description of Artificial Sequence: Synthetic coding sequence
atgagctggttcagcggcctgctggtgcccaaggtggacgagcggaaaaccgcatggggagagaggaacggacagaaaaggtctaggagacgtggaacgcgcgcaggtggcttctgtacaccacgctacatgtcttgcctccgcgacgcagaacccccttcaccaacccccgccggcccgccacgctgtccttggcaggacgacgcattcatcaggagaggcggacctggcaaagggaaggagctgggcctgcgtgcagtggccctggggttcgaagatactgaagtgacaaccaccgcaggaggaacggccgaagtagcacctgacgccgttcctcgcagtggccgctcgtgctggcggagactggtgcaggtgtttcagtcgaaacagtttcggtctgctaagctggagcggctgtaccagagatacttcttccagatgaatcagagttccttgaccctgttgatggccgtgctggttctgttgacagccgtgttgctggcgttccacgcagcccctgcgagaccacaacccgcatatgtggctctgttggcatgcgccgccgcattgtttgtagggcttatggttgtttgcaataggcacagtttccggcaggattccatgtgggtggtgagttacgtggttctgggaattctggcagccgttcaagtgggaggggccttggctgccgatccacgatcccccagtgcggggctatggtgccctgtctttttcgtttacattgcctatactttgctgcctataagaatgagggccgcagtgcttagtgggctgggtctttcaacattacacctgattctggcctggcagctcaataggggagacgctttcctctggaagcaacttggagcgaacgtccttctgttcctttgtacgaatgttatagggatttgtactcactatcccgcagaggtttcccagaggcaagcctttcaagaaacccgaggttatatacaagcacggctgcacctgcagcacgagaataggcaacaggaaaggctgttgctctccgtgctcccacagcatgtggctatggagatgaaggaggacattaacaccaaaaaagaagacatgatgtttcacaaaatctatatacagaaacatgacaatgtcagcattctgttcgcagacattgaaggctttacttcacttgcctcccagtgtacagcccaagagcttgtcatgaccctgaacgagctcttcgcccgattcgacaagctcgcagcggaaaaccattgtctgaggattaagatcctgggcgattgttactactgtgtctcgggcctacctgaggccagggccgaccacgcccattgctgtgttgaaatgggggttgatatgattgaagccatcagcctcgttcgggaagttaccggagttaatgttaacatgcgggtgggaatacatagcggacgggtgcactgtggagtgttgggcttgaggaagtggcagtttgatgtttggtccaacgacgtcactctggcaaatcatatggaggctgggggcagagccggccgaatccacatcacccgcgctacgctgcagtacctgaacggagactacgaggtggagcccggccgcggtggcgaaaggaatgcttatctcaaggaacagcatatcgagacctttcttattcttggagcaagtcagaagagaaaagaggaaaaggctatgcttgcgaagcttcagcggacacgggccaattcaatggaggggctcatgcccagatgggtgccagacagagcgttctcacgaaccaaagactctaaggcatttagacaaatggggatcgacgactcatcaaaggataataggggaacccaggatgctctgaaccctgaggatgaggtggacgaattcctgtctcgagccattgatgcccggtctatagaccaactccgcaaggatcacgtgagaaggttcttactgactttccagagggaggatctcgaaaagaaatactccaggaaggtcgatcctcgttttggcgcgtatgtcgcctgtgcactcctggtgttctgcttcatttgctttattcagctccttatcttccctcacagcacacttatgttagggatttatgccagcattttcttgctgcttcttattaccgtgctgatatgcgcagtctattcttgtggaagcctcttccctaaagcgctccaacggctgagtcgcagtatagtcagatctcgtgctcacagcaccgctgtggggattttttccgtgctacttgtgtttacaagtgctattgctaacatgtatttcatcgggaacatgctgctctccctgctggccagttccgtgttccttcatatcagtagcattggcaaacttgcaatgatctttgtgttgggactcatctatttagtgcttcttttactgggcccacctgccaccatcttcgacaattacgatctcctgctcggtgtgcatggactcgcttcttccaatgaaacttttgacggacttgattgccctgctgccggaagagtggctctcaagtatatgacgcctgtgatactgcttgtattcgctttggcattatacctacatgcacagcaggtggagagcaccgcccgcttagactttctctggaagctgcaggcaacgggagagaaggaggaaatggaagaactgcaggcgtataatcgccgtctcctacacaatatactccccaaagatgttgctgcacattttctggcccgcgagaggagaaacgacgagctgtattatcagtcgtgtgagtgtgttgccgtgatgtttgcctctatcgcgaatttctcagaattctacgtagagctggaggcgaacaatgagggcgtcgagtgtctgagactcctgaacgagataattgccgacttcgacgagattatcagcgaggagagatttcgacagctggagaagataaaaaccattggtagtacgtatatggccgcttcgggtcttaatgctagtacatatgaccaggtgggaagatctcatataacagcactggctgactacgctatgcgcctaatggagcagatgaagcatatcaatgagcattcattcaataacttccagatgaagattgggctcaacatggggcctgtggtagctggggtgattggggccaggaaaccacaatatgacatctggggcaataccgtgaatgtcagcagccgaatggactccactggcgtcccagacagaatccaggttactaccgacttataccaagtgctagcagccaagggataccagctggagtgtagaggcgtggtgaaagttaaaggtaagggggagatgacgacctatttcctgaatggggggccaagctcttag

SEQ ID NO: 178292 - DNA, 3348 bp, Artificial Sequence
  Description of Artificial Sequence: Synthetic coding sequence
atgagctggttcagcggcctgctggtgcccaaggtggacgagcggaagaccgcatggggtgagcgaaacggccagaaacgttcaaggaggcggggaaccagggccggtggtttttgtacacctcgttatatgtcctgtctgagggatgctgaaccaccttcaccgactccagctgggccgccccgctgtccatggcaggacgatgcctttattaggcggggcggcccagggaaaggcaaagagctgggcctaagggccgtcgccctgggtttcgaagacaccgaggtaactaccactgcaggagggaccgccgaagtcgctccagatgccgttcctcggagtggacgctcttgttggcggcgtttggtccaggtgttccagagcaagcaatttaggagtgccaaactcgaacgactctaccaaaggtacttttttcaaatgaatcagtccagtcttaccctgctgatggcagttctggtcttgctgactgctgtgcttctggcattccatgccgctccagccaggccacagccggcatacgtggctctgctggcatgcgcagctgccctgttcgtcgggctgatggtggtgtgcaatcggcattcctttaggcaggatagcatgtgggttgtctcctatgtggtgctaggaattttagccgctgtgcaagtcggaggagccctggcagctgacccccgatcacccagcgctggcttgtggtgtccagttttttttgtatacatagcttacaccctattgcccatacgcatgcgggccgcagtgttgtcaggtctggggctgtctacacttcaccttattttagcttggcaactcaatcggggcgatgcattcctatggaagcagctaggcgcgaatgtcctgttgttcctgtgcactaatgtcatcggaatttgcactcactaccctgctgaagtctctcagagacaggccttccaggagacgagggggtatattcaggcgcgtttgcatctacagcacgaaaaccgacaacaggagcgtcttctgttgtcagtgttgccccagcacgtcgcgatggaaatgaaggaagatatcaacaccaaaaaagaagatatgatgttccacaaaatatatatccaaaagcacgataacgtgtccattctgttcgcagacatcgagggttttacctccctggccagccagtgcaccgcccaggagctggttatgacactaaatgaattgttcgcaaggttcgataagctggcagcggaaaaccactgtctgaggattaaaatactgggagactgctattactgcgtgtcaggtttgccggaagcacgggctgatcatgcccattgctgtgtggagatgggcgtggatatgatcgaagcaatttccctagtaagagaggttactggagtaaatgtcaacatgcgtgtagggatacacagtggaagagtacactgcggcgtgctgggcctgcgcaagtggcagttcgatgtgtggtcgaacgacgttactctggccaaccatatggaggctggtgggcgggcagggcgcatccatataactagggcaacactccaataccttaacggtgattatgaggtggaaccaggaaggggtggcgaacgtaacgcctaccttaaggaacagcatattgaaacatttctgattctgggagcttcccaaaaaagaaaggaggaaaaagccatgctggctaagttacagaggacccgtgctaattccatggagggcctcatgccacgctgggtccccgatcgagccttctcccgcactaaagattccaaggcattccgccagatgggtatcgacgacagtagtaaggacaatcggggcactcaggacgccttgaatcctgaggacgaagtggatgaatttttgagccgtgcgatcgatgcgcggtcaatcgaccagctacgcaaagaccacgtccggcgattcttgctgacattccagcgggaagacctggaaaagaaatattctagaaaagtggatccccggtttggggcatacgtggcctgcgcactgctggtgttctgcttcatctgctttatccagttgctgatcttcccccactcaacgctgatgctgggtatctacgcctccattttcctgttgttgctcattactgtgttaatttgcgcagtgtactcatgtgggtcactttttcctaaagcactacaacggctatcccggagcatagtgcggagtcgagcccattctaccgcagtgggaatattctccgttctcctggtctttacaagtgctatagctaacatgtactttatcggcaacatgctgttgtctctgctcgcatcgagcgtgttcctacacatctccagcattgggaaacttgctatgatttttgtactcggactgatatatctggtgcttttactcctgggtcctccagccaccatattcgacaattacgaccttctcctgggtgtacacggactcgccagcagtaacgaaacttttgacggcctcgactgcccagctgcaggccgggtggctctgaaatacatgacaccggttatactgcttgtgttcgcattagccctgtaccttcatgcccagcaagtggagtccacagctcggctggattttctgtggaaattgcaggccacgggcgaaaaggaagagatggaagaattgcaggcttacaacaggaggctgctgcacaatatcctgccaaaggacgtggccgcccattttctggcgcgggaacggcggaatgacgaactgtactatcagtcatgcgaatgcgtggcagttatgttcgcctctattgccaacttctccgaattttacgtcgaattagaagcaaataacgaaggagtggagtgcttgcggctcctgaatgagattatcgccgattttgatgaaatcatttccgaggaacgcttccgtcagctcgagaagatcaagacaattggttcaacttacatggcagcctctggcctaaatgctagcacatatgatcaggtgggacgtagccacattacagcactagccgattacgccatgaggctcatggagcagatgaagcacatcaatgagcacagtttcaacaactttcaaatgaagatagggctgaatatgggtcccgtggtagctggggtgatcggcgcccgtaaaccacaatatgatatatgggggaataccgtaaatgtgtccagccgtatggactcaactggcgtgcctgaccgtatccaggtcaccaccgatctataccaggttcttgccgcaaaggggtatcaactcgaatgtcgcggagtggttaaagtcaaaggaaagggagagatgacgacctacttcctgaatggaggaccatcgagttag

SEQ ID NO: 178293 - DNA, 3243 bp, Artificial Sequence
  Description of Artificial Sequence: Synthetic coding sequence
atgcccgccaagggccggtacttcctgaacgagggcgaggagggcccagaccaggacgctttgtatgagaaatatcagttgacttcacagcatggacccctgcttctgacactcctgctagtggctgccacggcctgcgtcgcactgattataatcgcattctctcaaggtgatccatcacgccaccaggccattctcgggatggcatttctcgtgttggctgtctttgcagcactgagtgtgcttatgtatgtcgagtgcctgctcagacgctggttgagagcactcgcgctgcttacatgggcttgcctcgtcgccctcggatacgttctcgtttttgatgcctggactaaggcagcctgcgcgtgggagcaagttccgttcttcctgtttattgtctttgtcgtatacacgttgcttcccttctccatgagaggcgccgtggcagttggggccgtgtctacagccagccacctgctggtgctcggctctttgatgggcggattcacgacccccagcgtaagagtaggtcttcaactgcttgccaacgcagtgatattcctgtgtggtaacctgaccggcgccttccacaagcaccagatgcaagatgcgtctagagatctatttacatatacagttaaatgtatccagattaggcgaaaactaaggatcgaaaagcgccaacaggagaatctgctgctgagcgttctacctgcgcatattagtatgggcatgaagcttgctataatcgagaggctgaaagagcacggtgataggcggtgtatgccggataataacttccacagtctttatgttaaacgacaccagaatgtcagcattctgtatgctgatatcgtgggcttcactcagttagctagcgattgttctccaaaagagcttgtcgtggtcctgaatgaactcttcggcaaattcgaccaaattgcgaaagccaatgaatgcatgcgcatcaaaatcctcggtgattgttattactgcgtttccggactgcctgtgtctctgccaactcatgctcgaaattgtgttaagatgggacttgatatgtgtcaggcaattaaacaagtccgagaagcgactggagtcgatataaacatgagggtcggtattcacagcggaaatgtcctgtgtggcgtgattggcctccgtaagtggcaatatgacgtgtggtcacatgatgtgagtcttgccaaccgcatggaagctgctggtgttcctggtcgggtgcacattaccgaggctacccttaagcacctggacaaggcttatgaggttgaggacgggcacggtcagcagcgagatccgtacctcaaagaaatgaatatcaggacctatctcgttattgatccgcgctcacaacagccaccgccaccatctcagcacctgccccggcccaagggggatgccgccttgaaaatgcgggcctccgtccggatgactcgctacctagagtcctggggcgcagcacgcccctttgcccacttgaatcaccgagaatctgtttctagcggagaaactcacgttccaaatggccggcgacccaagtccgttccccagcgccatcgcaggactccagatcgaagcatgagtcctaagggcaggtcagaagacgacagctatgacgatgaaatgctgagcgctatcgaagggttgtcaagcacccgaccctgttgtagtaagtccgacgatttctatacattcgggtcgatatttctggagaagggctttgaaagagaatacaggctcgccccaataccacgcgcccgccatgattttgcgtgtgcctctctgatctttgtctgtattctattggtgcacgttctgctgatgccacggacagccgcgctaggggtctcatttggcctggtcgcgtgtgtcttaggcctggtgctcggcctctgctttgccactaaattctcacgttgttgtcccgcacgtggcacattatgtacaatcagtgagcgtgtcgagactcagcccctgctcaggttaactctcgctgtactgacaataggttctctgttaacagtcgcaataattaatctgccactcatgccatttcaagtgccagaacttccggtgggtaatgagaccggcctgctcgctgccagctccaagactagagccttgtgtgagcctttaccctactacacctgcagctgtgtcctggggtttatcgcctgttccgtgtttcttagaatgagcctagaaccaaaggtggttttactgacagtggctcttgtggcctatctcgtcctgtttaatctgtctccttgttggcaatgggattgttgtggccagggactgggcaacctaaccaagccgaatggcaccacctccggtaccccctcatgctcttggaaggatctgaaaaccatgacaaacttttacctcgtgctgttttatatcactttgctgacactaagccgacagatagattactactgccgcctcgattgtttgtggaagaagaaattcaagaaggaacacgaagagtttgagaccatggagaacgttaaccgactcctcctggagaacgtgctgccagcccacgtggccgcccactttatcggggacaagctaaacgaagactggtatcaccaaagttatgactgcgtgtgtgtcatgttcgcctccgtcccagattttaaggtattttatacagagtgtgacgtgaacaaggagggtctggaatgcctgcgtctgttaaatgagattatcgctgactttgatgaattgctgctgaagcccaaatttagcggagtcgagaaaatcaagacgatcggctccacatacatggcggccgcagggctctccgtcgcctccggccatgaaaaccaggagcttgaaagacagcacgctcacatcggcgtgatggtggagttttctatcgctctcatgtcaaaacttgacggtatcaaccgtcacagttttaactcctttcgactgcgggtgggaatcaatcatggtccagtcatagcgggtgttattggcgctcgtaaacctcagtacgacatatggggcaacactgtgaatgttgcttcacgcatggagtccactggagagttaggcaaaatccaggttaccgaagagacatgtaccattctccagggcctcggctacagctgtgagtgcagaggacttataaacgtcaagggtaagggagagttgcgtacctatttcgtgtgtacagataccgcaaaatttcaaggcctggggctgaactag

SEQ ID NO: 178294 - DNA, 3243 bp, Artificial Sequence
  Description of Artificial Sequence: Synthetic coding sequence
atgcccgccaagggccggtacttcctgaacgagggcgaggagggcccggatcaggatgccctatatgagaaataccagctgacgtcacaacacgggcctctgctgcttactctactgcttgtcgctgcaacagcctgcgtagcactgattattatcgctttctctcagggcgacccctccagacaccaggccattctcggtatggcatttctcgtgttggccgtgttcgctgccctgtccgtcctcatgtatgtggagtgtctgctgcggcgatggttgcgggctctagccctgttaacgtgggcatgcctcgtggccctaggctacgtcctggtcttcgatgcttggactaaagccgcatgtgcctgggagcaagtgcctttctttctctttattgtctttgtggtgtacactcttctccctttctcaatgcgaggggccgtggctgtgggggccgtatccacagcgtcacatctgctggtcctgggtagtctgatggggggttttaccacgccatccgtacgtgtaggtttacagctgctggctaacgccgttatattcctgtgcggtaacctgaccggcgccttccacaagcaccagatgcaggatgccagccgcgatcttttcacctatactgtgaagtgtatacagatccggcgtaaactccgcattgaaaaacgacagcaggagaacctgttgctgtccgtgctgcccgcccatatcagcatgggcatgaaactagctataatagagcggctgaaggaacatggagataggaggtgtatgcccgacaataacttccatagcctgtatgtgaaaagacaccagaatgtttccattttatacgccgatatcgtgggcttcacccagctcgcctcagactgttccccaaaagagctggttgtcgtgctgaacgagctgttcgggaagttcgatcagatcgcgaaggcaaatgagtgtatgcggatcaagattctgggcgactgctactactgtgtgtccggattgcctgttagtttacccacccacgctaggaactgcgtgaagatggggctggatatgtgccaggccattaagcaagttagggaggccaccggagtcgatataaatatgagggtgggaattcactcaggcaacgtactctgcggagttatcgggttgcgcaagtggcagtacgacgtctggtcccatgatgtaagcctagctaacaggatggaagcggcgggcgtgcccggcagggtgcatatcaccgaggcgacgctcaaacatctggataaggcctatgaagttgaagacgggcatggacagcagcgggacccgtacctgaaagagatgaatatccggacatatctggtgattgaccctaggtcccagcagccgccgcccccctcgcagcacttgcctaggccaaagggtgacgccgcgctgaaaatgagagcctctgtaagaatgacacgttatctggaaagctggggagctgcacgccctttcgctcacctgaaccacagagagtctgtttcatctggagaaactcacgttccgaatggaagacgtcccaaatctgtgccgcagcgacaccggaggactcctgataggagtatgtccccgaaaggacgctctgaggacgactcgtatgacgacgagatgctctccgctatcgagggtctatcttccacacggccctgttgcagtaagtctgatgatttttacacttttggctctatttttttagagaagggtttcgaacgtgagtatcggctggccccaattcctcgcgctagacacgatttcgcgtgcgccagcctgattttcgtctgtattctgctggtgcacgtcctgttgatgccaaggactgcagctcttggggtatcctttggtctggtggcatgcgtcctggggctagttcttggcctttgttttgcgaccaagttttcaagatgctgtcctgctcgtgggactctctgcacaatttccgaacgggttgaaacccagcccctgctgagactgacgctcgccgtactgacaatcggtagcctgctgactgttgccatcattaacctgcccttgatgccattccaggttccagagctcccagtcggcaatgagaccggtctgctggcggcctcttctaaaactcgagcactgtgcgagcctctcccatattacacctgttcctgcgtgctcggtttcatagcctgcagtgtgttccttcggatgagtctggaaccaaaggtcgtcctattaacggtggctcttgtggcatacctggtgctgtttaatctaagcccctgctggcagtgggattgttgtggtcagggcctcgggaatctgacaaaacccaacggcacaacatccggcactcccagctgcagttggaaagacctaaaaacaatgaccaatttttatctggtgttattctacattacgctactgacactatcccgccaaattgactactactgtaggctcgactgtctgtggaagaaaaaattcaaaaaagagcatgaggagttcgaaaccatggagaacgtgaatcgcctcctgctggaaaacgttctcccggctcatgtcgccgcccacttcataggagacaagctgaatgaagattggtatcaccagtcctatgattgcgtgtgcgtaatgttcgctagcgtgccggattttaaggtcttctacactgaatgtgacgtaaataaagaaggactagagtgtctaagactcctgaatgaaattatcgccgactttgacgagctcctgctgaagcccaaatttagtggcgttgaaaagattaagaccattggcagcacatatatggccgccgccggtctcagcgtcgccagcggacacgagaatcaggagctagaacgccaacacgcccacatcggcgtgatggtggaattctcaattgcccttatgtcgaaacttgacggcatcaacagacattccttcaactcattccggctgagagtaggcatcaatcacggccccgtgattgccggagtcatcggagcccgtaaaccccagtatgacatatggggtaataccgttaatgtggctagtcgcatggagtctaccggcgagttaggaaaaatccaggtgaccgaagagacctgtaccatccttcagggcctaggctatagctgtgagtgccgtggcctgatcaatgtgaagggtaagggcgaacttcgcacctactttgtgtgtacagatacagcaaaattccagggactggggctcaattag

SEQ ID NO: 178295 - DNA, 1302 bp, Artificial Sequence
  Description of Artificial Sequence: Synthetic coding sequence
atgcccgccaagggccggtacttcctgaacgagggcgaggagggcccagatcaggacgctctgtacgagaagtaccagttgacctcccaacacggacccctgctgctgacgctgctgttggtcgcggctaccgcctgcgtcgctctcatcatcattgcctttagccagggcgatccctcaagacatcaggctatcctggggatggcgttcctggttttggccgttttcgccgcccttagcgttttaatgtatgtggaatgtctgctgagaagatggctgcgggccctggccctgctgacatgggcctgtctcgtcgccctcggctatgtcctcgtcttcgacgcttggacaaaggctgcctgtgcctgggagcaggtgccgttttttctgttcatagttttcgtggtgtatacactgttacccttttccatgcgcggagcggtggcagtgggagcggtcagtactgccagccacttgttggtgctcgggtctctgatgggtggcttcactacgccctccgtcagggtcggactgcagctcctggcgaacgccgttatcttcttgtgtggaaatctcaccggagctttccacaagcatcaaatgcaggatgcgagtcgtgatctcttcacatacaccgtaaagtgcattcagattcggcgcaagttgcggattgagaaacgacagcaagagaatctgctcctatcagttctgcccgcacatatcagcatggggatgaagttggccattattgaacgcctgaaagaacacggtgatcgtcgctgtatgcccgataataattttcactcgttgtacgtcaaacggcaccagaatgtatctatcctgtacgcagatattgtgggcttcacacagcttgcatctgactgcagtccaaaggagttggttgtcgttctgaacgagcttttcgggaagtttgaccagattgcgaaggccaacgagtgcatgagaataaagatactgggcgattgctattactgtgtgtcaggacttcccgtgtctctccccacacatgcccgaaattgtgtcaaaatggggttagacatgtgccaggcgattaagcaagtaagagaggcaacaggagtggatatcaatatgagggtgggaatacactctggcaatgtgctgtgtggagtcatagggctcaggaagtggcagtatgacgtttggagtcacgacgtcagtctggctaaccggatggaggctgccggcgttccaggccgtgtccacattacagaagcaaccctgaagcacttggataaagcgctattgttacaggtgaggtag

SEQ ID NO: 178296 - DNA, 2205 bp, Artificial Sequence
  Description of Artificial Sequence: Synthetic coding sequence
atgcccgccaagggccggtacttcctgaacgagggcgaggagggcccggaccaggacgccctgtacgagaagtatcagctgacaagccagcacgggccacttttgttgactttgctgcttgttgccgcaacggcttgcgttgctctgatcatcatagcattttcccagggcgatccttcaagacatcaggcgatccttggcatggcctttctggtgctcgctgtgttcgctgctttatcggtgttgatgtacgtggaatgtcttctgcgccggtggctgagagctctagctcttctgacctgggcttgcttggtggcactggggtacgtgttggtctttgacgcttggacgaaagccgcatgcgcctgggagcaagtgccgtttttcctgttcatagtctttgtggtatacacactgttaccattctctatgcggggagcagtggcggttggtgccgtgtcgacagcctcacacctgctagtgctcgggagccttatgggcggattcaccactccctccgtgagggtgggtctacagcttctcgccaatgctgtaatctttctgtgcgggaatctaacaggagcttttcataaacatcagatgcaagatgcatctagggacctgttcacctatacagtaaaatgtatccaaattcgccgcaagctgcgaatcgagaaaaggcaacaggagaacttactcctgtctgtcctgccagctcacattagcatgggcatgaagctggctatcattgagagactgaaggagcacggagatagacggtgtatgccagataacaatttccactccctgtatgtaaagagacatcaaaacgtttccattctttatgctgacattgttggattcacccagctcgcatccgattgttcccccaaagagctcgtggtagttcttaatgaattgtttggaaaatttgatcagatcgccaaggccaatgagtgtatgagaatcaagatactgggagactgctactattgtgtctccggcctgcctgtgtccctccctacccacgctaggaattgtgtgaagatgggtctcgacatgtgtcaggcaataaagcaggtgcgcgaagcgactggggtggacataaacatgcgggtgggaatccactcgggcaatgtgttgtgcggcgtgattgggctgcgaaagtggcaatacgacgtctggagccatgatgtttccttggcaaaccggatggaggccgcaggcgtgcctggcagagtgcatatcaccgaagccacactgaaacatctggataaggcgtacgaggttgaggacggccacgggcaacagcgcgatccatatctgaaggagatgaacatccgaacatacttggtgatcgatcctagatcacagcagcctccaccacccagtcaacatctgccgaggccaaaaggtgatgctgcactgaaaatgcgcgctagtgtgcgcatgaccagatacctggaatcttggggcgccgcccgacccttcgctcacctcaatcacagggagagtgtgtccagtggcgagactcacgttcctaacggaaggagaccaaagtccgtgccccaaagacatcggaggacccctgacaggtctatgtctcccaagggacgcagcgaggacgattcatatgacgacgagatgctgagcgccatcgagggcctgtcaagtactaggccctgttgcagcaaatcagacgacttctacactttcgggtctattttcctcgaaaagggcttcgagcgggaatacaggctagcacccatacctagagcacggcatgatttcgcatgtgcctcgttgatattcgtgtgcattctgctggtgcatgtgctgcttatgccccggaccgctgctctgggcgtgtctttcggcctggtcgcctgcgtactgggactcgtgctgggactgtgttttgcgacaaaatttagcagatgttgtccagcgcgcgggaccctgtgtacaattagcgagcgggtagaaacccagccgctgctcagacttacccttgctgttctcacaattgggagtttgctcaccgttgccatcattaacttgcctctcatgccattccaggtgcctgagctgcccgttggcaatgagaccggcctcctggcagcgagctcgaaaaccagggctctgtgtgaacccctgccccacctgcacaccgtcttctccaggctgaacgagttgacaagttag

SEQ ID NO: 178297 - DNA, 3756 bp, Artificial Sequence
  Description of Artificial Sequence: Synthetic coding sequence
atggagctgagcgacgtgcggtgcctgaccggcagcgaggagctgtacacaattcacccaaccccccccgcgggcgatggccggtccgcttcgcgtcctcaacgactactgtggcagacagcagtgcgccacatcacagagcagcgctttatccacggacaccgcgggggcagtggcagcggaagtggcggttccggcaaggcctctgacccggctgggggcggcccgaaccatcatgcaccgcagctgagcggcgattcagccctaccattatacagcttgggccctggggagagggcacactctacttgcggcactaaagtgtttccagaacgctcgggctctggatctgcgagtggctccggaggagggggagatctgggatttctgcacctggattgcgcccctagcaacagtgatttctttctcaatggcggctatagttaccggggggttatattcccgactcttcgcaactcatttaagtcccgtgatctggagcggctgtaccagagatacttcctgggccagaggagaaagagcgaagtcgtcatgaacgtcctggatgttctgaccaagcttaccctgctagttcttcatctttctctggcgtcagcccctatggatcctctcaagggtattcttctgggattcttcaccggaattgaggtggtcatctgcgctttggtggtcgtccgaaaagacacaacgtcccatacctacctgcagtacagtggagtggttacgtgggtggcgatgactacacagatcctcgccgccgggctgggttacggcctgctgggggatggaatcggctacgttctgtttacactgtttgctacttattcaatgcttccgctgcctctgacttgggccatcctagccggactcggcacatccctccttcaggtgatattgcaggtggtcatccctcgcctggcagtgatatccatcaatcaggtggtggcccaagccgtccttttcatgtgcatgaatactgctggaatcttcatatcgtatctcagtgatcgagcccagcgtcaggcatttctcgaaaccaggagatgcgtggaagcacggctgcgactggaaacagagaaccagagacaagagaggctagtcctgtccgtactcccacgcttcgtcgtgctagaaatgataaacgacatgaccaacgtggaggatgagcatctccaacaccagttccaccggatctacatacaccgctacgaaaacgtgtccattctattcgcagacgtgaaggggttcaccaatctcagtaccacactgtccgctcaggaattggttagaatgctcaacgaactgttcgcccggttcgaccggctggcacacgagcaccactgcctgcggatcaaaattctaggtgattgttattattgcgtttctgggctccccgaaccccggcaggaccatgcccactgctgtgtagagatgggactatctatgatcaaaactattcgatacgtcagaagccggaccaagcatgatgtcgatatgagaattggaatacattcagggtctgtgttgtgtggtgtgctcggacttaggaaatggcaatttgacgtgtggtcctgggatgtggacattgcaaataagttagaatctggaggtattcctgggaggatccacataagcaaagctacactggattgccttaacggcgactacaatgttgaagaaggacacgggaaagaacgaaatgaatttcttcgcaaacataacattgagacctatctcattaaacaaccagaggattctctgctcagcctccccgaggatatcgtgaaagagtccgtctcaagctcagaccgcaggaactctggagccacctttacagagggatcatggtcccctgaactaccgttcgataatatcgtgggcaaacagaacacccttgccgcactaacccgcaatagcatcaatttgctgcccaatcatctcgcccaggccctccacgtgcagtccggtcctgaagagataaacaagagaattgagcacacaatcgacttacgtagtggtgacaagcttagaagggaacacatcaagccgtttagtctgatgtttaaagacagtagcttggagcacaagtactcgcaaatgagggatgaggtcttcaaatcgaacctcgtgtgcgcctttattgtgctcctgttcataaccgccatccagagtctcctcccgagttcccgtgtgatgcctatgaccatccagttctccattctcatcatgttgcatagcgcattggtcctgatcacaacggccgaggactacaagtgtttgcccttgattctgagaaaaacatgctgctggattaatgaaacctatttggcccggaacgtgataatatttgcgtctatactgataaactttttaggagcgatcctgaatattctttggtgcgacttcgacaaatctatacctctcaagaatctgaccttcaacagcagcgcagtgttcacagatatctgttcctatcctgaatacttcgtgttcacgggggtcttggcgatggtgacctgcgcggtgtttctcagactgaattcagtgctgaagttagctgtgctgttgataatgattgctatctacgcgcttctgacagaaaccgtttacgccggcctgtttcttaggtacgataacctgaatcacagcggtgaggactttctcggcaccaaagaagtgtctctgctgttaatggctatgtttcttctcgcggtattctaccacggtcaacaactcgagtacaccgcccggctggattttctgtggcgggtccaggcgaaagaggaaattaacgagatgaaagagttaagagagcacaatgaaaacatgctccgcaacatcctgccatcgcatgtcgcgcggcatttcctcgaaaaagatagggacaacgaggaactctatagtcagagttatgacgcagtgggcgtgatgttcgcatccatccctgggttcgcagacttctactctcagactgaaatgaacaaccagggggtcgagtgcctgaggctgttaaatgagataatcgctgattttgatgagctgctgggggaggatagatttcaggacattgagaagattaaaaccataggctccacttatatggccgtgtcagggctgtctccagagaagcagcagtgcgaggataaatggggacacctctgtgcactcgccgacttctccctggcgctcacggagtcgatccaggagattaacaagcatagcttcaataacttcgagctccggatcggcatctcgcatggatccgtggtcgccggggtgatcggagccaaaaagcctcaatacgacatctgggggaaaaccgtgaatctcgcttcgaggatggacagtactggtgtgtctgggcggatacaggttccagaagagacttaccttatcctgaaggatcaaggatttgctttcgactaccggggcgagatttatgtaaaaggaattagtgagcaggagggcaagataaagacatacttcttgctgggacgggtccagcctaatccttttattctcccgccacggagactgccagggcagtactccctcgccgccgtcgtactcggactcgtccagtctcttaataggcagcgccagaaacagttgctcaacgagaacaataacaccggcatcataaagggccattacaacagacggaccctactgtctccgagcgggacggagccgggggcacaggcagaaggaacggataaaagcgatctgccttag

SEQ ID NO: 178298 - DNA, 4062 bp, Artificial Sequence
  Description of Artificial Sequence: Synthetic coding sequence
atggccagccccccccaccagcagctgctgcaccaccacagcaccgaggtgtcttgcgattcttcaggggactctaattcagtgcgtgtgaagatcaatcccaaacaactgtcctcaaattcccacccgaaacattgcaagtattccatatcatccagctgctccagttctggggattcaggaggtgtgcccagaagagtgggaggaggcggtagacttcggcgccagaagaaattaccacagctgttcgagcgggcatcctctcgttggtgggacccgaaattcgactctgttaacctcgaggaggcatgtcttgagcgttgctttcctcagacacagcgccggtttagatatgccttattttacattggcttcgcttgcctgttatggtccatttattttgccgtgcacatgcgcagccgtctcatcgtcatggtggcacccgccctatgcttcctcctcgtatgcgtgggctttttccttttcactttcaccaagctgtacgcccgccattacgcttggacttcattggccttgacattgttggtgttcgctcttacgttagctgctcagttccaagtgctgacacccgtgtctggcagaggcgactcttctaacctgaccgcaacagctcgtccgacagatacctgcctgagccaggtgggctcatttagtatgtgtatcgaggtcctgttcctgctgtacaccgtcatgcacctcccgctttatttgtcactgtgcttgggagtcgcatactcggttctgtttgagaccttcggctaccattttcgcgatgaggcatgcttccctagtcctggtgctggcgctcttcactgggagctcctgtccagagggctgctgcacgggtgcattcatgccattggagttcacctattcgtgatgagtcaagttagaagtcgctccaccttcctgaaggtggggcagtcaatcatgcatggcaaagacctggaagttgagaaagctctcaaggagaggatgatccatagcgttatgccccggatcattgcggatgacttaatgaaacagggcgacgaggagagtgagaatagcgtaaaacgacatgccacaagctctcctaagaatcgtaagaaaaagtcttccatacagaaagcaccgatcgcctttcgaccttttaaaatgcagcaaatcgaagaggtgtctatcctgttcgcggacatcgtcggctttacaaagatgtccgccaacaaaagtgctcacgccttggttggcctcttgaacgatctgtttggccggtttgataggttgtgtgaagaaacaaaatgcgagaagattagcactctcggagattgttactactgcgtggcaggctgtccagaaccccgcgccgaccacgcctactgctgcatagaaatgggcctcggcatgattaaagccatagaacagttctgtcaggagaaaaaggaaatggtaaatatgagagtcggagtgcataccggaaccgtgctttgtggcatcttggggatgcgaagatttaagttcgacgtatggtccaacgacgtgaatcttgcaaatctgatggagcagctgggggtagcggggaaggtacacatttccgaagccaccgctaaatatctcgacgataggtatgaaatggaagacggtaaggtgatcgaacggctcggacagtcagtagtggctgatcaactcaaaggacttaagacctatctgatttcgggacaacgggcaaaggaaagtcgttgttcttgtgccgaggctctgcttagcggcttcgaagtgatcgatggaagccaggtgagctcaggaccgcgcgggcagggtactgcttcgagcgggaatgtgtccgatctggcgcagaccgtcaagacatttgacaacttaaagacatgccccagctgcggcataaccttcgccccaaagagcgaggccggagctgagggcggggcaccacagaacggttgccaagatgagcacaagaactcaactaaggcgtctggcggtcctaaccccaagactcagaacggcctgttaagtccccctcaagaggaaaagctgactaactctcaaacttcgctgtgtgaaatccttcaagaaaaggggcggtgggcaggtgtttcgttggaccagtcagctctcttacccctgcgcttcaagaatatacgcgagaagacggacgcgcattttgtcgatgtaataaaagaggattccctcatgaaagattacttttttaagcctccaattaaccaatttagtttaaacttcctggatcaggagttggagcggtcttacaggaccagctatcaagaggaagtaatcaagaactcacccgtgaaaacctttgcttctcccacgttctcaagcctgctggatgttttcctgagtactacagttttcctaactcttagcaccacttgtttcctcaaatacgaagcggccacagtccctcctcctcccgcagctcttgcagtttttagcgcggctcttctgttggaggttctgtctctcgcagtgtctatcaggatggtgttttttctggaagatgtgatggcatgcaccaagcgcctgctggaatggatcgcaggctggttaccaagacactgtatcggtgccatcctcgtaagtcttcccgccctggcagtctactctcacgtcacaagcgaatatgagactaatatccacttcccggtgtttaccgggtctgcagcactgatcgcagtggtccactactgtaacttctgccaactctctagttggatgcggagctctctggcgactgttgtcggagccggtcccctgcttttactttatgttagtctctgcccagactccagtgtactgacttctcctctcgacgcagtacagaacttctcgagcgaaaggaatccatgtaatagctcggtcccccgggacctgcgtcggcccgcctccctcattggacaggaagttgtgctcgtattcttcttgctgctgttgctggtgtggtttttgaaccgggagtttgaggtgtcataccgcctccattaccacggcgacgtagaagctgatctgcatagaacaaaaatccagtccatgcgggatcaggccgattggctcttgagaaatataattccctaccacgtggcagagcagttaaaagttagtcaaacctatagtaaaaatcacgactctggaggggtcatctttgctagtattgtgaacttctcggagttctacgaggagaactacgagggggggaaggagtgttaccgcgtactgaacgaacttatcggggatttcgacgagcttctttctaagccagactattcttccatcgagaagattaaaaccatcggcgctacatatatggctgcctcaggtctgaatactgcacaagcacaggacggctctcatccacaggaacacctgcaaattctgttcgagtttgctaaagagatgatgagggtcgtggacgattttaataataatatgctctggttcaactttaaactgcgcgttggttttaatcacggacccctcacagccggcgtgatcggaaccaccaagctcctgtacgacatctggggtgacactgtgaatattgcatctcgcatggacaccactggcgtggagtgccgcatacaggtttcagaggagtcatatcgagtgctgtcgaaaatgggatatgacttcgactacaggggaactgtgaacgtgaaaggaaaggggcagatgaagacctatctgtatcctaaatgcacggatcaccgggtgatcccccagcaccaactgtctattagtcctgacatacgggtccaagtcgatggtagcattgggcgcagccctaccgatgagatcgccaacctcgtcccatccgtacaatacgtcgacaagacgtcactgggttcagactccagcacacaggccaaggatgcccacctgtcccccaagcggccttggaaggaaccagtcaaggcagaggaaaggggccgttttggtaaagcaatcgaaaaagacgactgcgatgaaactggtatcgaggaggccaacgaattaaccaagctgaatgtgtccaagtctgtgtag

SEQ ID NO: 178299 - DNA, 531 bp, Artificial Sequence
  Description of Artificial Sequence: Synthetic coding sequence
atgaccatgtgcagcggcgcccggctggccctgctggtgtacggcataattatgcattcctctgtctactccagtcccgccgccgccggactgcgtttcccgggaatccgccccgaggaagaagcctatggagaagatggaaaccctctaccagatttcgatgggtccgagccccccggagccggctctccagcctccgctcctcgagccgctgcagcctggtaccggcccgcaggccgccgtgatgtggcccatggcattctgaatgaggcatatagaaaagtgttagatcagctttctgctggcaagcacctgcaaagcctagtagcaaggggcgtgggaggttcccttggcgggggggcaggggatgatgctgagccactgtctaaacgccactctgacggtattttcacggattcttactctaggtacaggaaacagatggccgtgaagaaataccttgctgccgtgcttggtaaacgctataagcagagggtgaagaacaagggacgccgcattgcctacctctag

SEQ ID NO: 178300 - DNA, 531 bp, Artificial Sequence
  Description of Artificial Sequence: Synthetic coding sequence
atgaccatgtgcagcggcgcccggctggccctgctggtgtacggcatcatcatgcactcctcagtctattccagtcccgccgccgccggcttgagatttcccggtatccgcccagaggaagaggcttatggtgaggatggcaacccattgccagatttcgacggctccgagccaccgggggccggatcacccgcctccgctccacgagcggcagctgcttggtacagaccagcaggccggcgtgacgtggcacacggcattttaaatgaggcgtaccggaaggtactggaccaattaagtgccggcaagcacctccagtctctggtagcccgcggagtgggcggatctctaggcggtggcgcgggagacgacgcagagcccctttccaagcggcacagcgacggcattttcacagattcctatagccgctacagaaagcaaatggccgtcaaaaagtacctcgccgcagtgctgggtaagagatacaagcagagagtgaagaataagggccgtagaattgcctacctttag

SEQ ID NO: 178301 - DNA, 948 bp, Artificial Sequence
  Description of Artificial Sequence: Synthetic coding sequence
atgctgaccaagcgggccctgcagaagccctgcagcgaccggttcctacggaccgctcagatcaaccgcagtcgccgccctgtaacaagcgtaacgtcaggctcctcttctcggagcagggcttccccacaccgccctcttttcctgtcttccgccagtctcagtgctccaccaagcctcagggtgaccctacctcccggatcagctcgactacaaaccttcgagcagaatacctccttggggaaacgggtgccccagctccttttgctcctccctctggtcccagcggcatcagcacaaactcctacccctgacggcgatgcctcaagggttgtaactcctgcccaggagctggaggaggccttatgtccaccaagctatctggctgctttgttagccgccggcggcgtcgaaggaatgaccatgtgctccggagcccgtcttgctctactcgtctatgggatcattatgcactccagtgtctatagcagtccagccgccgccgggctgcggttccctggaattcggcccgaagaggaggcatacggcgaagatggcaaccctctgcccgattttgatggcagcgaaccaccgggcgcggggtcacctgcctccgccccacgtgccgctgctgcctggtaccgccctgcgggccgtcgcgatgtcgcccacggcatcctaaacgaggcttacagaaaggttctggatcagctttccgcaggaaagcacttgcagtccttagtggccagaggtgtaggaggtagcctcggtggaggagcgggtgacgatgccgaacctctctccaaacgccattctgatgggatcttcaccgactcctattccagataccgcaaacaaatggctgtgaaaaaatacctagctgcagttctggggaagagatataagcagcgagtaaaaaacaaaggccgaagaatcgcctacctctag

SEQ ID NO: 178302 - DNA, 531 bp, Artificial Sequence
  Description of Artificial Sequence: Synthetic coding sequence
atgaccatgtgcagcggcgcccggctggccctgctggtgtacggcatcataatgcactccagtgtgtattcatcacccgccgctgctggcctacggttccccggcattcggcccgaggaggaggcgtacggcgaggacggtaacccactgcccgattttgacggcagcgagccaccgggggctgggtctcccgccagcgcccccagagctgccgctgcttggtataggcctgcaggccgccgtgatgtggcccatggtatccttaacgaggcatatagaaaagtcctggaccagttgtccgctggcaagcatctgcaatccctggtggctcgcggcgtgggggggagtctggggggcggcgcaggggatgacgctgagcccctctcaaaaaggcattcagacgggatcttcacagacagctattcgagatacagaaagcagatggcagtaaaaaaatatctcgcagccgtcctcggcaagaggtataagcaacgggtgaaaaataagggacggagaatagcttatctatag

SEQ ID NO: 178303 - DNA, 1407 bp, Artificial Sequence
  Description of Artificial Sequence: Synthetic coding sequence
atggccggcgtggtgcacgtgagcctggccgccctgctgctgctgcccatggccccagccatgcattctgattgtattttcaaaaaagagcaggccatgtgtctggaaaaaattcagcgggcgaacgagctcatgggattcaacgattcttcgccggggtgtcccggaatgtgggacaacataacctgttggaagcccgcccacgtcggcgaaatggtgctcgtaagctgtcccgaattgttccggatctttaaccctgaccaggtatgggaaaccgagacaatcggcgagtccgacttcggcgactctaacagcctggatctgtcagacatgggtgttgtcagtaggaactgtacagaagatggctggagcgagccatttccccactacttcgacgcctgtggcttcgatgaatacgaatccgagacaggagatcaggattactactacctgtcggttaaggccctttacacggtgggatatagtactagcctggtcaccttgacaactgccatggtaatcctctgtaggttccggaagctacattgcactaggaatttcattcatatgaacctgttcgtctcctttatgcttcgagcaatttcagtctttatcaaagattggatattatatgcagagcaggatagcaaccattgcttcatcagcactgtggagtgcaaagccgttatggtctttttccactattgcgtagtgtctaactatttttggcttttcatcgaggggctgtaccttttcacattgttggttgagactttttttcctgaaaggagatatttttactggtacaccattattggttggggaactccgaccgtatgcgtgactgtgtgggccacgttacgcctgtatttcgatgacaccgggtgctgggacatgaacgatagcaccgccctgtggtgggtcataaagggcccagtggttggttctattatggttaactttgtgctttttatcgggatcatcgtgattttagtacagaagctccaatcacccgacatgggcggcaatgagtcttccatctatctgcgcctagcccgttccactttattgctgatccccctgttcggaatacattatacagtcttcgcattttctccagaaaacgtttctaagcgagagaggcttgtctttgagctggggcttgggtccttccagggattcgtagttgcggtcctttactgttttctgaacggtgaggtacaggcggagatcaagaggaaatggcggtcctggaaagtgaacagatactttgcggtggactttaaacatcggcatccttcacttgccagttcgggggttaatggtgggacacagctgagcattctgagcaagtccagctctcagatcagaatgagcggcctgcccgcggataatctggccacttag

SEQ ID NO: 178304 - DNA, 594 bp, Artificial Sequence
  Description of Artificial Sequence: Synthetic coding sequence
atggtgttcttccactactgcgtggtgagcaactacttctggctgttcattgaagggctgtatctgttcactctcctggtcgagactttcttcccagagcgaagatatttctactggtacactatcatcggctggggcacgcctactgtttgtgttaccgtgtgggcaaccctccgcctgtacttcgatgatactggctgttgggacatgaatgattccacagctctgtggtgggtgatcaagggacctgtcgtgggctctattatggttaattttgttttgtttattggcatcattgtgatattggtccaaaaattacaatcacctgacatggggggcaatgaaagcagtatctatctgacaaatctctctcctcgagtccctaaaaaagccagggaagacccgctgcctgtgcccagcgaccagcacagccttccgttcctgtcctgcgtccagaagtgttattgcaagcctcagcgggcccaacagcactcctgcaaaatgtcagaactttctacaattactttaagactggccagaagtaccctccttttgatacccctgttcggcatacactatacagtgtttgcttag

SEQ ID NO: 178305 - DNA, 1491 bp, Artificial Sequence
  Description of Artificial Sequence: Synthetic coding sequence
atggccggcgtggtgcacgtgagcctggccgccctgctgctgctgcccatggcccccgctatgcactccgactgtatttttaagaaagagcaggcgatgtgtctggagaaaatccagagggcaaacgaactcatgggcttcaatgacagctctccgggttgtccaggtatgtgggacaacatcacgtgctggaaaccggcccatgtgggtgaaatggtgctggtgagttgcccagagctgttccggatctttaatcctgatcaggtgtgggaaactgagacaattggtgagagcgactttggagacagcaacagtctggacctcagtgatatgggagttgtgtcaaggaattgcacagaagatgggtggtcagagccattcccccactatttcgacgcctgcggctttgacgaatacgagtctgaaactggtgaccaggactactactacctgagcgtgaaggcactttataccgtaggctattctacctccctggttactctcactacagcaatggtgatattgtgccgctttagaaagctgcattgcacccgcaattttattcacatgaatcttttcgtctctttcatgctgcgcgcaatttctgtgttcatcaaggattggatattgtacgcagagcaggattcaaaccactgtttcatctcaaccgtggaatgcaaagccgtgatggttttttttcactactgtgtcgtgagtaattacttttggctgtttatcgaaggcctatatctcttcacattactggttgaaacctttttcccggagagacggtatttctactggtacacaattatcgggtggggcacccctaccgtttgcgttactgtctgggccacccttcgcctgtattttgatgatacggggtgctgggacatgaatgatagcaccgcactctggtgggtcatcaaagggccagttgtaggaagcattatggtgaatttcgtgctctttatcggtattatcgttatcttagtgcagaagcttcaatcaccggacatgggcggtaacgaatcttctatttacttctcctgtgtccagaagtgctattgtaagccacagagggcacaacaacattcatgcaaaatgagcgagcttagcactattactctgagacttgcccggtcaactctgcttcttatccccctgttcgggatacactacactgtcttcgcattcagtcccgaaaatgtgtccaagagggaacgcctggtgtttgaactcggtttgggcagctttcaaggcttcgttgttgccgttctttactgttttttaaacggagaggtgcaggctgaaattaagcggaagtggcgcagttggaaggtaaacagatacttcgcagtggactttaaacaccgccatccaagcctggcttcatcaggagttaacggtggcacccaactgagcatcctctccaagagctcatcacagatccggatgtctggattacctgcggataacctggctacctag

SEQ ID NO: 178306 - DNA, 1575 bp, Artificial Sequence
  Description of Artificial Sequence: Synthetic coding sequence
atggccggcgtggtgcacgtgagcctggccgccctgctgctgctgcccatggcacctgcaatgcacagtgactgcatcttcaagaaagaacaggcaatgtgtttggagaaaattcagcgggccaacgagctgatgggattcaatgactcgtctccgggatgtccagggatgtgggataacataacctgttggaagcctgcccacgtgggcgaaatggttctggtgagctgcccagagctgtttagaattttcaacccagaccaggtctgggagacggagactattggcgagagtgactttggagatagcaatagcctggatctcagcgacatgggcgttgtgagcaggaattgcacagaagatggttggtctgaaccttttccccattacttcgacgcatgtggcttcgacgagtacgagagcgaaacaggtgatcaagattattactacttatctgttaaagctctctatactgtgggctacagtactagcctggtgacactgaccacagcaatggtgatactctgtaggttccgcaagcttcactgcacacgtaacttcatccacatgaacctgtttgtatcttttatgctacgggccattagcgtgtttatcaaggactggattttatacgcagaacaggattccaatcactgcttcatatcaaccgttgaatgcaaagcggtgatggtcttttttcactattgtgtggtgtccaactatttctggctgttcattgaaggtctgtatctcttcacccttctggtcgagactttctttcctgagagacgatatttttactggtacaccatcataggttggggaacacctaccgtgtgcgttaccgtttgggccaccctgaggctatacttcgatgacaccggctgttgggacatgaacgattcaacagccctctggtgggttatcaaagggccagtcgtggggtctatcatggtgaacttcgtgctgtttattggcattattgtgatcctggtgcaaaagctacagagccctgatatggggggcaatgagagttcaatttacctgactaatctctcgcctagggttcccaagaaggccagggaagatcccttgcccgtcccctctgaccagcatagcctgccatttctgagttgcgtgcagaaatgctattgtaaaccccagcgggctcaacaacacagctgtaagatgtccgaactctctactattactctccgcttggcacgtagcactcttttactgattcctctttttgggatccattacacagtgttcgcttttagccctgaaaacgtgagcaagcgtgagcggctcgtattcgaacttgggctcggtagcttccagggttttgtggttgcggtattatactgctttttgaacggagaggtacaggcagagatcaagagaaaatggagaagctggaaagtgaatcgatacttcgctgtggatttcaagcaccggcatcccagcctggccagctccggggtgaatggaggtacgcaactctcaattcttagtaagagcagtagccaaattcgcatgtcaggcctgcctgctgacaatttggccacatag

SEQ ID NO: 178307 - DNA, 225 bp, Artificial Sequence
  Description of Artificial Sequence: Synthetic coding sequence
atggccggcgtggtgcacgtgagcctggccgccctgctgctgctgcctatggcaccagctatgcactctgattgtattttcaaaaaggaacaagctatgtgccttgaaaaaatccaacgcgccaacgagttgatgggcttcaatgatagctcaccaggctgccccgggatgtgggataatatcacttgctggaaacctgcacatgtcggtgagatggtcttgtag

SEQ ID NO: 178308 - DNA, 447 bp, Artificial Sequence
  Description of Artificial Sequence: Synthetic coding sequence
tgagccaccctgcggctgtacttcgacgacaccggctgctgggacatgaacgattccacggcattgtggtgggtgatcaagggacctgtggtgggctctatcatggttaactttgtgctctttataggcatcattgtcatccttgtacaaaaacttcagagcccggacatgggtggtaacgaatcctccatctacctgacaaatctgtctccccgcgtgcctaagaaagccagggaggatcctcttccagtaccatccgaccagcacagcctacctttcctgaggctagctaggtcaaccctcctccttatacctttatttgggatccactacaccgtctttgccttttctcccgaaaatgtgagtaaacgtgaacgacttgtctttgagttgggattggggtcttttcaggggtttgtcgtagctgtgctgtattgctttctgtag

SEQ ID NO: 178309 - DNA, 1344 bp, Artificial Sequence
  Description of Artificial Sequence: Synthetic coding sequence
atggccggcgtggtgcacgtgagcctggccgccctgctgctgctgcctatggcccctgctatgcattcagactgtatttttaagaaagaacaggccatgtgcctggagaaaattcagcgcgccaacgaattgatgggcttcaacgattctagccccggctgtccggggatgtgggataacatcacatgttggaaacctgcccatgtcggcgaaatggtgttagtaagttgccctgagctgttccgcatcttcaacccagatcaggacatgggtgtggtgagcagaaactgcactgaagatgggtggtccgagcctttccctcattatttcgatgcgtgtggttttgatgagtatgagagcgagacgggagaccaggattattactacctgtcagtaaaagccttgtatacagtaggatactcaacctcactggtgacactcacgacggcgatggtgattctatgtagattccgcaagctgcactgcactagaaactttatccatatgaatctgttcgtaagctttatgctcagagcgatttccgttttcattaaggactggattctttatgccgagcaggactcgaaccattgtttcatatccaccgtagagtgtaaggccgtcatggtctttttccattactgcgtagtgagcaattacttctggctcttcattgagggcctctatttattcacactgctcgtcgagacattctttccagaacgaagatacttttattggtatacaataattgggtgggggactccaaccgtgtgtgtgacagtttgggcaacattgaggctttacttcgacgatacaggatgttgggatatgaacgatagcacagctctctggtgggttataaagggacccgtggtggggtcaatcatggtgaattttgtgttattcatcgggataatagttatcctggtgcagaagctccaatctccggatatgggtggcaatgaatctagtatttacctcagacttgctcgctctaccctgctattgattcctctgtttggaattcattacacggtttttgccttctcccctgagaatgtctctaagagggaacgcctagttttcgaattgggcctgggtagctttcagggcttcgtggtggccgtgctgtactgcttcctcaacggggaggtccaagccgagataaagaggaaatggcgctcctggaaggtgaacagatactttgctgtggatttcaaacatcgacacccatccctggccagttccggagttaacgggggcacgcagctcagtatcctgtccaaatcatcctcccagattcggatgtctgggttgcctgcagataatctcgctacatag

SEQ ID NO: 178310 - DNA, 705 bp, Artificial Sequence
  Description of Artificial Sequence: Synthetic coding sequence
atggaccccggcctgcagcaggccctgaacggcatggccccccccggcgataccgccatgcatgttcctgcaggctctgtggcctctcatctagggacaacctctcgtagttacttctatctcaccacggccacacttgctctgtgtctggttttcaccgtggccacgataatggtcttggttgttcagcggactgatagcattccaaattccccggataacgttccgctaaagggtgggaactgttctgaagatctgctgtgcattctgaagcgggctccctttaagaaaagctgggcttatctgcaggttgctaaacatttgaataaaacaaagctgtcatggaacaaagacggaatcttgcacggggtcagatatcaagacggtaacttagttatccagttcccaggtttatactttataatctgtcagctgcagttcctcgtccaatgtcctaacaacagcgtagacctcaaactcgaactattaattaacaagcacattaaaaaacaggcactggtcaccgtctgcgagtccgggatgcaaaccaaacatgtttaccagaatctcagccagttcctgctggactacctgcaggtcaataccaccatcagcgttaatgtggacacatttcaatatattgacacatctactttccccttggagaatgtcctgagcatcttcttgtacagtaacagtgattag

SEQ ID NO: 178311 - DNA, 585 bp, Artificial Sequence
  Description of Artificial Sequence: Synthetic coding sequence
atggaggagaagctgaagaagaccaagatcatcttcgtggtgggcggcccaggcagcggtaaaggcacgcaatgcgaaaagatagttcagaagtatggctacacccacctctccacgggagacctgcttagaagtgaagtgtcatcgggatccgccagggggaagaaactgagtgagatcatggaaaagggtcaactagtgccactagaaactgtcctcgatatgttgagagacgccatggtggccaaggtgaacacgtcgaagggattcctgattgatgggtacccccgtgaggtccaacagggagaagagtttgaacggcggatcgggcagcccactctgctgctctatgtggacgctggtcctgaaaccatgacccagcggctgctcaagagaggagagacttccggtagggtggatgataacgaggaaactattaagaagaggctggaaacatattataaagcaacagagccagtgattgccttctatgaaaagcggggcattgtgagaaaggtaaatgccgaaggatctgtcgacagcgtcttctcccaggtgtgtacccacttggacgcgctcaaatag

SEQ ID NO: 178312 - DNA, 585 bp, Artificial Sequence
  Description of Artificial Sequence: Synthetic coding sequence
atggaggagaagctgaagaagaccaagatcatcttcgtggtgggcggtcctggatccggtaagggcacccagtgcgagaaaatcgtccagaaatatggatacactcacttaagcaccggtgacctgctgagatccgaagtatccagcgggtcagctaggggcaaaaagttgtcagagataatggagaagggccaacttgtgcccctggagacagttctggacatgctgcgggacgccatggtggcaaaagtgaatactagcaaaggcttcctgatcgacggttatccaagagaggtgcagcagggagaggaattcgaaagaagaatcgggcagcctacgctccttctgtacgtggatgccggcccggagactatgacccaaagactgctgaaacggggtgaaacgtccggacgggtcgacgataacgaagaaaccattaagaagcgcttagagacatactacaaggccacggaacccgttatcgccttttatgaaaagcgcggcatagttaggaaggtaaatgccgaagggtcagtcgatagtgtcttcagccaagtgtgcactcacctggacgccctcaagtag

SEQ ID NO: 178313 - DNA, 720 bp, Artificial Sequence
  Description of Artificial Sequence: Synthetic coding sequence
atggcccccagcgtgcccgccgccgagcccgagtaccccaagggcataagagcagtattgctcggtcccccgggcgcaggcaaagggactcaggcgccacgactggccgaaaacttctgtgtgtgtcacttggccaccggcgacatgctcagggccatggtcgcctccggtagcgagctcggaaagaaattgaaggccacaatggatgctggaaagctagtaagtgatgagatggtcgttgagttaattgaaaaaaacttggaaactcccctctgtaaaaacggcttccttctcgacggtttcccgagaacagtgcggcaggcggagatgctcgatgacctgatggaaaaacgcaaggagaaactggacagcgtgattgagttctccatccctgactcactccttatcagaagaatcaccgggcggctgattcatcccaaaagtgggcgtagctaccatgaagagttcaacccccctaaagagcccatgaaagatgatattaccggggaaccactcatccggagatcggacgacaacgagaaagctttgaagatccgcctccaggcctaccacacccagacgactcccctaatcgagtactatcggaagaggggaatccattcagccatagatgcctcccagactcccgacgtggtgtttgcctcaatcttggccgcgttttctaaggctacgtgcaaggacttggtcatgtttatttag

SEQ ID NO: 178314 - DNA, 699 bp, Artificial Sequence
  Description of Artificial Sequence: Synthetic coding sequence
atggcccccagcgtgcccgccgccgagcccgagtaccccaagggcatacgcgcggtgctgctggggccacccggggctggtaagggtacccaggccccccggctcgctgaaaatttttgtgtctgtcatcttgccaccggtgacatgcttagggcaatggtcgcttccggtagcgaactaggcaagaagctcaaggcaacaatggacgccggcaagctcgtctctgatgagatggtcgtggaattgatcgagaagaacctcgagacccctctatgtaaaaacggcttcctcctcgatggctttcccaggactgtgaggcaagccgagatgctggatgacctgatggaaaaacgcaaagagaaactggactccgtgattgagttcagcatccctgacagcctcctgattcgtcgcattacaggcagactgatacaccctaaatcaggcaggtcctatcatgaagagttcaaccctcctaaagaaccaatgaaagacgatataaccggagagccccttattcgtcgttcagatgataatgaaaaggctcttaaaatccgcctgcaggcataccatacccagacaacacctctgatcgaatattatcgaaaaagaggcatccactccgccattgatgccagtcaaaccccagatgtcgtatttgccagcatacttgccgcttttagcaaggccacgtcctag

SEQ ID NO: 178315 - DNA, 609 bp, Artificial Sequence
  Description of Artificial Sequence: Synthetic coding sequence
atggcccccagcgtgcccgccgccgagcccgagtaccccaagggcatccgggccgtgcttctcgggccaccaggggccgggaagggtacacaggcacccaggctggccgagaacttttgcgtgtgccacttggcaactggtgatatgcttagggctatggtcgctagtgggtcggagctgggcaagaagttgaaagcaaccatggatgctggaaagctcgttagcgacgagatggtcgtagaactgatagagaagaacctggaaactccactgtgtaagaatggcttcctcttagatgggtttcctcggacagttcgccaggcagagatgctggatgacctaatggaaaaaaggaaagagaaactagactctgtaattgaatttagcattccagattcactgctgatccgcagaatcactggtaggttgatccatcccaagtctggcagatcttaccacgaagagtttaatccacccaaagaacctatgaaagacgatatcactggagagcctctgatacgccggtccgtcattgggcaggccaagcgctcattcctgaggctcgcgaagatctccttcgatgtactgatcaaaaaggctctcgcttag

SEQ ID NO: 178316 - DNA, 474 bp, Artificial Sequence
  Description of Artificial Sequence: Synthetic coding sequence
atgacccggctggccctgcacgagctgaagaacctgacccagtactcttggcttttagacgggttcccccggacacttccacaggccgaggccctcgaccgcgcttaccagatcgacactgtcattaatctcaacgtgccctttgaagtaattaagcagcgtcttaccgctagatggattcatcccgccagtggccgcgtgtacaacattgagtttaatcctcctaagactgtagggattgacgacctgacaggagagcccttgatccagcgggaggatgataagcctgagacagttatcaagcgacttaaggcttatgaagaccaaaccaaaccagtgctggagtactaccagaaaaaaggcgttttagaaaccttcagtggtaccgaaactaacaaaatctggccatatgtctacgctttcctgcaaacaaaagttccccagcggtctcagaaggcctccgtgactccttag

SEQ ID NO: 178317 - DNA, 684 bp, Artificial Sequence
  Description of Artificial Sequence: Synthetic coding sequence
atgggcgccagcgcccggctgctgcgggccgtgatcatgggcgccccgggctcaggcaaaggcactgtgtcttcgaggattactacccactttgagctcaagcacttgagtagcggtgacctacttcgggacaatatgctccgaggcactgagattggagttctagcaaaagcctttatcgaccagggcaagctcataccggatgatgtgatgactcggctcgcactccacgagctgaagaatctgacccaatattcttggttgttagacggatttccaaggaccctcccccaggcagaggccctcgatcgcgcctatcagattgacacagtaataaacctcaatgtaccatttgaggtgataaaacagagattaactgcgcggtggatccacccagcttctggcagggtctacaacatcgaattcaaccctcctaagaccgtggggattgacgacctgaccggagaaccactcattcagagagaagatgacaagccagagacggttatcaagaggctgaaagcgtacgaggaccaaactaagcccgtgctcgagtactaccagaagaagggcgtgctggagacctttagcggcacggagaccaataagatctggccttatgtgtacgcgttcttgcaaactaaggtgccccagagaagccaaaaagcgtccgtaactccatag

SEQ ID NO: 178318 - DNA, 564 bp, Artificial Sequence
  Description of Artificial Sequence: Synthetic coding sequence
atgggcgccagcgcccggctgctgcgggccgtgatcatgggcgcccctggcagtggaaaagggaccgtaagttcaagaatcaccacccacttcgagctcaagcacctttcgtctggtgatttgctgcgcgataacatgctgcgaggcacaggattcccgaggaccctgccccaggccgaggccttggatagggcgtatcagattgacactgtcataaatttgaacgtgccctttgaggttatcaagcagagactcacagctagatggatccaccctgccagcggacgcgtgtataatattgagtttaatccacctaaaaccgtggggatcgacgatctgacgggtgagccgttgattcagcgggaagatgacaagccagagacggtcatcaaacgacttaaagcttacgaagaccaaactaaaccggtactcgagtactaccagaagaagggagtcttggagacattttcaggaactgaaacgaataaaatttggccctacgtttacgcattcctgcagactaaggttcctcagcggtcacagaaggcttctgtcactccctag

SEQ ID NO: 178319 - DNA, 474 bp, Artificial Sequence
  Description of Artificial Sequence: Synthetic coding sequence
atgacccggctggccctgcacgagctgaagaacctgacccagtacagctggctcctggacggctttccgcgaaccctgccccaagccgaggccttggatagggcctaccagatcgacaccgttatcaatctgaacgtgccgttcgaggtaattaaacagagactgaccgccagatggatacacccagctagcggacgggtgtacaacatcgagtttaacccaccaaagaccgtgggaattgatgatctgaccggcgaaccactgattcagcgggaggatgataagcccgaaacggtcatcaaacgactcaaagcgtacgaagaccagaccaagcctgtgctcgagtattaccaaaagaaaggcgtgttagaaaccttttccggcactgaaacaaataagatttggccatacgtgtatgcatttctgcaaaccaaggtgccccagcgatcacaaaaagcctcggttaccccgtag

SEQ ID NO: 178320 - DNA, 1611 bp, Artificial Sequence
  Description of Artificial Sequence: Synthetic coding sequence
atgtgcagcaagcccgaggaccccgtggagtacctggagagctgcctgcaaaaggtaaaagaattgggcggatgcgacaaggtcaagtgggatacctttgtatctcaggagaagaaaactctgcccccccttaatggggggcagtctcgacggtcctttctgcggaatgttatgcctgagaactctaacttcccttatcgaaggtacgataggttgcctccgattcaccagttttctattgaaagcgataccgacctgagtgagacggctgaattgatcgaggaatacgaggtattcgatcctacccgcccaaggccaaaaataatcctggttattggcggaccggggtcaggcaaggggacacagtccttgaagatcgccgaaaggtacgggtttcagtacattagtgtcggggagctgctaagaaagaagatccactccacatcatcgaacaggaaatggtcactgattgctaagattattaccaccggcgagttagcaccccaggagacaaccataaccgagatcaagcagaaactgatgcagatccccgacgaggagggcatcgtcatcgacgggtttccgcgtgacgtggcccaggccctgtccttcgaggatcagatctgtactcccgaccttgtcgtattcttagcatgtgccaaccagcgactgaaggaacggttgcttaaaagagccgagcagcagggacgaccagacgataatgtcaaagctacccagaggaggctaatgaacttcaagcagaatgcagcaccccttgtgaagtattttcaagagaaggggcttatcatgaccttcgacgccgacagagatgaagacgaggtcttctatgacatctcaatggctgtcgacaacaagctgtttccgaacaaagaagcagccgccggcagcagtgatctggacccatcgatgatcctagataccggagagattatcgacaccggctctgactacgaagatcaaggggatgaccagctgaacgtcttcggcgaggacactatgggcggattcatggaggatctgcgcaagtgcaagatcatcttcataattggaggccctgggagcggtaaaggtactcagtgcgagaaactggtcgagaaatatggcttcacgcatctctcaactggtgaacttctccgggaggagttagcaagtgaatcagaaaggtctaagctgattagggatattatggagagaggcgacctggtcccctccggtatcgtcctggaattgctaaaagaggccatggtggcaagcctaggagacacgagggggttccttatcgatggttacccacgcgaggttaagcagggggaagaatttgggcggagaatcggagacccccagctcgtcatttgcatggattgcagcgccgatactatgactaatagactgctgcagaggtccaggagctctctacctgttgatgataccaccaagactattgccaaaagactggaggcctactatcgagcatccattccagtgattgcctactacgagactaagacccagcttcataagattaatgccgagggaacacctgaagatgtttttttgcagttgtgcaccgccattgattccattttctag

SEQ ID NO: 178321 - DNA, 1689 bp, Artificial Sequence
  Description of Artificial Sequence: Synthetic coding sequence
atgaacaccaacgacgccaaggagtacctggcccggcgggagatccctcaactctttgaatctcttctgaatggactgatgtgctctaagccagaggatccagtggaatacctggagtcctgcctccaaaaagtgaaggaactgggcgggtgcgacaaagtcaaatgggatacttttgtgagtcaagagaaaaagacactgcctccgctcaatggcggacagtccagacgctccttcctcaggaatgtgatgcccgagaattccaactttccctataggcggtacgatcggctgcctcccattcaccaattcagcatcgagtccgatacagaccttagcgaaaccgccgaacttatcgaggagtatgaagtcttcgaccctactcggccacggcccaagatcattctggtcattggaggacccgggtctggaaaaggcacccagagtctgaaaattgccgagcgatatggcttccaatacatatccgtgggcgagctcttgcgaaaaaagatccactccaccagtagtaaccggaaatggtctctgatcgctaaaataataacaactggagagttggccccgcaggagacgaccatcactgagatcaagcagaagctcatgcagataccagacgaagaggggattgtcatagatggattccctcgggacgtggcacaggccctatcctttgaggaccagatctgcacacccgaccttgtggtgtttttagcgtgcgccaaccagcgactgaaggaaagacttttgaaacgggcggagcagcagggcagacccgatgataatgtcaaagctacacagcggcgtctgatgaactttaaacagaatgcggctcctctggttaagtactttcaggaaaagggtttaatcatgacgtttgatgccgaccgagacgaggatgaagtcttttatgacatctctatggccgtggacaataaactgtttccaaacaaggaggctgccgcaggttcatctgacctggacccctctatgatcttagacacaggtgaaatcatcgacacgggtagcgactacgaagaccaaggagacgatcaattgaatgtctttggggaggacacgatggggggtttcatggaggacctccgaaaatgcaagataatcttcatcattggcggtcctgggtctggcaagggaacccagtgtgagaaactggtggaaaaatacgggtttactcacctcagtacgggcgaactcctgcgagaagaactggcctccgaatcagaacgttcaaagctgataagggacattatggaaaggggggatctggtgccgagcggtatcgtactggagttactgaaggaggctatggtagcttccctgggggatacccgcggatttttgatcgacggctatccccgtgaggtcaagcagggtgaggagttcggcagaagaataggtgatccacaattagtcatttgtatggactgctccgcggatacgatgacaaaccgcctgcttcaaagatccaggagtagcctccccgttgacgatacaaccaagactatcgccaagagactggaggcttactatcgggcaagcattccagttattgcgtattatgaaaccaagacacagctgcacaagattaacgcggaggggaccccggaagacgtgtttctgcaactgtgtacagccattgatagcattttttag

SEQ ID NO: 178322 - DNA, 531 bp, Artificial Sequence
  Description of Artificial Sequence: Synthetic coding sequence
atgtgcagcaagcccgaggaccccgtggagtacctggagagctgcctgcagaaggttaaagagctgggcggatgcgacaaggtgaagtgggatacctttgtgagccaagagaaaaagacccttcccccacttaacggaggccagagcaggcgatcgtttctgcgcaatgttatgcctgagaatagcaacttcccttatcggagatacgaccggctgccaccaatccatcagttctccatcgagagtgatacggacctgagtgagactgctgagctcatcgaagaatatgaagtgtttgatcccaccaggcccaggccaaagattatcctggtgatcggcggacccggcagtggcaagggaactcaatcactcaaaattgctgaaaggtatggttttcagtatataagcgttggggaactcctccggaagaagattcacagcacaagctctaataggaaatggtccctgatcgctaagatcatcacgaccggcgaattggccccccaggagacgacaatcacggagatctag

SEQ ID NO: 178323 - DNA, 1647 bp, Artificial Sequence
  Description of Artificial Sequence: Synthetic coding sequence
atggccaagttcatgacccccgtgatccaggacaaccccagcggctggggcccctgcgccgttcccgagcaatttagagatatgccataccagccattttcaaagggagatcggctgggaaaagtcgcagactggacgggtgctacttatcaggataagaggtacactaacaaatacagcagtcagtttggaggaggaagccagtacgcctactttcacgaggaagatgagagctcgtttcagctcgtcgataccgctcggacacagaagactgcctaccagaggaaccggatgcgttttgcacagcgtaatctgaggcgcgataaagacagacgcaacatgttgcagtttaatctccagatcctgcccaaaagcgcaaaacagaaggaacgagagcgcattcggctgcagaagaaattccaaaaacagtttggagtccggcagaagtgggaccagaagagccagaagccgagggattcgagtgtggaggttagatccgactgggaagtgaaggaggaaatggattttcctcagcttatgaagatgaggtacttggaggtgtcagagccccaggacatcgagtgctgtggcgctctggagtattatgataaagccttcgaccgcataaccacccgcagcgagaaaccgctgaggtccattaaacgcatctttcacacggtgactacaaccgacgaccctgtgattcgcaagcttgcaaagacacagggaaacgtgttcgccacagatgctattctggcaacactgatgtcgtgcacccgctcggtgtactcgtgggatattgtcgttcaaagggtaggctctaaactcttctttgacaagcgcgataattcagacttcgacctgttgactgtttcggagactgccaacgaaccgccacaagatgaaggcaactctttcaacagtcctagaaacctggcaatggaggccacctacataaatcacaacttctctcagcaatgcctacggatgggaaaagaaaggtataattttccgaaccccaaccccttcgtggaagatgacatggataagaacgagattgctagtgtcgcttacagataccgccgttggaaattaggcgatgacatcgatttgattgtacgctgtgagcacgacggagtgatgaccggcgccaatggagaggtgagctttatcaacatcaagaccctgaacgagtgggattcaaggcattgcaacggggtggattggcggcaaaagcttgacagccagaggggagccgtgattgcaacagaacttaaaaataattcttacaaactcgcgcggtggacttgctgcgctctgctggctgggtctgagtacctaaaactcgggtatgtcagccgctaccacgtcaaagatagctctaggcatgttatattaggaacacaacagttcaagcctaacgaattcgcctcgcagatcaatctcagcgtggaaaatgcttggggcattttgcgttgtgtgatcgatatttgcatgaagctcgaagaagggaaatatctgatcctaaaggatcccaataagcaggtgattagggtatacagcctcccggacggcacattttcctccgatgaagatgaagaggaagaggaagaggaagaagaagaggaagaggaagaagagacatag

SEQ ID NO: 178324 - DNA, 1278 bp, Artificial Sequence
  Description of Artificial Sequence: Synthetic coding sequence
atggccgccggcggcgaccacggcagccccgacagctaccggagcccgttggcaagccggtatgcctccccagagatgtgctttgtcttcagtgataggtataagtttcgtacatggagacaactgtggctgtggctagccgaggccgaacaaactttaggcctccctattactgacgagcagatacaagagatgaagtcaaacctggaaaatattgatttcaagatggccgcagaagaggagaagaggctgagacacgatgtcatggcgcatgtgcataccttcggccactgctgtcctaaagctgcgggcatcattcacctgggtgctacaagttgttacgtgggtgacaacacagatctcatcattctgagaaacgccctggatctcctgctaccaaaattggcacgggtgatctcaaggctggcagacttcgcgaaggagcgggccagcctccccacactcgggtttacccattttcagccagctcagctcactactgttggcaagcgatgttgcctgtggatccaagacctgtgtatggacctacaaaaccttaaacgggtgcgcgacgaccttcgatttaggggagtgaagggcacgacggggacccaggcctcattcctgcaactcttcgagggtgacgaccacaaggttgagcagctcgataagatggtgaccgaaaaggccggttttaagcgggcctttataatcacgggacaaacatacacccggaaggtggatatcgaagtgttgtccgttttagcttccctaggcgcatcagtccacaaaatttgcaccgatatacggctacttgcaaacctgaaggaaatggaagagccttttgagaagcagcagatcggatcttctgcaatgccatataagcgaaatcctatgagatccgaaagatgttgctcacttgcgagacacttgatgactctggtgatggatcctctgcaaaccgcatctgtgcagtggttcgaaagaaccttggatgacagcgctaatcgaagaatttgcctggcggaggcattccttactgcagatactattctgaatacccttcagaatatatccgagggcctcgtggtgtacccaaaagtcatcgaaaggcgcattagacaggagctgccctttatggctacagagaacataattatggccatggttaaagccggcggtagtcgacaggtgcagcgctttctggaggaagaagtgtaccctttactaaaaccatacgaaagcgtaatgaaagtgaaagctgaactatgcctttag

SEQ ID NO: 178325 - DNA, 1497 bp, Artificial Sequence
  Description of Artificial Sequence: Synthetic coding sequence
atggccgccggcggcgaccacggcagccccgacagctaccggagccccttagcatcaagatacgccagcccagagatgtgctttgtgttcagcgacaggtataagtttcggacctggaggcaactgtggctctggttagctgaagccgagcaaactttaggcttaccaatcacagacgagcagatccaagagatgaagagcaatctggaaaatatagactttaagatggcagcagaggaggagaagagactccgccatgatgtcatggcgcacgtgcacactttcggacattgttgccctaaagccgccggaattatccacctcggtgctacatcgtgttatgtcggggacaataccagccttattctctcacgaggagtgattaaggcatattgtaacctgcgcctccctgggagcgactcttcaccagtgtctgtctcccagcttgcaagggtgatttcgcgcctagccgattttgcaaaagagcgggcctccctgccaaccctgggctttactcacttccagcctgcccagctaaccaccgtgggtaaaaggtgttgcctgtggattcaggacctgtgcatggacttacaaaaccttaagcgagtgcgcgatgacctgagattccgcggtgtcaagggaacaacaggaacccaggcatcttttttgcagctgtttgagggggacgaccacaaagttgagcagctagataagatggtcaccgaaaaggccggctttaaacgggctttcattataactgggcaaacgtatactcgtaaggtagacattgaagtattgagcgtgctcgcctctctcggggctagtgtgcataagatttgtaccgatattcgtctgctggcgaacctcaaagagatggaagaaccatttgagaaacagcagataggtagcagcgccatgccttacaaacgcaacccgatgcgctccgagcgctgctgcagcctcgcgcgtcacctgatgactcttgtgatggatcccctgcagactgcctccgtacagtggttcgaacgaaccctcgatgacagtgctaacaggaggatatgcctcgccgaagcttttcttacggcggacaccattctgaatacgctacagaacatttccgagggattggttgtgtatcccaaggtaatagagcgacggatacggcaggagctcccctttatggcgaccgagaatattattatggcaatggtaaaagccggcggttcgcgacaggattgccacgagaaaattagagtgctgtcccagcaggcggccagcgtcgtcaaacaggaaggaggcgacaatgacctgatcgagagaatccaggtcgacgcttactttagtccaatacactcccaacttgatcatcttctggatccatccagtttcaccgggcgcgccagccaacaggtgcagcggtttcttgaagaagaagtctacccccttctcaaaccttacgaatccgtaatgaaggtgaaagcggagctctgcctgtag

SEQ ID NO: 178326 - DNA, 915 bp, Artificial Sequence
  Description of Artificial Sequence: Synthetic coding sequence
atggacctgcagaacctgaagcgggtgcgggacgacctgcggttccgaggtgtcaagggaactaccggtacacaggcctccttcctgcagttattcgaaggcgacgatcacaaagtggaacagttggataagatggtgaccgagaaagccggattcaaacgcgccttcatcattaccggtcagacatacacgcggaaggtggacatcgaagttttatctgtattggcatcactgggggcatccgtccataagatctgcaccgatatccggttgctcgccaacctgaaagagatggaagaacccttcgaaaagcaacagatcggaagctctgcaatgccttataaacggaacccgatgaggtccgagcggtgctgctctctggctcggcacctgatgactttggtcatggacccccttcagacggcctcagtccaatggtttgagcgcacattggacgactccgccaatcgacgaatatgtttggccgaagccttccttacagccgatactattctgaacaccttacagaatatctccgaaggcctcgtcgtatatcctaaagttatcgagcggagaatacggcaagagctgcccttcatggccactgaaaatatcatcatggcgatggtcaaggctggtgggtccagacaggattgtcacgagaaaatccgagtgttgtctcagcaagctgcctctgtagtgaaacaggaaggcggggacaacgatttgatcgagaggatacaggtggatgcatatttctccccaatacatagccagctggaccatttgctggacccatcgtcctttacaggcagagccagtcagcaggtccagagattcctggaggaggaagtgtacccacttctaaagccctatgagagcgtgatgaaagtgaaagctgagctgtgcctttag

SEQ ID NO: 178327 - DNA, 384 bp, Artificial Sequence
  Description of Artificial Sequence: Synthetic coding sequence
atggccgccggcggcgaccacggcagccccgacagctaccggagccctctggcaagtcgatatgcctcccctgagatgtgcttcgtgtttagtgaccgatataagtttcgcacatggcggcagctgtggctatggctcgccgaggcagagcagacgctgggactgcccatcactgacgagcagattcaagagatgaagtctaatctggaaaatatagactttaaaatggccgccgaggaggagaagcgacttcgacatgatgtcatggcccatgtccatacttttggacactgttgtcccaaagccgctgggataattcatctgggggccactagctgctacgttggagataacacagtgggtgcctgtgtggtgtacacatag

SEQ ID NO: 178328 - DNA, 1371 bp, Artificial Sequence
  Description of Artificial Sequence: Synthetic coding sequence
atggccttcgccgagacctaccccgccgccagcagcctgcccaacggggactgcgggcgcccccgggcccgacctggagggaatagagttacagtggtgctgggggcccaatggggggacgagggaaagggcaaggtagtcgacttactcgcacaggacgcagacattgtgtgccggtgtcaggggggaaataacgcggggcatacagtcgttgtggatagcgttgagtatgacttccacttactcccttctggcattatcaatcctaacgtgacagcatttattggtaacggggtggtgatccatctgcccggcttgtttgaggaagccgagaagaacgtgcagaagggcaaaggactcgaaggctgggagaagcggctgattatatcagacagggcccacatcgtctttgactttcaccaggctgcagatgggattcaggagcaacagaggcaggagcaagctggaaaaaatctggggacgactaaaaagggcatcggccctgtttattccagtaaggcagcacgatctgggttgcgaatgtgcgacctggttagcgactttgacggcttcagcgaaaggtttaaggtccttgccaatcaatataaaagcatttacccaaccctagagatcgatatcgaaggtgagttgcagaagctgaagggatatatggagaagattaagccgatggtgagagacggcgtgtactttctctacgaagcactccacggccctcctaagaaaattctcgtggagggagccaacgctgccctcctagacattgatttcggaacttacccttttgtaacatccagtaattgcaccgtcggtggcgtgtgcacaggcctgggaatgcctcctcagaatgttggggaagtgtatggtgtggtgaaggcatataccacacgagtcggcatcggggcctttccaacggagcaggacaacgagatcggcgaactgctgcaaactcggggaagagagtttggggtcacaaccggcaggaaacgtagatgcggttggctcgatttagtgctcctgaagtatgcacacatgatcaatgggtttacggccttggcgttgaccaagttggacattctggacatgtttactgaaattaaggtcggggttgcttataaactcgatggagagatcatcccacatatccccgccaaccaggaggtgctgaataaggtggaggtgcagtacaagactttgcccggctggaacactgatatctctaacgccagggctttcaaggaactgccagtaaatgcccagaactatgtgaggttcatcgaggacgaactccaaattcctgtgaaatggattggagtcggcaaaagtcgggagtccatgatacagttgttttag

SEQ ID NO: 178329 - DNA, 1308 bp, Artificial Sequence
  Description of Artificial Sequence: Synthetic coding sequence
atggccttcgccgagacctaccccgccgccagcagcctgcccaacggagattgcgacgaagggaaaggaaaagtggtggacttattggcccaggacgcggacattgtttgccggtgtcaaggaggcaacaacgccggacacaccgtggtggtagacagcgtcgaatacgacttccatcttctgccgtccgggatcatcaatcccaacgtgacagcttttatcggtaacggcgtggtaattcatctgcccggacttttcgaagaggcagaaaagaacgtgcagaaaggcaaaggattggaggggtgggagaaacggctgattatctccgaccgagcccatattgttttcgactttcaccaggccgccgacgggatccaagaacaacagcggcaggaacaagcaggtaagaatctgggcacaactaaaaaggggatcggcccggtgtactcgtccaaggccgccaggtcaggcctccgcatgtgtgaccttgtctcagattttgatggattctccgaaagattcaaagtgcttgctaatcaatacaaatccatttatcctaccctagagattgacatcgagggggagcttcagaaactgaagggttatatggagaagatcaaacccatggtgagggatggcgtttacttcctatacgaagctctgcacggaccgccaaagaaaatcctggtagagggagctaatgctgccctgcttgatattgattttggaacctatcccttcgtgacgagcagtaattgtaccgtcggcggggtgtgtaccggcctcgggatgcctcctcagaatgtcggcgaggtctacggggtagtgaaggcatacaccaccagagtcggcatcggggcttttcctactgagcaggacaatgagataggcgagctcctgcagacccggggccgggagtttggtgtgaccacgggccggaagcgccgctgcggttggctggatcttgtcttactgaagtatgctcacatgataaatggcttcaccgccctcgcactcaccaaattagacatcttagacatgttcacggagatcaaggttggcgtcgcctataaactggatggggagatcattccgcacattcccgccaatcaggaagtacttaacaaagtggaggtgcaatacaaaacgctgccagggtggaataccgatatcagcaacgcacgggcttttaaggaactgcctgtaaacgctcaaaactatgtgcgcttcatcgaagacgagctgcagataccagtgaagtggattggggtggggaaaagccgcgagtccatgatccagcttttctag

SEQ ID NO: 178330 - DNA, 1236 bp, Artificial Sequence
  Description of Artificial Sequence: Synthetic coding sequence
atgtggatccagcagctgctgggcctgagcagcatgagcatccggtggccaggcaggcccctgggctcacatgcttggattcttatcgcgatgtttcaactggccgtagatttacccgcctgtgaggccctaggccccggtcccgaattctggcttttgccacgaagcccacccagacccccacggctgtggagttttcggagcggccaacccgcccgcgtgccggcccctgtttggagtcccaggcctccacgcgtggaacggatacacggtcagatgcagatgccaagagcccgccgggcacacaggccgcgggaccaggccgcagccctggttccaaaagctgggttggctaagccccccgctgcagccaaatctagcccgagtcttgcctcatcttcatccagctctagtagtgctgtcgccggaggggccccagaacagcaggctctgctgcgtaggggcaagcgccacttgcagggcgacggattgtcgtcctttgactctcgcggctcccgccccaccacagaaaccgagtttattgcttggggccctactggggatgaagaggccctggagtccaatacttttcccggcgtttatggccctaccaccgttagtattcttcagactagaaagaccaccgtagcagctacgacaaccacaaccaccaccgccaccccaatgacactgcagaccaaaggtttcaccgagagcctcgacccgcgacgaagaattcccggaggagtctccacaaccgagccctctacttctcccagtaacaatggcgaggtgacccagcctcccagaatactgggtgaagcctcaggcctggccgtgcatcagattatcactatcaccgtgagtctgatcatggtgatcgctgccctcataactacccttgttctgaagaactgttgtgcccagtcaggcaacacgcgccgcaacagtcaccaacgcaagacaaatcaacaagaagagagctgccaaaacttgactgattttccgagtgcccgcgtgccatcatctctcgatattttcacagcctataatgaaactctgcaatgcagtcatgagtgtgtcagagccagcgtgcccgtgtacaccgatgaaacactccacagcactaccggagagtacaagtcaacattcaacggaaacaggccctcatcttcagaccggcacttgatccctgtcgcctttgtgtctgagaagtggtttgaaatttcttgctag

SEQ ID NO: 178331 - DNA, 1236 bp, Artificial Sequence
  Description of Artificial Sequence: Synthetic coding sequence
atgtggatccagcagctgctgggcctgagcagcatgagcatccggtggcccggtagaccgctcggttcgcacgcatggatcctgattgctatgtttcagcttgccgtcgaccttccagcttgtgaggcacttggtcctggcccagagttctggctgctgcctagatcccctccccgcccccctcgtctttggtccttcagatccggccagccggccagggtgcccgcgccagtctggtcgccccggccgcctcgagtagaacggatccatggccagatgcaaatgccccgggcccgcagagcccaccgccccagggaccaagctgccgcacttgttcctaaagctgggctggccaagccccccgctgccgccaagtcttcaccatcgttggcttccagtagttcaagttcatcttctgctgtagcaggcggagctccagagcagcaggcccttctccgacgcgggaagcggcacctgcagggggacggactttcttccttcgacagtcggggaagccggcccaccacggagaccgagtttattgcatggggaccgactggggacgaagaggcactcgaaagcaacacatttccaggggtctatgggcccacgactgtctctatcctccagacacgaaaaaccaccgtcgccgctaccacaaccacaactacaaccgctacacctatgacactgcaaactaaaggctttaccgagtctctggacccacgccgcaggattcctgggggcgtctcaacgaccgaaccttccacctcccccagcaacaacggagaggtgactcagcctccaagaattttgggagaagcatctggcttggctgtgcaccagataatcaccataactgtcagcctgatcatggttatcgccgcattgatcacaacgctggtccttaagaattgttgcgcccagtcaggtaacacacgtagaaactcccaccaacgcaaaactaatcaacaagaggaatcctgccagaacttaacagattttccaagcgcgcgagtgccatcttccctggatattttcaccgcctacaatgaaacactccaatgcagccatgaatgcgtaagggcatccgttcctgtctacactgacgaaacgctccatagcacgaccggagaatataagagcacattcaacgggaaccgcccaagctcctcagatcggcacttaattcctgtggcattcgtatctgagaaatggttcgaaatttcctgttag

SEQ ID NO: 178332 - DNA, 1155 bp, Artificial Sequence
  Description of Artificial Sequence: Synthetic coding sequence
atggtgagcggcgactacagcctgggcctgaacgacctgaacgtgtctccacccgagctcacggtgcacgtaggcgatagcgcattgatgggatgcgtgtttcagagcaccgaggataaatgcatcttcaagatcgactggaccctgtcccctggagaacacgccaaagacgagtacgtgttatattactactcaaatctgagtgtccccatcggaaggtttcaaaacagggtccatctgatgggggacattctctgtaatgatggctccttgctgttacaggatgttcaggaagctgatcagggcacttatatctgcgaaatacgactgaaaggtgagagccaggtattcaaaaaggcagtcgtgctccatgtccttcccgaagaaccaaaggagcttatggttcatgtgggagggctcatccagatgggatgcgtcttccagtccactgaggtgaagcatgttaccaaagtcgagtggatcttcagtgggaggagggcgaaggaggaaatcgtctttcgatactaccataaactgcgaatgtccgtggaatattcccagtcttggggacactttcagaatcgtgtcaacttggtcggcgacattttccgtaacgacggcagtataatgctgcagggggtgagggagagtgacggtggaaattatacttgttcaatccaccttgggaatctcgtgttcaaaaagacaatagtgctccacgttagtccggaggaacctagaaccctcgtcaccccagcggcccttcgcccgctggtgcttggcgggaaccagttagtgatcatcgtgggaatcgtgtgcgccactatcctgcttctgcctgttttgatactgattgtgaagaaaacttgtggcaataagtcttcagtgaacagcaccgtgctcgtaaagaacacaaaaaagacgaatccggagattaaagaaaagccatgccactttgagagatgcgagggtgaaaagcacatctactctcctattattgtgagagaggtcatagaagaggaggagccaagcgaaaaaagcgaggccacatatatgacaatgcatcctgtttggccaagcttaaggagcgaccgtaacaatagtctggaaaagaagtcgggaggtggtatgcccaagactcagcaagccttttag

SEQ ID NO: 178333 - DNA, 1185 bp, Artificial Sequence
  Description of Artificial Sequence: Synthetic coding sequence
atgttctgccccctgaagctgatcctgctgcccgtgctgctggactattccttaggcctgaatgacttaaacgtgtctcccccggagctaactgtgcatgtaggcgactctgccctcatgggatgtgtttttcagtcaacagaagacaagtgcatttttaaaatagattggactctcagcccgggagaacacgcaaaggacgaatatgtactttattattattccaacctgtccgtgcctatcggacgtttccagaacagagtgcacttgatgggggatattttatgcaacgacgggtcacttctcttgcaggacgttcaggaggccgaccagggcacgtatatatgtgagatccgtctcaaaggcgagtctcaggtgtttaaaaaggccgtagtgctgcacgtgttgccggaggagcctaaggaacttatggttcacgtgggagggttgattcagatgggctgcgtctttcagagtactgaggtcaagcacgtcactaaggtggagtggatcttctcaggacgacgcgccaaagaagagatcgtatttaggtattaccacaagttgaggatgagtgtggagtactctcagagctggggtcactttcaaaatcgggtgaacctcgtcggggacattttccgcaacgatggcagcattatgctgcagggcgtaagggaatccgacggaggcaattacacctgtagcattcacctgggaaatttggtttttaaaaaaaccatagtcctgcatgttagccccgaggaaccccgtacactggtaactcctgccgcactcaggccactggtgctcggcggtaatcagttggtaatcatcgtgggtatcgtctgtgccaccattctgcttctgccggttctcatcctcatcgtaaagaagacctgtggaaacaaaagtagcgttaattcgactgtgctggtgaaaaacaccaaaaagacgaaccccgaaattaaggaaaaaccgtgccattttgagcgctgtgagggcgaaaagcacatctattcgccaatcatagtacgggaagtaattgaagaggaggagccaagtgagaaatccgaggctacttatatgactatgcatcctgtttggccttctctgaggtcagaccgtaacaatagtctggaaaagaaaagcgggggtggcatgccgaagactcagcaggctttttag

SEQ ID NO: 178334 - DNA, 468 bp, Artificial Sequence
  Description of Artificial Sequence: Synthetic coding sequence
atgttctgccccctgaagctgatcctgctgcccgtgctgctggactactctttagggctgaatgatctgaacgtgtcccctcctgagctgactgtgcacgtgggcgactctgccttaatgggatgcgttttccaatccaccgaggacaaatgtatcttcaagattgactggactctgtctcctggtgaacacgccaaagacgaatatgtcctgtattactattcaaatctgagcgtgcctatcggccgctttcagaatcgtgtacaccttatgggagacattctgtgcaacgatgggagtctcctcctgcaggatgtgcaggaggctgaccaaggcacttacatctgcgagatccggctgaagggcgagagccaggtctttaaaaaagctgttgtcctgcacgtcctgcctgaagagccgaaagaactgatggtccatgttggtggactgatccagatgggctgttag

SEQ ID NO: 178335 - DNA, 663 bp, Artificial Sequence
  Description of Artificial Sequence: Synthetic coding sequence
atgggctgcgtgttccagagcaccgaggacaagtgcatcttcaagatagactggactttgtctccaggcgagcatgcgaaggacgagtatgtcctttattattactcaaatctatctgtgcctatcggacggtttcagaacagagtacatctaatgggagacattctgtgcaacgacgggtctctcctactccaagacgtgcaggaggccgatcaggggacatacatatgcgagatcaggctgaagggggagtcacaggtgttcaagaaggcagtggtattgcacgttctcccagaggagcctaaggagttaatggtacacgtgggcggcctgatccagatgggatgcgtctttcagagcaccgaggttaagcacgtgacgaaagttgaatggatcttttctgggagaagggccaaagaagaaattgtattcaggtattatcacaagctcaggatgtcagtggaatactcccaatcctggggccactttcagaaccgcgtcaatcttgtgggtgacatctttcgcaacgacgggtccatcatgcttcagggggttcgagaaagcgacggtggaaactacacgtgctccattcatttaggaaacctggtattcaaaaaaacaatcgtattgcatgtgtcacccgaagagcctaggaaatggtag

SEQ ID NO: 178336 - DNA, 1128 bp, Artificial Sequence
  Description of Artificial Sequence: Synthetic coding sequence
atgagcagccacaagggcagcgtggtggcccagggcaacggcgcccccgcaagtaatcgggaggccgacaccgtggaacttgccgagctaggacctctgctggaggagaagggcaaaagggttatagccaaccctccaaaggctgaggaggagcagacatgtcccgtgccacaggaggaagaggaggaggtacgagtgctgactctgccgcttcaggcccatcatgcaatggagaagatggaagaattcgtgtataaagtatgggaaggaagatggcgcgttattccgtacgatgttctgcctgactggctgaaggacaacgattatctgctccacggccaccggccacctatgccatctttccgggcatgctttaaaagcatcttcagaatccatacagaaactgggaatatctggacccacctgctgggcttcgttctgttcctatttctgggcatcctgaccatgctgagaccaaatatgtatttcatggccccgctgcaggagaaggtggtgttcggtatgttttttttaggcgccgtgttgtgcctgtctttctcatggctgtttcacacagtctactgccattccgagaaagtctcaagaactttttccaagctggactacagcggtattgcactcttgattatggggtcattcgtcccctggttgtattacagtttttactgcagcccacagcccagacttatctacctgtccatcgtttgcgtgctggggatctccgccattatagtggctcaatgggatcggttcgcaacaccgaagcataggcagaccagagcgggagtgtttcttggcctgggcctgtccggagtcgttccaactatgcactttactatcgcagaaggcttcgttaaagcgacgactgtggggcaaatgggttggttcttcctgatggcagtcatgtacatcaccggcgcaggcctctatgcagcccgtatcccagagcggttcttccctggaaagtttgacatttggtttcagtcacatcagattttccacgtcctggtcgtggcggccgcttttgtccacttctatggagtcagcaatcttcaggagttcagatacggcctcgagggggggtgtacagacgatacacttttatag

SEQ ID NO: 178337 - DNA, 516 bp, Artificial Sequence
  Description of Artificial Sequence: Synthetic coding sequence
atgagcagccacaagggcagcgtggtggcccagggcaacggcgcccctgcaagcaatcgtgaggctgacacagtcgaactcgccgaactggggcctctgctggaggaaaagggtaagcgggtgatagcaaatcccccgaaagcggaggaggaacagacatgcccagtgccacaggaggaggaggaggaggtgcgagtgctgacacttccactccaagcccaccacgccatggagaaaatggaggagttcgtgtacaaagtgtgggagggaagatggcgggtcatcccttacgatgtcctgccagattggctgaaggataatgattacctgctgcacgggcacagacctcccatgccttctttccgggcctgcttcaagtccatttttcgcatccacacagagaccggtaacatctggacccacttgcttgccaccgcccacttacccctgcaccggttgtgcccaggacatttctgtcaccattgtggcgctgtggggcctgtctgccattcctag

SEQ ID NO: 178338 - DNA, 801 bp, Artificial Sequence
  Description of Artificial Sequence: Synthetic coding sequence
atgagcagccacaagggcagcgtggtggcccagggcaacggcgccccagcctctaatcgagaggccgacactgttgaactggcagagctgggcccgctgctcgaggagaaaggcaaaagagtcattgcgaaccccccgaaggccgaggaggaacaaacatgtcccgtcccccaggaggaggaggaggaggtccgggttttaacacttccattacaggcacatcacgccatggagaagatggaagaatttgtgtacaaggtgtgggaggggcgctggcgggtgattccctacgatgtgctaccagattggctgaaagacaatgattacctgctgcacggccaccgtcctccgatgccaagttttcgcgcgtgctttaagtccatctttaggatccacacagaaaccgggaacatatggactcacctgttgggcttcgttctctttctgttcctgggaatccttaccatgctgagacccaatatgtattttatggcaccgttgcaggagaaggtggtgttcgggatgttcttcctgggcgctgtcctgtgcctgagcttcagttggcttttccacacagtgtattgccacagcgagaaagtttcccggacgttttccaaactggattattctgggatagctctattaatcatgggcagctttgtcccttggctgtactatagtttctattgcagtcctcagccacggctcatttacctatcaattgtctgtgtgctcggcatcagcgccatcatcgttgcccaatgggacagattcgcaacacccaagcatcggcaaacatag

SEQ ID NO: 178339 - DNA, 618 bp, Artificial Sequence
  Description of Artificial Sequence: Synthetic coding sequence
atgagcagccacaagggcagcgtggtggcccagggcaacggcgcccccgccagcaaccgtgaggctgatacagtcgagcttgctgagctcggcccactgttagaagaaaaagggaaacgcgtcatagccaatccccccaaagcagaagaagaacagacctgtcccgtaccccaggaagaagaggaagaggtcagggtactaacgctaccacttcaggcccaccatgccatggagaaaatggaagaattcgtgtataaagtgtgggagggacggtggagagtaattccatacgatgttctcccagactggttgaaggacaacgactaccttctgcacggccatagaccccctatgccaagctttcgtgcttgctttaaatctatcttccgaattcatactgaaaccggcaatatctggacccacctgctgggtttcgttctttttttgtttcttggcatccttactatgcttcgacccaacatgtattttatggcacctctgcaagaaaaggttgtttttggaatgttttttctgggagccgttctatgcctgtccttctcgtggctctttcatacagtatattgtcactctgagaaagttagccgcaccttcagctag

SEQ ID NO: 178340 - DNA, 1128 bp, Artificial Sequence
  Description of Artificial Sequence: Synthetic coding sequence
atgagcagccacaagggcagcgtggtggcccagggcaacggcgccccagcttccaacagagaggcggacacagtcgaactcgcggagctaggacctctgctagaggagaagggtaagagagtcatcgcaaatcccccgaaagcagaagaggagcaaacttgccccgtgccacaggaagaggaggaggaggttcgagtgctgaccttaccccttcaggctcaccacgccatggagaaaatggaggagtttgtgtacaaagtctgggagggcaggtggagagtgattccctatgacgtgctccctgactggctcaaggacaacgactatttgctgcacggccacaggccacccatgccgtcattccgagcctgttttaagtcaatctttagaattcatacagaaaccgggaacatttggacccatctcctcgggtttgtgctatttttgtttctcggcattctgaccatgcttcgccccaatatgtacttcatggcgccattacaagagaaggtggtgtttggaatgttctttttaggggctgttctgtgcctgagcttctcctggctctttcataccgtgtactgtcactccgagaaggtcagtaggacattctccaaattagactacagtggcatcgcactcctcattatgggaagcttcgtgccttggctgtactacagtttctactgtagcccccaaccccgactgatctatctgtctattgtgtgtgttcttggcataagtgctatcattgtagcccagtgggaccgattcgcaacgcccaaacaccgacagacccgagccggagtgttcctgggcttggggctgtccggagtggttcctaccatgcacttcactatcgccgaaggctttgtgaaggccaccactgttggacagatgggatggttctttctcatggctgtgatgtacattaccggagccggactatatgcggcacgcatccccgagcggttctttcccggtaagttcgatatctggttccagtcccatcaaattttccacgttctcgtggttgccgccgccttcgtacatttttatggcgtgagcaacctgcaagaatttaggtacggcctcgaagggggatgcacagatgacactctactttag

SEQ ID NO: 178341 - DNA, 1161 bp, Artificial Sequence
  Description of Artificial Sequence: Synthetic coding sequence
atgaacgagcccaccgagaaccggctgggctgcagccggacccccgaacccgacatccggctaaggaaaggccaccagctggacggaactaggcgcggcgataacgatagccaccagggggatttggagccgatattagaggcctctgtgctcagctctcaccataagaagagtagcgaagaacatgaatactccgatgaggccccacaagaggatgaggggttcatgggcatgagccccctgctgcaggctcaccatgcaatggagaaaatggaggaatttgtgtgcaaggtctgggagggacgctggcgggtgatccctcacgacgtcctccctgattggctcaaagacaacgatttcctgctgcacgggcatcggccgccaatgccctcatttagagcttgttttaagtccatctttagaatccacacagagaccggaaatatttggacccatctgttgggatgcgtattttttctgtgcttgggcattttctacatgtttcgtcccaacatttcttttgtggctcctctgcaggaaaaggtcgtgttcggccttttttttctaggcgcaatcttgtgtttatcctttagttggctgtttcatacagtctactgtcacagtgaaggcgtcagccggttgttctctaaactcgactactcaggtatcgccttgcttatcatgggctcttttgtgccttggttatactactccttctactgtaacccccagccatgctttatttatctcatcgttatctgcgtgctggggattgcagccatcatcgtgtctcagtgggatatgttcgccactcctcagtatcgcggggttcgcgcaggcgtcttcttgggcctcggactttctgggatcatcccgactctccactacgtgatcagcgagggctttctcaaagcagccacaattggacagatcggatggctgatgttaatggcaagcctgtacatcacgggggcagctctctatgccgccaggatccctgaacgcttctttcctggaaaatgcgatatctggttccattcacaccagctgttccacatcttcgtcgtggcaggagccttcgtgcactttcatggagtgagcaatttacaggaatttcgtttcatgatagggggaggctgtagtgaagaagatgcgctgtag

SEQ ID NO: 178342 - DNA, 735 bp, Artificial Sequence
  Description of Artificial Sequence: Synthetic coding sequence
atgctgctgctgggcgccgtgctgctgctgctggccctgcccggccacgatcaggagaccacaacccagggccctggcgtgctgctccctctcccaaagggcgcatgcaccggttggatggccggcattcccgggcatcctggacataatggcgcaccaggacgggacggtcgcgacggaacacctggggaaaagggggaaaaaggagaccctggactgatcgggccgaagggggacatcggagagactggagttccaggcgccgaggggccacgcggcttcccggggattcagggccggaaaggtgagcctggggaaggcgcatatgtgtatcggtcagctttctctgtgggtctggagacttacgtcaccattcctaacatgcctatccggtttaccaagatattttacaaccagcaaaaccactatgatggaagcactgggaaatttcactgcaacattcccggcctgtactacttcgcctaccatattactgtgtacatgaaagacgtgaaagtcagcctgtttaagaaggacaaggctatgttgttcacttacgatcagtatcaagaaaataatgttgatcaagccagtggaagtgtgctcctccatctcgaggtgggcgatcaggtatggctgcaggtgtatggcgagggtgaaaggaacggtctgtacgcagataatgacaatgatagcacttttactggtttcctgctgtatcacgacaccaattag

SEQ ID NO: 178343 - DNA, 735 bp, Artificial Sequence
  Description of Artificial Sequence: Synthetic coding sequence
atgctgctgctgggcgccgtgctgctgctgctggccctgcccggccatgaccaggagaccactacacagggccccggtgtgctgctgccccttccaaaaggggcgtgtacaggatggatggcgggcattccagggcatcctggccacaacggagcacctggacgagatgggcgcgacgggacacccggggaaaaaggagaaaaaggagaccctggtctgatcggacccaagggtgacattggcgaaaccggcgttccaggcgcggagggcccccggggcttccccggcattcagggacggaagggagagcctggtgaaggagcttatgtatatagatccgcgttcagcgtcgggctggagacatatgtgacaattccaaacatgccaattagattcactaaaatcttttacaatcaacaaaaccactacgatggaagcaccgggaagttccactgcaacataccgggactgtactacttcgcttaccacatcaccgtttatatgaaggacgtgaaagtctccctgttcaaaaaggacaaggccatgctgtttacctacgatcagtaccaagagaacaatgtggaccaggccagcggctctgtgttgctccacctggaagtcggcgaccaggtgtggctccaggtgtatggcgagggggaacgcaacggcctctacgccgataacgacaacgattcaacttttaccggctttttgctgtatcatgacaccaactag

SEQ ID NO: 178344 - DNA, 735 bp, Artificial Sequence
  Description of Artificial Sequence: Synthetic coding sequence
atgctgctgctgggcgccgtgctgctgctgctggccctgcccggccacgatcaggaaactacaacacaggggcccggtgtgctgttgccacttcccaagggagcatgtactgggtggatggctggcattccgggccaccctggccataacggagcacctggccgggatggacgagacgggaccccaggggaaaaaggtgagaaaggggatccaggtctgattggccctaaaggagatatcggtgagaccggggtgcccggcgcagagggaccacgcggctttcccggaattcagggaagaaagggagaacccggcgaaggggcttatgtgtatcggagcgccttctcggttgggttggaaacctatgtcaccatcccaaatatgccgatacggtttactaagatcttttacaaccagcagaaccactatgacggatccacagggaaatttcactgcaacattcccggactttactatttcgcctatcacataactgtctacatgaaggacgttaaagtctcactgtttaaaaaagacaaggctatgcttttcacatatgaccagtaccaggaaaataatgtggatcaggcatccggctcagtgttgttgcacctggaagtcggagaccaggtgtggctgcaggtctacggcgaaggggagaggaacggcctatacgctgacaacgataacgactcgacattcacgggctttcttctgtaccacgacactaactag

SEQ ID NO: 178345 - DNA, 1491 bp, Artificial Sequence
  Description of Artificial Sequence: Synthetic coding sequence
atggccctgtggcggggcagcgcctacgccggcttcctggccctggctgtgggctgtgtcttcctccttgagcccgaactgccgggatctgcgcttaggtccttatggagttcactatgcctcgggcccgctcccgcccctccagggcctgtcagcccagaagggcggctggccgcagcctgggacgccctgattgttagacctgtcaggcggtggaggagagtagctgtaggggtgaacgcttgtgtggatgtggttctgtctggcgtgaagttgctccaagcactggggctgtcacccggtaacgggaaggaccactctatcttgcactcacgaaacgatctcgaggaggccttcattcatttcatggggaaaggagctgctgccgaacgattcttcagcgataaggagacatttcatgatatcgcccaggtcgcctccgagttcccaggggcacaacactatgtgggcggcaacgcagccctcattggacaaaagtttgccgccaactcagacctcaaggttttgctgtgcggcccagtaggccccaaactacatgagctgctggatgacaatgtgtttgtgcctccagagagcctgcaagaagttgacgagttccacctgatcctcgagtatcaagcgggggaagaatggggccagctgaaggctccacacgcgaacaggttcatcttctctcacgacttatcgaacggagccatgaacatgctggaggttttcgtctcatccttagaggaattccagccagacctagtggtgctgagtggcttgcatatgatggaaggtcaatccaaagaactccaaagaaagcggctactggaagtggtgaccagtatctctgacattcctactggaattccagtgcatctggaacttgcttctatgactaacagagagctcatgtcttccatcgtgcaccaagtgttcccagccgtcacatcactgggactcaacgaacaagagctccttttcctaactcaaagtgccagcggccctcacagctcactgagctcatggaatggcgtgccagatgtcggaatggtgtctgacatattattttggattctgaaagagcacggacgtagcaaatcaagagcttccgacctcacccgcatacactttcatacgctggtataccatatcctggccactgtggatggccactgggcaaatcagctggccgccgtggccgccggtgcccgcgtggctggcacacaagcctgtgcaaccgaaacaatcgacacctcacgagtgagccttcgggccccacaggagttcatgacttcgcacagcgaagctggctcgaggattgtgctcaaccctaataaaccggtggttgagtggcaccgggagggaatctcctttcacttcacaccagtattagtgtgtaaagatcctattcgtacagtcggccttggcgatgctatttccgcagaaggactgttttactctgaagtgcacccacactactag

SEQ ID NO: 178346 - DNA, 1041 bp, Artificial Sequence
  Description of Artificial Sequence: Synthetic coding sequence
atgggcaagggcgccgccgccgagcggttcttcagcgacaaggagacttttcatgatatcgcccaggtggcttctgagttcccgggcgcccagcattacgtcggcggtaatgctgcacttattggacagaagttcgctgcaaactcagatttgaaggtgttgctgtgtggaccagtaggcccaaagctccatgaacttctagacgacaatgtgttcgtgcccccagagagtcttcaagaggtggatgaattccacctcattctggagtatcaggctggagaggagtggggacagttgaaggctccacacgcaaatcgttttattttttcccatgacctgtccaacggtgccatgaacatgctggaagtgttcgtgtctagtctcgaagaatttcagccagatcttgtggttctgtctggcctacacatgatggaagggcagtctaaggaactgcaacgtaaacgcttactcgaggtggtgacctctatcagtgacatccccaccggcataccagttcatttggagctggcttccatgacgaatagggagctgatgtcctcgatagttcaccagcaggtctttccggcagtcacctccctgggcctaaatgagcaggaattactctttctgacccaaagtgcatccggtcctcacagctccctttcttcttggaatggggttccagacgtcgggatggtgtcagacattctcttttggatcctcaaagaacacggccgtagcaagagccgcgcgagcgatctgactcgcattcacttccatacgcttgtataccatatcttggccacagtcgacggacactgggcaaatcagctcgcggccgtggcctcttcttgtggctgggataccgggctgagacatagaaatcaccggcaccagcccagtgtcagtgaaggtactcctagagttcacgacttcccatttggggggagactacaagactgtatcaaaccaaaacaggccagctcaagaatggcccaaaggggcaacatcttgccgttacacacaagcatcggagtctag

SEQ ID NO: 178347 - DNA, 1251 bp, Artificial Sequence
  Description of Artificial Sequence: Synthetic coding sequence
atggccctgtggcggggcagcgcctacgccggcttcctggccctgggtctttcccccggtaatgggaaagaccacagtattctccactcccgaaacgacctagaggaagctttcatccattttatgggcaaaggggctgccgcggaacgatttttctccgacaaggagactttccatgatatcgcccaggtggcttctgagttcccaggggctcaacattacgttggcggcaacgccgcattaattgggcagaagtttgctgcaaatagcgacttaaaggtactgctgtgcggacccgtggggcctaagcttcacgagctgttggatgacaacgtcttcgtcccacccgagtccctccaagaagtagatgagttccacctcattcttgaatatcaggctggggaagagtgggggcagctgaaggctccacatgcaaatagattcattttttcacacgatctgtctaatggcgctatgaacatgttagaagtgtttgttagctctctggaggagtttcaacctgacctggtggtgctctccggcctccatatgatggaagggcagagtaaggagttgcagaggaagcgcctgttagaggttgttacttctatctcggacatccccacaggtattcctgttcatctggagctagcctctatgacaaatagagagctgatgagttctatcgtgcaccaacaggtgtttccagctgtgactagtttggggctaaatgagcaggagctcctcttcctcacacagtctgcttccggaccccattccagcctctcctcttggaatggcgtgcccgatgttggtatggtctccgacatcctgttttggattctcaaggaacacggaaggtctaagagccgtgcaagtgatctaacccgtattcattttcataccctcgtgtaccacatcctcgcgaccgtggatggccattgggctaaccaactcgccgccgtggccgcgggcgcgcgcgttgcaggcacccaggcgtgtgccacagagaccatagacacaagtagagtctccctgagggccccgcaagaattcatgacatcccattcagaagctggtagcaggattgtgctgaacccaaacaagcccgtggtggagtggcacagagaaggtatcagcttccacttcacgccagtcctcgtctgtaaagatcctatccgaacagttggacttggggacgcaatctccgcagaggggctgttctactcagaagtccacccccactattag

SEQ ID NO: 178348 - DNA, 669 bp, Artificial Sequence
  Description of Artificial Sequence: Synthetic coding sequence
atggccgccagctgccgggtggtgaccagcatcagcgacatccccacaggcatacccgtgcatctggaattggcaagcatgacaaacagagaactgatgtcttcaatcgtgcatcaggtgttccctgcagtcacctcactggggttgaatgagcaagaacttctctttttgactcaatctgcctccggccctcattcgagccttagttcttggaacggagttcccgatgttggcatggtttctgacattttgttttggattttgaaagagcacgggaggtccaagagccgcgcttccgacttaaccagaatccattttcacacactggtgtaccacattctggccactgtcgacggacattgggccaaccagctggccgccgttgcagctggcgccagggtggcgggcacacaagcatgtgcaacagaaaccattgacacaagcagagtatcccttagggctccacaggaattcatgacaagtcatagtgaagctggctctagaattgtgcttaacccaaataaacccgtcgtcgaatggcatagagaaggcataagcttccattttaccccagtgctggtttgcaaggatcctatccgcacggtggggctcggcgatgcgatctctgccgaggggctgttctacagtgaagtgcaccctcattactag

SEQ ID NO: 178349 - DNA, 546 bp, Artificial Sequence
  Description of Artificial Sequence: Synthetic coding sequence
atgggcaacatcttcgccaacctgttcaagggcctgttcggcaagaaggagatgagaattctgatggtcgggctcgacgcagccgggaaaaccaccattctttacaagctcaagttaggcgagattgtaactaccattcctacaattggatttaacgtagagacggtagaatacaaaaacatttcctttactgtatgggatgtcggcggccaggacaagattaggcctttgtggcgccattactttcagaatacccaaggtctcatcttcgttgtcgattcgaacgaccgggagagggttaacgaggcacgcgaggaacttatgaggatgttagcagaggacgagctccgcgacgccgtgctgctcgtctttgcgaataagcaggatttaccaaacgccatgaatgcggcagaaatcacagataagctgggattgcattctctgaggcaccggaattggtatattcaggcaacctgcgcaaccagcggagacggcctctatgagggtctcgactggttatcaaatcagcttcggaatcaaaaatag

SEQ ID NO: 178350 - DNA, 546 bp, Artificial Sequence
  Description of Artificial Sequence: Synthetic coding sequence
atgggcaacatcttcgccaacctgttcaagggcctgttcggcaagaaagagatgcgtatcctgatggtggggttggacgctgcagggaagacaacgattctgtataagcttaaactcggggagatcgtcacaaccatccccacgatcggctttaatgtggaaacagttgaatacaaaaacatctcgttcactgtgtgggacgtgggaggtcaagacaaaattagaccactgtggcggcactatttccagaatacgcaggggctaatcttcgtggtcgatagcaatgatcgggaacgggtcaatgaagctagagaggaattgatgcggatgttggccgaggacgaacttcgcgatgctgtcctactggtatttgcgaacaagcaagacctgcctaatgcaatgaacgccgcagagattaccgacaagctcggcctgcattctctgagacaccgcaattggtatatccaggctacatgtgccacctctggcgacggtttgtatgaagggctggattggctgagcaaccaactgaggaaccagaaatag

SEQ ID NO: 178351 - DNA, 546 bp, Artificial Sequence
  Description of Artificial Sequence: Synthetic coding sequence
atgggcaacatcttcgccaacctgttcaagggcctgttcggcaagaaagagatgagaatcctcatggtagggctggacgcagcgggtaagacaacaatcctctacaagctgaagttaggtgaaatagtgaccaccatacccaccatagggttcaacgttgagaccgtggagtataagaacatctccttcacggtatgggatgtcggtggccaggacaagattagacctctgtggaggcactactttcaaaacactcaaggactgatctttgtcgtggacagcaatgaccgcgaaagagtgaacgaggctagggaggaacttatgcgaatgctggctgaggacgagctgcgggacgccgtgctgcttgtgttcgcgaacaaacaggacctgccgaatgcaatgaacgcagccgagatcacggacaagctcggtctgcatagcctgcgccaccgcaattggtatatccaggctacctgcgccacctctggagatgggctctacgagggcctggactggctcagtaaccagctgcggaaccagaaatag

SEQ ID NO: 178352 - DNA, 519 bp, Artificial Sequence
  Description of Artificial Sequence: Synthetic coding sequence
atgggcaacatcttcgccaacctgttcaagggcctgttcggcaagaaggagatgcgtattctgatggtcggtctcgatgccgccggcaaaacaactatcctgtacaagcttaagctcggcgaaatagtgacaactatacctaccattggcttcaacgtagagaccgtggagtataagaacatatcatttaccgtgtgggacgtcggaggtcaagataagatccggccactgtggaggcattatttccagaatacccaaggcctgatttttgtcgtggactccaatgatagagaacgcgtgaacgaggcccaggacgaactcagagatgccgtcctcctcgtcttcgctaataaacaggacctgcccaatgctatgaatgccgccgagattacggataagctgggcttgcattcccttagacaccgaaattggtacattcaggcaacttgtgctacttcaggagatggactgtatgagggtcttgactggctcagcaaccagcttaggaaccagaaatag

SEQ ID NO: 178353 - DNA, 546 bp, Artificial Sequence
  Description of Artificial Sequence: Synthetic coding sequence
atgggcaacatcttcggcaacctgctgaagagcctgatcggcaagaaagaaatgcgcattctaatggtgggcctggatgctgctgggaaaacaacaatcctgtacaaactgaaactcggagaaattgtgaccaccatccctacaattggctttaatgttgaaaccgtcgagtataagaacatctctttcacagtttgggatgtgggaggtcaggataaaattcgccccctgtggagacattacttccagaacacacaagggctcatttttgttgtggatagcaacgaccgggagcgagtcaatgaggcgcgcgaagagctcatgcgcatgttggcagaggacgagcttagagacgctgtgcttctcgtattcgccaacaagcaggatctccccaatgcgatgaatgcggccgaaatcaccgacaaactcggcctgcactcactcagacacagaaattggtacatccaggcgacatgtgcgacatcgggtgacgggctctatgagggattggactggttggccaaccagcttaaaaataaaaaatag

SEQ ID NO: 178354 - DNA, 435 bp, Artificial Sequence
  Description of Artificial Sequence: Synthetic coding sequence
atgggcaacatcttcggcaacctgctgaagagcctgatcggcaagaaagagatgagaatcctgatggtggggttggatgccgccggaaagacaaccatactgtataagctgaaactgggggaaatcgtcactaccataccaacgatagggctgatctttgtagtcgattctaatgatagggagcgggttaacgaggctagggaggagctgatgcgcatgctcgcagaagacgagctgcgcgatgccgtgcttctcgtgtttgccaataaacaggatctaccgaacgctatgaacgcggccgagatcactgataagctgggcctccactctctgcgacatcgaaattggtatattcaggctacttgcgccacttccggcgatggtctctacgaagggctggattggctcgcaaatcaattaaaaaacaaaaagtag

SEQ ID NO: 178355 - DNA, 153 bp, Artificial Sequence
  Description of Artificial Sequence: Synthetic coding sequence
atgggcaacatcttcggcaacctgctgaagagcctgatcggcaagaaggagatgcgaattctgatggtcggtctggacgctgctgggaaaactactatcctgtacaagttgaaactgggagaaattgtcaccactattcccactattggatag

SEQ ID NO: 178356 - DNA, 309 bp, Artificial Sequence
  Description of Artificial Sequence: Synthetic coding sequence
atgggcaacatcttcggcaacctgctgaagagcctgatcggcaagaaggagatgcggattctgatggtggggctggacgctgccggcaaaacgactattctatacaaactgaagttaggggagatcgttactacaatccccaccataggcttcaatgtggagacggtcgaatacaagaacatatctttcacagtttgggacgtgggtggccaggataagatccggcctctatggagacattatttccagaacacacaagggctcatttttgttgtggactccaatgaccgcgagcgggttaacgaatag

SEQ ID NO: 178357 - DNA, 546 bp, Artificial Sequence
  Description of Artificial Sequence: Synthetic coding sequence
atgggcaacatcttcggcaacctgctgaagagcctgatcggcaagaaagaaatgcgcatcctcatggtgggtctggatgcagctggaaagaccacaatcctctacaagttgaagctaggggaaatcgttacaaccatccccacaatcggatttaacgttgaaacagtggagtataagaacatcagttttacagtgtgggacgttggcggtcaggacaagataaggcctctttggaggcattattttcaaaatacacaagggctcatcttcgtcgtggactccaatgatcgggagagagtcaacgaagccagggaggagctcatgcgaatgttggctgaggacgagctgcgagatgctgtgctcctcgtgttcgccaacaaacaggatttacctaacgcgatgaacgctgctgagatcaccgataagttggggcttcactcactgcggcatcggaactggtacatacaggctacatgcgcaactagtggggacgggctgtatgaaggtctggactggctggcaaaccagctgaagaacaagaagtag

SEQ ID NO: 178358 - DNA, 123 bp, Artificial Sequence
  Description of Artificial Sequence: Synthetic coding sequence
atgggcaacatcttcggcaacctgctgaagagcctgatcggcaagaaggaaatgcggatcctgatggtggggctggacgcagcgggaaagaccaccattttgtataagctgaaactgggatag

SEQ ID NO: 178359 - DNA, 543 bp, Artificial Sequence
  Description of Artificial Sequence: Synthetic coding sequence
atgggcctgaccatcagcagcctgttcagccggctgttcggcaagaagcagatgagaattctcatggtgggcctcgacgcagccggcaagacaaccatcctgtataaactcaaattaggggaaattgttactactataccaactatcggatttaacgtcgaaacagtggagtacaaaaatatttgctttaccgtctgggatgtcggaggccaggataggatcagacccttatggaagcactacttccagaatacacagggactgatcttcgttgtggattccaatgaccgagaacggattcaggaagtggctgatgaactgcagaaaatgttgttagtcgatgagctcagggacgcagtcttgctcctctttgccaataaacaggacctgcctaatgcgatggcgatttccgaaatgactgataaactgggcctgcaatccttacgcaatagaacatggtatgttcaggcaacttgcgcaacccagggcaccggcttatacgaaggactggactggctctcaaacgaactgagcaaaagatag

SEQ ID NO: 178360 - DNA, 384 bp, Artificial Sequence
  Description of Artificial Sequence: Synthetic coding sequence
atgggcctgaccatcagcagcctgttcagccggctgttcggcaagaagcagatgagaatcctgatggtgggtctggatgcggctggtaaaacaacaatactctacaagctgaagctcggggagattgtgactacgatccccacaatcgggttcaatgtggagacagtggaatacaagaatatttgttttactgtttgggatgtgggtggccaggaccgaatcaggcccctgtggaagcactatttccagaacacacagggtttgatatttgtggttgattcaaacgaccgggagcgtatacaagaagtggcggacgaactgcagaaaatgctgctggtggacgagctgagggacgccgtcctgctcttgtttgctaataagtag

SEQ ID NO: 178361 - DNA, 69 bp, Artificial Sequence
  Description of Artificial Sequence: Synthetic coding sequence
atgggcctgaccatcagcagcctgttcagccggctgttcggcaagaaacaaatgcgcattttgatgtag

SEQ ID NO: 178362 - DNA, 543 bp, Artificial Sequence
  Description of Artificial Sequence: Synthetic coding sequence
atgggcctgaccgtgagcgccctgttcagccggatcttcggcaagaagcagatgcgaatattaatggttgggttagacgcagccggcaagacaacaatcctgtacaagcttaagctcggtgagattgtcacaaccattcccaccattggcttcaatgtggaaactgttgaatacaagaacatctgttttacggtctgggatgtcggggggcaggataagatccgcccactatggcgccactacttccagaacacgcagggattaatttttgtggtggatagtaatgaccgggaacgagtacaagagtcagccgacgaactgcagaagatgctgcaggaggacgagctccgcgatgccgtgctgctggtattcgcaaataaacaggacatgccaaacgcgatgcccgtctcagaacttaccgataagctggggttgcagcaccttcgctctcgtacatggtatgttcaggcaacctgcgccacacagggaaccggtttgtatgacggacttgattggctgagtcacgaactgtcaaagagatag

SEQ ID NO: 178363 - DNA, 1245 bp, Artificial Sequence
  Description of Artificial Sequence: Synthetic coding sequence
atggccagcccccggacccggaaggtgctgaaggaggtgcgggtgcaggacgaaaataacgtgtgtttcgagtgtggagcgtttaatccacagtgggtatccgttacgtacgggatttggatctgcctggagtgcagtggtagacaccgaggcctgggagtacacctgtccttcgtgaggtccgtaactatggacaaatggaaagacattgaactggaaaagatgaaggctgggggcaatgccaagttccgcgagttcctagagtctcaggaagactacgacccttgttggtccctccaggaaaagtacaattcaagagccgccgctttgttccgggataaagtggtggcgctcgcagagggacgagagtggagcttagaaagtagccctgcccagaactggacccccccccagcccaggacccttccctccatggtccatcgcgtgtcaggccagccccagagtgtgacagcctccagtgacaaggcgttcgaggattggcttaacgacgacctcggctcctatcagggtgctcaaggcaatcgatatgtgggttttgggaacactcctcccccccaaaagaaagaggacgactttcttaacaatgctatgtcttcgctgtactccggctggagcagctttaccacaggggcctcaaggtttgcaagcgccgctaaggagggagctacaaaattcggcagccaggcttcccagaaattttggggtcacaagcagcagccagagccagcctccgagctcgggcactctctgaacgagaatgtgcttaagcccgcccaggagaaggtcaaagagggcaagatcttcgacgacgtgagcagcggagtaagccagctggcctccaagggggtgggcagcaaaggttggagagacgtcactacgtttttttctggtaaggctgaggggcctctggatagcccctctgaagggcatagctatcaaaactccggacttgatcatttccagaatagcaatattgatcagtccttctgggagacattcgggagtgccgagccaacaaaaacacgcaagtctccaagctctgattcatggacctgcgccgacacctctacagagagaagatcatctgactcatgggaagtgtgggggtccgccagcacaaatcggaactccaactcagatggaggggagggaggagaaggcacaaagaaagcggtgccccctgcagtccccacagatgatggatgggacaatcagaactggtag

SEQ ID NO: 178364 - DNA, 1212 bp, Artificial Sequence
  Description of Artificial Sequence: Synthetic coding sequence
atggccagcccccggacccggaaggtgctgaaggaggtgcgggtgcaagatgagaacaatgtatgcttcgagtgcggagcttttaacccacagtgggtcagcgtcacatacggcatttggatctgtttggaatgcagcggcagacacagggggttgggagtccatctgtccttcgtgagatcggtcactatggacaagtggaaagacatcgagctggagaagatgaaagcggggggcaacgccaaatttagagaattcttggagtcccaggaggactacgacccgtgctggagtcttcaagagaaatataacagtcgagcagcagcactgttccgcgacaaagtggtggctctggccgaaggacgggagtggtctctggagtcttcccccgcacagaactggacccccccccagcctcgaacactgccttccatggtgcacagggtgagcggccaacctcagagcgtcacagcatcctctgataaagcattcgaagattggttaaatgacgacctcggttcctaccaaggcgctcaggggaatcgatatgtgggcttcggaaacactccgcctccacagaagaaagaggatgattttctcaataacgctatgagctctctgtactctggctggagcagttttacaacaggagcttctcgtttcgcaagcgccgccaaggaaggggctaccaaatttggctctcaggccagccaaaaggcaagtgagttgggtcacagcttaaatgaaaacgtcctcaagcctgcccaggaaaaggtcaaggaaggaaaaattttcgacgatgtgagtagtggggtgagccagttggccagtaagtgccaacgtcgtttgtgctgccaccagagccattgctccgcaggacatctaggcagagccttttgtcctgtctcgtggcatgaagcactgtgcggacagacaggcagggaggagcaggcctctctgctcccacctaagcacgtggtaggtgccctcgaggtgtgcgccaggggctgtcccaggtgccacgtcccacacacccctggcaccgccgctgagtggccaggccggctgtgcctgagtcgggagagcgtggttcgggacgggggaacatcccccccgtttttccggggcaaacaacgggccccctggactgcacctcggcgcgcaactgttatacgaacagccgtgtggacaacttcgaagaccgccacatag

SEQ ID NO: 178365 - DNA, 1221 bp, Artificial Sequence
  Description of Artificial Sequence: Synthetic coding sequence
atggccagcccccggacccggaaggtgctgaaggaggtgcgggtgcaggacgaaaacaacgtttgcttcgaatgcggcgcgtttaacccacagtgggtctccgtgacctatggcatatggatttgtctggagtgcagcgggaggcacagggggcttggcgtgcatttgtctttcgtccgtagcgtcaccatggacaagtggaaagacatcgaactggagaagatgaaagccggcggtaatgccaagttcagggaatttctggaaagtcaagaagactacgatccatgttggagcctgcaagaaaaatacaattcccgggcagctgcgttgttcagagacaaggttgttgctttagccgagggcagagaatggtccctggagtcatctcccgcacagaactggactcctccccagccgaggacacttcccagcatggttcatagagtgtcaggccagccccaaagcgtcaccgcatcttccgacaaggccttcgaggactggcttaacgatgatctgggatcctatcagggggcccagggaaaccggtatgtcgggtttggtaacactcccccacctcagaagaaagaagacgattttcttaataacgcgatgtcaagtttgtactcagggtggtccagtttcaccaccggggcatctaggtttgcctcagctgccaaggaaggcgcaaccaagtttgggagccaagctagccagaaagcatctgaactgggccacagtctgaatgagaacgtgttgaaacctgcgcaagagaaggtgaaggagggaaaaatattcgatgatgtctcaagcggggtcagccagttagcgagcaaagtccaaggggtcgggtctaaggggtggcgggatgtaaccacttttttctccggtaaggcagaggggcccctggacagcccaagtgaaggacactcataccaaaactctggcctcgatcattttcagaattcaaacatcgaccagagcttctgggagacgtttgggagtgcagagccaaccaagactagaaaatctcctagctcagactcttggacttgcgcagatacttcaactgaacggcgcagctccgattcatgggaggtgtggggatctgcctctactaaccggaatagcaattccgatggtggcgaaggaggggaaggcaccaaaaaggccgtgcctccggccgtccctactgacgatggatgggacaatcaaaattggtag

SEQ ID NO: 178366 - DNA, 882 bp, Artificial Sequence
  Description of Artificial Sequence: Synthetic coding sequence
atgctgagcagcgagagcagctggagcctgcggcggatcaccatcctggccggaccctgtagacggagtacaacagctgagccccgtccgtccctcggaatcagagtcagcggccaacctcagtcggtgacagcgtcttcggataaagccttcgaggactggctgaatgacgacttaggttcgtaccagggcgcgcagggaaaccgatacgtcggctttggtaatacccctcctcctcaaaagaaggaggacgacttcctgaacaacgcgatgtcctcactctacagcggctggtcatctttcaccacaggagcaagcaggttcgcgtctgctgcgaaggagggtgcaaccaagtttgggtcccaggcgtcccagaaggcaagtgagctaggacattcactaaatgagaacgtccttaaaccggcccaggagaaggtgaaagaaggcaaaatcttcgacgatgttagcagcggggttagccagctggcaagcaaagttcagggcgtaggatccaagggctggcgcgacgtaactactttcttcagcgggaaggcagaggggccccttgacagcccttccgagggtcactcctaccagaacagtggactcgatcacttccagaatagcaacattgaccagagtttctgggagaccttcgggtcagcagagccaaccaaaactagaaagagtccaagctcagatagctggacctgcgccgacaccagtacagaacggcggagtagtgactcttgggaggtgtggggttctgctagcacgaatcggaactccaatagtgacggtggagaaggcggagaaggaactaaaaaagcagttcctcctgccgtccccactgacgacggatgggacaatcaaaactggtag

SEQ ID NO: 178367 - DNA, 1086 bp, Artificial Sequence
  Description of Artificial Sequence: Synthetic coding sequence
atgcggaccaccttcgtgcggagcgtgaccatggacaagtggaaggatatagagttggagaaaatgaaggcgggggggaacgcaaagttccgagaattcctcgaatcacaggaagattacgatccgtgctggtcactacaagaaaaatataacagccgcgccgctgctctatttcgcgataaagtcgtagctctggctgagggtagagaatggtctttagaatcatcaccagctcagaactggacaccaccgcagcctagaacactgccgagtatggtgcatcgcgtatccggccagccgcagtccgtgaccgccagttccgataaagccttcgaagattggctcaacgatgacctggggtcctatcaaggtgcacaaggtaatcgctacgtgggcttcgggaatactccacctccacagaaaaaggaggatgactttctgaacaacgcgatgagctctctctatagtggttggtcatcattcaccaccggcgcatcccgttttgccagtgcggctaaggagggggccactaaattcggatctcaagcctcgcagaagttctgggggcacaaacagcagcccgaacccgcctccgaactgggtcatagtttaaatgaaaatgttctgaagcctgcccaggagaaggttaaagagggcaagatatttgatgacgtcagctccggggtttctcagttagcctcaaagggagtcggaagcaaagggtggagagatgtgactaccttcttttcaggcaaggctgagggccctctggattctccttcggagggccacagttaccagaatagcggattagatcactttcaaaactccaacatcgaccagagtttttgggagacttttggatctgcggagcccaccaaaactcgaaagagccctagttccgatagttggacatgtgcagacacctcaactgagcgccgaagctcagacagctgggaggtgtgggggtcagcgagcactaataggaacagcaacagcgacggcggcgaagggggggagggaactaaaaaagccgtacctccagccgttcctacagatgacgggtgggataatcagaactggtag

SEQ ID NO: 178368 - DNA, 786 bp, Artificial Sequence
  Description of Artificial Sequence: Synthetic coding sequence
atggccagcccccggacccggaaggtgctgaaggaggtgcgggtgcaagacgagaacaatgtgtgctttgagtgcggggccttcaatccccagtgggttagcgtgacttacggaatttggatttgccttgaatgttccgggaggcacaggggccttggcgtccatctctcttttgtgaggtcagtcaccatggacaagtggaaggacatagagcttgagaagatgaaagccggaggcaatgcgaaattcagagagtttctcgaatctcaggaagattacgatccgtgctggagtttgcaggagaagtataactcccgtgctgccgctttgtttagggataaagttgtcgccctggccgaaggcagggaatggtctctggagagcagcccggcccagaattggacaccaccccaaccaagaacactcccgtctatggtccacagggtttcaggtcagccacagtccgtcacagcctcgtcagacaaagcttttgaagactggctgaacgatgatctgggttcataccagggggcacagggcaacagatatgttggttttggtaacacgcccccaccccaaaaaaaggaggatgattttctgaataatgccatgtctagtttgtactctggttggagttcattcacgaccggggcatcccggttcgccagtgctgccaaggagggtgccacgaaattcggttctcaagccagccagaaggccagtgagctggggcactcactgaatgagaatgttctgaagcccgcccaggaaaaagttaaagaatag

SEQ ID NO: 178369 - DNA, 240 bp, Artificial Sequence
  Description of Artificial Sequence: Synthetic coding sequence
atggccagcccccggacccggaaggtgctgaaggaggtgcgggtgcaagatgagaacaatgtgtgtttcgagtgcggggccttcaatcctcagtgggtcagtgtgacctacggtatatggatttgtctcgagtgctcgggtcgacatcgcggcttgggtgtgcaccttagctttgtcagatctgtgacgatggacaaatggaaggacatagaattggagaaaatgaaggccgggggatag

SEQ ID NO: 178370 - DNA, 369 bp, Artificial Sequence
  Description of Artificial Sequence: Synthetic coding sequence
atggccagcccccggacccggaaggtgctgaaggaggtgcgggtgcaggacgaaaacaatgtatgctttgaatgcggcgccttcaacccccagtgggtttccgtcacctacggcatctggatttgtctcgagtgcagtggacgccacaggggacttggggtccatctatccttcgtgcggagcgtgactatggacaagtggaaagatattgaactggagaagatgaaagctgggggcaatgctaagtttagggagtttctcgaatcccaggaggattatgacccctgttggtcgcttcaagaaaagtacaattcccgggctgctgctctgttccgagacaaagtggtggcactggccgagggcagatag

SEQ ID NO: 178371 - DNA, 759 bp, Artificial Sequence
  Description of Artificial Sequence: Synthetic coding sequence
atggtggccagcatgcggctggcctaccaggagctgcagatcgacagaaagaaagaggagaaaaagctgcagaacttagaaggcaaaaaacgtgagcaggccgaacggctgggaatgggtctcgtgtcgaggagttccgttagccactctgtcctgtccgagatgcaagtgattgaacaagaaactcctgtcagcgcgaagtctagtagaagccagctagatctgttcgacgacgtcggtaccttcgcttctggtccacccaagtataaagataaccccttcagtctgggcgagtctttcggatcccgatgggataccgacgccgcgtgggggatggatagagtagaagagaaggaaccagaggtgaccattagttccatacggcctatctctgagcgcgccacaaataggcgagaggtcgaatctcggtcttccgggcttgagtcctctgaggcacgccagaaattcgccggcgccaaagccatcagcagcgatatgtttttcggacgcgaagtcgatgctgagtacgaagcaaggagccgcctacagcagctttccggttccagcgccatttcaagtagtgatctattcggtgacatggacggagcacatggcgctggcagtgtttcactggggaacgtcctaccgaccgcagacatcgctcagtttaaacaaggggtgaaaagtgttgcaggaaagatggctgtgctagctaatggggttatgaattcacttcaggacaggtatgggtcctattag

SEQ ID NO: 178372 - DNA, 1245 bp, Artificial Sequence
  Description of Artificial Sequence: Synthetic coding sequence
atgcaggtgggcggcaacgccaacgccaccgccttcttccggcagcacggctgcacagctaatgatgcgaacaccaaatataactcgcgtgccgcccagatgtatagggagaaaatcaggcagctcggatctgccgctctcgcaagacacgggacagatccacccgcctgggacgctcccgctacagagccttctggaacacagcaaccggctccaagcacagagtcctcaggacttgcccagcctgagcatgggcccaataccgatctacttggtacgtctccaaaggccagtcttgagctgaaaagcagcatcataggtaaaaagaagccggccgcggccaaaaagggcttaggcgcgaaaaaaggactgggcgctcagaaggtgagcagtcagagttttagcgagatagaacggcaagcacaggtagccgagaagctcagggaacaacaggccgccgacgccaagaagcaggcagaagagagtatggtggcgtctatgagactcgcatatcaggagctgcagatagatcgaaagaaagaggaaaagaaactgcagaatctggaaggaaagaagagagagcaagccgagcgcctcgggatggggctcgtctctaggtccagcgtcagccatagcgtgctatctgagatgcaggttattgaacaggaaacaccagtttccgcaaaaagcagcagaagccagctcgacctgttcgatgatgtcggcaccttcgcctccggcccacccaagtataaggataatccctttagcctcggcgagagcttcgggagtaggtgggacaccgacgccgcgtggggtatggatagagtggaggagaaggaacccgaagtaactatctcaagcattcgcccaatcagcgaaagggccacgaatagacgcgaggtggagtccagatcaagtggcctggagtcctctgaggcccggcagaaatttgctggcgcaaaggccatatcatccgatatgttttttggacgggaagtcgacgcagagtacgaggccagatccagactgcagcagctgtccggatcctcggccatcagcagtagtgatttatttggcgacatggatggagctcatggagcaggatcagtctccctggggaacgtccttcccaccgccgatattgcacagttcaagcagggagtcaagtcagtcgccgggaagatggccgtcctggccaatggcgttatgaactccctgcaggatcggtacggctcctattag

SEQ ID NO: 178373 - DNA, 1158 bp, Artificial Sequence
  Description of Artificial Sequence: Synthetic coding sequence
atggccgccgagcccaacaagaccgagatccagaccctgttcaagagactgcgagcagtgcccacaaacaaggcttgcttcgactgtggtgctaagaatccctcatgggcttctatcacatacggggtgttcctctgcattgactgcagcggagtacacaggtctctaggcgtccatctcagctttatcagatcaacagagctcgactctaattggaattggtttcagctacgctgcatgcaagtcggcggaaatgccaatgcccttggtgctaaaaagggattaggggcgcaaaaggtgtcctctcagagcttttccgagatcgaacgtcaggctcaggtagcagagaagctgagggagcagcaggctgcagatgctaagaagcaggccgaggaatctatggtggcctccatgcggctggcctaccaggaactgcagattgacagaaaaaaggaagaaaagaaactccagaatttggaagggaagaagagggagcaggctgaaagactaggcatgggcctagtcagccgcagcagcgtatcacattcagtcctgagcgaaatgcaggtgatcgaacaggagacacccgtgagtgctaaaagcagtcgatcccagttagatttgtttgacgacgtaggaacatttgccagcggcccacctaaatacaaggacaatcccttttcactcggcgagagctttggctctcggtgggacactgatgctgcctgggggatggacagggtagaggagaaggaaccggaggttaccattagctctataagacccatatctgagcgggcaacgaataggagggaggtcgagagccggtcttctggtcttgagagttccgaggctcgacagaagtttgctggagcaaaagccatatcctctgatatgttcttcgggcgtgaggtagacgctgagtacgaagctaggtcacgacttcagcagcttagcggctcgagcgctatttcttctagcgaccttttcggagatatggatggcgcccacggggcaggatccgtttccctgggaaatgtgctacccactgctgatatcgcacagttcaaacagggggttaaaagtgtggctggcaaaatggcagtgcttgcgaacggcgtcatgaacagtctgcaggatagatacggttcttattag

SEQ ID NO: 178374 - DNA, 1566 bp, Artificial Sequence
  Description of Artificial Sequence: Synthetic coding sequence
atggccgccgagcccaacaagaccgagatccagaccctgttcaagcgcctccgcgcagtgcctacaaacaaggcatgcttcgactgcggcgccaagaacccttcctgggccagcatcacctatggagtattcctgtgtatcgattgctcgggagtgcatagatctctgggggtgcatctgtcattcattaggtctacagagctggatagcaactggaattggttccagctgagatgtatgcaggtaggaggcaacgccaacgcgacggcattttttcggcagcacggttgtaccgccaatgacgcgaacaccaaatacaactcaagggccgctcagatgtatcgggagaagattcgacagctcgggtcagcagccttagcacgacatgggacagatctgtggatcgacaacatgagctccgctgtgcccaatcactcacccgagaaaaaggattctgactttttcacagaacatactcagcctcccgcgtgggatgcccccgccacagagccctcgggaacacaacaacctgcaccaagtacagaatcatccgggcttgctcagcccgaacatgggcccaatactgatctactgggaacctctcctaaggcctcactggagctaaagtcttccataattggtaagaagaagccggccgcagcaaagaagggtctcggtgccaagaaaggactgggagctcagaaggtgtctagccagtccttctccgagatcgaacgacaagcccaggttgccgaaaagttaagggaacagcaggccgcagacgcaaaaaagcaggccgaggaatctatggtggccagtatgcgattggcttaccaggagttgcagatcgatcgaaaaaaggaggaaaagaagctgcagaacctggagggtaaaaagcgggaacaggcggagaggcttggcatgggcctggtgtctcgtagcagcgtgtctcactccgtactgtcagaaatgcaggtcattgaacaggagacgccggtctctgcaaagagtagcaggtcacagttggatctcttcgatgatgtgggcaccttcgcttccgggccacctaagtacaaggacaatccattctcccttggggaaagctttggtagccgttgggatacagacgctgcctgggggatggatagggtcgaagaaaaggagcctgaagtgactatatcttcgataaggccaatctccgagcgtgccacaaacagaagagaggtcgaaagcaggagcagcggactggagtcctctgaggcgcgccaaaaattcgcaggtgcaaaggctatttcttcagacatgttcttcggccgagaggtcgatgccgagtatgaagccagaagtcggctccagcagctcagcgggagctctgctatttcaagcagtgatctctttggcgacatggacggggctcatggcgcgggtagtgtttcactgggaaacgttcttcctaccgcagacatcgcccaatttaaacagggggttaagtctgttgctgggaaaatggctgttctagcaaacggcgtgatgaatagcctgcaggataggtacggatcttactag

SEQ ID NO: 178375 - DNA, 1551 bp, Artificial Sequence
  Description of Artificial Sequence: Synthetic coding sequence
atgggcgaccccagcaagcaggacatcctgaccatcttcaagcggctcaggtctgtcccgacaaacaaagtgtgctttgactgcggcgccaaaaacccctcctgggcttctattacatatggcgtcttcctctgcatcgattgttcagggtcccatagatcacttggggtacacttgagtttcattcgctccaccgaactcgattccaactggtcctggtttcaactgcggtgtatgcaggttggaggaaatgcatctgcctcaagttttttccaccagcatggttgctcgactaacgataccaacgcgaaatataacagtagggcagctcaattatacagagaaaagattaagagtctggctagccaggcaacccgtaaacacggcaccgacttatggttagactcgtgcgtggtccctccgctctctcctccccccaaagaggaagacttttttgccagtcatgtgtccccagaggttagtgatacagcctgggcttccgctattgctgaaccatcatctctcacaagtagacccgtagaaaccaccttggagaataacgaaggagggcaagagcaaggaccgtcagtggaggggctcaatgttcccactaaggcaacactcgaggtgagctcaatcataaagaaaaagccaaaccaggcgaaaaaggggctcggagcgaaaaaagggagtctcggagctcagaagctagcgaatacatgtttcaacgagatcgaaaagcaggcacaggccgccgacaagatgaaggagcaagaggatttggccaaagtggtctcaaaggaagaatcaatcgtctcgtcactcagactggcatacaaagaccttgagattcagatgaaaaaagacgaaaagatgaacatttctggcaaaaaaaacgttgacagtgatcggttaggcatgggattcgggaactgcaggtcagttatcagtcatagtgtgacaagtgacatgcagaccatcgagcaagagtcacctattatggcgaaaccccggaaaaagtataatgacgacagcgatgactcttattttacgtctagctcctcttactttgatgaacctgtcgaactgcgcagttcttcttttagcagttgggacgactcctccgattcatactggaaaaaggaaacctcaaaggatacagagacagtcttaaaaacaacgggctacagcgatagacctaccgccagacgtaagccggattacgagcctgtggagaacacagacgaagcacaaaaaaagttcggaaacgtcaaggctatctcctccgacatgtacttcgggaggcagtcgcaggccgattatgagactagggccaggctggagaggctttctgcttcatcatctatctcctcagccgacctctttgaggaacctcggaaacagcctgcggggaactattctcttagctccgtgcttcccaacgctcccgacatggcacagttcaagcagggagtgcgtagcgttgccgggaaacttagtgtcttcgccaatggggtcgtcaccagcatccaggatcgctatggttcatag

SEQ ID NO: 178376 - DNA, 1335 bp, Artificial Sequence
  Description of Artificial Sequence: Synthetic coding sequence
atgggcgaccccagcaagcaggacatcctgaccatcttcaagcggctgaggtctgtccccaccaacaaggtttgtttcgattgtggggctaagaatccaagttgggcctcaatcacatacggcgtgttcctatgcatcgactgcagtggctcacatcgttccctcggtgttcatctttcatttatcaggtcgactgaactcgatagcaactggtcctggttccagctgaggtgtatgcaagtgggggggaacgcctcagccgtcagcgacactgcctgggccagcgccattgcagaaccttctagcctgactagtcgccccgtagaaactacactggaaaacaatgagggagggcaggagcagggtcccagtgtagaagggctgaacgtacctactaaagcgaccttggaggtttcaagcattatcaagaagaaacctaatcaggccaagaagggactgggcgccaagaagggcagcctgggcgcccaaaagctggccaacacctgcttcaacgagatcgagaagcaggcccaggccgcagacaagatgaaagagcaagaggacctggctaaggtcgtatcgaaggaggagtctatcgtttcatccctgagactagcttataaggatctagagattcagatgaaaaaagatgaaaaaatgaacatttccggtaaaaaaaacgtagacagtgacagactggggatggggttcgggaattgtagatcagtaatttcgcattctgtcacctctgacatgcagaccattgagcaggagtcaccaattatggcaaagcctagaaagaagtataacgatgactctgacgacagctattttacatcttctagctcatatttcgacgagcccgtggagctgcggtcttcttcattcagttcatgggatgatagttccgactcttactggaagaaggagacatctaaggacactgagactgttctaaaaactaccgggtatagcgacagacccaccgcccggaggaagcctgactacgaacctgtggagaatactgacgaggcacagaagaagttcgggaatgtgaaggccatcagctctgatatgtattttggaaggcagtctcaggccgattacgaaaccagggctcggctggagaggctctctgcctcttcttctatttccagtgccgatttattcgaggaaccacgtaaacagcctgcaggcaactactctctgtcctctgtgctgcctaatgcgcctgatatggcacaattcaagcagggggtgcgatccgtggctggaaaactatctgtgttcgcaaacggcgtagtgactagcatacaagatcgctacggttcctag

SEQ ID NO: 178377 - DNA, 1419 bp, Artificial Sequence
  Description of Artificial Sequence: Synthetic coding sequence
atgggcgaccccagcaagcaggacatcctgaccatcttcaagcggctacgatctgtgccaacaaacaaggtgtgttttgactgcggggccaagaacccatcgtgggcttccatcacctatggagtgtttctgtgcatcgattgttctggctcccaccgttcccttggagtccacctctctttcatccgctccaccgagctagacagtaactggagctggttccagttacggtgtatgcaggtcggagggaatgccagtgcactgtggctggactcctgcgtggtgccaccattgtcaccgccaccaaaggaggaagactttttcgcttcccacgtcagtccagaagtgtccgataccgcttgggcaagcgctatcgctgagccaagctccttgacatcccgtcccgtggaaacgactctcgagaataatgaaggaggacaggaacagggcccctctgttgaagggctgaacgtgccgactaaagccactctggaggtgtcgagcatcattaagaaaaaaccaaaccaagctaaaaagggattgggtgccaaaaaaggctccctgggtgctcaaaagctcgccaatacttgcttcaacgaaattgaaaaacaggctcaggctgctgataagatgaaggagcaggaggatctcgcaaaagtagttagcaaagaggagagcatagtcagctctctgagactagcttacaaggatttagagatccagatgaagaaggacgaaaagatgaatatcagcggcaagaaaaatgttgattctgacagactggggatgggttttggaaattgccggagcgttatctctcacagtgttactagcgacatgcaaacaattgagcaggagagccctatcatggccaaaccaagaaagaaatataatgatgattcagacgatagctacttcacatcttcttcaagctacttcgatgaaccggtggagttgcgatcgtctagtttctcgtcctgggatgatagttcagactcttactggaagaaggagacctcaaaggacactgaaacggttctgaaaaccacgggctattcagataggcctacagcccgacggaagcctgactatgagccggtggagaataccgatgaggcccagaagaaatttgggaatgtgaaagctatttcttcagatatgtactttgggcggcagagccaggcagattacgaaacgcgggcgcgcctggagaggctgtctgcaagttcctccatttcctccgccgatctattcgaggaaccccggaagcagccagcaggcaactattctctgtccagcgtgttaccaaatgccccagacatggcacagttcaagcagggagtgcgatcagtcgcgggaaaactttccgtgtttgccaatggggttgtgactagcatccaggatagatacggatcctag

SEQ ID NO: 178378 - DNA, 822 bp, Artificial Sequence
  Description of Artificial Sequence: Synthetic coding sequence
tgactggccctgttccaggtgagcgacaccgcctgggccagcgccatcgccgaaccatcctcgctgacttcaaggcccgtggaaaccaccttggagaataacgagggcggacaggagcaaggcccgtcagtagaaggactgaacgtgcctacaaaggccaccttggaggtgtcttcaatcatcaaaaaaaaacccaatcaggcaaaaaaggggctgggtgcgaagaaggggtccttgggtgctcaaaaactcgccaacacatgcttcaacgagatcgaaaaacaggcccaggcggccgacaagatgaaggaacaggaggacttagccaaggtggtatccaaggaagaatcgattgtttcatcccttcgcctggcatacaaagatctggaaatacaaatgaaaaaagacgagaaaatgaatatctctggcaagaagaacgtggactcagataggctgggcatgggatttgggaattgtaggagtgtcatctctcattccgtcacctcggatatgcagacaatcgaacaggagtcacccatcatggccaagccaagaaaaaaatacaatgacgattctgacgatagctacttcacctcctcttcccggcctactgctcgcagaaaaccagattacgagcctgtggaaaatacagatgaggcgcagaagaaattcggcaatgtcaaggccatctcttctgatatgtacttcggcaggcagtcccaggctgattacgaaaccagggcccgactcgagagattatcggctagctcctcaattagttccgccgatctcttcgaggagcccagaaaacaacccgcatag

SEQ ID NO: 178379 - DNA, 459 bp, Artificial Sequence
  Description of Artificial Sequence: Synthetic coding sequence
atgggcgaccccagcaagcaggacatcctgaccatcttcaagcggcttaggagcgtccctactaataaggtctgcttcgattgtggtgcaaagaaccctagctgggcctcaattacctacggcgtgtttctttgcatcgattgctctggttcacatcgaagccttggagttcacctgtcatttattcggtcaacagagctggactctaactggtcctggtttcagctccgatgcatgcaggtagggggaaacgcaagtgccgtgagtgacacagcctgggcgagcgccatagccgaacccagttcccttacatctagacccgtcgaaacgacacttgagaacaatgaaggcgggcaggagcagggtccttcagttgaagggctgaacgtgcccactaaagcaacactggaagttagtagcataatcaagaaaaaacctaatcaggccaaaaaaggctag

SEQ ID NO: 178380 - DNA, 5550 bp, Artificial Sequence
  Description of Artificial Sequence: Synthetic coding sequence
atgtacgagggcaagaagaccaagaacatgttcctgacccgggccctcgagaagatcttggccgacaaggaagtgaaaaaggcgcaccactcacaactgagaaaggcctgtgaggtggccctggaagagataaaggctgaaaccgagaaacaatcccctccgcatggagaggccaaagccgggtcctcaacgttacctcccgtgaagtcgaagaccaacttcatcgaggcagataagtactttctccccttcgagttggcctgtcagtctaaatgtccccgtatcgtgtccacatctctagactgcctccagaagctgatcgcctacgggcacctgaccggaaatgcacccgattccactactccaggcaagaaactgattgaccggattatcgagacaatatgcggctgttttcagggaccgcagactgacgaaggagtgcagctccaaataatcaaggctctccttacggcagtaaccagccagcatattgaaatccatgaaggcactgtgctgcaggccgtaagaacttgttataacatttacttggccagtaaaaacctgatcaaccaaactactgctaaagccactctcacacaaatgctgaatgttatttttgccagaatggaaaatcaagccctgcaggaggccaaacaaatggaaaaggaacggcaccgccaacaccatcatctcctccagtcacctgtcagccaccatgaacctgagtccccacagttgcggtatttaccacctcaaactgttgatcatattagccaggagcatgaaggggatcttgatttgcatacgaatgacgtggacaagtcattacaggatgataccgagcccgagaacgggtcagacatctcttcagcagagaacgagcagacagaagccgaccaggcaaccgctgccgaaactttgtccaagaacgaggtgctctatgatggggagaaccatgattgtgaagaaaaaccgcaggatatcgtgcagaatattgtggaagagatggttaatattgttgtgggtgatatgggagagggtactactataaacgcctctgccgacgggaatatcgggacaattgaggacggaagcgatagcgaaaatattcaggctaatggaattcccggcactcctattagtgtcgcatacaccccatccctgcccgatgatagactgtccgtctcatctaacgacacacaagagtccggaaattcatccggcccatccccgggcgcgaagttttctcacatccttcagaaggatgcgtttttggtttttcgatcgctctgcaaactctcaatgaaaccactgagcgacgggcccccggatcccaaaagccatgaactgcgcagcaagatactctcactgcagcttttgctttccatactccagaatgcaggtcccatttttaggaccaatgagatgtttataaacgcaataaaacagtacctgtgcgttgccctaagcaaaaacggagtctcatctgtccccgaagtgtttgaattgagcttaagtatttttctcaccttactgtctaactttaaaactcacttgaaaatgcagattgaggtgttttttaaagaaattttcctgtatatcctggagaccagcactagctcatttgaccataagtggatggtgatccagactcttactcggatatgtgccgatgctcagagcgttgtggatatttacgtgaattatgattgcgatttgaacgccgcaaacatttttgagaggctagtgaatgacctgtccaaaatcgctcagggccgtgggtcacaggagctcggcatgtctaatgttcaagaactgagcctgcggaaaaagggactcgagtgtcttgtttctatcctgaaatgcatggtggagtggtcaaaggatcagtatgtaaaccccaacagccagacaacactgggccaggaaaagccctccgaacaggagatgtccgagatcaagcatcccgagaccataaatcgttacggatctcttaactcgctggaatccaccagcagttccggtattgggtcttatagcactcagatgtctggaacagataatccggagcagttcgaggtgttaaaacaacagaaggaaattattgagcaaggcatcgacctgttcaataaaaagccaaagagaggcattcagtacttgcaggaacaaggtatgctgggcacaaccccagaggacatcgcgcagttcctgcaccaggaagagaggcttgactccacccaagtcggggagttcctgggcgataatgacaagttcaataaggaagtcatgtacgcatacgtggaccaacatgattttagtgggaaggattttgtgtccgctctgcggatgtttcttgaaggatttcgactgccaggcgaggcccagaagattgacaggctgatggaaaaatttgccgcgcgttacttggagtgcaaccagggccagactctcttcgcctcagctgacacagcgtatgtcctggcctactcaataattatgctcacaacagacctccacagcccacaggtgaagaataaaatgacaaaagagcagtatatcaagatgaatcgcggaattaacgatagcaaagatctgcctgaggagtatctgtccgctatttacaacgagatcgctggcaagaaaattagcatgaaggaaactaaggaattgaccatccctactaaaagctctaagcagaacgttgcttccgagaaacagcgaagactcctctataacttggagatggagcagatggctaagacggccaaggccctgatggaagccgtcagccacgttcaggctccctttacctccgccacccatctggaacacgtacgcccaatgttcaagctagcctggactccattccttgcagcatttagcgtgggattacaggattgcgacgacaccgaggttgcatcattatgtcttgagggtatcagatgtgctattagaatcgcttgtattttcagtatccagcttgaaagggacgcctatgtgcaggcgttggccagattcacacttctaacagtgtccagtgggatcactgagatgaagcaaaagaacatcgatactataaagacgctgatcacagtggctcacaccgatggcaactatctgggaaactcatggcatgaaatcctcaagtgcatcagccagctggaactggctcaattgatcggtaccggtgttaaaccaaggtacatctcaggcactgtcagaggcagggaaggcagcctcacaggcactaaagaccaagccccagacgaattcgtcggtctggggcttgtcggggggaacgttgattggaaacagatcgcctccattcaggagtcgattggagagacgagctcccaatcagtcgtggtcgcagttgaccggatcttcactggctctacccgactggatggcaacgctatagtggatttcgtacgctggctgtgtgctgttagtatggacgagctgctgtctaccacccaccctcggatgttcagcctgcagaagattgttgagatctcatactataacatggggcgtatccgtttgcagtggtctcgcatctgggaggttattggcgatcattttaacaaggtgggctgtaacccaaacgaggacgtcgcgatcttcgctgtggactctcttcgacaactgtccatgaaatttctggagaaaggcgagctggcaaacttccggtttcagaaagactttttgaggccttttgaacatataatgaaacggaatcggtcaccaacaatccgtgatatggttgttcgctgcattgcccaaatggtaaactcgcaggccgccaatattcgctcaggatggaagaacatcttctccgttttccatttggcagcttcagatcaagacgagagcatcgtggagttggcatttcagacaactggtcatatcgtgacactcgtattcgagaagcacttcccagccacgatcgactccttccaggacgcagtaaaatgcctctctgaattcgcctgcaatgccgcatttccagatacgtcgatggaggcgatcaggctgatcaggcactgtgccaagtacgtgtcagacagacctcaggctttcaaggaatatacctctgatgatatgaacgtggcccccgaggacagagtctgggtcagaggatggttcccaatcttattcgaactgagctgcattatcaatagatgcaaacttgatgtccgcaccagagggctcaccgtgatgttcgagattatgaaaacctacggacatacctacgaaaagcattggtggcaggacttgtttcgaatcgtctttagaatttttgataacatgaagctgccagagcagcagaccgagaaagctgagtggatgaccaccacgtgtaatcatgctctatacgccatttgcgatgtgttcacgcagtacttggaagtactctcagatgttctacttgacgacatcttcgcccagttgtactggtgcgtgcagcaggacaacgagcagctggcccggtctggcactaattgtttggagaacgtggtgattcttaatggcgagaaatttacactcgagatatgggataaaacatgcaactgcacattggacattttcaaaaccactattcctcacgctctccttacctggaggccgaactccggagagacagctccaccccccccaagccctgtcagcgaaaagccgctggacactatctctcagaagagcgttgacattcatgattctatccagccccggtccgtcgacaatcgccctcaggctcccctggtatcagccagcgctgtcaatgaggaagtttctaagatcaaatcgaccgcaaaattcccagaacagaaactgtttgccgcgctgctcattaaatgtgtagttcagctcgaacttattcagaccattgataacattgtgtttttccccgcgacatcaaaaaaggaggacgccgaaaatctggccgctgctcaacgcgatgctgttgattttgatgtgagggtggacacacaggaccaaggcatgtatcgcttcctgacgtcccagcaattgttcaagttactcgattgcctgctggagagccataggtttgcgaaagccttcaactctaataacgaacagagaacggcattgtggaaggctggtttcaagggtaaatccaaaccaaatctcctcaagcaggagactagctctctggcatgcggcctgcgaattttgtttagaatgtacatggacgaaagtcgggtgtccgcctgggaagaagtgcagcaacgacttctcaatgtgtgctccgaagccctcagctactttttaactctgacctcagaaagccaccgggaggcatggacaaacttgctcctcttgttcctcacaaaagttctgaaaatttccgataaccgcttcaaggcccacgcgagtttctattacccgctcctttgtgaaatcatgcagttcgatctcatccccgagctgcgcgctgtgctgcgtcgctttttcctgcgaattggtgttgtctttcagatcagccagcccccggaacaagaactcgggatcaacaagcagtag

SEQ ID NO: 178381 - DNA, 5358 bp, Artificial Sequence
  Description of Artificial Sequence: Synthetic coding sequence
atgcaggagagccagaccaagagcatgttcgtgagccgggccctggagaaaattctggcggataaggaggtgaaacgacctcagcactctcaactgaggcgtgcctgtcaagtcgcactggacgaaattaaggcagagatagaaaagcagcggctagggactgccgcccctcccaaagcgaattttatcgaagcagacaagtactttctgccgtttgaactagcatgccagtccaagagtcccagagttgtctcaacttcgttagactgcctacagaagctgatcgcctatgggcacatcacaggcaatgccccagattcaggtgcacccggcaaacggctcatcgaccgaatagttgaaaccatttgctcttgctttcaagggccacagaccgacgaaggtgtccagttacagattattaaagccctcctgacagctgtgacgagcccccatatcgagatacacgaaggtacaattcttcagactgtccggacctgctacaacatctatctggcgtccaagaaccttatcaaccaaaccacggccaaggcaactctgacacagatgctaaacgtcatcttcacccggatggaaaatcaagtacttcaggaggctcgggagttggaaaagccaattcagtctaaacctcagtcccccgtaattcaggctgccgccgtgagccccaaatttgtccgtctcaagcactcgcaggcccagtccaaaccaaccacgccagaaaagacagatcttacaaatggcgagcacgccagaagcgattctggtaaggtgtcaactgagaatggcgacgcgcctagggagaggggatcctctctctccggtacagacgacggggcccaggaggtggtgaaggacatcctcgaggacgtggtgacttctgctattaaggaggctgccgagaagcacgggttgacagagccggaacgcgttctgggcgaacttgagtgtcaggagtgcgctatcccacctggggtagatgagaactcccagactaacggaatcgccgatgatcgccagtccctgagttccgccgataacctggagtctgatgctcaagggcaccaggtggccgctaggtttagccatgttctgcagaaggatgcttttctagtgttcagaagtctgtgtaagctctcaatgaaacctctgggggaggggccgccggacccaaagtcacatgaacttcggtccaaggtggtgtcactgcaattgctactatctgttctgcagaatgctgggccggtttttcggacccacgagatgtttattaatgctattaagcagtatctttgtgtggctctgtccaaaaatggggtgagtagtgtgccagacgtgttcgaactctccttggcaatatttctgacactacttagcaattttaagatgcacctcaaaatgcagattgaagtgtttttcaaagaaatttttttgaatattctggagacctctacatcctctttcgaacataggtggatggtaatccaaacacttaccaggatctgtgctgacgcccagtgcgtggtggacatctatgtgaactatgattgcgacctaaatgctgctaacatctttgaacggctggtgaacgatctgtcgaagatagcacaggggcgctcagggcacgaactgggaatgactcccttacaggaactgtccctgagaaagaagggtcttgagtgcctggtttccatccttaaatgtatggtggaatggtccaaagacctatatgtcaatcccaatcaccaaacatccctcggccaagaaagactgaccgaccaggaaattggggacggcaaaggactggatatggctcgccggtgtagtgttacatctatggaatcaactgtctcctcaggcacccagaccacggtacaagatgaccccgaacagttcgaagttattaaacagcagaaagaaattatcgagcacggcatcgagttgtttaacaagaagcctaaaagagggatccagtttctccaggagcaggggatgcttggcacttcggtggaagacatcgctcagttcttgcaccaggaggagcgtctggacagtacccaggtcggggacttcctgggcgatagcgctaggttcaataaagaggtgatgtatgcctacgtcgaccagctggacttctgtgaaaaggagttcgtttcggctttaaggacctttctggaggggttcaggctgccaggcgaagcgcagaagattgatagactgatggagaaatttgccgctcggtacattgaatgtaaccagggccagacactgttcgcatcagcggatacggcctacgtcctcgcatatagcataattatgctgaccactgatctgcactctccacaggtgaagaacaagatgaccaaagaacagtatattaagatgaaccgggggatcaatgactccaaagacttgcccgaagaatacctttcgagcatttacgaagagatcgagggaaagaagattgcaatgaaagaaacaaaggagttaacaatcgccaccaaaagcacaaagcaaaacgttgcctctgaaaagcaaaggaggcttctctacaacctcgaaatggagcaaatggccaagacggccaaggccttaatggaagccgtgtcccacgctaaggcaccattcaccagcgccacccacctggatcacgtgcgcccaatgtttaagctcgtttggacccccttgctcgctgcctatagcatcgggctgcaaaactgtgacgacactgaggtagcctctctgtgtctcgagggaatcagatgcgccattcggattgcctgcatctttgggatgcagctggagagggatgcatacgtgcaggcactagctcgattttcactgctgactgccagcagtagtattaccgagatgaaacagaaaaatatcgatactatcaaaacactcatcaccgtggctcataccgacgggaattatctgggaaactcatggcatgaaatcttgaaatgtattagtcaactcgagctggcacagttaatcggaacaggcgtgaaaactcggtacctgtccggcagcggcagggagagagaaggatctcttaagggccacacattagccggcgaggagttcatgggccttggcctcgggaacttggtatcagggggggtcgataaacgtcagatggcatccttccaggaaagtgtgggagagaccagcagtcaaagcgtcgtcgtagctgttgatcgcatattcaccggatccaccaggttggatggaaacgcgattgtagattttgtgcggtggctgtgtgccgtatctatggatgagttggccagcccacatcacccgcgtatgttttcactccaaaagatagttgaaatctcttactataatatgaatcgcatccgtcttcagtggtcaagaatctggcatgtaattggcgaccactttaataaggtggggtgcaatcccaatgaggatgttgccatttttgcagtggattccctgcggcagcttagtatgaagttcctcgagaaaggagagctggctaattttcgatttcagaaagacttccttaggcctttcgaacacataatgaaaaagaatcgcagccccaccattcgagacatggctatcaggtgtatagcacaaatggtcaactcccaggctgcaaatattcggagtggttggaagaacatctttgccgtcttccatcaggccgccagcgatcacgacggaaatatagtcgagctggctttccagacgacatgccatatcgtgaccaccatttttcaacaccattttcccgccgctattgatagtttccaggacgctgttaaatgcctgagtgaatttgcttgtaatgcggcattccctgacacttcaatggaagctatccgcctgattagattttgtggaaagtatgtgagcgagaggcccagggtgctgcaggagtacactagtgacgatatgaatgtcgcccctggagacagagtctgggttcgagggtggttccctattctgtttgagctgagttgtataatcaatagatgtaagctagatgtccgtacgcgcggtctaacagtcatgtttgaaatcatgaagagttacgggcatacgtttgaaaaacattggtggcaggacctcttcaggatcgtgttccgcatctttgacaatatgaagcttccagaacaactgtccgaaaaaagcgaatggatgacgacaacctgcaaccacgctctgtatgctatttgtgatgtgttcacacaattttatgaagctctcaatgaggttctcctctctgatgtgtttgcccagctccagtggtgtgtcaaacaggacaatgagcagcttgcgagatccggtacaaattgtctcgagaacttggtgatttctaacggagagaagttctccccagaagtgtgggatgagacatgtaactgcatgctggacatattcaagaccacaatccctcacgtgttgctgacatggcggcccgtgggcatggaggaggattccagtgagaagcacttggacgtcgaccttgatcggcaatcattgtcttccattgacaaaaacccctctgagcgcggacagagccaactcagcaacccaactgacgactcttggaagggacggccttacgctaatcagaagctgttcgcctcactattgattaaatgtgtggtgcagctcgagcttatacagaccatcgataatatcgtcttttacccagccacttcaaagaaggaagacgctgaacacatggtggcggcgcagcaagatacattggacgcggacatccacattgagacagaggaccagggcatgtataagtatatgtccagtcagcacttattcaaactgctggattgcctgcaagagtctcacagtttcagcaaagccttcaactctaattacgagcaacggacagttttgtggcgggccggattcaaaggcaagtcgaaacctaacttgctaaagcaggaaacttcctcccttgcttgctgtctgcgtattctctttcgcatgtacgtggatgagaatcgtagggattcttgggaagagatccagcagaggctgttaaccgtgtgtagtgaggccttggcttatttcatcacagtgaacagtgagagccatcgagaagcatggacatccctgttgttgttgcttctcaccaagacactcaagatcaatgacgagaagtttaaagcccacgcttctatgtactatccctacttatgcgaaatcatgcagttcgacctcatcccagagctccgggctgttctgcgtaagttcttcttgagaatcggagtagtctacaaaatctggattcccgaggaacctagtcaggtgccagccgctctgagtcccgtctggtag

SEQ ID NO: 178382 - DNA, 2499 bp, Artificial Sequence
  Description of Artificial Sequence: Synthetic coding sequence
atgcaggagagccagaccaagagcatgttcgtgagccgggccctggaaaagatcctggcagataaggaagtgaagaggcctcagcattctcagttacgacgggcttgccaagttgcattagatgagataaaggcagaaattgagaagcagcggctcggtaccgctgcaccgccaaaggctaacttcattgaggcagacaagtattttctgcccttcgaactggcatgccaatcaaagagcccacgggtggtgtcaacatctcttgattgtcttcaaaaattaattgcttatggccatatcaccggaaacgcgccggattctggcgctcccgggaagcgactgatcgataggatcgttgaaactatatgttcctgcttccaaggtcctcaaacggacgagggcgttcagctgcagatcatcaaagctcttctgactgcagtgactagcccacacatcgagatccacgaaggcactattttgcagactgtgagaacttgttacaatatctaccttgcctcaaagaacttgatcaaccagaccactgccaaggctacactcacccagatgctgaatgtgatcttcacccgcatggagaaccaggtgttgcaggaggccagagagctggagaagcctatccagtcaaagccccagtctcccgtcatccaggcagcagctgtgtcccccaagttcgtgcgcttgaagcactctcaggcgcagagcaagcccactacacctgagaagactgatctgacgaacggtgaacatgcacgttctgattccggaaaggtaagtacggaaaacggggacgccccgcgagagcggggcagtagtttgagtggcacagatgatggagcacaggaggtcgttaaggacattctcgaggatgtggttacctcagccattaaggaggccgccgagaaacacggtttaacggagcccgagagagtactgggtgagttggagtgccaagaatgcgcgattccaccgggagtggatgaaaattctcagaccaatggtattgccgacgatagacagagcctgtcttctgccgataacctggagagcgatgctcagggacaccaggtcgccgctcgtttcagtcacgtccttcaaaaggatgccttcctggttttccggagcctctgcaagttgtccatgaaacccctgggggagggcccgcccgatccaaagagccacgagctgagaagtaaggtcgtatctttgcagctgctcttgagcgtccttcagaatgctggcccagtattcagaacacacgagatgttcatcaatgccatcaagcagtatctttgcgtcgctctgagcaagaatggcgtctcttccgtgcctgacgtctttgagcttagcctggcaatcttcttgacactgctgtccaatttcaagatgcatctgaaaatgcagattgaggtattctttaaggagatcttcttgaatatactcgagaccagcacatcctcctttgagcaccgctggatggtcattcagacacttacgcggatttgcgcggacgcacaatgtgtagttgatatttatgtgaactacgactgcgacttgaacgctgctaacatttttgagcgacttgtgaatgacctctccaagatcgcccagggccgttcaggtcacgagttaggaatgacacctttacaggaactaagccttagaaagaagggcctagagtgtctggtaagcatactaaagtgtatggtcgaatggtccaaagacctgtacgttaaccctaatcatcagacttcattaggccaagaaaggctgactgaccaggaaattggggatggcaaaggcttagatatggccaggaggtgctccgtaacgtctatggaatctaccgtgtcctctgggacccaaaccaccgttcaggacgatccagagcagtttgaggttatcaagcagcagaaggaaattatagagcacggaatagaactgttcaacaaaaagccaaagcgagggattcagtttctccaggagcagggtatgcttggaacctcggttgaggacatcgcacagttcctgcaccaggaagagcgcctggacagtactcaagtgggggactttctaggagattcggcacggttcaacaaagaggtcatgtacgcgtatgtcgatcagctcgacttttgcgagaaagaatttgtgtccgccctgagaacattcctcgaagggtttagactgcccggggaagctcaaaaaatcgaccgactgatggagaagtttgccgccaggtatatcgagtgtaaccaaggacaaactttgttcgcttctgccgatactgcatacgtcctggcatattctattatcatgctcacaacggacctccattcaccgcaggtaaaaaacaagatgacaaaggagcagtatatcaagatgaaccgcggcataaacgatagcaaagatctccctgaggagtacctttcttcaatttacgaggagattgaaggcaagaagatcgctataaaaaagaactag

SEQ ID NO: 178383 - DNA, 591 bp, Artificial Sequence
  Description of Artificial Sequence: Synthetic coding sequence
atgggcagcgtgaacagccggggccacaaggccgaggcccaggtggtgatgatgggattggattctgccggcaaaacaacacttctgtataagctcaagggtcatcaattagtcgagactctgcctactgtcggatttaatgtcgagccgttgaaagctccgggtcacgtgtctttgaccctgtgggacgttggtggccaggcgccgttgcgggcaagttggaaagactacctggaaggtactgacatcctagtatacgtactggactctactgacgaagccaggctgccagaatccgccgccgagttaaccgaagtgctgaacgacccaaacatggctggagtaccgtttttagtactggcaaataagcaggaggcacctgacgcgctccccttgctgaagatcagaaataggttgtccctggagcggttccaagaccattgctgggagctgcggggctgtagcgccctgaccggagaaggcctgcccgaagctctgcaaagcttgtggtccctgcttaagtcacgctcttgcatgtgtctgcaggccagggctcacggcgcggaacgcggcgattcaaagagaagttag

SEQ ID NO: 178384 - DNA, 966 bp, Artificial Sequence
  Description of Artificial Sequence: Synthetic coding sequence
atgttcagcctgatggccagctgctgcggctggttcaagcggtggagagaacctgtgcggctggccaataagcaggacaaggagggagctttgggtgaagccgacgtgatcgaatgtttatcactggaaaagctcgtgaacgaacacaagtgcctgtgccagatcgaaccctgctcggccatatccggatacgggaaaaagatcgataagtcaataaaaaagggcttgtattggctcctgcatgtgatcgcgcgagattttgatgccctaaacgagcgaatacaaaaggaaactactgaacaacgggccctcgaggaacaggagaagcaagagcgggccgaaagagttcggaaacttagagaggagcgcaagcagaacgagcaggagcaggcggaactggatgggacttccggtcttgccgagctagaccccgaacccactaatccttttcaacccattgcaagcgtgatcatcgagaatgaaggcaagctggagcgcgaaaaaaagaatcaaaaaatggagaaggattccgatggctgtcaccttaaacacaaaatggagcacgagcagatcgaaacgcagggacaagtgaatcacaacggacagaagaataacgagttcgggctggtggagaactataaagaggctttaactcagcaactcaagaacgaagacgaaaccgacaggccaagccttgagtccgctaacggcaagaaaaagacaaaaaagctccgcatgaagcggaatcaccgggtggagcccttaaacatcgatgattgcgcacccgagagccctactcctccgcctccacctccacctgtgggctggggaacacctaaagtaaccagattaccgaagctggagcctctgggcgaaacccaccacaatgacttttatagaaaaccactgcccccgctggcagttccccagaggcctaactcagatgcccacgacgtgatatcctag

SEQ ID NO: 178385 - DNA, 1287 bp, Artificial Sequence
  Description of Artificial Sequence: Synthetic coding sequence
atgttcagcctgatggccagctgctgcggctggttcaagcggtggcgggaaccagttcggaaggtaactctcctgatggtgggtcttgacaacgccgggaaaaccgccaccgccaaagggattcagggggaatatccagaggacgtggcgcctacagtcggcttttctaagattaatctcaggcaaggcaaatttgaggtcaccatcttcgacctcggcgggggcatccgaattagaggcatctggaaaaattactatgctgagtcgtatggagtgatattcgtggtagatagttccgacgaggaaaggatggaggaaaccaaggaagcgatgtccgagatgctgcgccatccccgcataagtggcaagcctattctggtgttagctaataaacaggataaagaaggggctctgggggaggctgatgtgatcgagtgccttagccttgaaaagctagtgaacgaacataaatgtctgtgtcagatcgaaccttgcagcgctatttcagggtatggaaagaaaattgataagtctatcaaaaagggattatattggctgctacacgtcattgccagagatttcgatgccctaaacgagcgaatccagaaggagactactgagcagcgggccctggaagagcaggagaaacaggagagggcagagagagttaggaaattacgcgaggagagaaaacagaatgaacaagaacaagccgagctagatggtacatctggtttggctgagctcgatcccgagcctactaacccatttcaacctatcgctagtgtgataattgagaatgagggaaagcttgagcgtgaaaaaaagaaccagaagatggagaaggatagcgatgggtgccacttgaaacataagatggagcacgagcagatcgagacccagggacaggtgaaccataacggccaaaagaataacgaattcggccttgttgagaattataaagaggcactcacacagcagcttaagaatgaggacgagacagaccgcccgtcgttggagtctgcgaacggcaagaaaaagaccaagaagctgcggatgaagaggaaccaccgagtcgagccccttaacatcgacgattgtgctcccgaaagtcctacaccacctcccccacctccccccgtgggctggggcactcccaaagttaccagattgcccaagctggagccactcggcgagacgcaccacaatgatttttatcgcaaacccctgccacccctggccgtcccccagcgcccaaattccgatgcacacgatgtaatctcctag

SEQ ID NO: 178386 - DNA, 1287 bp, Artificial Sequence
  Description of Artificial Sequence: Synthetic coding sequence
atgttcagcctgatggccagctgctgcggctggttcaagcggtggcgcgaaccagttcgcaaggtgaccctgctcatggtcggcctcgacaacgctggaaaaactgccactgccaaaggcatacaaggcgagtaccccgaagacgtcgcccctacagtgggtttcagcaagatcaatcttagacagggcaaatttgaagttactattttcgatctgggaggtggaatccgcatacgcggaatatggaaaaattactacgccgaatcttatggcgtcatcttcgtcgtggattcatctgacgaggagaggatggaggagacgaaggaagccatgtccgaaatgctgcggcaccccaggatttctggaaagccgattcttgtcctggccaataaacaggataaagagggtgcgctaggtgaagctgatgttatcgagtgcctgagtctggagaaactggtcaatgagcataagtgcctctgtcagatagaaccttgtagcgccatctctggctacgggaagaaaatcgataagagtatcaagaagggtttgtattggcttctccatgttatagcaagagattttgacgccctaaacgagaggatccagaaggagacaaccgagcagcgcgctcttgaggagcaggagaagcaagagagggcagagcgcgtgcgtaagctgcgggaggagcgcaagcagaatgagcaggagcaggctgagctcgatggcactagtgggctcgccgagctggatccagaacccacaaatccattccagcctattgcctccgtgataatcgaaaacgagggaaagctcgagcgcgagaaaaaaaaccagaaaatggagaaggattccgacgggtgccatttgaagcataagatggagcatgagcagatcgagactcagggacaggttaatcacaacggccagaaaaacaacgaattcgggttggtggagaattacaaagaagccttgacccagcagttgaagaacgaggacgagaccgatcgtccaagcctcgaatctgctaatggtaaaaaaaagactaagaagctgcgaatgaaacgcaatcaccgcgtggagccattgaacatcgacgattgcgctcctgaatcaccgacaccccccccacctccccccccggtcggatggggaacccctaaggtgacgcggctccctaagctagaaccacttggggagactcaccataacgacttttacagaaagcccctgccgcctctggcagttcctcaacgccccaactcagacgcccatgatgttatatcttag

SEQ ID NO: 178387 - DNA, 978 bp, Artificial Sequence
  Description of Artificial Sequence: Synthetic coding sequence
atggaggagaccaaggaggccatgagcgagatgctgcggcacccccgtataagcggcaaacctatcctggtattagctaacaagcaggataaggagggtgccttgggtgaggctgacgtgatcgagtgcctcagtcttgagaaactagttaacgaacacaaatgtctctgccagatagaaccatgtagcgctatttcagggtatggcaagaaaattgataagagtattaagaaaggcctctattggctcctacatgtaatcgcccgcgacttcgacgctttgaacgagaggatccaaaaggaaaccacggagcaaagggcactagaggagcaggaaaagcaggagagagcagaaagagttcgcaagcttcgcgaggaaaggaagcaaaatgagcaggaacaagccgagctcgatgggacctccggccttgcagaactggatcccgaacccaccaacccattccaacctatcgcgtccgtcataatcgagaacgaggggaaactcgaacgcgagaagaaaaaccaaaaaatggagaaggactctgacggctgtcacctaaaacataaaatggaacatgaacaaattgagacccagggccaggtcaatcacaacggccagaagaataacgaatttggactggtcgagaactacaaagaggctttaacccagcaactgaaaaacgaggacgaaactgatagaccatctctcgagtcggcgaatggtaagaaaaagacgaagaaactgagaatgaagcgaaatcacagagtcgagccactcaatatcgacgattgtgctcccgaaagtcccacaccacctccacccccacctccagttggatgggggactccaaaggtgaccaggctgccgaagctggaaccgttgggagagacccaccacaacgatttctacagaaaaccgctgcctccactcgcagtgccacagaggcccaatagtgacgcccacgatgtgatctcttag

SEQ ID NO: 178388 - DNA, 450 bp, Artificial Sequence
  Description of Artificial Sequence: Synthetic coding sequence
atggagaaggacagcgacggctgccacctgaagcacaagatggagcatgaacagatcgaaactcaggggcaggtgaaccacaatggacaaaaaaacaatgagtttggcctggttgagaattataaagaggccttaactcagcagctgaagaatgaagacgagaccgatcgcccctcgttagaatccgcgaacgggaagaagaaaactaaaaaattaagaatgaagcggaaccaccgcgtggaacctctgaatatagatgactgtgccccagagagtcccacaccaccaccaccaccaccccccgtagggtgggggacccctaaagtcacaagattgcctaagttggaacccctcggagagacacaccacaacgacttctacagaaagccgctacctccactggctgttccccagcgccccaactccgatgctcacgatgtgatttcttag

SEQ ID NO: 178389 - DNA, 579 bp, Artificial Sequence
  Description of Artificial Sequence: Synthetic coding sequence
atgggcagcctgggcagcaagaacccccagaccaagcaggcccaggtcttgttgcttggcctcgactccgctggaaagtctacactgctgtataagctcaaactggcaaaagatatcactaccatccctacaatcgggttcaacgtagagatgatagagctggaaaggaatctgagtctaaccgtgtgggatgtgggaggacaggagaaaatgaggaccgtgtggggatgctactgcgagaacaccgacggtctggtgtacgttgtcgatagcaccgataagcagaggctggaagaatcgcagcgccagtttgaacatatactaaaaaacgaacacatcaaaaacgtaccagtagtcctcttagcgaacaaacaggacatgcccggggccctgacagcagaagatatcactcgtatgttcaaggttaagaaattatgctccgacagaaactggtacgtccagccatgctgcgccctgacaggcgaaggtctggcacaggggttccgcaagctgactggatttgtgaagtcacacatgaaatctagaggagacactttagctttttttaagcaaaattag

SEQ ID NO: 178390 - DNA, 555 bp, Artificial Sequence
  Description of Artificial Sequence: Synthetic coding sequence
atgggcctgctgaccatcctgaagaagatgaagcagaaggagcgggaattgaggctcctcatgctcggcctggataacgccggcaagactacaatcctgaagaagttcaatggagaggacatcgataccatatctcctacgctggggttcaatattaagaccctggaacacaggggattcaagttaaacatctgggatgtgggggggcaaaagtccctgcggagctactggcggaattacttcgagtctaccgacggtctgatttgggtggtggattccgctgaccgccagcgcatgcaggattgccagagagaactgcaaagcttgctggtggaggaacgcctggcaggtgccaccctgctgattttcgctaacaaacaggatctgccaggggccctgtcatcaaacgccatacgcgaagtcctggagctggattccatcaggtcccatcattggtgcatccagggctgttcggccgtgactggtgagaaccttcttcccggcatcgattggctgctcgatgatatcagctcgcggatttttacagccgactag

SEQ ID NO: 178391 - DNA, 555 bp, Artificial Sequence
  Description of Artificial Sequence: Synthetic coding sequence
atgggcctgctgaccatcctgaagaagatgaagcagaaggagcgggaactaagactgttaatgttaggattggataacgcaggtaaaacaacaatattgaaaaagtttaacggagaagacattgataccataagtccaactctcggctttaacattaaaacccttgagcaccgtgggttcaagctgaatatctgggatgtagggggacagaagtccctgaggtcttactggaggaattattttgagagcacagacgggcttatttgggtcgtcgactcagccgatcgccagaggatgcaggattgtcagagagaattacagagcttattggttgaagagcgcttggccggagcgaccctgctgatttttgcaaataaacaggatcttcctggcgctctgagttccaatgccatcagggaagtgctggagctggatagcattcggagccaccactggtgcatccagggctgctctgccgtgactggagagaacctgctcccaggcatagactggttactggatgacatatcttcccgtatcttcacagctgattag

SEQ ID NO: 178392 - DNA, 474 bp, Artificial Sequence
  Description of Artificial Sequence: Synthetic coding sequence
atgggcctgctgaccatcctgaagaagatgaagcagaaggagcgggagttgcggctgttgatgttagggttggacaatgccggcaaaaccaccattctgaaaaaatttaatggtgaggacatcgatactatttcgccgactcttggttttaatattaagacccttgaacaccgcggctttaagctcaacatttgggacgttggagggcagaagagcctgcgcagttattggcggaattacttcgaatctacagatggactgatctgggtggtggattctgctgaccgacagagaatgcaagactgccaacgggagctgcaaagtctcctggtcgaagaggtactcgagttggactctattagatcccaccactggtgtattcagggttgttcagccgtgacgggggaaaatctcctgccaggtatcgattggctcttagacgacatttcttcccgtattttcaccgcagattag

SEQ ID NO: 178393 - DNA, 549 bp, Artificial Sequence
  Description of Artificial Sequence: Synthetic coding sequence
atgggcctgctgagcatcctgcggaagctgaagagcgcccccgaccaagaagtgcggatactgctcctgggccttgataatgcaggaaaaacaacattgctaaagcagctcgccagtgaggacatttcccatattacaccaacgcaggggtttaatattaagagcgtgcaatcacaggggtttaagctgaacgtctgggacataggaggtcagcgtaagattcgaccttattggaaaaactatttcgaaaatactgacatactcatctacgtgatcgattccgccgaccgaaaacgcttcgaggagactggtcaggagctcgcggagctcctggaagaggagaagctgagctgcgttccagttcttatctttgcgaacaaacaggacttgctgacagctgcacccgcctccgagattgcagaaggcttgaacctgcatacaattagggatagggtctggcagattcagtcctgcagcgcactgaccggagagggcgtgcaagacggcatgaactgggtttgcaaaaatgtgaacgcaaagaaaaaatag

SEQ ID NO: 178394 - DNA, 606 bp, Artificial Sequence
  Description of Artificial Sequence: Synthetic coding sequence
atgggcaaccacctgaccgagatggcccccaccgccagcagcttcttgccccactttcaggcgctccacgtcgtggtgattggactagattccgccggaaagacgtctttgttatacagactgaaatttaaagaattcgtgcagagcgtgccaaccaaggggttcaatactgagaagatacgcgtcccgctgggtgggtctagagggatcaccttccaggtgtgggatgtgggcgggcaggagaaattaaggccactatggcggtcttacacccgtcgaacggacggcctggtatttgtcgtggacgcagcggaggccgagcgcttggaagaagcaaaggtggagttgcacaggatcagcagggccagcgacaaccaaggagtgcctgtgctggtccttgccaataagcaagaccagccaggcgcactgtccgcagccgaggtggagaagagactggcggtccgagagctcgcagcagcaaccctgacacacgtgcagggatgttccgcagtggacggcttagggctccagcaggggctggaaaggctgtacgagatgattctgaagagaaagaaggcagcgagaggggggaagaaacgcaggtag

SEQ ID NO: 178395 - DNA, 561 bp, Artificial Sequence
  Description of Artificial Sequence: Synthetic coding sequence
atgggcctgctggaccggctgagcgtgctgctgggcctgaagaagaaggaggtccatgtgctgtgcttaggactcgataacagtggtaagactacaatcatcaacaaactcaaaccctctaatgcccagagccaaaatattctgccaacaatagggttcagcatagagaagtttaagtctagctctttgtctttcacggtgtttgatatgtcaggacaagggagataccggaatctgtgggagcattactacaaggagggacaggcaatcatattcgtgatagacagctcggatcgccttagaatggtggtagcgaaggaggaactcgacactctgctcaatcaccccgatataaaacaccggcgtatccccatcctcttctttgctaacaagatggatctgagagatgccgtcacatcagtgaaggtgagccagcttctctgcttagaaaatatcaaggataaaccctggcacatttgcgcctcggatgccattaagggggagggtcttcaggagggtgtcgattggctgcaagaccagatccagactgtgaagacctag

SEQ ID NO: 178396 - DNA, 561 bp, Artificial Sequence
  Description of Artificial Sequence: Synthetic coding sequence
atgggcctgctggaccggctgagcgtgctgctgggcctgaagaagaaggaggttcacgtgctctgccttggtctggacaatagtgggaagaccacaattatcaacaaactgaaaccctccaatgcacagagccagaatatcctccctactatcggctttagcattgagaaatttaaatcttcctccctgtccttcactgtgtttgatatgagcggccagggacggtatagaaacctgtgggaacattactataaagaaggtcaggccattatttttgtgatcgattcaagcgaccggctgcgcatggtcgtcgcaaaagaggaactggacaccctgcttaatcacccagatatcaagcatcggcggattcccattctgttctttgccaacaagatggacctgcgtgacgcggttaccagcgtgaaggtgtcacaattactgtgcttggaaaacattaaagataaaccttggcacatctgtgccagcgatgccattaagggcgaaggtttgcaggaaggcgtggactggctgcaggaccagattcagaccgtcaagacctag

SEQ ID NO: 178397 - DNA, 366 bp, Artificial Sequence
  Description of Artificial Sequence: Synthetic coding sequence
atgggcctgctggaccggctgagcgtgctgctgggcctgaagaagaaggaagtccacgtcctgtgtctgggactggacaattctggaaagacaaccattatcaataaactgaagccgtctaacgcacagagccagaatattctccccacaatcggcttcagcattgagaaattcaagtctagcagcctgtcgttcaccgtgttcgacatgagtggacaaggacgatataggaatctctgggagcattattacaaggagggtcaagcaatcattttcgttatcgactcaagtgaccgcttgcggatggtggtggctaaagaggaactggacacacttctcaatcatcccgatattaaacatcgctag

SEQ ID NO: 178398 - DNA, 561 bp, Artificial Sequence
  Description of Artificial Sequence: Synthetic coding sequence
atgggcctgctggaccggctgagcgtgctgctgggcctgaagaagaaagaggtgcacgtactctgcctcggcctggataactccggcaagacgacaatcatcaataagttgaaaccatccaacgcccagagccagaatattttacccaccattggattcagcatagaaaaattcaaaagttccagcctctccttcactgtgttcgatatgagtggacagggtcgatataggaatctgtgggagcactattataaagaagggcaggcaattatcttcgtgatcgatagctccgatcgtttgcggatggtggttgccaaagaggagctggacactttactcaatcatccagacataaagcatcgcaggatacctatactgtttttcgcaaacaaaatggaccttcgggacgcggttacgtccgtcaaggtgtcccagctgctttgtctggagaacataaaagataaaccatggcacatatgcgcttccgacgccatcaagggtgaagggctccaggagggcgttgattggttacaggaccagatccagacagttaaaacctag

SEQ ID NO: 178399 - DNA, 561 bp, Artificial Sequence
  Description of Artificial Sequence: Synthetic coding sequence
atgggcctgctggaccggctgagcgtgctgctgggcctgaagaagaaagaggtccacgtgctatgcctgggcctcgataattcagggaaaacgactattatcaacaagctgaaacccagcaacgctcagtcgcagaacattcttccaactattggcttttctatagaaaagttcaaatcatcatcactttcttttaccgtcttcgacatgtctggccagggtagatacaggaacctctgggagcattactataaagagggtcaagccattatttttgtcattgactcatccgatcgcctcagaatggttgtcgccaaggaagaactggataccctcttaaatcatcccgacatcaaacatcgcaggatccccatactgttctttgccaataagatggacctgagagacgcggtgacatctgtcaaagtctcccagctgctctgcctagaaaacatcaaggacaagccgtggcacatctgcgcctctgacgctatcaaaggagaaggactgcaagagggtgtggactggctccaagatcaaatacagacagttaagacctag

SEQ ID NO: 178400 - DNA, 564 bp, Artificial Sequence
  Description of Artificial Sequence: Synthetic coding sequence
ctgcggcccacctggaaggccctgagccaccccgcctggcccgaggaaaagaacaagcagattctggtgctgggtctggacggagccggtaaaaccagtgttctgcattctctcgcatcaaatagggttcaacactccgttgcccctactcaggggtttcatgctgtttgtattaacaccgaggacagtcagatggagtttctggaaatcggcggcagtaaaccgtttcggtcctactgggaaatgtacctgtcaaagggcctcctgctgatctttgtggtcgattctgccgaccatagtagactgcctgaagccaagaagtacctgcaccagctaatcgccgccaacccagttttgccccttgttgtgttcgcgaacaagcaggatctagaagccgcataccacatcaccgatatccacgaagcacttgccctatctgaagtcggaaatgacaggaagatgtttttatttggaacatacctcaccaagaatgggagtgagatcccgtctactatgcaggatgccaaagacctcatcgctcaactggcagccgacgtccagtag

SEQ ID NO: 178401 - DNA, 1083 bp, Artificial Sequence
  Description of Artificial Sequence: Synthetic coding sequence
atggagcgggccggccccgccggcgaggagggcggcgcccgggaggggaggcttttgcctagagcccctggcgcttgggtgttgcgggcctgtgctgaaagggccgccctggaagttggagccgcaagcgcagacaccggagtcaggggctgcggtgcccggggacctgctcctctgctcgccagtgccggcggagggcgagcccgtgacggaacatggggagtgaggactaaaggttcgggcgcagccctcccgtctcgcccagcgagccgtgcagcacctagacccgaggcttcttctcctccattacctctggagaaagctaggggaggcctgtctgggccacagggaggcagagctcggggtgctatggcccatgtggggtcccgcaagcgtagtcggagcagaagccggtcccgagggcgcggaagcgaaaaaaggaagaagaaaagtcggaaggatacctcccggaattgttcggcctccaccagccagggccgcaaggcatccacggctcccggggccgaagcctcaccgtctccttgtatcacggaacggtccaaacaaaaggccagacggcggactaggtccagtagctcatcatcctcaagctcttcctcatcttcatcatcatctagcagcagcagtagtagcagctctagtgatggccgtaaaaaaagaggaaagtataaagataaacgacggaagaagaaaaaaaaacggaagaaattgaaaaaaaaggggaaggaaaaggctgaggcccagcaagttgaggctctgccgggccctagcctggatcagtggcatcggagcgccggggaggaagaagatgggcctgtgctcaccgacgagcagaaatctagaattcaggctatgaaaccgatgactaaggaggagtgggacgcccgacagagcatcatccgtaaggtcgtggaccccgagacaggccgaaccagacttattaagggagatggggaggtattggaagagatcgtcaccaaagaaagacatcgtgagatcaataaacaggctactagaggagactgcttggccttccagatgcgcgcgggtcttctcccatag

SEQ ID NO: 178402 - DNA, 1017 bp, Artificial Sequence
  Description of Artificial Sequence: Synthetic coding sequence
atggagcgggccggccccgccggcgaggagggcggcgcccgggagggtaggcttcttcccagagcccccggtgcatgggtgctgcgtgcctgcgccgagcgggccgccctggaagtcggcgccgcctccgccgatacaggggttagaggctgcggcgcccgtggccctgcgccgctcttagccagtgctgggggcggacgggccagggatggcacgtggggggtgcgcaccaaggggtcaggcgctgctcttccatccagacctgcttcacgggcggcgcctaggccagaggcttctagccctcctttgccgctggagaaggcaaggggcgggctgtctggtccacagggcggcagagcccgtggcgccatggctcatgtaggcagcaggaaacggtcacggtcccggagccgctccaggggacgcggcagcgagaagaggaagaagaagagcagaaaggacacatctagaaactgtagcgcgagtaccagtcaggagcgcagtaagcaaaaggcccgtcggagaacccggagctcaagctcaagctccagtagctctagcagctccagttcctcttcgtctagttcaagttcatcttcatcctctgacggaagaaagaagcgcggtaagtataaagataaacggcgcaagaaaaagaagaagcgcaagaaactgaagaagaaagggaaagagaaggccgaagcgcagcaggtagaagcacttcctggcccttcactcgaccagtggcatcgatctgctggcgaggaggaagacgggccagtgttaacagatgaacaaaagtcccgtatccaggctatgaaacctatgactaaggaggagtgggatgccaggcagtcgattatccgcaaggtggtggatcctgagacgggccggacgcgcctcattaaaggagacggcgaggtactggaagagatcgttaccaaggagcgacatcgcgagattaataaagtgggagttgcgcctctacctgcgataaggccacagctatgcctgtag

SEQ ID NO: 178403 - DNA, 1059 bp, Artificial Sequence
  Description of Artificial Sequence: Synthetic coding sequence
atggagcgggccggccccgccggcgaggagggcggcgcccgggagggacgcctgctgccccgcgcaccaggagcttgggtgttacgggcgtgtgccgagcgcgcggccctcgaagtgggcgcagcctctgcagacaccggagtgcgtggatgcggcgccaggggaccagccccgctcctcgcctctgctggaggcggccgcgctcgagacgggacctggggggtgagaacgaaaggctctggtgctgccctgccttccaggcctgccagccgcgccgccccacgtccagaggcgagttcacctcctttgcctctggagaaggcacggggtggactgagcggtccgcaggggggccgcgcaagaggggctatggctcacgttggttcccggaagaggagtagaagtcgcagcagaagtcgtggacgcggctcggagaagaggaaaaagaaatctaggaaggacacttcacgcaactgcagcgcctccacctctcaaggacgtaaggcaagcacagcccccggcgccgaagagagaagcaaacaaaaggccaggaggcgcacgcgcagttcttcgtcaagtagtagtagcagctctagttctagtagctcatcctcttcttccagcagttcctctagtagtgatggcagaaaaaagcgaggaaagtacaaggataaacgacggaaaaagaaaaagaagcgcaaaaaactgaagaagaaaggcaaagagaaggcagaagcccaacaggttgaagccctgcccggtccatcattggatcagtggcaccgctctgccggggaagaagaggacggacctgtgcttactgacgagcagaagagtcgaatccaggccatgaaacctatgacgaaagaggagtgggatgcgaggcagagcattatcaggaaggtggtagatccagaaacaggaaggaccagattaataaaaggagacggcgaagttttagaggaaatagtgaccaaagaaagacatcgagagatcaataagcaagcaacacgaggggactgcctggcctttcagatgagagccgggcttctgccctag

SEQ ID NO: 178404 - DNA, 1026 bp, Artificial Sequence
  Description of Artificial Sequence: Synthetic coding sequence
atggagcgggccggccccgccggcgaggagggcggcgcccgggagggcagactccttccaagagctccaggggcttgggtcctgcgtgcctgcgccgagagggctgcgctggaagtgggagctgcctccgccgacacaggcgtccgcgggtgtggggctcggggccctgctcctcttctggccagcgccggtggaggacgcgcgcgagatggtacctggggagttcgtaccaaggggagcggtgctgcactgccatctcggcccgcctcaagagctgcacccaggccagaggcctcttcccctcctttacccctggaaaaggctagaggaggtctgtctggcccacagggcggacgcgcgcggggagccatggcacacgtaggaagcaggaaaaggtctaggtcgaggtctcgcagccgcggtagaggcagcgagaaacgaaagaaaaaaagcaggaaagacacttccagaaactgctcggcttcaacatctcaggaaagatcaaagcagaaggcgaggaggcgcactaggagctcctcttcctcttcatcatccagctcgtccagctcatccagctcctcatcaagctcttcttcttcctcatcagacggacggaagaagaggggaaagtataaagacaaaaggcggaagaaaaagaagaaaagaaaaaagcttaaaaaaaagggcaaggagaaggcggaggcgcagcaggtggaggccttgccaggtcccagtctcgaccagtggcaccgtagtgcaggtgaggaagaagacggtccagtcctcactgatgagcagaaatcccggattcaagccatgaaaccgatgaccaaggaagagtgggacgccagacagagtattattcgcaaggtcgtcgatcccgagactggaagaacccgactgatcaagggagacggggaagtgttggaggaaatcgttaccaaggagaggcaccgggagataaacaagcaggccacccggggtgattgtttggccttccaaatgcgggctgggttgctcccctag

SEQ ID NO: 178405 - DNA, 567 bp, Artificial Sequence
  Description of Artificial Sequence: Synthetic coding sequence
atggacgtgaacatcgcccccctgcgggcctgggacgacttcttccccggaagcgaccggttcgctaggccggattttcgagatatctccaaatggaacaatcgcgttgtcagtaatttgctgtattaccagaccaactacctggtggtagccgccatgatgatatccatcgtgggtttcctcagccctttcaacatgatcctaggaggcattgtcgtggtgctcgtgtttacgggattcgtgtgggctgcccacaacaaggacgtgctgcgccgcatgaagaaaaggtatcccaccactttcgtgatggtcgtgatgctcgcgagctattttcttataagtatgtttggaggcgtcatggtctttgtgtttgggatcacatttccactgttgctgatgttcattcacgcctctttgaggctgagaaatctgaagaataagctggaaaacaaaatggagggaataggtcttaagaggactcccatgggtatcgtgctggacgcgctggaacaacaagaggaaggtattaatagactgactgattacataagtaaagtgaaggagtag

SEQ ID NO: 178406 - DNA, 411 bp, Artificial Sequence
  Description of Artificial Sequence: Synthetic coding sequence
atggacgtgaacatcgcccccctgcgggcctgggacgacttcttcccgggctcagaccgcttcgctcggcccgactttcgcgacatttctaagtggaacaatcgggtggtttctaatctactgtactatcagaccaactacttggtggtagcagccatgatgatctcaattgttgggttcctttccccttttaatatgattctggggggcatcgtcgtggtgctcgttttcactggcttcgtgtgggccgcccacgacgtgaggtatggcggacatgttggcgaattgttcccctacctgcatgtatggagatcacacggtctgtgcgtctggcactactttagtttcgccgtggatgtctatccctgtattgtcgaaacgtcagagccccaagagcagacgggagagtag

SEQ ID NO: 178407 - DNA, 819 bp, Artificial Sequence
  Description of Artificial Sequence: Synthetic coding sequence
atggtgcggtgctacgtggagatcgtggagaagctgcccgagcggcggccggaccccgccacaatagaaggttgcgcccaactgaagcctaataactatttgctggcctggcatacaccctttaatgagaaagggagcggatttggggcggctacgaaggccatgtgcataggactgaggtactggaaaccggagaggcttgaaaccctgatagaggtgtccgtggagtgtggacgaatgacccataatcatcctaccgggtttctggggtccctctgcactgctctctttgtgagcttcgccgctcaaggaaaaccactggtccagtggggccgagacatgctcagagccgtgcctttggccgaggagtactgtagaaagacaatccggcacacagctgagtaccaggaacattggttttacttcgaagcaaagtggcagttctacctggaagagaggaaaattagtaaggactccgagaataaagcaatatttccagataactacgatgcggaggaacgtgaaaagacctaccgcaagtggagtagcgagggcaggggcggacgcaggggccacgacgctcctatgatcgcctacgatgcccttttggcagccgggaatagttggacagaactttgtcacagggccatgtttcatggaggagagtcagccgcgaccgggactatagcaggatgtctgttcggtctgctgtatggtttggatttggtgccaaaaggactgtaccaagacctggaagataaggagaaattagaagatttgggtgccgcattgtaccgcttgtcaacggaggagaaatag

SEQ ID NO: 178408 - DNA, 1065 bp, Artificial Sequence
  Description of Artificial Sequence: Synthetic coding sequence
atggagaagttcaaggccgccatgctgctgggcagcgtgggcgacgcgctgggatatcgcaacgtatgtaaggagaattccaccgtgggcatgaaaatacaagaggagctacaaagatccggaggcctggatcacctggtgctgtcacccggagaatggcctgtcagtgataatacaattatgcacattgccacagctgaagcactcacaacagattattggtgcctggacgacctctaccgggagatggttcgttgttatgtggagattgttgagaagttacccgagcgcagacccgatcctgccaccatcgagggctgcgctcagctcaaacctaataactatctcctggcgtggcatactccgttcaatgagaaaggctccgggttcggcgcggccaccaaagccatgtgtatcgggctgcggtattggaaacctgagagactagagacattgatcgaggtgagcgtagagtgtggaagaatgacccataatcacccaactggcttcctcggtagcctctgcaccgccctttttgtttcgtttgctgcccagggaaagccactggtgcagtgggggagagacatgctgagggcagtgcctctcgccgaagagtactgtcggaaaactattcggcataccgctgaatatcaagaacactggttttatttcgaggccaaatggcagttctatctcgaggagagaaagattagtaaggatagcgaaaacaaggccattttccctgataattacgatgccgaagagagggaaaagacataccggaagtggagctctgagggtagaggcggccggcgcggtcatgatgcaccaatgatcgcctatgacgctcttctcgcggcgggtaattcctggacagaactctgtcatagggctatgttccacgggggtgaatcagcagcaaccggcactatcgcgggttgtttgtttggtctgttgtacggtttagacctggtgccgaagggtctttatcaggatctcgaggacaaggagaaactagaggacctgggtgccgccctctatagactgagtacggaggaaaaatag

SEQ ID NO: 178409 - DNA, 531 bp, Artificial Sequence
  Description of Artificial Sequence: Synthetic coding sequence
atggtgcggtgctacgtggagatcgtggagaagctgcccgagcggcgtccagatcccgccactattgagggctgtgctcagctcaagccaaacaattacctgcttgcttggcacacaccttttaacgaaaagggcagcggcttcggggcggcaaccaaggcaatgtgcatcggcctcagatactggaagccagaacggctagaaactcttatcgaggtctccgtggaatgcggaaggatgactcataatcatccaacgggctttctggggagcctgtgtacagctctgtttgtatctttcgccgcgcagggaaaacctctggtgcaatggggtcgggatatgctccgagcagtgccactggcagaggaatactgcagaaagaccataaggcatactgcggaatatcaggagcattggttctacttcgaggccaagtggcaattctacctggaggaacgaaagatttctaaggactccgagaataaggcgatcttcccagacaattacgacgctgaggaaagggagaaatag

SEQ ID NO: 178410 - DNA, 1092 bp, Artificial Sequence
  Description of Artificial Sequence: Synthetic coding sequence
atggccgccgccgccatggccgccgccgccggcggcggcgccggcgctgcgcgctcattgagtagatttaggggctgtctggccggcgcactcctgggtgattgtgtcggcagcttctatgaagctcacgatacagtggatctgacctctgtgctgaggcacgtccagagtttagagccggaccctggcaccccagggtctgagcgcaccgaagccctgtactacacagacgacacagctatggcacgcgccctcgtgcagtcccttctggccaaggaggccttcgacgaagtagatatggcccacagattcgcccaagagtacaaaaaggacccagatcgtggctatggggcgggagtcgtcaccgtgtttaagaagctcctaaatcccaaatgtagggacgtgtttgaaccagcacgtgcccagttcaacgggaagggatcatacggcaacggtggtgcaatgcgcgtggccggaatcagtcttgcctattcctcagttcaggacgttcagaagttcgcccggctgtctgctcagttgacccacgcctcttccttggggtacaacggcgccattctgcaggctcttgccgtacacttagccttacaaggagaatccagctctgagcacttcttgaagcagttgctcggacacatggaagatctcgaaggcgatgcgcagagtgtgctcgacgcacgcgagctaggtatggaggagcgaccttactcctctcgtcttaagaagattggtgaattgcttgaccaggcatcggtgaccagggaagaggtcgtttcagaactgggaaacggaatcgctgcttttgaatccgtgccaacagccatttactgtttcctgagatgtatggagcctgatcctgagattccttcagcttttaatagtcttcagcgtacgctcatctattccattagcttaggcggggatacagatacgatagccacaatggcaggcgctatcgctggcgcttactacggaatggaccaggtgccggaaagctggcagcagtcctgcgaaggctatgaagaaaccgatatcttagcacagagcttacacagggtgttccagaaaagctag

SEQ ID NO: 178411 - DNA, 852 bp, Artificial Sequence
  Description of Artificial Sequence: Synthetic coding sequence
atggcccgggccctggtgcagagcctgctggccaaggaggccttcgatgaagtggatatggcacacaggtttgcccaagagtataagaaggaccctgaccgggggtatggagccggggtcgtgaccgtttttaaaaagttgctcaaccccaaatgtagggatgttttcgagccagcccgcgctcagttcaatgggaaaggaagctatggcaatggcggagctatgcgcgtggccgggataagtcttgcttattcttcagtgcaggatgttcagaagttcgcacgtctctctgcacaattgacccatgcctcctccctgggctacaacggggccattctccaggccctagcagttcacctcgcgcttcagggggagagctcctctgaacattttcttaagcagcttctcggccacatggaagatctcgagggtgacgcacagtcagtgctggatgcacgggaactgggcatggaagaacggccgtactccagtcgactcaaaaagatcggtgaactgctggatcaagccagtgtaactagggaagaggtggtgtctgagttgggtaatggtattgctgcctttgagagcgttccaaccgcgatctactgttttttgaggtgcatggagccagacccagaaatcccttcggcctttaatagccttcagagaacgctgatctatagcatctcacttggaggggatacagatacgatcgccactatggcaggagccattgctggcgcgtattatggaatggatcaggttcctgagtcttggcagcagagttgcgagggttatgaggagaccgacattctggctcaaagtctgcacagggtcttccagaagtcctag

SEQ ID NO: 178412 - DNA, 630 bp, Artificial Sequence
  Description of Artificial Sequence: Synthetic coding sequence
atgcgggtggccggcatcagcctggcctacagcagcgtgcaggacgtgcagaagtttgcccgcctaagtgcccagctgacccatgcctcttcccttggctacaacggcgccatcttacaagcccttgccgtacacctggccctccagggggagtccagtagcgagcacttcttgaaacagctgctaggccatatggaggatttagagggtgatgcgcagtctgtgctggacgctcgggagctggggatggaggaacgaccatactcatctagacttaagaaaattggggagctcctcgatcaagcctccgtgactcgcgaagaggttgtgtcagagctcgggaatgggattgccgctttcgagtctgtgccgacagctatctattgttttttgcgatgcatggagcccgacccagaaattcccagcgcctttaattccctacagcggacgcttatatactctatcagtctaggtggtgatactgatactattgccacaatggctggcgctatcgccggtgcatattacggcatggatcaagtgcctgagagctggcagcagtcttgtgaggggtacgaagagacagacattctggcccaatcactccacagggtctttcaaaagtcttag

SEQ ID NO: 178413 - DNA, 984 bp, Artificial Sequence
  Description of Artificial Sequence: Synthetic coding sequence
atgcagatgcccgccatgatgagcctgctgctggtgagcgtgggcctcatggaggcgctgcaggcccaaagtcaccccatcacaagaagggacctattttcccaagaaatacagttggacatggctttggcatcctttgatgaccaatacgccggctgcgccgccgccatgaccgctgcattacccgatctgaatcatactgaattccaggccaaccaggtatatgccgacagttggaccttggctagctcacagtggcaagagcggcaggctcgatggcctgaatggagcctgtcccccacccgtcctagcccaccgcctctaggctttcgcgatgaacacggcgtcgctttactggcctatacagcaaactcaccactgcacaaggaattcaatgctgcagttagagaagccggtcgcagtcgcgcccattatctgcaccatttctcttttaaaacccttcatttcttgctgacggaagccctgcagttattgggctcaggccaaagacctcctagatgtcaccaggtctttagaggcgtgcacgggctgagatttcgacctgcagggccgagggctactgtaagattgggggggttcgcctcggcctctctgaaacatgtggctgctcaacagtttggagaggacaccttttttggcatatggacctgtctgggggcaccaattaaagggtacagcttcttcccaggggaagaggaagtgctaattcctccatttgagacctttcaggtgatcaatgcaagccgtttagcgcagggccctgccagaatctacttacgtgctctcggcaaacacagtacttataactgtgagtatattaaagataagaaatgcaagtctggaccttgccaccttgacaattctgcaatggggcagtccccactatccgcggtttggtctttacttctgctattgtggttccttgttgtgagagccttcccagatgggccgggcctcctgtag

SEQ ID NO: 178414 - DNA, 1104 bp, Artificial Sequence
  Description of Artificial Sequence: Synthetic coding sequence
atgaagaccggccacttcgagatcgtgaccatgctgctggccaccatgatcttagtggacatcttccaggtcaaggctgaggtgctggatatggccgacaacgccttcgatgatgaatacctgaagtgcactgatcgcatggagatcaaatatgtgcctcagctcctgaaggaagagaaggcgtcgcatcagcagcttgacaccgtgtgggaaaatgccaaggcaaagtgggcagcaaggaagacacagatcttccttcccatgaatttcaaggacaaccacggtattgccctgatggcctatatttccgaagctcaggaacagacacccttttatcatctattttccgaagcggttaaaatggcaggtcagtctagagaagactatatatacggcttccaattcaaagcttttcacttctatctgacaagagctctgcagttattacggaaaccctgtgaggccagttcgaagactgtggtgtataggacctcacagggcacaagcttcacattcggcggcctgaaccaggcccggttcggccatttcaccctagcgtactctgctaagcctcaggcggctaatgaccagttgactgtactatctatctacacctgtctgggggttgatattgagaatttccttgacaaagaatcagagaggataacactcattcccctgaatgaggtcttccaggttagtcaggagggagccgggaacaatctgattttacagtccatcaataagacctgctcgcattacgagtgtgcctttctgggggggctcaagaccgagaactgtatcgaaaacctggaatactttcagccgatctacgtgtataaccctggagaaaagaaccagaaattggaggatcatagcgagaagaattggaagcttgaagaccacggagagaagaaccaaaagctggaggaccacggggtgaaaattttagagccaacacagatccccgcacctggcccggtgcccgttcccgggccaaagagccatccgtccgcctccagcgggaagttgttgctgcctcagttcggaatggtgatcatattaatcagtgtaagcgccatcaacctgttcgttgccctctag

SEQ ID NO: 178415 - DNA, 1137 bp, Artificial Sequence
  Description of Artificial Sequence: Synthetic coding sequence
atgaagaccggccacttcgagatcgtgaccatgctgctggccaccatgattttggtcgatatcttccaggtcaaagccgaggtgctggatatggctgacaatgcattcgacgatgaatatctgaaatgcactgacagaatggaaataaaatatgtgccacagctgctaaaagaggagaaagccagccaccagcagttggacaccgtgtgggagaacgcaaaagctaaatgggcagcccgcaagacacagatctttctgccgatgaatttcaaggataatcacggcattgcactgatggcgtacatctcagaagcccaggaacagacgcccttctatcacctgttctccgaggccgtgaagatggcagggcaatcacgggaagattacatctacgggttccagtttaaagcctttcacttttaccttaccagagctctccagcttctccggaaaccttgtgaagcaagttcaaagaccgtggtatatcgcacctcccagggaactagctttacgttcggcggcttaaaccaggcacggtttggccactttacccttgcatattcggcaaaaccacaggcagctaatgaccaactgacggttctctccatctatacctgcctgggggtcgatattgaaaacttcctcgacaaagagagtgagcgtattacacttattccactgaatgaggtgttccaggtgagccaggaaggtgccggcaacaatctgatcctgcagtcaatcaacaagacgtgctcccactatgagtgcgccttcctgggagggctgaaaaccgagaactgcatagagaatctggaatactttcagccaatttatgtctataatccaggggaaaagaatcaaaagcttgaggaccacagcgagaaaaattggaagctggaggaccacggtgagaaaaatcagaaattggaagatcacggggtcaaaattttggaacctacccagatccccgaggataagtctcaagggaatataaacaacccaaccccgggacctgtccccgtgcccggaccgaagtcccatcctagtgctagcagcggtaagttgctgctccctcaattcggaatggttataatcctcatttcagtttctgcgatcaatctgttcgttgccctatag

SEQ ID NO: 178416 - DNA, 1170 bp, Artificial Sequence
  Description of Artificial Sequence: Synthetic coding sequence
atgaagaccggccacttcgagatcgtgaccatgctgctggccaccatgatcctggtagatattttccaggtaaaggctgaggtgctcgacatggccgacaacgcttttgatgacgagtacctcaaatgcaccgaccgtatggaaattaagtatgtgccacaacttcttaaggaggagaaagcttcccatcagcaactggatacagtctgggaaaacgccaaagcgaaatgggctgcgaggaagacccaaattttcctgccaatgaattttaaagataaccatgggatcgcactgatggcatatatctcagaagcccaggaacagaccccgttctatcatcttttttccgaagccgtcaagatggcaggtcagtcacgcgaggattacatctatgggtttcaatttaaggccttccacttctacctcaccagggccctgcagctcctcaggaagccctgcgaagcatcttcaaagaccgtggtgtacaggaccagtcaaggaacctcttttacatttggtggactcaaccaggccaggtttgggcatttcactcttgcatactccgcaaaaccacaagcagccaacgatcaactcactgtgctctctatctatacgtgcctcggagttgacatcgaaaattttttggacaaagagtctgagaggataacattgattccgctgaacgaggtgttccaagtaagtcaggagggagccggtaataatctgatcctgcaaagcattaataagacctgtagtcactacgaatgcgctttcctggggggcctcaaaactgagaattgtatcgaaaatctcgaatatttccagccaatatacgtttataatccaggagaaaaaaaccaaaagctggaggatcactctgagaaaaattggaagttggaagatcatggggagaaaaaccagaagttagaagatcacggtgtgaagatcctggagcccacccagatacctggtatgaaaatcccggaaccatttcctctgccggaagataagagtcagggaaatataaataatcccacacccggccccgtgcccgtaccaggaccgaagtctcaccccagcgcttcctccggcaaactgctacttccacagttcgggatggtgatcatactgatttccgtatctgctattaacctgtttgttgccctttag

SEQ ID NO: 178417 - DNA, 390 bp, Artificial Sequence
  Description of Artificial Sequence: Synthetic coding sequence
atgaagaccggccacttcgagatcgtgaccatgctgctggccaccatgatcctggtcgacatcttccaggtgaaggctgaagtcctggacatggcagataatgctttcgacgacgagtatctcaagtgtacggaccgcatggagattaagtatgtccctcaactcctcaaagaagagaaggcatcgcatcagcaactggacactgtctgggagaacgcaaaggcaaagtgggcagccaggaagactcagattttcctgcccatgaactttaaggacaaccatggaatagcccttatggcctatatctccgaagcccaggagcagactcccttctaccaccttttctccgaggcagtaaaaatggcggggcagtctagggaggactactag

SEQ ID NO: 178418 - DNA, 528 bp, Artificial Sequence
  Description of Artificial Sequence: Synthetic coding sequence
atgaagaccggccacttcgagatcgtgaccatgctgctggccaccatgattcttgtcgacatcttccaggtgaaggccgaggttctcgacatggccgacaatgctttcgacgacgagtatttgaaatgcactgacaggatggagattaaatacgtgccgcagcttctgaaggaagaaaaggccagtcaccagcagcttgacacagtatgggaaaacgctaaagccaaatgggccgcccgcaaaactcaaatcttcctgcccatgaatttcaaagataatcacggcattgctctgatggcctacatttccgaggcccaggagcagacacctttctaccacctcttcagtgaggctgtgaaaatggccgggcagtcgcgcgaagactacatttacggcttccagtttaaggcatttcacttttacctgacgagagctctgcagcttctaaggaagccgtgcgaggcctcctccaagacagtcgtttaccggacttcccaaggcacgtcattcaccttcggaggactgtag

SEQ ID NO: 178419 - DNA, 609 bp, Artificial Sequence
  Description of Artificial Sequence: Synthetic coding sequence
atgaagaccggccacttcgagatcgtgaccatgctgctggccaccatgatcctggtagatattttccaagttaaggccgaagtgctggacatggccgataatgcgtttgatgacgagtacctgaagtgcacagatagaatggaaataaagtacgtgccgcagctgctgaaggaagaaaaggcctcccaccagcagctggacacagtgtgggaaaacgctaaggccaagtgggctgcaagaaagacccagatctttctgcccatgaatttcaaggacaatcatggcattgctcttatggcatatattagtgaggctcaggagcaaacccctttttaccatctttttagcgaggctgtgaagatggctgggcagtccagagaggattacatttacggattccagtttaaagcttttcatttctatctcactcgtgctctgcagctgttacggaaaccctgcgaggcaagctcgaaaacggtggtctatcgtacgagccaaggtacgtcttttacgttcggcggcctgaatcaagccagatttggccatttcactctagcatacagtgctaaacctcaggctgccaacgatcaactgacggtgctcagttag

SEQ ID NO: 178420 - DNA, 324 bp, Artificial Sequence
  Description of Artificial Sequence: Synthetic coding sequence
atgaagaccggccacttcgagatcgtgaccatgctgctggccaccatgattttggttgacatttttcaggtgaaagccgaggtgcttgatatggcagacaatgcctttgatgatgagtatctgaagtgcactgatcgcatggaaattaagtacgtgccccaattactgaaggaagagaaagcctcgcaccagcagctggacacagtatgggaaaatgctaaagcgaaatgggccgcacgtaagacccagatctttctgccaatgaacttcaaagacaatcatggcatcgcactcatggcttatatctccgaagctcaagaatag

SEQ ID NO: 178421 - DNA, 456 bp, Artificial Sequence
  Description of Artificial Sequence: Synthetic coding sequence
atgagcggccggggcaagcagggcggcaaggtgcgggccaaggccaaatctcgctcaagccgcgcgggactgcagtttccagtggggcgggtgcaccgcttactgcgaaaaggcaattatgccgaaagggtcggcgcgggtgcgcccgtctacctcgcagcagttctggagtatctgacagctgaaatcctggagctggccggcaatgcggctcgcgacaataaaaaaaccagaattatcccccggcatctgcaactggctatcagaaacgacgaggagctgaacaaactgctgggcaaagtaaccatcgcccagggcggagtcctgcctaatattcaggctgtgttactgccgatatgtgagcattccggaccatcctccggcaaaattccgtctgatcgggcagagttaggtgccggctcggtgtgcggtcacatttttcagaaggtcgagtag

SEQ ID NO: 178422 - DNA, 177 bp, Artificial Sequence
  Description of Artificial Sequence: Synthetic coding sequence
atgggccccctgatcaaccggtgcaagaagatcctgctgcccaccaccgtaccccccgccaccatgagaatatggttattgggcggcctgctgccctttctgctgctgttgtcagggcttcagcgcccaactgaaggtagtgagctgccagcccgtaacgcctcactcattctttag

SEQ ID NO: 178423 - DNA, 876 bp, Artificial Sequence
  Description of Artificial Sequence: Synthetic coding sequence
atggccctggccgccctgatgatcgccctgggcagcctgggcctgcatacatggcaagcccaggctgtgccaattcttcccctgggtttggctcctgatactttcgatgacacgtatgtgggctgtgccgaggagatggaggaaaaagcggcccctttattaaaagaggagatggcacaccatgccctcctgcgggagagctgggaggccgctcaggagacctgggaggataagaggaggggccttaccttgccacccggcttcaaagcccagaatgggattgcaatcatggtgtatactaattcatcaaacacactgtactgggaactgaatcaggccgtcagaacgggcggtggcagccgcgaactctatatgaggcactttccatttaaggctctgcatttttaccttatccgcgctctccagttgctgagaggctccggcgggtgctcgcgcggaccgggcgaggtggtctttcgtggggtggggtcccttaggtttgaaccgaagcggctcggggattcggttcggctcggtcaatttgcaagtagctccttagacaaagccgtggcgcatagattcggaaatgcaacgctcttttctctcactacttgtttcggcgcacctattcaggcattctcagttttccctaaagagagagaggtgctgattccccctcacgaagtgtttctcgtgacacggtttagtcaggatggtgcccagagtctagtaactttatggagctacaatcagacctgttctcattttaattgtgcctacctggggggagaaaaacgccgggggtgtgtatcggctcccggagccctgggcacaggtgaccttcacatgacaaaacgccacttacagcaaccatag

SEQ ID NO: 178424 - DNA, 720 bp, Artificial Sequence
  Description of Artificial Sequence: Synthetic coding sequence
atggccctggccgccctgatgatcgccctgggcagcctgggcctgcacacatggcaagcgcaggctgtgcccatccttccattgggcctcgcccccgacacatttgatgatacctacgttgggtgtgctgaggaaatggaggagaaggcagcccccctgttgaaggaagaaatggcacaccatgcactattgagggaaagctgggaagcggcccaagagacttgggaagataaacggagaggtttgacattgcccccgggctttaaggctcagaacgggatcgctattatggtttacacgaacagtagcaataccttgtactgggagctgaaccaagccgtaaggacaggcggcgggtcccgagaattgtacatgcgacatttcccttttaaagcactccacttctacctcatcagagctttgcaactattgagagggtcaggaggttgcagccgcggccctggagaagtggtgttcaggggtgttggctctcttagatttgagcctaagaggttaggagattcagtcagactcgggcagttcgcctcgagcagtttagacaaggcggtggcccatagattcggcgaaaaacgacgcggctgcgtctcggccccgggcgtacagctaggctctcagtcagagggcgcgtctagcctcccaccatggaaaactctcctgctcgctcccggcgagtttcagctgagcggcgtcggcccctag

SEQ ID NO: 178425 - DNA, 876 bp, Artificial Sequence
  Description of Artificial Sequence: Synthetic coding sequence
atggccctggccgccctgatgatcgccctgggcagcctgggcctgcacacatggcaggcccaggcagtaccaattctacctttgggactggcacccgatacttttgatgacacatacgttggatgtgctgaagaaatggaagaaaaggctgccccactgcttaaagaggagatggctcatcatgcattgttgagggagtcttgggaggcggctcaagaaacatgggaggacaaaaggcggggcctgacactgcctcctggcttcaaggcccaaaacggcatcgccatcatggtttacaccaacagttcaaacaccctttattgggagctgaatcaggctgtccgaactggaggcggttctagagagctgtacatgaggcattttcctttcaaggccctgcacttttacctgatcagggcgttgcagctcctgagagggagcggaggatgcagccgcggacctggcgaagtcgtgttccgcggggtggggagcttacgctttgagcctaaaaggctcggagattcagtccggctggggcagtttgctagttctagcctagacaaggccgtggcccaccgtttcgggaatgcgaccctgttctcactgacaacatgtttcggcgctcccatccaggctttctcagtgtttcccaaggaacgcgaggtccttatccccccacatgaagttttcctggtaacccgctttagccaggacggagcccagtcgcttgtaacactgtggtcatacaatcagacctgctcccacttcaactgcgcctacctcggcggagagaaaagacggggatgcgtttcagcccctggcgccctggggacaggcgacctgcacatgacaaaacgacatctgcagcagccatag

SEQ ID NO: 178426 - DNA, 1401 bp, Artificial Sequence
  Description of Artificial Sequence: Synthetic coding sequence
atggtgttcctgagcggcaacgccagcgacagcagcaactgcacccagccaccagcgcctgtcaatattagcaaggccatcttgcttggcgttatcctagggggcttaattttattcggcgtgcttgggaatatcttagtaatcctctccgtggcttgccaccgtcaccttcacagcgtaacccactattacatcgtgaacctggccgtggctgatctgttactgacaagcaccgtgcttcccttctctgctattttcgaagttctgggttattgggcatttggcagggtgttctgcaacatctgggctgcagtggatgtcctgtgttgcactgcttcaattatgggcctgtgcatcatttcgatagacagatatatcggagtgagttaccccctcagatatcctaccattgtgacccagagacggggtttgatggctcttttatgcgtttgggcactttctctagtcatcagcattggcccgctgtttggatggcgccagcctgcccctgaggacgaaacaatctgccagatcaacgaggagcccggatacgttctgtttagtgcccttggaagcttttacctacctctggctataatcctggtaatgtactgccgggtctatgtcgtagccaaaagggaatcccggggactaaagagtggtctgaaaactgacaagagcgactccgagcaagtaacccttcgtattcacaggaaaaatgcccccgctggtggcagcggtatggcctctgctaagactaaaactcatttttctgtgaggctgcttaaattctccagagaaaagaaagccgccaagactctgggaatagtagtcggctgtttcgttctatgttggttgccgttctttttggtgatgccgatcgggtcctttttccccgattttaagccgagcgaaacagtcttcaagattgtattttggttaggctacttgaactcatgtattaaccccatcatttacccctgtagttcccaggaattcaagaaggcatttcagaatgttttgaggatacaatgcctgtgtaggaagcagtcatccaagcatgctttgggctataccctccatcccccttcacaggcggtggaaggacagcacaaggatatggttcgcatcccggtagggtcgcgcgagaccttctaccggatttccaagacagacggggtgtgcgaatggaagttcttctctagcatgccgcgcggatccgcccggatcacagtgtccaaggaccagagcagttgcacgacagccagagtgaggtctaagtctttccttcaggtctgctgttgcgtaggccctagcacgcctagtcttgataaaaaccaccaggtgcccactatcaaggtccatactatttccctgtccgaaaatggcgaagaggtgtag

SEQ ID NO: 178427 - DNA, 1368 bp, Artificial Sequence
  Description of Artificial Sequence: Synthetic coding sequence
atggtgttcctgagcggcaacgccagcgacagcagcaactgcacccagccccccgccccggtgaatatctcaaaggcaatccttctcggtgttatactgggaggactaatcctctttggcgtgttgggcaatatcttggtgattctaagtgtggcatgccatcgtcatctgcactccgtcacacattattacatcgtcaatcttgccgtagcggatttactgctgacttccaccgtgctccccttttctgcgatatttgaggttctggggtactgggcatttgggcgtgtgttctgtaacatctgggcagcagtggacgtgctgtgttgtaccgccagcatcatgggcctgtgtatcatctcaatcgacaggtacataggagtgagctatcctttgcggtaccccacaatcgtgactcaacgaagaggcctgatggcactcttgtgcgtttgggccctgtcgctcgttattagcattggccccctgtttggctggcgtcagccggctcctgaagacgagacaatctgccagattaatgaagaacctggctacgtcctctttagtgcgctgggatctttttaccttcctctcgcaatcatccttgtcatgtactgccgggtttacgtggtggctaaaagggagtcaagaggactgaagagtggtctcaaaaccgataagtctgattccgagcaggtaacgctcagaattcatcgaaagaatgcgccagcaggcggaagcgggatggccagtgctaaaacgaaaacgcacttcagcgtacggttactgaaattcagtagagagaagaaagccgccaagacacttggcatagtcgtggggtgcttcgtgctgtgctggctgccattcttccttgtgatgcctatcggatctttctttcctgactttaaaccttcggaaaccgttttcaagatcgttttctggctggggtatcttaatagttgtataaatcctatcatctacccttgtagttctcaggagtttaagaaagccttccagaatgttttaagaatacaatgcctgtgccgtaaacagagttccaagcacgctttgggttataccctccatcctccatctcaggcagtggaaggccagcacaaagacatggtccggatccctgtcggtagccgagagacattttacaggatttccaagacagacggggtatgcgagtggaaatttttcagctctatgcctcgtgggagtgccagaattacggtcagtaaggatcagagcagctgtaccacagcacggcgtggaatggactgcagatacttcaccaaaaattgtcgagagcacatcaaacatgtgaattttatgatgcccccgtggcggaaaggaagtgaatgttag

SEQ ID NO: 178428 - DNA, 975 bp, Artificial Sequence
  Description of Artificial Sequence: Synthetic coding sequence
atggtgttcctgagcggcaacgccagcgacagcagcaactgcacccaaccaccagcgcctgtcaacatttcaaaagcaatcttgctgggtgtgatccttggggggctgatcctcttcggtgtgctaggcaatattctggtcatcttatctgtggcctgccaccgtcacctgcattcggtgactcactattatatcgttaatctcgcagtggcagatctgctgctgactagtaccgtactgcccttcagtgctatctttgaggtacttggctattgggcatttggccgtgtgttttgtaatatttgggcagccgtcgacgtgctgtgttgtactgcctcaatcatgggactatgcatcattagtatcgataggtatatcggcgtgtcctatcccctacgataccctaccatcgttacacagaggagaggcctgatggctcttctgtgcgtgtgggccctaagtctggtgatttctattggaccgctctttggatggcgccagcccgcaccagaggatgagaccatttgtcagatcaacgaggagcccggctatgtcctgttttccgccctgggctcgttctacttgccccttgccatcatcctcgtcatgtactgccgcgtgtatgtggttgccaaaagagagagccggggattaaagtccgggctgaagaccgacaagtccgattccgagcaggtcaccctccgcatacaccgaaagaatgcgccggcgggtggaagcgggatggcatccgccaagaccaagacacacttttcggtgcgcctactgaaatttagccgggagaagaaagccgccaagaccctgggaattgtggtcggatgctttgtgttgtgttggctgcccttcttcttggtaatgcccattggcacctacatcctcaagtacgacgttttgttctggcgcaaagggctgtccgtgtgcacccggctgcgcgagcgtaaggagatcaagaattag

SEQ ID NO: 178429 - DNA, 1029 bp, Artificial Sequence
  Description of Artificial Sequence: Synthetic coding sequence
atggtgttcctgagcggcaacgccagcgacagcagcaactgcacccagcctccggcaccagttaatatcagtaaagcgattcttctaggcgtcatccttgggggactcatactgtttggcgtgctcggtaatatcctggtgattctcagcgtggcctgtcacagacacctgcactcggttacccattactatattgtgaacctcgctgtcgccgacttgttacttactagcacagtattgcccttcagcgctatatttgaagtgctcgggtactgggcgttcggacgtgtgttttgtaacatctgggcagccgtggacgttctgtgttgcaccgccagtattatgggtctctgcattatctccatcgataggtacattggagtgtcctaccccctgagataccctacgattgtgactcagcggcggggcctgatggctctactgtgtgtatgggccctctcactcgtgataagcattggtcctctcttcggctggagacagcctgcacctgaggacgagactatctgccaaatcaatgaagaaccgggttacgtgctcttcagcgctctggggagtttctacctgcctctcgcaataattttagttatgtattgtcgggtgtacgtggtggccaagagggagtctagaggtttgaagagcggcctgaaaacagataagtccgattcagaacaggttacattgcgaatccacagaaagaatgcaccagctggtggaagtggcatggcctcagccaagacaaaaacccacttctcagtgcgtctcctgaagtttagcagggaaaagaaagcagcgaaaaccttaggcatcgtggtgggctgttttgttctgtgttggctgcccttttttctggtgatgcctatagacgaggaaacagaagcccaggagggtaagaatgactccccctcatttaaacagcccgttcaccacgcagccgtcttagggctggaagtgatggagaaagagaacctcgagggagtgtctaggaaggacacctgcggggtctggtag

SEQ ID NO: 178430 - DNA, 1401 bp, Artificial Sequence
  Description of Artificial Sequence: Synthetic coding sequence
atggtgttcctgagcggcaacgccagcgacagcagcaactgcacccagccacctgcacctgtcaatattagtaaggccattttactcggcgtcatcctgggaggcctgatcctgttcggagtcttaggaaacattttggtaattctcagcgttgcctgccataggcatctccattcggtgacccactattacatcgttaacctcgccgtggccgatctgctgctgacgagcaccgtcctacccttctctgccatcttcgaagtgctgggctattgggcctttggtagggtgttctgcaacatttgggcagccgtggacgttctgtgctgcactgcatctattatgggcctttgtattatttcaatcgataggtacatcggagtgtcctatcctctcagatacccgacaatcgtgacccaaagacgcggcctgatggctttactatgcgtatgggcgttgagcctggtcatcagcataggacctctgtttggttggagacagcccgccccagaagatgagactatttgtcagatcaatgaggaacccgggtacgtcctgttcagcgcactgggatccttctacctgcccttagccatcattctggtgatgtactgccgtgtttatgttgtcgctaagagggagtcccgtggattaaagagtggcctgaaaaccgacaagtctgatagcgagcaggttacgttaaggatccatcgcaaaaacgctcctgctggcgggagtggaatggctagtgccaaaaccaagactcatttttctgtgaggctcctgaagttctcccgagaaaagaaggctgccaagacattgggcattgtggtgggctgtttcgttctctgttggcttccctttttcctggtcatgcctatcggatcgttttttccggacttcaagccttcagagacggtgttcaaaattgtgttttggctggggtacctaaactcctgcatcaatcccatcatctatccttgttcttcacaggagtttaaaaaggcctttcaaaatgtgttgagaatccagtgcctgtgtcgaaagcagagtagcaagcatgccttgggatacacgctccacccccccagccaggctgtggagggccagcataaggatatggtacgcattcccgttggcagccgggaaacattctacaggataagtaagaccgatggggtgtgtgaatggaagtttttcagctccatgccaagaggctctgctcgtattaccgtcagcaaggaccaaagcagttgtacaacagcccgcgtgcgctcaaaatctttcctccaggtctgttgttgtgtcgggccctcaacccccagcctcgataaaaatcaccaagtccccaccattaaggttcacacgatcagcctttccgagaatggcgaagaagtgtag

SEQ ID NO: 178431 - DNA, 1119 bp, Artificial Sequence
  Description of Artificial Sequence: Synthetic coding sequence
atggtgttcctgagcggcaacgccagcgacagcagcaactgcacccagccccccgctccggtgaatatttctaaggccatacttctaggggtcatcctagggggactgatcctgttcggcgtgctcggaaacattctggtcatcctgagtgtggcttgccaccgacacctgcactccgtgactcactactacatagtaaatctcgccgtggctgacctcttgctgacttcaaccgtactcccattctccgccatatttgaggtcctggggtactgggctttcgggagggttttttgcaatatttgggcagccgttgatgtgctgtgttgtacagccagtataatgggactttgcattatttccattgacagatatatcggggtgtcatatccactcagataccctacaatagtgacccaaagaagaggcttgatggccttgctgtgtgtgtgggctttaagcctggtcatttccatcggccctctgtttgggtggcggcagcctgcgcctgaagacgagacaatttgtcagataaacgaggagccgggatacgttctgtttagtgctctggggagtttttacctccccttagccattatcctggtgatgtactgccgggtgtacgtcgtggctaaacgtgagagccggggactgaagtccggcctgaaaactgacaaaagcgacagtgaacaggtcaccctccgcatacaccggaaaaacgcccctgccggcgggagtggaatggcctccgcaaaaacgaaaactcacttctcagtgaggctgcttaagttcagcagggagaaaaaggctgcaaaaacattagggatcgtggtgggctgcttcgtgctgtgctggctcccctttttcttggtcatgcccatcggcacacatacccatgacatgaagcctgcgagccgccctcgtctcttatctttgctgccgaaggagggcgaacacgaaacccaccactggagttgtgacccactcagcctggaatcaaccccgggcgctcaggaaccctgtctgaccctgggctttaccagcttgtcaagcatccatctgacgaaggctcagatacagcatgtgactgtgacagacaccgggaagacggtcacatag

SEQ ID NO: 178432 - DNA, 1290 bp, Artificial Sequence
  Description of Artificial Sequence: Synthetic coding sequence
atggtgttcctgagcggcaacgccagcgacagcagcaactgcacccagcctccagcacctgtaaacatcagcaaagccatcctgctcggagtgattctagggggtttaatcctctttggagttcttggcaatatattagtgatcctctccgtagcatgccatcgacacttgcacagcgtgacgcactattacatcgtcaacttggctgtggccgatctgctcctcactagcaccgtgctgcccttttccgctatcttcgaggtgctggggtactgggctttcggccgagtattttgtaacatttgggctgcggtggacgtactttgctgtaccgcttcaatcatggggctgtgcataattagcatcgatcgttatatcggtgttagctatcccctccggtatccaactatcgtgacccagcggcggggcctcatggcactgctctgtgtctgggccctgagcctggttatctctattggaccactgttcggctggagacagccagcccccgaagatgagaccatatgtcagatcaatgaggaacccggctatgttctcttcagcgctctgggctccttctacctacccctggccattattctggtaatgtactgtcgggtgtacgtggtagctaagcgagagtccagagggctcaaaagcggtctcaagaccgacaagagtgactcagagcaggtgacactgaggatccatcgcaagaatgccccagctggcggaagcggcatggcctctgctaagactaagacccacttttcagtgcgcttgctgaagttttctcgcgagaaaaaggcggccaaaaccctcggtattgtagtgggatgttttgtcttgtgctggttgcccttttttctggtgatgcccatcggctccttcttccccgactttaagccatcagaaactgtgttcaagattgtgttctggctgggttatctgaactcttgtatcaaccctattatctacccctgttcctcacaggaatttaagaaagcctttcagaatgtactgcgcattcaatgcctgtgtcggaaacaatcttccaagcacgccctcggttacactctccaccccccgtcccaagcagtagagggtcagcacaaagatatggtgaggatccccgtgggatccagagaaaccttctaccgcatttccaaaacggatggcgtatgtgagtggaagtttttctcctcaatgcctcggggttcagctagaatcacagtcagtaaggaccagagttcatgcactaccgcccgagggcacacacccatgacctag

SEQ ID NO: 178433 - DNA, 1428 bp, Artificial Sequence
  Description of Artificial Sequence: Synthetic coding sequence
atggtgttcctgagcggcaacgccagcgacagcagcaactgcacccagccacccgcacccgtcaatatctccaaggcgatacttctgggagtaatactcggaggattaatcctgttcggcgtcctcgggaatatcctcgtaattcttagcgtcgcatgtcatcggcacctgcatagcgtgacgcactattacatcgtgaacttggctgtcgccgatcttctcctgacgagcactgttttgccgtttagtgccattttcgaagtgttggggtattgggcatttggccgcgtgttctgcaatatttgggcagcagtggatgtgctatgttgtaccgctagcatcatgggtctgtgcattatctctattgaccgatatattggggtgagttaccccctgcgatatccaacaattgtgacgcaacgcaggggcctcatggctttactgtgcgtctgggcactatcactcgtgatatctataggcccgctctttggctggcggcagcccgcccctgaagacgaaactatttgtcagattaatgaggagccaggatatgtgctgtttagtgccttaggcagcttctatttacccctggccatcatcctggtgatgtactgccgggtgtacgtggtagcaaaacgagagagcaggggcctgaaatccgggctgaagacggataaatctgactcagagcaggtcactttgcggattcatagaaagaatgcccccgccggtggaagcggcatggccagcgccaagaccaagactcacttctcagtgaggctgcttaagtttagccgggaaaagaaggccgccaaaaccctggggatagttgtgggttgctttgtactgtgctggctgccattctttctggtcatgcctatcggatccttcttccctgatttcaaaccaagcgagacagtgtttaagattgtcttttggctcggctacctgaacagctgtatcaaccccataatatacccctgttcttctcaagagttcaaaaaggcttttcagaatgtgcttcgtatccagtgcctatgtagaaagcagtctagtaaacacgctctcgggtatacactgcatccgccctctcaggctgtggaaggacagcacaaggacatggtccgtattcctgtgggctcccgggaaacattctatcggataagcaaaacggacggtgtctgcgaatggaagttcttttcaagcatgccacgaggttctgcgagaatcaccgtgagtaaggaccagtcttcctgcactacagcacgcacgaagtcacgctcagttacaagactggagtgttcgggaatgatcctggcgcattgtaatctgaggttacctgggtccagggactctcccgcttctgcttctcaagcggccggcaccacaggcatgtgccatcaggcagacgctacaaggcctagctag

SEQ ID NO: 178434 - DNA, 1113 bp, Artificial Sequence
  Description of Artificial Sequence: Synthetic coding sequence
atggtgttcctgagcggcaacgccagcgacagcagcaactgcacccaaccaccagccccggtcaacattagtaaggctatactgctcggagtgattttggggggcctgatcctcttcggcgttttgggaaatattcttgtgatactttctgtcgcatgccaccggcatttgcactctgtgacacactattatatcgtcaacctcgctgtggccgacctgctactgacaagcaccgtgcttccgttttccgcaattttcgaggtgctaggctattgggctttcgggcgagtgttttgcaatatttgggctgctgtggatgttctctgttgtaccgcctccatcatggggctatgcatcattagtattgacaggtatattggcgtgtcttacccacttcggtatcccacaattgtgacccagagacgcgggttgatggctctactgtgcgtgtgggcccttagcctggttatttccatagggcctctattcggttggcgtcaaccggctccggaggatgaaacgatctgtcaaattaacgaggagcccggctacgtccttttctctgcactgggctcattttacctgcccctggccattatcctggtgatgtactgtagggtgtacgtggtcgcaaagagggagagccgaggcctaaaatccggcttaaaaaccgacaaatccgactcggaacaggttaccctcagaatccacaggaagaatgccccggctgggggaagcgggatggcaagtgcaaagacgaaaacacacttctcagtgagactgttgaaattctctagagaaaagaaagccgcaaagactctcgggatcgtggttgggtgctttgtgctgtgctggctccctttctttctcgtgatgcctatagatgaggtgtctttgtgtcaccaggccggtgtgcaatggcacgacctgggtagtctgcagcctccaccaccaggctttaaacgcttctcctgcctgagccttccttctagctgggactaccgcgacgtccccccgggccgtagacatcaggcgcagcttatattcgtttttctggtggaaacaggctttcaccacgtcggacaagacgacctagacctgctcacaagctag

SEQ ID NO: 178435 - DNA, 1284 bp, Artificial Sequence
  Description of Artificial Sequence: Synthetic coding sequence
atggtgttcctgagcggcaacgccagcgacagcagcaactgcacccagcctccggcccctgttaatatttcaaaagccatactgctaggagtgatactaggaggtcttatcctgtttggcgtgctggggaacatcctcgtcatcctgtccgtcgcttgtcatcggcacctccactctgttacccactattacatagtgaatttggccgtcgcggacctcctgctcacatctacagtcctcccttttagtgcaatcttcgaggtgttggggtattgggccttcggcagggtcttctgcaacatctgggccgctgtagacgttctttgttgcactgctagcattatgggcctttgcattataagcattgacaggtacattggggttagctatccgctgcgctacccaactatcgtgactcagcgccgcgggctgatggccctgctctgtgtctgggcattgagtctggtgatctcgatcggacccctgttcgggtggcgtcagccagcacctgaagacgagactatttgtcagattaacgaagagcccgggtatgtgttgttctcagccctcggctccttttacctgcctctcgccataatcctggtcatgtattgtagagtgtatgtggtagctaagagagagagcaggggactgaagagcggtcttaagactgacaagtccgatagtgaacaagtgacacttaggatacatcgcaagaatgccccagctggtggttctggaatggcctcagcaaagactaaaacccattttagtgtccgactactcaagttctctagagagaaaaaggctgctaaaactctcggcattgttgtgggctgctttgtgttgtgttggctcccattcttcttggttatgcctataggatcattcttccctgactttaaaccttccgagaccgtgtttaaaattgtgttttggcttggctaccttaactcctgtatcaatcccatcatctacccttgttcatcacaggagtttaagaaagcgtttcaaaacgtgttaagaattcagtgtttatgtcggaagcaatcatcaaagcatgctttgggctatactctgcatccaccatcacaggccgtggaaggccagcataaggacatggtgcgcataccggtcggtagccgagagacgttctaccgaattagtaagaccgacggagtctgcgagtggaagttctttagttccatgccacggggcagcgcaaggatcactgtctctaaggaccaaagtagctgcacgacagctcggtcctcagggttttag

SEQ ID NO: 178436 - DNA, 1563 bp, Artificial Sequence
  Description of Artificial Sequence: Synthetic coding sequence
atgaaccccgacctggacaccggccacaacaccagcgcccccgcccattggggtgagctgaagaatgctaacttcacagggcctaaccagacctcctcgaactccactctgccccagctcgatataacccgtgcaatcagtgtggggctggttttgggcgccttcatcctgtttgccatcgtggggaatatactggtgatcctgtccgtagcttgtaataggcatctgcggaccccaaccaattacttcatcgtgaacctcgcaatggccgatttgctgctctcctttaccgttctgcccttttccgccgcgttggaagtgctcggatactgggtcctcggcagaatcttttgcgatatttgggccgctgtcgacgttctgtgttgtactgcctcaatcctttccctgtgtgctatttccatcgatcgatatataggggtccggtatagcctccaataccccacgctcgtaactagacggaaagctattctggcccttctgagcgtctgggtactgtctaccgtgatttccatcggacccctcttgggctggaaagagcctgcccccaacgatgataaagagtgtggggtcacggaagagcctttttacgcactgttctcctctctcggaagcttctacattcccctggccgtgatcttagtgatgtattgcagagtgtacattgtggccaagcggaccaccaagaatcttgaggccggcgtcatgaaggagatgtccaacagcaaagaactgacactgcgcatacacagtaaaaattttcacgaagacactcttagctccacaaaagccaaagggcacaacccacgttcctcaatagccgtcaaactgtttaaattttcacgagagaaaaaggctgcgaaaactcttggaattgtcgttggaatgtttatactctgttggttgcccttttttatcgcactgcctcttggttctctgttcagcactttgaaaccacccgacgcagtgttcaaggtagttttttggctggggtatttcaattcctgtctaaaccccatcatctacccctgttcgtcgaaagagtttaaacgtgccttcgtacggatcttgggctgtcagtgccgcgggcgcgggcgaagaagacgcagacgaaggagaaggctgggggggtgcgcttacacgtatagaccctggacgcgcggcggtagcctcgagaggtcacagtccagaaaagacagtttagatgactccggaagttgtttaagcggctcccaacggaccctaccatcagcaagccctagcccggggtatttaggaagaggcgctccaccacccgttgagttatgcgccttccctgaatggaaggcccccggcgccctgctgtctctgccggcccccgagccacctggaagacggggccggcatgatagcggcccccttttcacctttaagcttctaacggaacccgagtcccctgggacggacggtggtgctagtaacggagggtgtgaggcggctgccgacgtcgcaaatggccagcccgggtttaagtctaacatgcctctggctccaggacagttctag

SEQ ID NO: 178437 - DNA, 1719 bp, Artificial Sequence
  Description of Artificial Sequence: Synthetic coding sequence
atgaccttccgggacctgctgagcgtgagcttcgagggcccccggcccgatagcagtgccggtggttcttcggctggcggggggggcgggagcgctggaggggcagcaccttccgagggcccagccgtcggcggagtgcctgggggcgccggggggggcgggggcgtcgtgggggccggaagcggcgaggacaatagatcttcagccggggagccagggtcagcgggcgcagggggcgatgttaatggaacagccgctgtgggtggtttggtggtaagtgcccagggggtgggggtgggcgtattcttagccgcgttcattctaatggcggtggcggggaacctcttggttatattgagcgtggcctgcaataggcatctccagaccgtgaccaattactttattgtcaacctggctgtcgccgatctcttgctctccgccaccgttcttcccttttctgcgacgatggaggtgctcggtttttgggcatttgggcgggctttttgtgatgtttgggccgccgttgatgttctgtgctgtacagcaagcattcttagcctctgcaccatatcggttgatcggtacgtcggtgtgcggcatagcctcaagtatccggctattatgaccgaaagaaaggccgcagccatccttgccctcctttgggtcgtggctctggtggtgtccgtagggcccctgctgggctggaaggagcccgtgccccccgatgagaggttttgtggaataaccgaggaggccggctacgcggttttcagttcggtttgtagcttttatcttccaatggctgtgattgtggtgatgtactgtcgcgtttatgtggtggctcgctcaactacccgttccttggaagctggggtgaagagggaacgcggcaaggcctccgaggtggtgttgaggatccattgccgaggcgctgcgaccggggccgatggtgctcacggtatgcgctcagccaaaggccataccttcaggtctagtctttccgtccgcctgctgaagttcagtcgcgaaaagaaggcagctaagacattggctatcgtcgtgggagtgttcgtcctgtgttggttccccttcttcttcgtgctcccactgggctcactcttcccacagttgaagccttctgagggcgtgttcaaagtgatcttctggctcggctacttcaactcctgcgtgaacccgctgatctacccctgttcatcacgtgaattcaaacgggcctttctacgccttcttcgatgtcaatgtcggagacgcaggcggcgccgacccctttggcgggtgtatggacaccactggcgggcgagcacaagcggtctccgtcaggactgtgcccccagctcaggagatgcgccaccaggagctcccctggccctcacagctctgccagatcccgaccccgagcccccaggaacacctgagatgcaagcccccgtcgcatcccgccgaaagccgccttcagcattccgagagtggcgcctattagggccgtttcggagacctacgacccagctgcgtgctaaggtatcctcgctaagccataaaattcgggcaggaggcgcacagcgggctgaagcagcttgtgcccagagaagcgaggtggaggctgtgtccctgggggtacctcacgaggtagctgagggtgcaacgtgccaggcctacgagcttgcggactattcgaacctccgcgaaacagatatctag

SEQ ID NO: 178438 - DNA, 1344 bp, Artificial Sequence
  Description of Artificial Sequence: Synthetic coding sequence
atggaccaccaggacccctacagcgtgcaggccaccgccgccatcgccgccgcgatcacattcctgattctgttcacaatttttggtaatgccctcgtgatactggcggtgctgacaagcaggagtctgcgagcgccccaaaatctattcttggtgagtctggcggccgcagacatcctggtcgcaaccctgattataccgtttagtctcgcaaatgagctgctgggctactggtactttcggagaacatggtgcgaggtttacctagctctggacgtacttttctgtaccagcagtattgtccacttgtgtgccatctctctcgacaggtactgggccgtgagtcgcgccctcgaatataactcgaagaggacacctcggcggataaaatgcattatcttgacagtgtggctgattgccgcagtgataagtctcccaccccttatctataagggggaccagggccctcagcccagagggaggccgcaatgcaaactgaaccaggaggcttggtacatcctcgctagcagcatcgggagcttcttcgccccctgcctgattatgattctggtgtatctcaggatttacctgatcgctaagagatctaaccggcggggcccccgggctaaggggggacccggtcagggcgaaagtaagcagccacggccagatcatggcggggcactggcctcggccaaactacccgcactggcttccgtcgcgagcgcacgagaggtcaacgggcatagcaaatccactggagaaaaggaagagggcgaaacacccgaagatacaggaacccgagcactgcctccttcttgggctgctttgcccaattcggggcaaggccagaaggaaggggtgtgtggtgccagccccgaagacgaggccgaagaggaggaagaagaggaagaggaatgcgagcctcaggccgttcccgtgagtccagcttccgcatgttcgccccccttacaacagccacaaggcagcagagtgcttgccaccctgagaggccaggttcttctaggccgaggtgtgggggcaattgggggccagtggtggagaagaagggcgcagcttaccagagaaaaacgtttcacgtttgtgttagccgtagtaatcggggttttcgtgctctgctggttccccttttttttcagctatagtctgggggcaatttgtccgaagcattgtaaggtgccccacgggctgtttcagttcttcttctggatcgggtactgcaatagttccctcaaccctgtcatttacaccatctttaaccaggactttaggcgggccttcagaaggattctgtgcagaccctggacccagacagcctggtag

SEQ ID NO: 178439 - DNA, 1389 bp, Artificial Sequence
  Description of Artificial Sequence: Synthetic coding sequence
atggccagccccgccctggccgccgccctggccgtggccgccgccgccggacctaatgcatctggggcaggggagcggggctcaggtggggttgctaatgcttctggagcgtcgtggggccctccaagaggacaatactctgccggcgcagtcgccgggctggccgccgtagtggggttcctgattgtctttacggttgtgggaaatgttctggtggtaatcgctgtactgacttctcgggctctgagagcacctcagaatctgttccttgtcagccttgcctccgctgatattcttgtcgctacactggtgatgcctttctccctggctaatgaattgatggcctattggtattttgggcaagtgtggtgcggcgtgtatctggccttggacgtgctgttttgcacctcctccattgtgcatttgtgtgctattagtctggacaggtattggagtgtgacccaggcagttgagtataatctcaaacgcacaccacggagagtaaaggcaacgatcgttgccgtgtggctcatctctgccgtgatctctttccctcctctggtgagtctgtatcgacaacccgacggcgccgcatacccccagtgtggacttaacgatgagacctggtatatattaagcagttgcattggaagcttttttgccccttgcctgataatgggcctggtatatgcccgcatctatcgggtggctaagctgcgaacacgtacactctccgaaaagcgagcccctgtcgggccagatggagctagtcccacgactgagaacggtctgggggccgccgcgggcgccggggagaacggccactgcgctcctccccccgccgatgtcgaaccggatgaatcctccgcagcggccgagaggcgacgccggcgcggcgctctccggcggggcggcaggagaagagcaggtgcagaaggcggtgcgggtggggcggatgggcagggtgctggaccaggagctgccgagtctggagcactcactgccagccgctccccgggccctggcggaaggttatctagagcgtcatcccgctcggtggaattcttccttagcaggcggagacgcgccagatcctctgtctgtaggcggaaggtggcccaggcaagggaaaaacgcttcacatttgtgttagcagtagtaatgggtgtctttgtgctctgctggttccccttttttttttcttattccctttatggcatctgcagagaggcttgtcaggttcccggcccgttattcaagtttttcttctggataggttactgcaacagctctcttaaccctgtgatttacactgtgttcaatcaggatttccgaaggtcctttaaacatatcctgtttcggcgccggcgtagaggctttcgccagtag

SEQ ID NO: 178440 - DNA, 2070 bp, Artificial Sequence
  Description of Artificial Sequence: Synthetic coding sequence
atggccgacctggaggccgtgctggccgacgtgagctacctgatggccatggagaaatcaaaggctacaccggcagctagagctagcaaaaaaatcctgttgcccgagcctagtattcggtctgtgatgcagaagtacctcgaggacaggggcgaggtcactttcgagaagatattttcccagaaattgggttatctgttgtttagggatttttgcctcaaccacctggaagaggctaggcctctggtggagttctatgaggagattaagaaatatgaaaagctggagactgaggaagagcgggtggctcgaagtcgcgagatttttgactcctacattatgaaagagttattagcttgcagccatccgttcagtaagtccgccaccgagcacgtgcaggggcatctgggtaaaaagcaagtgcctcctgacctgttccagccctacatcgaggagatatgtcagaacctgaggggagatgtgttccagaagtttatcgaatctgacaaatttacacgcttttgtcagtggaagaacgtggagctgaacatccatcttacaatgaatgatttcagcgttcaccgcattattggccggggaggatttggagaggtctatgggtgtaggaaggccgatactggcaagatgtacgccatgaagtgtctggacaaaaagcgtataaagatgaagcagggtgagaccctagcattgaatgagcgcatcatgctaagtctcgtctcaactggggattgtccattcatcgtgtgtatgtcatatgcgttccatacgcctgataagttaagcttcatccttgatctaatgaacgggggagaccttcactatcatttatctcaacatggtgtcttttccgaagccgatatgcgcttttacgccgccgaaataattctggggcttgagcacatgcacaacaggtttgtcgtctatcgggatctgaaacccgccaatatattgctggacgaacatggacacgtccgcataagcgatctggggctcgcctgcgatttcagcaagaaaaagccccatgcaagcgtgggaactcatggctacatggccccagaagtactgcaaaaaggtgtggcctacgactcctctgccgactggttctccctggggtgcatgctattcaaattgctgagaggacactctccatttaggcagcataaaacgaaggataaacacgagatagatagaatgaccctaacaatggccgtagagttgcccgacagcttcagccctgaacttaggtcactgctcgagggactgctccagagggacgtgaataggagactaggttgcctgggtcggggggctcaggaggtgaaagaaagtccgtttttccgctcacttgattggcagatggttttcctgcagaagtatccgcctcccctgatccccccacgtggcgaagtgaatgccgcagatgcattcgacatcgggagctttgacgaagaggacactaaaggaataaaactcctcgattccgaccaagaactataccggaatttccccctgacaatttccgagcggtggcaacaggaggtagccgagacagtgtttgacacgatcaatgctgagacagacagacttgaggcccggaaaaaggctaagaacaaacagttgggacacgaggaagattacgcactgggtaaagattgcataatgcatggatatatgtctaagatgggcaacccttttcttactcagtggcaacgcaggtacttttaccttttcccaaatagattagagtggcggggcgaaggagaagcccctcagagcctgctgacgatggaagagattcaatccgtggaggaaacgcaaattaaagagagaaaatgcctgctgctcaagatcaggggcgggaaacagtttatcctccagtgcgattctgatcctgagctggtgcagtggaaaaaggaacttagagatgcctatcgggaggcgcagcagctggtgcagcgcgtcccgaagatgaaaaacaagcctagaagcccagttgtggaactctcgaaggtgcctctcgtgcagcggggcagcgctaacggcctctag

SEQ ID NO: 178441 - DNA, 2067 bp, Artificial Sequence
  Description of Artificial Sequence: Synthetic coding sequence
atggccgacctggaggccgtgctggccgacgtgagctacctgatggctatggagaagagtaaagccacacctgctgcacgcgcttcaaaacgcatcgtcctccccgagccgagtatccggtccgtcatgcagaagtatctggccgagaggaatgagattacgtttgacaagatattcaatcagaagataggcttcttgctttttaaagacttctgcttaaatgaaatcaacgaggcagtgcctcaagttaaattctacgaggaaattaaggaatacgaaaaacttgacaacgaagaggatcgactgtgtagaagcaggcaaatatacgacgcgtacatcatgaaagaactgctgtcatgttcacaccctttcagcaagcaagctgtggaacacgtgcagtcccacttaagcaagaagcaggtcacaagcaccctttttcagccctatatcgaagagatctgcgagtcactccgaggtgacatcttccagaaattcatggaatccgacaaatttacccgtttctgtcagtggaagaacgtcgagcttaacatccatctgacaatgaatgaatttagcgtgcacaggatcatcgggaggggaggcttcggcgaggtgtacggttgccgaaaggccgacactggcaaaatgtacgctatgaaatgcttggacaagaagcggatcaagatgaaacagggagaaacattggctttaaacgaacgcattatgctttcccttgtgtcaactggtgattgtccgttcatcgtctgcatgacatatgccttccacactccggataaactttgtttcatcctggacttaatgaatgggggcgatctccactatcacctgagccaacatggggtattctccgaaaaagagatgagattctacgccacggagattattctcgggctcgaacatatgcacaaccgatttgtagtatacagagatttaaagcctgcgaacattttacttgacgaacacggccacgcaagaatctccgacctcggcctggcttgcgatttctccaaaaaaaaaccacacgcaagcgtcggcacccatggatacatggcaccagaggtgttacagaagggaactgcgtacgatagcagtgccgactggttttcacttgggtgcatgctatttaagttgttaagaggccattccccgttccggcagcataagaccaaggacaagcacgagatcgaccgcatgaccctcacagtaaacgttgagctgccggatacgttcagtccagaattgaagtcattgctggagggccttctccagagagatgtgtccaagcggttagggtgccacggaggaggaagccaagaagttaaagaacactcgttttttaaaggagtggattggcagcatgtttatctgcagaaatatcccccccctctcattcctccccgcggcgaggtcaatgccgccgatgctttcgacattggatccttcgatgaagaagataccaaaggcatcaagttgttggactgtgatcaggaattgtataagaattttccactggttatcagcgagcgatggcaacaggaggtgactgagactgtgtatgaggcagtgaacgctgataccgataagatcgaggctaggaaaagagccaagaacaagcaactggggcatgaagaagactatgcacttggcaaggactgtattatgcatggatacatgctcaaattgggcaatccgttccttacccaatggcagagacgttacttttatctgttccctaatagactggaatggcggggcgagggagagagccgccaaaatctcctgaccatggagcagattctgtccgttgaagagacccagatcaaggacaagaagtgcattttattccggatcaagggagggaagcaattcgtgcttcagtgtgagtccgatccagagtttgtgcagtggaagaaagagcttaatgaaaccttcaaggaggcccagaggctgctgagacgggccccaaagttcctgaacaagccacgcagtggtactgttgagctccctaagccatccttatgtcacaggaacagcaatggcctgtag

SEQ ID NO: 178442 - DNA, 1164 bp, Artificial Sequence
  Description of Artificial Sequence: Synthetic coding sequence
atggccgacctggaggccgtgctggccgacgtgagctacctgatggccatggagaagagcaaggctacccccgcagccagagcttcgaaaaggatagtgctgccagaaccctcaatcagatctgttatgcagaaatatctggcagaacgaaatgagatcacctttgacaagatctttaatcagaagatcgggtttctccttttcaaggacttctgtctgaatgagattaatgaggcagtgccccaggtgaagttctacgaagagattaaggaatatgagaaactcgacaacgaggaagatcggctgtgtaggtctaggcagatatatgatgcctatataatgaaggagcttttatcatgttctcacccattctcaaagcaggcggtggagcatgtgcagtcacacctgtccaagaaacaggtcacatcaactttgtttcagccttacattgaagagatctgcgagagcctcaggggtgatatcttccagaagttcatggaatctgacaaattcacgcggttttgtcaatggaagaacgttgagctgaacattcacttaacaatgaacgagttttccgttcacagaattattggacggggcggcttcggcgaggtgtacggatgtcgaaaggccgatactggcaagatgtatgccatgaagtgcctggacaagaagcgcatcaaaatgaaacaaggcgagacactggcactaaatgagcgcatcatgttgtctctggtatctaccggcgattgccccttcatagtgtgcatgacctacgcttttcacacaccagataagctttgtttcatcctcgacctgatgaacgggggagatttacattatcatctctcacagcatggcgtcttctcagagaaggaaatgcggttctatgcaacagagattattctcggactggagcatatgcataaccggtttgtggtgtatcgcgatctgaaacctgctaacattctgctcgacgagcatggccatgcaagaattagcgatctggggctggcctgcgacttttccaagaagaaaccacatgcatccgttgggactcacggatatatggctccagaagtcctgcaaaaaggcactgcatatgatagctccgctgactggttttccctgggctgtatgctgtttaagctgctgcgcggatag

SEQ ID NO: 178443 - DNA, 1434 bp, Artificial Sequence
  Description of Artificial Sequence: Synthetic coding sequence
atgggcgccggcgtgctggtgctgggcgccagcgagcccggcaacctcagttccgccgcaccgttgccggatggcgccgctaccgcagccaggctcctagttccagctagcccaccagcatctctcctgcctccagcttccgagtcgcctgagcctcttagccaacaatggactgccgggatgggtctgctgatggccctgatagtgctgcttatcgtggccggcaatgttctcgtgattgttgccatcgcgaaaacaccacggctgcagaccctgaccaacctgttcattatgagtttggccagtgcagacctagtaatgggcctccttgtcgtaccatttggcgccaccattgtcgtttggggtagatgggaatacggttcctttttctgtgagctctggacaagtgtggacgtgttatgtgtaacagcatcaatcgaaactctttgtgtcatcgcacttgatagatatctggcaatcacgagcccatttagatatcaaagcctcctgacgagggcccgcgccagaggcctggtgtgtactgtgtgggccatctctgccctcgtgtcattcttaccaattctcatgcactggtggcgtgccgaaagcgacgaggcccgcaggtgctataatgatccaaagtgttgcgattttgttactaacagggcgtacgcaatcgccagctctgtggtctctttctacgttcctctttgcatcatggcattcgtttacctcagagtctttagagaagcccagaagcaagttaaaaaaattgactcctgcgagcgcaggtttctgggtggaccagcccgccctccgagcccatcccctagccctgttcccgcccctgccccaccgcccggtcctccaaggcctgctgcagcagcggccacagcacctctggctaatggaagggccggtaagcgccggcccagccgattagtcgcactccgcgaacaaaaagccctgaagactctgggtatcattatgggagtgttcaccctctgttggttgccgttttttctcgctaatgttgttaaagcttttcaccgagagctggtacccgatcggcttttcgtcttttttaactggctgggctatgccaattccgcatttaaccccataatttattgccgttcccccgattttcgcaaagccttccaggggctgctgtgttgtgcacggagagctgcccggcggagacatgccacacacggtgatcgaccacgagcctcgggatgcctggcaagacctggcccgccaccgtctcctggagcagcatccgacgacgatgatgatgacgtagtcggagcaaccccgccggccaggctcctcgagccctgggcgggttgcaatggcggagctgccgcagacagcgattcttccctcgacgagccatgcaggccagggttcgcctcagagtctaaagtttag

SEQ ID NO: 178444 - DNA, 1242 bp, Artificial Sequence
  Description of Artificial Sequence: Synthetic coding sequence
atgggccagcccggcaacggcagcgccttcctgctggcccccaacgggtcccatgctcccgatcatgatgtgacacaggagagagatgaggtctgggtggtcggtatggggattgttatgtcactaattgtactcgccatcgtgttcggcaatgtcctggtgatcacagcgatcgccaaatttgagcggctacagacagtaaccaattacttcatcacaagcttggcgtgtgccgatctcgtaatgggcctggctgttgtgccttttggtgcagcccacatactaatgaagatgtggactttcggcaacttctggtgtgaattctggacttctatagatgtcctgtgtgtgaccgcatcgatcgagacgctctgtgtgatagccgtggaccgatacttcgcaataacctctcccttcaagtaccagtccttactaacaaagaacaaggcgagggtgatcattctcatggtatggattgtaagtggcctcacaagcttcctgcctatccaaatgcactggtatcgggctacccaccaggaggcaattaattgctacgcaaacgagacttgttgcgacttttttaccaatcaggcttacgccatagcgtcctctatagtgagcttttacgtcccattggtcatcatggtatttgtgtatagtagggttttccaggaagccaaaagacaactgcaaaagatcgataaatcagaggggcgattccacgtgcagaacctctcccaggtggagcaggacgggcggaccggacacggactgcggcgaagtagcaagttctgcctgaaggaacacaaggctctgaagacattaggcatcataatgggtacctttactctgtgctggctccccttttttatcgtcaatattgtacatgtgattcaagataacctgatccggaaggaggtctacatcttactgaattggataggctatgtaaactccgggtttaatcccctcatctactgtcgcagccccgactttcggattgcatttcaggaactcctctgcctgcggcgctcaagtctcaaggcatacggtaacggatattcttctaatgggaacacaggagagcagagcggctatcatgtggaacaggagaaagaaaacaaattactgtgcgaggatcttccaggcacggaggatttcgtagggcatcaggggaccgtccccagtgataatatcgattctcagggaaggaactgttcgacgaacgattctctcctatag

SEQ ID NO: 178445 - DNA, 1227 bp, Artificial Sequence
  Description of Artificial Sequence: Synthetic coding sequence
atggccccctggccccacgagaacagcagcctggccccctggcccgatctgcccacgctggcccctaatacagctaacaccagtggcctgccaggggtgccatgggaagctgcccttgccggagctctgctggctctggctgtgctcgccacagtcggcggcaatctgctggtcatcgtagctatcgcatggactcctaggctacagacaatgaccaatgtcttcgttacatcgctggccgcagcagacctggtgatgggcctcttggtggtcccccctgcagcgacccttgcgctgacaggccactggccgttgggtgctactgggtgcgagctgtggaccagtgtagacgtcctatgcgtcaccgcaagcattgaaacactatgtgccctggctgttgaccggtatctggctgttaccaaccctctacggtatggtgcacttgtgaccaagaggtgtgcgaggacagctgttgtgctagtgtgggtcgtctctgctgctgtgtcctttgccccaattatgagtcagtggtggagggtgggggctgacgcggaggcacagaggtgccacagtaatcctagatgttgcgcgtttgcatcaaacatgccctacgtgctgttgtcgtcttcagtctccttttacctgcctctgctcgtgatgctctttgtatatgctcgcgtttttgttgttgccactcgccagttgcgcctcctgagaggggaacttggacggttccctccggaagaatctccgcctgcaccgagccgctcacttgcccctgccccagtcggcacctgtgctccccctgagggggtgccagcgtgtggtagacggcctgctaggctgctccccctgcgtgagcacagagcactgtgtacactgggactgattatggggaccttcacgctctgctggttgccctttttcctggccaatgtgctgagggccctagggggcccgtccctcgtgcccggcccagcctttcttgcactgaattggctaggatacgctaacagcgccttcaatcccctaatatattgccgcagccctgatttccgcagtgcctttagacgactgctctgtcgatgcggcaggcggcttccgcccgaaccatgcgccgccgcaagacctgctctattcccttccggggtgcctgcagctagaagctccccggcccagccccggttgtgtcagcgcctggacggagcctcttggggagtgtcctag

SEQ ID NO: 178446 - DNA, 1044 bp, Artificial Sequence
  Description of Artificial Sequence: Synthetic coding sequence
atggccgccggcaccgccgtgggcgcctgggtgctggtgctgagcttgtggggcgctgtggtaggggcccaaaatattaccgcccgaattggtgagccactcgttctgaaatgcaaaggggcccctaagaagccgccccagcggctcgagtggaaactgaacactggcaggacagaagcttggaaagtcttatcccctcagggaggcgggccctgggactctgtggcacgcgttctgccaaacggtagcctgtttctgcccgccgtggggatccaggatgaaggcattttcagatgccaggccatgaataggaatggtaaggagaccaagtccaactaccgagttcgggtgtatcagatcccgggcaagcctgaaattgtagacagcgcatccgagctcacagcgggagtccccaataaagttggcacctgtgtgagcgagggaagctacccagctgggaccctgagctggcatctcgatggaaagcctctggtgccgaatgagaagggtgtatcagtgaaagagcagactagacggcatccagagactggtttatttaccttgcagtccgagttaatggtgacccccgcgcgcggcggtgacccacgcccgactttctcctgttcctttagcccgggcctgcctaggcatcgggcattgaggactgcgcccatccagccacgggtgtgggaacctgttcctctggaggaagtccaattggtggtggagcctgagggcggcgctgtcgcacccgggggtactgtgacccttacatgtgaagtgcctgcccagccatcaccccagatacattggatgaaggatggggtccccctgccacttcctccatcccctgtcttgattcttcctgagattggaccccaggaccagggcacgtattcttgcgtggcaacgcatagctcacatggacctcaagaaagtcgagccgtgagcatctctatcatagagccaggagaagagggacccacggcgggggagggctttgataaagttagagaagccgaagactcaccgcagcacatgtag

SEQ ID NO: 178447 - DNA, 702 bp, Artificial Sequence
  Description of Artificial Sequence: Synthetic coding sequence
atggccgccggcaccgccgtgggcgcctgggtgctggtgctgagcttatggggcgctgtcgtaggggcgcaaaacatcacagcacgtataggcgagcccctggtcctgaaatgcaaaggagcccccaagaagccccctcagcgacttgagtggaaattaaataccggccgtaccgaggcttggaaagtgctaagccctcagggcggcggcccctgggattctgttgcccgcgtactgcctaacgggtctttatttcttcccgccgtcggaattcaggacgagggcatttttcgatgccaggctatgaataggaatggtaaagaaactaagagtaactatcgcgtgagggtgtaccaaatcccgggaaagccagagattgtcgactccgcctcagagttgacagccggcgtgccaaataaagtcgtggaagaatctcggcgtagcaggaaaagaccttgtgaacaggaagtaggtacttgtgtcagcgaaggcagttatccagccggcaccttatcctggcatctggatgggaaacctctggtgcccaacgagaaaggcgtgtctgtgaaggagcagacacgacggcacccggaaactggcctctttacactacaatcagaactcatggtgacccccgcccggggtggagacccacggccaacatttagctgtagctttagccctggtttaccccggcattag

SEQ ID NO: 178448 - DNA, 402 bp, Artificial Sequence
  Description of Artificial Sequence: Synthetic coding sequence
atgaaggacggcgtgcccctgcccctgccccccagccccgtgctgatcctacccgagatcgggccccaagatcagggaacatactcctgcgttgcgacacactccagtcacgggccacaggagtcccgggccgtatctatcagcatcatagaacccggggaggaagggccaacagccggatctgtcggggggagcgggttaggaacccttgcactggctctgggcattctggggggactaggtactgccgcgctcctcattggcgtgatcctctggcaacggcggcagcgtaggggcgaggagcgaaaggctcctgagaatcaagaagaagaggaagagcgcgcagagcttaaccagagcgaggaaccggaggctggggagagcagtactggcgggccttag

SEQ ID NO: 178449 - DNA, 366 bp, Artificial Sequence
  Description of Artificial Sequence: Synthetic coding sequence
atggccgccggcaccgccgtgggcgcctgggtgctggtgctgagcctctggggcgctgtggtgggggcacaaaatattaccgcccgaatcggggagccactggtgctgaaatgtaaaggagcacccaagaagccccctcagagactggagtggaaactgaacacaggaaggacggaagcctggaaggttttgtcgccccaggggggcggaccgtgggatagcgttgctcgcgtcttacctaacggctccctctttctgcctgccgtgggcatccaggatgagggtatttttaggtgtcaggcaatgaacaggaatggcaaggaaaccaaatccaattggtggtggtcgcagaaggtggaacagtag

SEQ ID NO: 178450 - DNA, 1029 bp, Artificial Sequence
  Description of Artificial Sequence: Synthetic coding sequence
atggccgccggcaccgccgtgggcgcctgggtgctggtgctgagcctctggggcgcggtggtgggagcacagaacatcactgccagaattggtgaacccttggtgcttaagtgtaaaggcgcccccaaaaagcctcctcaacgcctcgagtggaagctgggagggggcccatgggactctgtggctcgggtattgcctaatggaagcctgttcctgcctgctgtgggcatccaggatgaaggaatctttagatgtcaggccatgaacagaaatggtaaggaaaccaagtctaactatcgggtgcgggtgtatcagattcctggcaaacctgagatcgtggattctgcctctgagctgacagccggagtccctaacaaagtcgggacctgcgtcagcgagggcagctatcccgccggcactctcagctggcatctcgacggcaaacctctggtgccaaacgagaaaggggtgagcgtgaaggagcagactcgccggcaccccgaaaccggcctgtttactctgcagtctgagttgatggtgacgcccgcacgcggcggtgatcctagaccaacattttcatgttctttctcccccggtctgccccgacaccgcgcactgagaaccgcccctatccagccccgagtgtgggagccagtgccactggaagaggttcagctcgtggtggaacctgagggaggcgcagtagcccctggaggcaccgtaacattgacttgtgaggttccagcccagccttcaccacaaattcattggatgaaagacgtcagcgatctcgaacgcggagccggaagaaccagacgaggtggagcaaattgtcgtctgtgtggacggattcgtgcaggtaactccagtcccggacccggcgatcccgggagacccggggatagcagacctgcacattggggccatttggtagcaaaagctgctacgccacgaagaggagaagagggtcccaggaagccaggcggccgaggtggggcatgcaggacagagtcagtcggagggacctag

SEQ ID NO: 178451 - DNA, 885 bp, Artificial Sequence
  Description of Artificial Sequence: Synthetic coding sequence
atgaaccggaacggcaaggagaccaagagcaactaccgggtgcgggtataccaaatcccaggcaagccagaaatcgttgactctgcctcagagctgaccgctggggtgcctaacaaggtgggaacttgtgtgtctgagggcagttaccccgccggcactcttagttggcatctggatggcaagccccttgtcccaaatgagaagggcgtgtccgttaaggagcaaaccagacgacatccagaaacaggtctgttcactcttcagtccgagctcatggttacaccagcgcgcggcggcgatccgaggccaacattctcctgcagtttctctcctgggctgcctagacatagagctctgaggacagctccaatacagcctagagtgtgggagcctgtcccccttgaagaagtgcaacttgtcgttgaacccgaaggaggcgccgtggcccccggcggtaccgtcactctgacttgcgaagtccctgctcagccatccccacaaatacattggatgaaggatggagtgccgcttcccctgccgccttctcccgtgctgattctacctgaaatcggcccacaggaccaaggtacctattcctgtgtagctacacatagtagccacggcccgcaggagtcccgcgcagtgagcatcagcattatcggctcagtggggggcagcggacttggcacattggctctcgcgctcggaatattaggggggctcggtacagccgctttgctgatcggtgtcatcctgtggcagagaaggcagagacggggagaagaaaggaaagcaccagagaatcaggaagaggaggaagaacgtgcggagctgaaccagagtgaagaacctgaagcaggggaaagttcaacaggcggaccatag

SEQ ID NO: 178452 - DNA, 1308 bp, Artificial Sequence
  Description of Artificial Sequence: Synthetic coding sequence
atgggcgccggcgagcgggtgcaggcccccccccgggccgaggccacagccggcaggggggctgaccgagctagaaccctggaaggatctcgcatggcggccgggacagcagtgggcgcctgggttctggtgctaagtctatggggggctgtagtaggcgcccagaacatcaccgccagaatcggggagcccctggtcctgaaatgcaagggggcaccaaaaaagcccccacagcgcctggaatggaaattaaatacagggaggaccgaggcatggaaggttctgtcaccccagggtgggggcccttgggatagcgtggcaagagttctaccgaacgggtctttgttcctgccggctgtgggcatacaggatgaggggatcttcagatgtcaggcaatgaatcggaatggaaaggagacaaagtccaattacagggtgcgggtttaccaaatccccggaaagcctgagatagttgatagcgccagtgagttgacagcaggggttcccaataaggtaggcacatgcgtctctgagggctcttacccagcaggaaccctgtcatggcatttagacggtaagccactcgttccaaacgagaagggcgtctctgtaaaagaacagacacgccggcacccggaaaccggcctttttactcttcaatcggaactcatggtcacgcctgccaggggtggggacccacggcctacgttcagctgctccttctcacccggattgccccgacacagggctcttcgcaccgcaccaattcagcccagggtgtgggaaccagtacccctggaagaggtccagctggtggtagaaccggagggcggtgccgtggcccctggcgggactgtaacccttacatgtgaagtgcccgcacagccctctccgcagattcattggatgaaggatggggtgccattaccgctcccaccaagtcccgtgcttatcctaccagagatcggtccacaggaccagggcacatactcttgcgtggccacacacagttcccatggccctcaagagtccagggcagtctccatctccatcattgagcctggcgaggagggcccaaccgccggctctgtagggggatctgggctgggaaccttggccctggctttaggaatcctagggggcttggggacagccgccctcctaattggcgttattttgtggcagcgaaggcaaaggcgcggagaggagcgaaaggccccagagaaccaggaggaggaagaagaacgagccgaactcaatcagtccgaagaaccagaggccggtgagtcctccacgggcggaccttag

SEQ ID NO: 178453 - DNA, 1215 bp, Artificial Sequence
  Description of Artificial Sequence: Synthetic coding sequence
atggccgccggcaccgccgtgggcgcctgggtgctggtgctgagcctgtggggggccgtggtgggcgcccagaacattaccgctcgtatcggggagcctctagtgctcaagtgcaagggcgcacccaagaagcctcctcaaaggctggaatggaagttgaacaccggccgcaccgaggcctggaaagtcctgtctccccaggggggcggaccatgggattccgtcgccagagtgctacccaacggctccttattcttgccagccgtcggaatccaggacgaggggatcttcaggtgccaggcaatgaaccgcaacggaaaggaaaccaaatcaaattatcgcgtccgggtctatcagatccctggaaagccagagatcgtagattctgcatcagaactgacagccggagttccaaataaagtcggtacctgtgtaagcgagggtagttaccccgcgggcacactttcctggcacttagacggaaaacctctggtgccaaatgagaagggagtatcagtgaaggagcaaactcgccgccaccccgagactggcctcttcacccttcagtcggaactgatggtgacgcccgcacgcggtggcgaccctagacccacatttagttgttcatttagccccggactcccgaggcatagggctcttcgcactgctcccatccaacctagagtgtgggaaccggtgcctctggaggaggtgcagcttgtggtagagcccgagggtggcgccgtggctccaggaggaaccgtgaccctcacatgtgaagtcccagcgcaaccctcgcctcagatccattggatgaaagacggcgtgccacttccactgcccccttccccagttctgatcttaccagaaatcggtcctcaggatcagggaacttactcatgcgtggctactcactccagccacgggccacaggaaagtcgagccgtgtccatttcaattatcgaacccggagaggagggacccacagccggcagtgtcggaggcagcggactcgggacactggccttggccctgggtattctagggggcctcggtacggcggctcttttaatcggggtgatcctttggcagcgtcgtcagcggcggggggaggaaagaaaagccccggagaaccaggaagaagaggaggaaagggccgaattgaaccagagtgaggaaccagaggccggagaatcttctacaggtggcccgtag

SEQ ID NO: 178454 - DNA, 1044 bp, Artificial Sequence
  Description of Artificial Sequence: Synthetic coding sequence
atggccgccggcaccgccgtgggcgcctgggtgctggtgctgagcctgtggggagcagtcgtaggagcccagaatattacagcacgtataggcgagcccctagtcttaaaatgtaaaggggcccctaaaaagccaccccaacgcctggagtggaagctgaatacggggcgtaccgaggcctggaaggtcctctctccccaggggggcggcccatgggattctgttgcccgggtgttgcccaacggctccttattcctcccagctgtcgggattcaagacgaaggcatcttcaggtgccaagcgatgaataggaacgggaaagaaaccaaatctaactacagagtgagggtctaccagatacccggaaaacccgagatcgtagatagcgcttcagaacttaccgcaggcgtcccaaacaaagtgggtacctgcgtgtccgagggcagttatccagccggcaccctctcctggcacctggatggaaaacctctcgtgcccaatgagaaaggagtaagcgtcaaggagcagacaagacggcacccggagactggcctgttcacattgcagagcgaattgatggtgacaccagctaggggcggcgatccacgccccactttctcctgctctttcagccccggccttccccgccaccgtgcccttcggaccgcccctattcagccccgggtctgggaaccagtcccgctggaagaagtacagctggtggttgagccagaaggtggagcagtggcaccgggtgggactgtgaccctgacctgcgaggtgccagctcagcctagcccgcaaattcattggatgaaggatggggttccgctgcctctcccaccgagcccggttctgattctccccgaaatcggacctcaggatcaggggacctacagttgcgtagccacacactcttcacacggaccccaagagtcacgcgccgtcagtatctccattatcgaaccaggtgaagaggggcccactgccggcgaaggcttcgacaaggtaagagaagccgaggattccccacagcatatgtag

SEQ ID NO: 178455 - DNA, 1029 bp, Artificial Sequence
  Description of Artificial Sequence: Synthetic coding sequence
atggccgccggcaccgccgtgggcgcctgggtgctggtgctgagcttgtggggtgcagttgtgggcgcccagaacattactgccaggatcggcgaaccactggttctgaagtgcaaaggagctccaaagaagcctccccagagactcgagtggaagctgggggggggtccctgggatagcgttgcacgggtgttgccaaacggcagcctcttccttcccgctgtgggcatccaggatgagggtatattcaggtgtcaggccatgaacagaaatggcaaggaaaccaaaagcaattatcgagtgagggtttaccagatacccggaaagcccgagattgttgactctgccagtgaacttactgctggcgtccctaataaagtgggcacctgcgtcagcgagggaagctacccagcggggacactgtcatggcacctggatggtaagcccctggtccccaacgagaagggagtgtctgttaaagagcagaccagacggcatcctgaaaccggattgtttaccctgcagagtgaactgatggtgacaccagctaggggtggtgacccacgccctactttctcctgttctttctcacctggcctgccacgtcacagagccctgaggactgctcccatccagccgagagtatgggaacctgtgcccctcgaagaggtacagctggtggtcgagcccgaagggggcgcagtggcgcctggaggaacggtaactctcacctgcgaggtcccggcccagcccagtcctcaaattcactggatgaaggatgtgtctgacctagagcggggggcagggcgaactagacgggggggagctaactgtcgcctctgtggtcgtatccgagccggcaactcttccccaggtcctggggaccccggccgccctggagattcacgtcccgcgcactggggccatctggtggccaaggccgcaactccaaggaggggtgaagaaggaccccgcaaacccgggggcaggggtggagcttgtcggacggagtcagtgggagggacctag

SEQ ID NO: 178456 - DNA, 1029 bp, Artificial Sequence
  Description of Artificial Sequence: Synthetic coding sequence
atggccgccggcaccgccgtgggcgcctgggtgctggtgctgagcctgtggggggccgtcgtgggggcacagaacattacagcaaggattggcgaacccctggtgctgaagtgcaaaggcgctcccaagaagcctccacagaggctggaatggaagctgggaggcgggccctgggacagcgtcgctcgggttttacctaatgggagtctattcctacctgcagtggggattcaggacgagggaatctttcgctgtcaggccatgaataggaacggaaaggagaccaagagtaattaccgagtccgcgtctatcaaattcctggaaaaccagagatcgtcgatagcgcaagcgagctcacagcaggagtgcctaacaaggtgggcacctgtgtcagcgaaggcagttacccggccggcaccctgagttggcatctcgatgggaagccactagtgccaaacgaaaagggggtctctgtcaaggaacagactcgtaggcatcctgagacgggtctctttacactgcaatccgagcttatggtgacgccggcacgtggtggagatccccggcctaccttttcctgttctttcagtccaggcctgcctcgccaccgggcactacgcacagccccaattcaaccccgagtgtgggaacccgtgccccttgaagaggtccagctggtcgtggagccagaaggcggagcagtcgccccggggggcacagtgacattgacctgcgaagtgcccgcacaaccgtctcctcagatccactggatgaaggacgtcagcgacctggaacgtggagctggccggaccagacgtggaggagcaaattgtaggctctgcggcagaatccgcgcgggcaacagctcacccgggccgggcgatcctggcaggcctggtgacagtcgccccgctcactgggggcacctcgttgcgaaggctgccacaccgcggcgcggagaggagggcccgcgcaagccggggggtcgcggcggggcttgtaggactgagtcagtaggcgggacgtag

SEQ ID NO: 178457 - DNA, 702 bp, Artificial Sequence
  Description of Artificial Sequence: Synthetic coding sequence
atggccgccggcaccgccgtgggcgcctgggtgctggtgctgagcctgtggggagcagtggtgggagcacagaacatcaccgcaaggatcggtgagccacttgttctcaaatgtaaaggagctccaaagaagcctccccaacgactcgagtggaagctgaatactggccgcactgaagcatggaaggtgctatcaccacagggaggcggcccttgggattccgtggctagagttttgccgaacagctccctgttcttaccagcggtggggattcaggacgaggggattttcaggtgccaagctatgaatcgtaacggcaaggagacaaagagcaactatagagtccgcgtgtatcagatccccggaaaacccgaaatcgtcgatagcgccagtgagttgactgcgggggtacccaataaggtcgtggaggaatcccggaggtcaagaaaacgaccctgcgaacaagaagtgggaacatgtgtttctgagggttcttaccctgctggaacactctcttggcacctggacggtaagccactggtgcctaatgagaagggagtgtcagtaaaggaacagacccgacgacaccccgaaacaggtctcttcactctgcagtccgaacttatggtgactccggctcgaggcggtgaccctcgcccgacgttttcatgttcattctccccaggactacctaggcattag

SEQ ID NO: 178458 - DNA, 705 bp, Artificial Sequence
  Description of Artificial Sequence: Synthetic coding sequence
atggccgccggcaccgccgtgggcgcctgggtgctggtgctgagcctgtggggcgccgtggtgggtgcccaaaacatcacggcaaggatcggcgagccactggtgttaaagtgtaaaggcgccccaaaaaaacctccgcagcgtctcgagtggaaactcaataccggaagaactgaggcatggaaagtcctgagtccacagggtggaggaccatgggattcagtcgctagggtgctgccgaatgggtctctctttctgcctgccgtagggatccaggatgagggaatcttcaggtgccaggcaatgaataggaacgggaaagaaaccaagagtaattataggtctttgcgcaccttcacgattactgccagtgattggatatttcctccctcagaaatccccgggaagcctgaaatagtagacagtgcttccgagctgacagctggtgtacctaataaggtcggtacatgtgtgtcggaaggctcttatcctgccggaacactgagctggcaccttgatggaaagcctttggtgccgaacgagaagggcgtctccgtgaaggagcaaacgagaagacaccccgagactggactttttaccctccagagtgaactgatggtgacacccgctcgaggcggagatcccaggccaacattttcctgctctttctccccagggctgccgagacaccgcgctctcaggtag

SEQ ID NO: 178459 - DNA, 705 bp, Artificial Sequence
  Description of Artificial Sequence: Synthetic coding sequence
atggccgccggcaccgccgtgggcgcctgggtgctggtgctgagcctctggggagcggtggtgggcgctcagaatatcacagcccgcattggcgaacccttggttcttaaatgtaaaggcgcaccaaagaaaccccctcagagactggaatggaagctgaacaccggacggaccgaagcatggaaggtgttatccccccagggcgggggtccttgggattctgtcgcacgagtgctgcccaatggaagcctgttcctcccagcagttggaatccaggacgaaggaatcttccgatgccaagcaatgaatcgaaatgggaaagagactaaaagcaattatcgcagcttgagaaccttcaccataaccgcctctgattggatcttccctccctccgagatcccagggaagccagaaattgttgacagtgcttcagaactgaccgccggtgtgccaaataaggtggggacttgtgtgtccgaggggagctatccagctgggactctgtcttggcacctggatggcaagccacttgtccctaatgagaaaggcgtttcagtgaaagagcagacaagacgccatcctgagacagggctgtttacacttcagtcagaactgatggttacccccgccaggggaggcgatccccggcccacattctcttgttcttttagtcctggacttccacgacatagagccctgagatag

SEQ ID NO: 178460 - DNA, 702 bp, Artificial Sequence
  Description of Artificial Sequence: Synthetic coding sequence
atggccgccggcaccgccgtgggcgcctgggtgctggtgctgagcctgtggggggcagttgtcggagcgcagaatatcactgcccggattggggaaccgcttgttctgaaatgcaagggcgccccaaaaaagcctccccagcgcttggaatggaagctgaatacaggacggacagaggcatggaaggtgctatctcctcagggcggcggcccttgggacagcgtggcgagagtcctacccaatggaagcctatttctgcccgcagtgggtatacaggatgaaggtatcttcagatgtcaggccatgaacagaaatgggaaggagacaaaatccaattatagggtgcgagtttaccagatccccgggaagccggagattgtggattccgccagtgagctgaccgcaggcgtgccgaacaaggttgtggaggaaagccgacgcagtcggaagagaccttgtgaacaagaagtgggtacctgcgtgtccgagggctcctatccggccgggacactgagctggcacctggacggtaagcctttagtgcctaacgaaaaaggtgtcagcgtgaaggaacaaacaaggcggcatcccgaaaccggcttatttacattgcaatctgagctcatggtaactccagctcgggggggtgaccccagacctacattcagttgctcgttcagtcccggcctgcctagacactag

SEQ ID NO: 178461 - DNA, 1215 bp, Artificial Sequence
  Description of Artificial Sequence: Synthetic coding sequence
atggccgccggcaccgccgtgggcgcctgggtgctggtgctgagcctctggggcgccgtagtcggtgcccagaatattaccgcccgtataggcgagcccctagttctgaaatgtaaaggcgcgccaaagaaaccgccacagaggctcgagtggaaacttaacacaggcaggaccgaggcctggaaggtgttaagcccacaggggggtggcccttgggacagtgtggcaagggtactaccaaattcaagcctcttcctgccggctgtgggcattcaagacgagggcatctttcggtgtcaggccatgaataggaatgggaaggagacgaaatcaaattacagggtacgcgtgtatcaaattcctgggaaacccgagatcgttgactcggcgagcgaactgacggccggagtcccaaataaggtggggacttgcgtgtccgagggtagctacccagctgggaccctcagctggcatctggatggcaaaccacttgtgcccaacgagaagggggtctccgttaaagaacagacccgcagacaccctgagactggcctctttacactgcaaagcgaactcatggtgacccccgcccgtggtggcgatccgaggccaacattttcctgcagctttagtccggggttgcctaggcaccgggccctaagaaccgcaccgattcaacctagggtgtgggaaccggtgcccttggaggaggtgcagctcgtggtggagcccgaggggggggcagtggctccagggggaactgttacattgacatgtgaagttccagcgcagccctcccctcagatccactggatgaaggacggcgtgcctctccccctgcccccaagtcccgttctgattttacccgaaattggaccacaggaccaaggcacatattcttgcgtggcaacccattcctcccacggaccacaagaatccagagctgtgtcaattagcattatcgaacccggagaggagggacccaccgcaggttctgtgggaggttccggactggggactttagcgctggccctagggattctgggtggcctgggcaccgctgcactgcttatcggcgtgatactatggcagagacgccagcgaagaggagaggaaagaaaggcaccggaaaatcaagaagaggaggaagaacgtgctgagttaaaccagtctgaggaaccagaagcaggggagagctccactggcggtccttag

SEQ ID NO: 178462 - DNA, 1044 bp, Artificial Sequence
  Description of Artificial Sequence: Synthetic coding sequence
atggccgccggcaccgccgtgggcgcctgggtgctggtgctgagcttgtggggagccgtggtgggggcccagaatattacggctcgcattggagaaccgctggtcctgaaatgcaagggcgccccaaaaaaacccccgcagagactcgagtggaaactcaatacagggcgtaccgaagcatggaaggtgctcagtccacagggagggggcccctgggactccgtagccagggtactccccaacggttctttgtttctccctgccgtgggcatccaggatgaggggatattcaggtgccaagctatgaaccgaaacgggaaggagacaaaatcaaactacagggtccgggtgtaccagatcccaggcaaacctgagatcgttgatagcgcatccgagctgacagccggcgtacccaataaagtcggtacttgcgtgagcgaaggctcttatccagctgggacactctcttggcacctcgacggtaagcctctcgttccaaacgaaaagggagtgtccgttaaggaacaaacccgaaggcatccggagaccggcctcttcacactgcagtcagaactgatggtgacccccgcgaggggcggtgatcctagaccgacattctcttgctccttctcccctggccttcctaggcaccgggcactccgcaccgcccccattcagcccagggtgtgggaacctgtcccattagaggaggtccagctggtggtggagcccgaaggcggggctgtggctcctggcggtaccgtgactctgacttgcgaggtgcccgcccagccctcaccacagatacactggatgaaggatggcgttccgcttcccctgccaccgagtcccgtcctgatcctgccagaaatcggtccccaggatcagggtacttatagctgcgttgccacacacagcagtcacggccctcaggagagtcgtgctgttagcatctcgatcattgagccaggcgaggaaggtcccacggctggggaaggcttcgacaaggtgcgggaagccgaggactcgccccagcacatgtag

SEQ ID NO: 178463 - DNA, 702 bp, Artificial Sequence
  Description of Artificial Sequence: Synthetic coding sequence
atggccgccggcaccgccgtgggcgcctgggtgctggtgctgagcctatggggggcggtggtgggcgcacagaatatcaccgcacggatcggcgaaccattggtactgaaatgtaagggtgcacctaagaagcctcctcaacgtttagagtggaagctgaacacggggaggaccgaagcctggaaagttctgtcccctcagggaggtgggccatgggacagcgtagcccgggtgctgccaaacgggagcctctttttacccgctgttggtatacaagatgaaggaatattcaggtgtcaggctatgaatcgcaatgggaaagagaccaaatccaactacagggtgcgcgtatatcaaatcccaggcaaacccgagatcgtggatagcgctagcgaactgactgcaggagttcctaataaagtggtggaggaaagtcgacggagtcgcaaacgaccttgcgaacaggaggtgggcacttgcgtgtctgagggatcctacccagcaggcactctctcttggcatctcgacggcaaacccctggttcccaacgaaaagggtgtgtcagtgaaggagcagacccgcaggcacccagaaactggactctttaccctccagagcgagctgatggttactcctgcccggggcggtgacccccgacctacctttagttgctcttttagccctggcctgccccggcattag

SEQ ID NO: 178464 - DNA, 1215 bp, Artificial Sequence
  Description of Artificial Sequence: Synthetic coding sequence
atggccgccggcaccgccgtgggcgcctgggtgctggtgctgagcctgtggggagccgtcgtcggtgctcagaatattacagccaggatcggagaacctttggttctaaagtgtaagggggcacctaagaaacccccccagagactggagtggaaactgaacaccggccgtactgaagcatggaaggtcctctccccacaggggggcgggccgtgggactcagtcgctagagtgctgccaaacggtagcctctttttacctgccgttggcattcaggacgagggaatctttcgctgccaggccatgaaccggaatggcaaagagactaagtccaactatagagttcgcgtgtaccaaatacccggcaaaccagagatcgtggactctgcctccgaactgacagctggcgtgccaaacaaggtcggaacctgcgtctcagaaggctcatatcctgcaggtaccttgtcctggcacctcgatggtaagccactggtgccaaatgaaaagggcgttagcgtgaaagaacagacgagaagacatcccgaaacaggacttttcacactgcagtccgagctaatggtgacccccgctcgcggaggcgatccccgccctacatttagttgtagcttttctcctggcctgcctagacatagggcgctacgtacagcccccatacagcctagggtatgggagcctgtgccgctagaagaggtacaactggttgtcgaacccgagggaggagccgtcgctccgggaggtaccgtgaccctcacctgcgaagtgcctgcacaaccttccccccagattcactggatgaaggacggagtgccacttcccctgccccccagtcctgttctgatcctgccagagatcgggccccaagatcaaggcacatactcctgtgtcgctacacactcaagccacgggccccaggaatctagggctgtctcgatctcaataatagagcccggtgaggagggccccactgccgggagcgtaggaggctccggcctaggcactctggctttagcgctcggtatcttggggggcttgggaaccgctgcgctgctgattggtgttatcttgtggcagagacggcaaagacgaggtgaagagagaaaagctcccgagaatcaagaggaagaggaggagagagccgaactgaaccagtcagaagagccagaagcaggtgagtcatccaccggtggaccctag

SEQ ID NO: 178465 - DNA, 705 bp, Artificial Sequence
  Description of Artificial Sequence: Synthetic coding sequence
atggccgccggcaccgccgtgggcgcctgggtgctggtgctgagcttgtggggcgcagtagtcggagctcaaaatataacggcaagaatcggggagccccttgttctgaaatgtaagggcgcgcctaagaagcctccacagcgattagaatggaagcttaacacggggcgcactgaagcttggaaggtgttgagcccccagggtggaggtccttgggatagtgtcgcgagggttttgcctaacagcagtctattccttcccgctgtgggaattcaggatgaaggaatctttagatgtcaagccatgaaccgcaacggaaaggagaccaagtctaattaccgttcactgagaactttcaccattacagcaagcgactggatatttccaccttcagagattcccggcaaaccggagattgttgatagcgcatctgaactcactgctggggtccccaacaaagtggggacctgcgtgagtgagggatcataccccgctggtaccctaagctggcatctggacggcaaaccgctggtacccaacgagaaaggagtttccgtgaaagagcagactcgcagacaccctgaaacgggtctgtttacattacagtcagagctcatggtgactccggcgagaggaggcgacccacggcccactttcagctgctctttcagccctggtcttccgcgccaccgggctctcaggtag

SEQ ID NO: 178466 - DNA, 1092 bp, Artificial Sequence
  Description of Artificial Sequence: Synthetic coding sequence
atggccgccggcaccgccgtgggcgcctgggtgctggtgctgagcctctggggtgctgtggtgggtgcccagaacatcacggcgcggattggggagcctctcgtgctgaagtgcaagggcgcaccgaaaaaaccacctcagaggttggagtggaagctgaatacgggtagaacagaggcatggaaggtgctgtcgccccaaggcggtgggccctgggatagtgttgccagagttctgccaaacggaagtctgtttctaccagcagttgggattcaggacgaaggcatcttcagatgccaggcaatgaaccgcaacggtaaggagaccaaatcgaattaccgggttcgggtgtaccagattccaggtaagcccgagatcgtggattctgcttcagagctgactgccggtgttcctaacaaagtcgttgaggaaagcagaagatcccgtaaaagaccttgcgaacaagaagttggcacttgcgttagcgaaggatcatacccggcagggactctgagttggcatctggatggcaaaccgctggtgcctaatgaaaagggagtgtctgtgaaggagcaaaccagaaggcaccctgagactgggctgttcactctgcagtcggaactgatggtcacaccagcacgaggaggtgaccctcgccctactttctcctgcagcttttctcccggcctcccaaggcatcgggccctgcgaaccgccccgatccagccgagggtgtgggaacccgtgccgcttgaagaggtgcagctggttgtcgaaccagaaggtggggctgtggcgccaggcggcacagtcacgctgacctgtgaagttcccgcgcagccttccccacagattcactggatgaaggatggagtccccctgccactgccaccctcaccagtcctgattttgccggaaattggcccccaagatcaaggaacctattcctgtgtggccactcattcttctcacggccctcaggaatcacgggctgtttcgatttcaattatagaaccaggggaggaaggaccgacagccggcgaaggatttgataaggttagggaagcggaggacagcccccagcatatgtag

SEQ ID NO: 178467 - DNA, 1029 bp, Artificial Sequence
  Description of Artificial Sequence: Synthetic coding sequence
atggccgccggcaccgccgtgggcgcctgggtgctggtgctgagcctgtggggtgcagtggtcggcgctcaaaacataaccgcccgtatcggagagcccctcgtgctgaagtgtaagggtgccccgaaaaaaccaccacagagactggagtggaaactgggcggcggcccgtgggattccgtggcacgcgtgctgcctaatggctccttgttcctgcccgccgtcggtatccaggacgagggaatcttccggtgtcaggcaatgaatcggaatggaaaggaaacaaaatccaactaccgggtgcgggtataccaaattcctggcaaacccgagattgtcgatagtgcttccgaactgactgcaggcgtgcccaacaaggtcgggacatgcgttagcgaaggctcgtaccccgctggaacactcagctggcatctcgatggcaaacccctggtaccgaacgaaaaaggcgtgtccgttaaggaacaaacccgacggcacccagagactggcctctttacactccagtctgaattaatggtgactccggcccgaggtggcgaccccagaccgaccttctcctgtagcttctccccaggactgcccagacaccgagccctgcgaaccgctcctatacaacctagagtatgggaacccgtaccccttgaggaggtgcagttagttgtcgagccagaggggggcgcggtagctcccggcgggactgtgacactgacttgtgaggtcccagcccagcccagtccccagattcactggatgaaagatgtctctgatttggaacgtggcgctggccggactcgtagaggaggcgcgaactgtcgtttgtgtgggagaattagggcagggaactcaagcccgggacctggcgacccaggacgccctggcgattccaggcccgcccactggggccatcttgtggctaaagccgccacccctagacggggtgaggagggacccaggaagcccggaggccgcgggggtgcttgtaggactgagtctgtgggagggacctag

SEQ ID NO: 178468 - DNA, 702 bp, Artificial Sequence
  Description of Artificial Sequence: Synthetic coding sequence
atggccgccggcaccgccgtgggcgcctgggtgctggtgctgagcctgtggggggccgtggtgggtgcccaaaacatcactgcaagaattggggagcccttagttcttaagtgcaaaggcgcaccgaaaaagcctccacagcggttagagtggaaactgaacacaggtcgaacagaagcttggaaagtactgtcacctcaggggggcggtccctgggacagcgttgcaagggttctgcccaacggcagcctgtttttacccgccgtcggtatccaggatgagggtatttttagatgccaggctatgaacagaaacggtaaagagacaaagtctaactacagggtcagggtctaccagattccagggaagcccgaaattgtggacagcgccagcgagctgacagccggcgttcccaacaaggtcgtcgaagagtcccgcaggtctcgtaagcgcccctgtgagcaggaggtggggacatgtgtctcggaaggatcttaccctgcaggtaccctgagttggcacctggatggcaagcctttggtccctaacgaaaagggtgtgtctgtgaaggagcagacccgccggcacccagaaactggcctattcactttgcaaagcgaacttatggtgacccccgcacgcggtggggacccgcggcccaccttctcgtgtagtttctcacccggtttgcctcgacactag

SEQ ID NO: 178469 - DNA, 1029 bp, Artificial Sequence
  Description of Artificial Sequence: Synthetic coding sequence
atggccgccggcaccgccgtgggcgcctgggtgctggtgctgagcctatggggtgcggttgtcggcgctcagaatataactgctaggattggggaaccattggtgttaaagtgtaaaggagctccaaagaaacctcctcagaggctcgagtggaagttaggcggcgggccatgggatagcgtcgcacgggttctccccaatggttctctgtttttgccagccgttgggattcaggatgaagggatcttccggtgccaagcaatgaatcggaacggaaaggagacaaaaagcaactatcgggttagggtgtaccagatccctgggaagcccgagatcgtggacagtgccagtgagctgactgcaggcgtacccaacaaagtaggaacttgcgtgtctgagggctcctaccctgccggcacattatcttggcacctcgacggcaagcctcttgtgccaaatgagaagggggtttcagtcaaagaacagacacggagacatccagagacggggctgttcacccttcagtctgaacttatggtgacacccgcaagagggggcgatcccagacccactttctcttgttcattttcgcccggattaccacgccaccgggcactgagaacggcccctatacagccaagagtgtgggaacctgttccattggaggaggtgcagctggtggtggagcctgaaggcggcgctgtagcacctggcggtactgtgaccctcacctgtgaagtgcctgcccagccctcccctcaaattcactggatgaaggatgtgtcagatctagaaaggggggccggacggactagacgggggggcgccaattgccgcttgtgcggccgaatcagggctggcaacagtagtccagggcctggagaccctggaagacccggggattcaagaccagcgcactggggtcatctggtggctaaggctgcgacaccaagaaggggcgaggagggcccaagaaaaccgggcggccgggggggcgcttgccgcacagaatccgtcggaggcacatag

SEQ ID NO: 178470 - DNA, 705 bp, Artificial Sequence
  Description of Artificial Sequence: Synthetic coding sequence
atggccgccggcaccgccgtgggcgcctgggtgctggtgctgagcctgtggggcgcggtggtaggggcccaaaatatcacagcacggatcggggaacccctggtcctgaaatgtaagggtgcccccaagaaacccccccagagattagaatggaagctgaacacagggcgaaccgaggcctggaaagtgctctctccccagggaggtggaccttgggattcagtggcacgggtcttacctaacgggtctctatttctccccgccgtaggcatacaggacgagggtattttccggtgtcaggcaatgaatagaaatgggaaggagaccaagtctaattatcggtctctgagaactttcaccatcaccgcatcagactggatctttccgcctagtgaaatcccaggcaaacccgagattgtcgatagcgcatcggagttgacggccggtgtgccaaataaagttggaacttgcgtgtctgagggtagctaccccgccggaactttgtcctggcatctcgatgggaagcccttggtgccgaatgagaaaggagtgtctgttaaggaacagaccagacgccatccagagacaggcctgtttactctgcagagcgaactcatggtgactccagcccggggtggcgatcctcgaccgactttctcatgttctttttctcccggcctaccccgtcacagggctcttcgatag

SEQ ID NO: 178471 - DNA, 1215 bp, Artificial Sequence
  Description of Artificial Sequence: Synthetic coding sequence
atggccgccggcaccgccgtgggcgcctgggtgctggtgctgagcctgtggggggccgtggtgggcgctcaaaacattaccgctagaattggcgaacctctagtcctaaaatgcaagggcgcccccaagaagccaccccagcgtttggagtggaagcttaacacgggaaggacagaagcctggaaggtactgtcaccccagggcggaggcccctgggactcggtggctcgcgtgttgccgaacggctccctgttccttccagctgtcggtatccaagacgaagggatattccggtgccaggcaatgaatcgcaacgggaaggagaccaagagtaactacagagttcgagtgtatcagatcccggggaagcctgaaatcgttgatagtgcctccgagttaacagccggcgtgcccaacaaggtcgggacgtgcgtttccgaaggttcctacccagcagggacgctctcgtggcacctcgacgggaagcctctagtgccgaatgaaaaaggggtgtccgttaaggagcagacgcggagacaccctgagacgggcctttttaccctgcagagtgagctgatggttacgcctgctagagggggagacccaagacccacattcagttgctctttctcaccaggtttacccagacacagagcgctgagaacggcacccatacagcctagagtctgggagccagtgcctctggaggaggtgcagctggtagtagagcccgaaggtggagccgtagcccccgggggcacagtcaccctaacttgcgaggtgcccgctcaaccctcgccacagattcattggatgaaagacggcgttcctctgcccctaccaccaagccctgtactcatacttcccgaaatcgggccacaggatcagggcacctactcctgtgtcgcgacacatagttcacatggtcctcaagagagtcgggctgttagcatcagtatcatagagccgggagaagaaggccccacggccggcagcgtcggtggaagcgggctggggactcttgcattagctcttgggatcctgggcgggcttggtacggccgcacttttgattggagtgattttatggcagaggcgccagaggcggggggaggagagaaaagctcccgagaatcaggaggaagaggaggaaagggccgagctcaaccaaagcgaggaacctgaggccggagaaagcagcacgggtggcccctag

SEQ ID NO: 178472 - DNA, 1029 bp, Artificial Sequence
  Description of Artificial Sequence: Synthetic coding sequence
atggccgccggcaccgccgtgggcgcctgggtgctggtgctgagcctgtggggagcagtggtgggggcacagaatataacagcccgcataggcgagcctttggtcttaaagtgcaaaggtgcaccaaagaagccaccacagaggcttgagtggaagcttggcggtggtccctgggactccgttgccagagtccttccaaactcgtcgttgtttctccctgccgtgggcattcaagatgagggaatctttcgctgccaggccatgaatcggaatggcaaggaaaccaagtccaactatcgtgtaagggtgtaccaaatccccggaaaacctgagattgtcgactccgcatctgagctgactgccggcgtgcctaacaaggtggggacatgtgtatcagagggatcttatccggccgggaccctctcttggcacctcgatggcaagcccctcgtgccaaatgagaaaggagtctccgtgaaagagcagaccaggagacatccggagacgggcttgttcaccctccagagcgaattaatggttacacccgcccgcggcggagacccccggccaaccttctcctgttcgttctccccgggcctgccgcgacatcgagctctgcggacagctccaattcagccaagagtatgggaacctgtcccattggaggaggtacagcttgtagtcgagcctgagggaggagcagtagccccagggggaaccgtgaccctcacctgtgaggtccctgcacaaccttcgccacagattcactggatgaaggacgtcagcgacctcgagagaggcgcaggtcgcactcgccggggcggagccaattgccggctctgtggcaggatccgtgcgggcaacagcagtcctggacccggtgatcctggaagacctggggatagcaggccagcccattggggtcatctcgttgcgaaagctgcgactccgcggcgcggcgaggagggcccaagaaagccggggggacgcggtggcgcatgtcgtaccgagtcagttggcgggacatag

SEQ ID NO: 178473 - DNA, 1044 bp, Artificial Sequence
  Description of Artificial Sequence: Synthetic coding sequence
atggccgccggcaccgccgtgggcgcctgggtgctggtgctgagcttgtggggcgccgtggtgggagcacagaacattacggcacggattggggagcctctggtgctgaaatgcaagggcgcccctaagaagccacctcagcgtttggaatggaaattgaacactggtagaacagaagcttggaaggttctgtccccccaagggggtggaccgtgggacagcgtggcgagggtgctgcccaacggatctttatttttgccggctgtgggcatccaggatgagggcatattccggtgccaggccatgaacagaaacggcaaggaaactaaatcgaattaccgagtgagggtgtaccagatccccggtaaacccgagattgtagatagcgcttccgaacttactgccggggtgccaaataaagtgggcacatgtgtctctgagggctcctacccagccgggaccctgtcatggcacctggacggtaagcccctcgttcccaacgagaaaggcgtaagtgttaaggagcagacccgccgacatcccgagacgggactcttcacccttcagagcgaactcatggtgaccccagcccggggaggagatcccagaccgaccttttcgtgctccttctcgccaggcctgcccagacatagagctctgcggactgcacctattcagccaagagtgtgggagcctgtgcctctggaagaggttcagctggttgtcgagcctgagggcggcgcagtagcacctggcggcaccgtgaccctgacatgcgaggttcccgctcagccatcgccccagattcattggatgaaggatggggtacccctgccgctacctccctcgccagtgctcattctgccggagatcggaccacaagaccagggcacatactcctgcgtcgccactcactcttcacatgggcctcaggaatcacgggccgtgtccatctccatcatagagccaggcgaggaggggcctacagcaggcgagggttttgataaagtccgggaagcggaggactctccacagcacatgtag

SEQ ID NO: 178474 - DNA, 705 bp, Artificial Sequence
  Description of Artificial Sequence: Synthetic coding sequence
atggccgccggcaccgccgtgggcgcctgggtgctggtgctgagcctgtggggagcggtggtaggtgctcagaatatcacggcacgcattggagagcctctggtgttgaagtgcaagggagcaccaaagaagcctcctcaaaggctcgagtggaaactcaacaccggccgaaccgaagcatggaaagtcttgagtccccagggcggcgggccttgggattctgtggcccgcgttctgccaaatggatcactgttcttgccggccgtggggatccaggacgagggcatttttcgatgtcaggctatgaaccggaacggcaaggagactaagtccaattatcgcagcttaaggacgttcactatcaccgcttccgattggatctttccaccctcagagatccctggaaaacccgagattgtcgacagcgccagtgagctgactgcaggggtccctaacaaggtcggaacatgcgtgagcgagggctcctaccccgccgggaccctttcctggcatctggatggcaagccactcgtccccaatgagaaaggcgtcagtgtcaaggaacagacccgtaggcaccctgaaactggcctattcacattgcagtctgaactaatggtcacacctgccaggggcggagacccaaggccaacattttcctgcagtttctctccaggtttaccgcgacacagggccctgaggtag

SEQ ID NO: 178475 - DNA, 1215 bp, Artificial Sequence
  Description of Artificial Sequence: Synthetic coding sequence
atggccgccggcaccgccgtgggcgcctgggtgctggtgctgagcctttggggcgcggtagttggagcccagaacattaccgctaggattggcgagccactggtgttgaaatgcaaaggtgccccgaagaaacccccccagcgccttgagtggaagctcaatacagggagaactgaggcctggaaggtgctgagtccccagggcgggggcccatgggactctgtggccagggttctccctaacggtagtttgttcttgcctgcagtggggatccaggacgaggggatcttcaggtgtcaggcgatgaacaggaacggaaaggaaacaaaatcgaactaccgagtgcgggtctaccagattcccggcaagccagagattgtggattcagccagcgaactgactgcgggtgtgccaaacaaggtcgggacctgtgtgagcgagggctcataccctgcggggacactgtcttggcacttagatggcaagcccctggtgcctaatgaaaagggcgtgagtgttaaggaacagacacgaagacatccggaaaccggtctgttcacgttgcagagtgaactcatggttaccccggctcgggggggtgatccgcgccccacgttctcatgttcttttagcccgggcctaccacgccatcgggctctgagaaccgcaccgattcagccccgggtatgggagccagtgcctttggaagaagtgcaacttgtagtggagcctgaaggcggtgctgttgcaccaggggggactgtgactctcacctgcgaagtgcctgcccagcctagccctcagattcattggatgaaggatggagtgcctctgccattgccgccgtcaccagtactgatccttccagagatcggtccgcaagaccagggcacgtattcctgcgtggctacccatagctcccacggcccccaggagtccagagccgtgtccatctcaataattgagcccggcgaggagggcccaacagccgggtctgtgggcgggagcgggcttggaacactggcactggccttgggcatactgggcggactgggtaccgctgccttgctcattggggtgattttatggcagcgtagacagcgtagaggagaagaacggaaagcacccgagaaccaggaagaagaggaggagcgagctgaactgaaccaatccgaagagccagaggccggagagagcagcacgggggggccatag

SEQ ID NO: 178476 - DNA, 1044 bp, Artificial Sequence
  Description of Artificial Sequence: Synthetic coding sequence
atggccgccggcaccgccgtgggcgcctgggtgctggtgctgagcttatggggcgcagttgtcggtgcccaaaacattacagcccgcataggagagcccttggtgttaaaatgtaaaggggcccctaagaagccaccccagagactggagtggaagctgaatactggccggacggaggcctggaaagttctgtccccccaggggggagggccgtgggatagtgtagcacgagttttgcccaacagcagcctgttccttcccgccgttggaattcaggacgaaggaatcttccgttgtcaagcaatgaacaggaatggcaaagagactaagtcaaactaccgagtacgggtgtaccagatcccaggtaagcctgagatagtcgactcagcatctgagctgacggctggggtgcccaacaaggtcggcacctgcgtgtccgaggggtcttatcctgcgggtactctctcctggcatttggatgggaaaccgttagtgcccaacgagaagggtgtgagcgtgaaggagcagacaagaagacacccagagactggcctatttactcttcaatctgagctgatggttacccctgctagagggggcgacccgagacccactttttcctgctctttttctccgggtttgcccaggcaccgggcactgcgcacagccccaattcagcctcgggtgtgggagccagtgcccttagaggaagtgcagcttgttgtggagcctgaaggcggagccgttgcccctggcggtactgttaccttgacatgcgaagtgccggcacagccatcgccccagatccactggatgaaggacggagtgccactgcccttgccaccatccccagtcctgattttgcctgaaattgggccacaagatcagggcacctactcttgtgtcgcgacgcactcttctcatggacctcaggagtctagagccgtctccatttctatcattgagccaggcgaggaaggccctaccgctggggagggctttgataaggtgcgcgaagctgaggacagcccacagcacatgtag

SEQ ID NO: 178477 - DNA, 702 bp, Artificial Sequence
  Description of Artificial Sequence: Synthetic coding sequence
atggccgccggcaccgccgtgggcgcctgggtgctggtgctgagcctctggggggccgtcgtgggcgcacagaacataaccgcccggataggcgagcctctggtgctcaaatgcaagggggcccctaagaagccaccgcagcgcctggagtggaaactaaatactggtaggactgaggcatggaaagtgctctccccacagggcggtggaccctgggacagtgtggctagagtgctgcccaacggttccctgttcctccccgctgtagggatccaggatgagggcatttttcgctgtcaagcaatgaaccggaatggtaaagagacaaaatctaactatcgcgtcagagtctatcaaatacccggaaagccggagatcgtcgattctgcctctgaactgacggcgggagtccctaataaagttgtagaggaatctcgccgatcacggaaaaggccgtgtgagcaggaagttggcacttgtgtgagtgaaggtagttaccccgcgggcacccttagttggcacttagatggaaagcccctcgttccaaatgaaaaaggggtctccgtcaaagaacagacgaggagacaccccgaaacaggtcttttcacgcttcagagcgagctgatggtaacgcctgccagggggggtgacccaagacctaccttttcgtgtagcttttctcccggcctcccgagacattag

SEQ ID NO: 178478 - DNA, 1044 bp, Artificial Sequence
  Description of Artificial Sequence: Synthetic coding sequence
atggccgccggcaccgccgtgggcgcctgggtgctggtgctgagcctgtggggcgccgtggtcggcgcccaaaacattacagcccgaattggagagcccttggttctcaagtgcaagggtgccccgaagaagcctcctcagagattggagtggaagctgaacacaggtaggacagaggcatggaaggtactctcaccccaaggagggggcccatgggattctgtagcacgcgtgctgcccaatggaagcctctttttaccagctgtgggcatccaagacgagggaatcttccggtgtcaggcaatgaacagaaatgggaaggaaacaaagagtaattaccgagttcgcgtttaccagattccaggcaagcctgagatcgtggatagtgctagtgaacttactgctggagtcccaaataaggtgggaacctgtgtgtctgagggatcataccctgctgggacccttagctggcatctcgatggaaagcctctagtccctaacgaaaagggtgtatctgttaaagagcaaacccgaaggcacccagagaccggactttttacgctgcagtccgaattgatggtgacccccgcaaggggcggagatccaaggcctacattctcgtgcagcttcagccctggcctaccacgccacagggccctgcggaccgcccccattcagccccgagtatgggaaccagtgcctcttgaggaagtacagttggttgtcgaaccagaagggggcgcagtggcccctggcgggaccgttactttgacctgtgaggtccctgcccagccctctcctcagattcattggatgaaagatggcgttccactgcctcttccaccatccccggtcctgatcctaccggagattgggccacaggatcagggaacttactcatgcgtggcaactcacagctctcacggaccacaagaaagtagggcggtttccatctctataatcgagcctggagaggaaggacctactgcaggcgagggattcgacaaggtgagggaagccgaggacagcccccagcatatgtag

SEQ ID NO: 178479 - DNA, 705 bp, Artificial Sequence
  Description of Artificial Sequence: Synthetic coding sequence
atggccgccggcaccgccgtgggcgcctgggtgctggtgctgagcttatggggggccgtagtcggtgctcagaacattactgcccgtattggggagccactagttctgaagtgtaaaggggcgcctaagaaacccccccagcgactggagtggaagctcaatacgggcaggaccgaggcctggaaggtgctaagtccgcagggcggtgggccctgggacagcgtcgcccgcgtactcccaaacggctcactcttcctgcccgccgtgggcattcaggacgaggggatattccgatgtcaggcaatgaacagaaacggaaaagagaccaagagcaactacagaagcctgaggacctttacaattaccgcttcggattggattttccccccaagcgagattcccggcaaaccagagattgtggattccgcctccgagttgactgctggcgtgccaaataaggttggaacatgcgtgtctgaaggcagctaccctgctggaaccctgtcatggcatttagacggaaagcctctggtacctaacgagaaaggcgtgtccgtgaaggagcaaactcggaggcaccccgaaaccggcctctttaccttacaaagcgaacttatggtcactcccgcgcgaggcggtgacccaaggccaacttttagttgctctttcagtcctgggctgccaagacaccgcgccctccgctag

SEQ ID NO: 178480 - DNA, 1215 bp, Artificial Sequence
  Description of Artificial Sequence: Synthetic coding sequence
atggccgccggcaccgccgtgggcgcctgggtgctggtgctgagcctttggggagctgtggtgggcgctcagaacattaccgccaggatcggtgagcccttggtattgaagtgcaagggtgccccgaaaaagccgccccagcgacttgaatggaagcttaatactgggagaactgaagcatggaaggtgctctctccacaagggggaggaccatgggattcagtggctcgtgtgctgccaaatgggagcctcttcttaccagccgtgggcatccaagacgagggaatctttagatgccaggccatgaacaggaatggtaaggagacgaagtcgaactatagggttagagtgtaccaaatcccgggaaaacctgagatcgtcgacagcgcctctgagttgacagccggcgttcccaacaaggtgggcacttgtgtgtctgagggcagctacccagctggcaccttaagctggcatcttgacggcaagccgctcgtgcccaatgaaaagggggtctctgtaaaggaacagaccagacggcaccccgaaaccggattatttactctgcaatccgaactcatggtgacgccagcccgagggggtgatccaagaccaactttttcatgctctttttccccaggtctcccccgccaccgcgccctcagaaccgcgccaatccaacccagagtgtgggaaccagtgcctctcgaggaagtacagcttgtggtggagccagaaggaggagccgtggcaccgggtggcacggtgactctgacatgcgaagttccagcgcaaccttcaccgcaaatacactggatgaaagacggggtgccactgccgctgccgcctagtcccgttttgatacttccagagatcggtccacaagatcagggtacttactcatgcgtggccacccattcaagtcacggacctcaagagtcacgcgcggtctccatctcaatcatcgagcccggagaggagggacccaccgccggctctgtgggcgggagcggcctgggcaccctggcgctggccttgggaattttgggcggcctgggcacagccgcattgctgattggtgtgatactgtggcagcggcgccagagaaggggtgaggaacggaaggccccagaaaatcaggaggaagaggaggagcgggccgaactgaatcagtcagaagagcctgaggcaggagagagctccacgggcggaccctag

SEQ ID NO: 178481 - DNA, 387 bp, Artificial Sequence
  Description of Artificial Sequence: Synthetic coding sequence
atggccgccggcaccgccgtgggcgcctgggtgctggtgctgagcttatggggggccgtggttggcgctcagaacattactgctaggatcggggaacccctggtgctgaaatgcaaaggcgccccaaagaagccaccccaacgtctggaatggaagcttaataccggacgaactgaagcatggaaagtcctctctccccaaggtgggggcccatgggacagcgtggcaagagtcttaccaaatggatccctgttcctccctgccgtcggcatccaggatgaaggaatattcagatgccaggccatgaaccgaaacggcaaagagactaagtcgaactatcgtgttagagtttaccagtttgaaaacctgcataactattcgctgtag

SEQ ID NO: 178482 - DNA, 462 bp, Artificial Sequence
  Description of Artificial Sequence: Synthetic coding sequence
atggccgccggcaccgccgtgggcgcctgggtgctggtgctgagcctttggggcgccgtcgtgggcgcacagaacataacagctaggataggagagccgttagtgctgaagtgcaagggggcccctaagaaaccaccccagcgccttgaatggaagttaaacaccggaaggaccgaggcttggaaggtactatcccctcaaggtggcggaccttgggactccgtagccagagttctgcccaacggaagtctgttcttgcccgccgttggcattcaggacgaagggattctagggggtttaggcaccgcagcactgctgatcggtgtaattttgtggcagagacgccaaagacgtggcgaggagaggaaggctcccgagaaccaggaagaggaagaagagcgagccgagctgaaccagtccgaggagcccgaggccggggagagctccaccggcggcccttag

SEQ ID NO: 178483 - DNA, 885 bp, Artificial Sequence
  Description of Artificial Sequence: Synthetic coding sequence
atgaaccggaacggcaaggagaccaagagcaactaccgggtgcgggtttaccagatcccagggaaaccggagatcgtcgattctgctagtgaacttactgctggcgtgcctaataaggtgggaacatgtgtctcagaaggttcctacccggcagggactctttcttggcacctagacgggaaacctctggtaccaaatgagaagggggtgtcagtgaaggagcagacccgccggcatcctgagactggtcttttcaccctacagtctgagctgatggtgactcccgcgcggggtggggaccctcggcccacatttagttgcagttttagcccagggctgccccgccaccgagcactgcgtaccgccccaatccagcctcgcgtctgggaacctgtgcctcttgaggaagttcaattggtagtagagcctgagggaggcgcagtggcccccggcgggacagtgactcttacatgtgaagtccccgcacagccttcgccacaaatccattggatgaaggatggcgtcccattgccacttcccccgagcccagtgctgattctgccagagatcgggcctcaggaccagggcacgtattcatgtgtcgccacccacagttcccatggacctcaagagtcacgcgcagtgtcgatttcgattataggcagcgtgggcggcagtggccttggcacacttgcccttgctttgggaatattgggcggcctgggcactgccgccctgctgattggggttattctgtggcagagaaggcagcggcgtggggaggagcgtaaggctcccgaaaatcaggaggaggaggaggagagagctgaactcaaccagagcgaggagcccgaggcaggcgagagcagcaccggaggcccctag

SEQ ID NO: 178484 - DNA, 885 bp, Artificial Sequence
  Description of Artificial Sequence: Synthetic coding sequence
atgaaccggaacggcaaggagaccaagagcaactaccgggtgcgggtttaccagatcccaggcaagccggagatcgtggatagcgcgtccgaattgactgctggcgtcccaaacaaggtcggtacatgcgtgtctgaggggtcttacccagccggtacactctcttggcatctcgatggcaagccgctagtgccaaacgagaaaggtgtaagtgtgaaagaacagacccggcggcaccctgaaactgggctatttacactgcagagcgagctgatggtgacgcccgctcgcggtggagaccctagacccaccttttcatgctccttctcccctggcctgcctcgccatcgcgctctgagaactgccccaattcaaccccgagtttgggagccagtgcccctggaggaggtgcagctcgtcgtggagcctgagggtggtgctgtagccccagggggtacggtgaccctgacctgtgaagtcccagcccagccatctccccagatccactggatgaaggacggggtaccacttcctctgccaccctcccctgtcctgattcttcccgagattggacctcaggatcagggaacctattcctgcgtcgccactcactcgtctcatggaccgcaagagtctcgcgcggtgtcaattagcatcataggatctgtcggcgggagcggactgggcaccctagctctggctctgggtatcctgggcggtctgggtaccgcagcactactcataggggtgatcctatggcagaggaggcagcggcgcggagaggagcgcaaggctcctgaaaaccaggaggaagaagaggaacgtgccgaactgaaccaaagcgaggaacccgaagcaggggagagttccacaggtgggccatag

SEQ ID NO: 178485 - DNA, 366 bp, Artificial Sequence
  Description of Artificial Sequence: Synthetic coding sequence
atggccgccggcaccgccgtgggcgcctgggtgctggtgctgagcttatggggagccgtcgtcggagcccagaatataaccgcacggataggagaacccctcgtgctgaagtgcaagggcgcgcccaagaagccccctcagcgcctggaatggaaactcaataccggccgcacagaggcctggaaggtgctgagcccccagggtggcggtccttgggacagcgtggcaagggtgctgcccaatggcagtcttttcctgccagcggtcggcattcaagacgaggggatctttaggtgtcaggcgatgaatcggaacgggaaggaaactaagagtaattggtggtggtcacagaaggtcgaacagtag

SEQ ID NO: 178486 - DNA, 1308 bp, Artificial Sequence
  Description of Artificial Sequence: Synthetic coding sequence
atgggcgccggcgagcgggtgcaggcccccccccgggccgaggccactgccgggcgtggcgccgaccgcgccagaactctagaagggtctcgcatggcagccggcacggccgtaggagcatgggtgctcgttttgagcctgtggggcgcagtggtaggggcgcagaacataactgcgagaattggggagccgctcgtgttgaaatgtaaaggggctcccaagaagccccctcagcggttggagtggaaactgaatacaggaagaaccgaagcatggaaggtcctgtcccctcaggggggcgggccgtgggactctgttgcgcgcgtgcttccaaatggctccctcttccttccggccgttggaatccaggacgagggtatcttcagatgccaggccatgaacaggaatggaaaggagactaaaagtaactatcgggtcagagtgtatcaaattcccggcaaacctgagatagtggacagcgcctctgagcttacagccggcgtgccgaataaggtgggtacttgtgttagcgagggaagctatcctgcagggacgctgtcctggcatttagacggcaaacctctggtccccaacgagaaaggcgtatctgtcaaggagcagactaggcgacatcccgaaacaggcctgttcacgcttcagtccgagttgatggttacacctgctcgaggcggagatccaagacctacattttcttgttcattctctcccggactgccacggcatagggctttacgtaccgccccaatccagcccagagtgtgggaacctgtcccacttgaagaagtacagttagtagtagagcctgaaggcggtgccgtagccccggggggcactgtgactttgacctgtgaggtcccagctcagccttccccccagatccactggatgaaggatggcgtgcccttgccgctgccccccagtcccgtgctcattcttccagagatcggcccacaggaccagggtacatactcttgcgtagctactcacagctcccatgggccacaggagtcaagagccgttagcatctccatcattgagcccggggaggaagggcccaccgctggcagcgtcgggggttcaggcttgggcactcttgccctggccttgggaatactgggaggtcttggtaccgcggctctgttaattggcgtgattctgtggcagcggcggcagagacgcggagaagagaggaaagccccagaaaaccaggaggaggaagaggagcgagctgaactgaaccagtcggaggagcccgaggcaggcgagtcctcaaccggcggaccttag

SEQ ID NO: 178487 - DNA, 1092 bp, Artificial Sequence
  Description of Artificial Sequence: Synthetic coding sequence
atggccgccggcaccgccgtgggcgcctgggtgctggtgctgagcctatggggagccgttgtgggtgctcagaatattactgccaggattggggagccattagtcctgaaatgcaagggcgcgccgaaaaaaccaccccagcgacttgagtggaagctgaacacagggcggacagaagcctggaaagtgttatctccccagggcggcggaccttgggattctgttgctcgagtgctccccaatggatctctgtttctccctgcggtggggattcaggatgagggaatcttccgctgccaggcaatgaacaggaatggcaaagagaccaagagtaactaccgggtgagagtctaccagatcccgggcaagccagagattgtggattcagcctcagagctcaccgctggggttccaaataaggtagtggaagagagccgcagatctaggaagcgcccctgcgagcaggaggtaggtacatgcgtgagcgaaggaagctaccccgccgggactctgagttggcatctcgatggaaagccattggtaccgaacgagaaaggagtttcagtgaaggagcaaactcgcagacatccagagacaggcctgtttactttgcagtccgagttgatggtcacccctgctcggggcggggacccccgaccaactttttcttgtagcttttcccccggactgccccgacatcgcgcgcttcggacagctcccatccagccccgggtatgggagcctgtccccctagaagaggtccaactggtggtcgagcctgagggaggcgcggttgcgccgggagggacagtgacactcacctgtgaagtccccgcccagccaagccctcagattcactggatgaaagatggcgttccactccctctgcccccttctcctgttcttatactgcctgagattggtccgcaagaccagggcacctatagttgcgtagcaacccattcctcccatgggccgcaggaaagcagggctgtatcaatctctatcatcgagcccggggaagaggggcccacagcaggcgagggcttcgataaagtccgagaggccgaagattcccctcagcatatgtag

SEQ ID NO: 178488 - DNA, 402 bp, Artificial Sequence
  Description of Artificial Sequence: Synthetic coding sequence
atgaaggacggcgtgcccctgcccctgccccccagccccgtgctgattctccctgagatcggcccacaggaccaaggcacctatagctgtgtcgctacccactcgagccatggacctcaggaaagcagggctgtctccatatctattatcgaacccggcgaagaagggccgacagctggctctgttgggggttcaggtctcggtactctggccctcgccttaggcattcttgggggtctcggcactgctgctctactaattggtgttatcctgtggcagcggagacaacgaagaggtgaagaaagaaaagctcccgaaaaccaggaagaggaagaggagagagcggaacttaatcagtctgaggagcctgaggctggtgaatccagtaccgggggcccttag

SEQ ID NO: 178489 - DNA, 387 bp, Artificial Sequence
  Description of Artificial Sequence: Synthetic coding sequence
atggccgccggcaccgccgtgggcgcctgggtgctggtgctgagcctttggggggcagttgttggagcccagaatatcacagccagaattggggagccgctggttctgaagtgtaaaggcgcgccaaagaaaccaccccaacgtctagaatggaaattaaacaccggccgcacagaggcatggaaggtgctcagtcctcaagggggcggaccttgggatagtgtggcacgcgtgctgccaaatagttccttattcttgcccgccgtgggaattcaggacgagggaatttttcggtgccaggccatgaaccgcaacggcaaggaaactaagtctaactaccgtgtcagagtgtaccagtttgaaaatctgcataactattcgctgtag

SEQ ID NO: 178490 - DNA, 462 bp, Artificial Sequence
  Description of Artificial Sequence: Synthetic coding sequence
atggccgccggcaccgccgtgggcgcctgggtgctggtgctgagcctgtggggagcagtggtaggggcacagaacatcaccgcacgcatcggtgagcccttggtactcaagtgtaagggcgcgcctaaaaagccccctcagcgcctggagtggaaactgaacactggcaggacagaagcttggaaagtcctaagccctcagggagggggaccatgggatagtgttgcccgagttctgcccaatggaagtctgttcctcccagctgtcggcatccaggacgagggtatcctgggcggattgggtactgcagccctcctgatcggggtaattctgtggcagaggagacaacggagaggggaagagagaaaagctccggagaatcaggaagaggaggaagagcgagccgagttgaaccagtccgaggaacccgaggcaggtgagtccagtaccggcggtccttag

SEQ ID NO: 178491 - DNA, 1308 bp, Artificial Sequence
  Description of Artificial Sequence: Synthetic coding sequence
atgggcgccggcgagcgggtgcaggcccccccccgggccgaggccaccgctggacgcggggccgatagggcacgaactctggaagggtcacgcatggcagccgggaccgccgttggcgcctgggtgctggtattaagcctgtggggggccgtagtgggcgcccagaatataacggccagaattggcgaacccctggtcctgaaatgcaaaggagcccccaagaaacctccgcaaagactggaatggaaattgaatacgggccgaaccgaggcgtggaaagtgctatctccccaggggggcgggccatgggactccgtagcccgcgttcttcctaacggatcattgtttctgcccgcggtggggattcaggacgagggaatctttcggtgccaggccatgaaccggaatggcaaagagacaaaatccaactacagagtgcgcgtctatcagattcctggaaaaccagaaatcgtggattccgcgtcagaacttactgctggtgtgcctaacaaagttggaacatgtgtgagcgaaggttcttatccagcgggtactttaagttggcatctggatgggaagccattagtgccaaacgaaaagggcgtgtctgtgaaggaacagacacggagacaccccgagacgggcttatttacccttcagtccgagctgatggtgacaccggccagaggaggcgatcctagacctaccttctcatgttcattctctccaggccttcctcgacatagagctttgagaactgcccccattcaaccgagagtgtgggaaccggttcccctagaggaagtgcagctggttgtggaacctgaaggaggagccgttgccccaggggggaccgtcaccctgacatgtgaggtccccgcccaaccatccccccaaatccattggatgaaagatggagtcccattaccattacccccttcccccgtcttaatcctgccagagatcggcccacaggaccagggtacatacagttgcgtggctacccactcatcccacggcccccaagagtcccgcgcagtcagtatctccataatcgagcctggcgaggaaggaccgacagcgggttcagttggggggtcgggactgggcacactcgctctagctctcggcatcctgggagggctggggacagccgccctcttaatcggagttattctctggcaaaggagacaacgaaggggcgaagagaggaaagccccagagaaccaggaggaggaagaggagcgagccgaactgaaccagtccgaagagcccgaggctggggaaagcagcactggtgggccatag

SEQ ID NO: 178492 - DNA, 366 bp, Artificial Sequence
  Description of Artificial Sequence: Synthetic coding sequence
atggccgccggcaccgccgtgggcgcctgggtgctggtgctgagcttatggggggctgtggtgggggcccaaaatattaccgcgaggatcggggagcctctggtccttaagtgcaaaggggcgccaaagaaaccacctcagagattggagtggaaactcaatacaggacggacagaagcatggaaagtgctaagcccacaggggggaggcccttgggattcagttgcacgcgtattgcccaatggaagtctgtttttgccggccgtgggaatacaggatgaaggaatttttaggtgccaggctatgaacagaaatggcaaggaaactaaatctaattggtggtggagtcagaaagtagaacagtag

SEQ ID NO: 178493 - DNA, 387 bp, Artificial Sequence
  Description of Artificial Sequence: Synthetic coding sequence
atggccgccggcaccgccgtgggcgcctgggtgctggtgctgagcttgtggggggccgtggtaggcgcccagaacatcaccgccaggattggggagccactcgtgctgaagtgtaaaggcgcaccgaagaagcctccccaacggctcgaatggaaattgaatacaggacggacagaggcttggaaagtgctctctccccagggcggcggtccatgggattcggtggctcgggtgctgcctaatggaagcctctttctgccagcagtgggtatccaggatgaagggattttcagatgtcaggctatgaaccgcaatgggaaggagactaaatccaactatagggtcagggtgtaccaattcgagaacctgcataactactccctgtag

SEQ ID NO: 178494 - DNA, 885 bp, Artificial Sequence
  Description of Artificial Sequence: Synthetic coding sequence
atgaaccggaacggcaaggagaccaagagcaactaccgggtgcgggtgtatcaaattcctggcaagcctgagatagtggactccgcttccgagctgaccgccggagtgcccaacaaggttggcacatgtgtgagcgagggaagttatcctgcaggaaccttgagttggcacctggacggtaaaccgctagtccctaatgagaaaggagtcagtgtcaaagagcagacaagacgtcatcccgagactgggctgtttactctgcagtcagaattaatggtgacacccgcccggggcggggacccacgccctacattctcatgctccttttcccctggactgccgcggcatagggccctgagaaccgcacctattcagcctcgcgtctgggagccagtgcctcttgaggaggtccagctggtggtggagcccgaaggtggggcagtcgctcccggagggactgtcactctgacctgcgaggtgcctgctcaacctagccctcaaatccactggatgaaagatggtgtgcctctgccactcccacccagtcctgtgctaatactccccgagatcggcccgcaggatcagggaacttactcctgtgtggccacacacagctcccatggacctcaggaatcgcgcgccgtgagcattagcatcatcgggtccgtggggggttccggcttaggaacgctcgctcttgctctcgggatactaggcggactggggacagccgcacttcttatcggggtcattctctggcagagaaggcagcgacgcggcgaggagagaaaagcgcccgagaaccaggaggaagaggaagagagagctgagctgaatcaaagcgaagaaccagaggccggggagtcatcaacggggggcccgtag

SEQ ID NO: 178495 - DNA, 366 bp, Artificial Sequence
  Description of Artificial Sequence: Synthetic coding sequence
atggccgccggcaccgccgtgggcgcctgggtgctggtgctgagcctatggggtgcagtagtaggcgcccagaatatcacagcccgcattggggaaccgctggtgttgaaatgcaagggggcacctaagaaacccccccagcgactggaatggaagctaaacactggacggaccgaagcttggaaggttcttagcccacaaggaggaggtccatgggactccgtggcccgggttcttcccaattcttccctcttcttgcccgcagtcggcatccaagacgagggaatctttaggtgtcaagccatgaaccgtaatggaaaagaaactaaatcaaattggtggtggagccagaaggtggaacagtag

SEQ ID NO: 178496 - DNA, 462 bp, Artificial Sequence
  Description of Artificial Sequence: Synthetic coding sequence
atggccgccggcaccgccgtgggcgcctgggtgctggtgctgagcctctggggcgcagtggttggtgctcagaacataaccgcccgaatcggggagccactcgtgcttaaatgcaagggtgctcccaagaaacctccacaaaggctggaatggaaacttaacacaggaagaaccgaggcctggaaggtcctgagcccacaagggggaggtccctgggactctgtcgcaagggttttgccgaacggatcgctgtttttacccgccgtgggtatccaagatgagggtatactggggggactgggaaccgcggccttgctgataggcgtgatattgtggcagagacgtcaacgtagaggcgaggagagaaaggcccccgagaatcaagaagaagaggaggagcgggcagaactgaaccagtcagaagagcctgaagccggagaaagcagtaccggaggtccttag

SEQ ID NO: 178497 - DNA, 1308 bp, Artificial Sequence
  Description of Artificial Sequence: Synthetic coding sequence
atgggcgccggcgagcgggtgcaggcccccccccgggccgaggccaccgcaggacgtggggctgatagggctcgaactctggaaggatcaaggatggcagccgggactgccgtgggcgcatgggttctcgtactttcactgtggggggccgtagtgggcgcccagaatatcacagcccgcataggggagcccctggttctaaaatgtaagggggcaccaaaaaagccacctcagagactcgaatggaagttgaataccggacggaccgaggcttggaaggtgctgtcgccccagggcggagggccatgggacagtgtagcccgcgtgctaccaaacgggtccctgttcctgcctgccgttgggatacaggatgagggcatcttcaggtgtcaagcaatgaataggaacggaaaagagactaaatcaaactacagggtcagagtctaccagattcctggcaaacccgagatcgtggactcggcaagcgagctcacggccggggtgcccaacaaggtgggcacgtgtgtgagtgagggaagctatccagccggaacactcagctggcacctagacggcaagcctcttgttccgaacgaaaagggagtgtcagtaaaagaacagactcgccgccaccccgaaaccgggctgtttactttgcagtcggagttgatggttacaccagcgaggggcggagatcctcgccccacatttagttgcagcttctccccaggcctccctcgccacagagccttgagaaccgctcccatccagcctagggtgtgggaaccagtcccactggaagaggtccagctggtggtggaacccgagggcggcgcagtggcacctggtggcacagtgacgcttacttgcgaagtgcccgcacagccgtctccacagattcactggatgaaggacggtgtgcctttgccactgccacccagcccagtgctaattttaccagaaatcggtccacaggatcagggtacctacagctgcgtggccacccactcatcccacggcccccaagaaagtcgcgctgtgtccattagtattattgaacctggcgaggaaggcccaacagccggttccgtgggcggatcaggcctaggcaccttagccctagccctgggaattttgggaggcttgggaacagccgcgttgctgataggcgtgatcctgtggcagagaagacagcgccgaggggaggaacgaaaggcacctgaaaaccaagaggaagaagaggagagggcagaattaaatcagtcagaggaacccgaggctggcgaatcttcaaccggcggcccttag

SEQ ID NO: 178498 - DNA, 366 bp, Artificial Sequence
  Description of Artificial Sequence: Synthetic coding sequence
atggccgccggcaccgccgtgggcgcctgggtgctggtgctgagcctgtggggtgcagtggtgggcgcccagaacataacagctcgaattggcgaaccacttgtcctgaaatgcaagggtgcccccaagaaacccccccagagacttgagtggaaactaaacaccggcaggactgaagcttggaaggtgctttccccccaggggggaggaccttgggactcagtggcccgtgtactcccaaatggctcactgtttctgccagccgtcggcatacaggacgagggcatttttaggtgtcaagctatgaataggaacggcaaggaaacaaagagcaattggtggtggagtcaaaaggtggaacagtag

SEQ ID NO: 178499 - DNA, 402 bp, Artificial Sequence
  Description of Artificial Sequence: Synthetic coding sequence
atgaaggacggcgtgcccctgcccctgccccccagccccgtgctgatcctgccagagatcggcccccaagaccaagggacttattcttgcgttgccacacatagttctcacggaccacaagaaagcagggctgtaagtatttccatcattgaaccaggggaagagggtccgacagcgggaagcgtgggcggcagtggactcgggactctcgccttggccctgggaattctggggggcctgggcacggccgcactactgataggagtgattctgtggcagcgaaggcagaggaggggcgaggaaaggaaggctcccgaaaatcaagaagaggaagaagagcgggctgagctgaatcagagtgaggagcccgaggcgggcgaatcctctactggaggtccatag

SEQ ID NO: 178500 - DNA, 885 bp, Artificial Sequence
  Description of Artificial Sequence: Synthetic coding sequence
atgaaccggaacggcaaggagaccaagagcaactaccgggtgcgggtctatcagatcccaggcaagccagaaatcgtagatagcgcctctgagctgactgcaggcgttcccaataaagtgggcacttgcgtgagcgagggaagctatcccgcaggcactctgtcatggcatctggatggcaaaccacttgtaccaaacgaaaagggggtctctgtcaaagagcaaacacgacgacatccagagaccggcctctttaccctgcagagcgaactgatggtgacacctgctcgcggaggtgacccacgaccaaccttcagttgctctttttcgcctgggctgcccaggcatcgcgcgttaaggaccgcccctatccagcccagagtgtgggagcctgtcccactcgaggaagtgcagcttgtcgtcgaaccagaggggggcgcagttgcccctggtggcaccgttacccttacatgtgaggtccctgcacagccctctccccaaattcattggatgaaagatggagtcccattacctctgccaccatcccctgtgctgatactgccagagatcggccctcaagatcagggcacgtattcctgtgtcgcaacccattcttctcatggcccccaggagtctagggccgtgtcaatctctattatcggcagcgtagggggtagcggcttggggacgctcgctctcgctcttggtatcttagggggattgggaaccgccgcactattgattggcgtgatactatggcagaggagacagcggaggggcgaagaaagaaaggctccagagaaccaggaagaagaggaagaaagggctgaactgaaccagtccgaggaacccgaagcgggagaaagtagcaccggcgggccttag

SEQ ID NO: 178501 - DNA, 402 bp, Artificial Sequence
  Description of Artificial Sequence: Synthetic coding sequence
atgaaggacggcgtgcccctgcccctgccccccagccccgtgctgattttaccagagatcggccctcaggatcagggcacatatagttgcgtcgctacccacagttcccatggcccccaggagtcacgtgccgttagcatatcaattatcgagcccggtgaggagggccccacagctggctccgttggaggttctgggcttggcaccctggctctggcgctcggcattctgggcggcctcggcacagccgccttgctcattggcgtgattctgtggcaaagaagacagcgtcgaggggaggaacgaaaagcacccgaaaaccaggaggaggaggaggagagagccgagctgaatcagagcgaggaacccgaggcaggggagtctagcacaggtgggccatag

SEQ ID NO: 178502 - DNA, 1092 bp, Artificial Sequence
  Description of Artificial Sequence: Synthetic coding sequence
atggccgccggcaccgccgtgggcgcctgggtgctggtgctgagcctgtggggcgcagtcgttggtgctcagaacatcacggcaaggattggggagcctttggtcctcaaatgtaagggtgccccgaagaaaccgccccagagactggagtggaagctcaatacggggagaacagaagcttggaaggtcctgagccctcaaggtgggggcccctgggacagcgttgcccgggtgttgccaaacggaagtctgttccttccagcagtggggattcaagatgagggaatcttcaggtgtcaggctatgaatagaaacggaaaagagaccaagagtaattaccgggtgagagtttaccaaattcctggcaaaccagagatcgtggatagcgcctcagaacttaccgccggagtgcccaacaaagtggtggaggagtccagaaggtcccgcaagagaccttgcgaacaggaggtgggcacatgcgtgagcgaaggaagttatccagccgggaccttgagttggcacctcgatgggaagccactcgtgcctaacgagaagggtgtatctgttaaggagcagacgcgacggcacccggagaccgggctgtttactctgcagtccgagctgatggtaactccagctcggggaggtgacccgaggccaaccttttcttgcagtttttctcctggtcttccacggcaccgcgccttacgcacagctcctattcagcctcgagtttgggagcctgtacctctcgaggaggttcagctcgtggttgagccggaggggggcgccgtggcacccggtggcaccgtgaccctcacttgcgaggtgcccgcccagcctagcccgcagattcactggatgaaagacggggtacctctcccactaccaccatcacctgtattgatcctacccgagatcgggccacaggaccaaggtacatatagctgcgtggcgacccacagtagccacgggccgcaagagtcacgggctgtgtcgatctcgattatagagcccggggaggagggccctacagccggtgagggcttcgacaaggttcgggaggctgaggactcaccccaacacatgtag

SEQ ID NO: 178503 - DNA, 1308 bp, Artificial Sequence
  Description of Artificial Sequence: Synthetic coding sequence
atgggcgccggcgagcgggtgcaggcccccccccgggccgaggccacggcgggccgaggtgcagatcgcgcacgaaccctcgaaggttcccgaatggccgcaggtaccgctgtgggagcctgggtcttggtcttatccctctggggtgcagtggtcggtgcccagaacataaccgcgcgcattggtgagcccctagtgctgaagtgtaagggcgcaccaaagaaacctcctcagagactggagtggaaactgaacactggcaggaccgaggcctggaaagtgctcagcccccagggaggcggcccgtgggattccgttgccagggtgttgccaaactccagtcttttcctccccgccgtgggtatccaagacgagggcattttccgatgtcaggctatgaatcggaatggcaaggagactaagtctaattaccgagttcgcgtgtaccagatcccaggcaaacccgagatcgtggactccgccagcgagctgaccgccggagtgcctaacaaagtaggaacatgcgtgtcagaaggcagctacccggccggcacgctgtcatggcatctggatgggaagcccttggtgcctaatgaaaaaggagtctccgttaaagagcaaacccgaagacaccccgaaaccgggctgtttacgctgcagtccgagctgatggttactccagcaagagggggagatccgaggccgacatttagctgcagcttttcacctggtttgcccagacaccgcgccctgcgaactgccccaattcaaccccgcgtgtgggagccagtccccctggaggaagtgcagctggttgtcgagcctgagggaggagccgttgccccaggcgggaccgttaccctgacatgtgaggtacccgctcagccgtcccctcagatccattggatgaaagatggagtgcctctcccactgcctccctctccagtgcttatccttcctgagatcggcccccaggatcagggtacatattcttgcgtcgccacccacagtagtcacggaccccaggaaagtcgcgccgtttctattagcattatagaacctggtgaggaaggacctacagccggaagcgtcggggggtctgggctggggacactcgcattagcactgggaatactgggcggactgggaacggccgcacttctcatcggtgtcattttgtggcaacgtcgccaacggagaggggaagagcgcaaagcacccgagaatcaagaagaagaggaagagcgagctgaactgaatcagtcagaagaacccgaggcaggtgagtcaagcaccggggggccttag

SEQ ID NO: 178504 - DNA, 387 bp, Artificial Sequence
  Description of Artificial Sequence: Synthetic coding sequence
atggccgccggcaccgccgtgggcgcctgggtgctggtgctgagcctgtggggagcagtcgtaggcgcccagaatataaccgccaggatcggcgaacctctggttctcaagtgtaaaggcgctccaaagaagccgccgcaaagattggagtggaaactcaataccggtcggacagaagcttggaaagtcctctccccacagggcggaggcccatgggattctgtagctagggttctgcccaatggaagtctgtttctgccagcggtggggatacaagatgagggaatctttaggtgccaggccatgaacagaaatggcaaggagaccaagagcaattaccgcgtgcgagtctatcagttcgagaatctgcataactattccctctag

SEQ ID NO: 178505 - DNA, 462 bp, Artificial Sequence
  Description of Artificial Sequence: Synthetic coding sequence
atggccgccggcaccgccgtgggcgcctgggtgctggtgctgagcctgtggggcgcagtggttggagctcaaaacatcactgccagaattggggaacctcttgtactaaaatgcaaaggcgcgcctaagaagccaccccaacgcctggagtggaaactcaatacaggccgcaccgaggcctggaaggttctcagccctcagggaggtggcccgtgggacagtgtggcaagggtcctgcccaacggatcattgtttctgcctgccgtcgggattcaagacgagggaatattgggtgggcttggaactgccgccttattgattggggtcattctatggcaacgcagacaacgtagaggagaggagcgaaaggctccggaaaatcaagaggaagaggaggagagagcggagctcaatcaatccgaagaacccgaagctggggaatcttctacgggtggaccctag

SEQ ID NO: 178506 - DNA, 1092 bp, Artificial Sequence
  Description of Artificial Sequence: Synthetic coding sequence
atggccgccggcaccgccgtgggcgcctgggtgctggtgctgagcttatggggcgccgtggtgggcgcacagaacataactgcacggatcggggagcctcttgtgctgaagtgtaagggcgcccctaaaaaaccaccgcagcgcttggaatggaagctgaacacgggccgaacagaagcctggaaggtgctgtccccccaagggggagggccttgggatagcgttgctcgagtgttgcccaacggctccctcttcctgccggccgtgggtattcaggatgagggtatattcagatgtcaggcaatgaacagaaatgggaaagaaaccaaatcaaactaccgcgtgagggtctatcagatacccgggaaacctgagatcgtcgattctgcctccgagttgaccgcgggtgtgccaaataaggtggtcgaggagagccgcaggtcacgaaaaagaccctgcgaacaggaagtcgggacctgtgtctctgagggatcttaccccgccgggacactgagttggcatcttgatggcaagcccttggttcctaacgagaagggggtttctgtaaaggagcaaacccgtaggcaccctgagaccggcctgttcacactgcaaagcgagttaatggtaacaccagctcgggggggagacccacgtccaactttcagttgttcattttcacccgggttacctcgtcatcgcgccctcaggaccgctcccatccagcctcgcgtctgggagccagtccccctggaggaggtgcagctagtagtcgagccggaggggggcgcagtggccccaggggggaccgttactctgacatgtgaagtcccagctcaaccctcgcctcagatacattggatgaaagatggtgtcccattgcctctccctccctcccccgtgctgatactgcccgagattggcccccaagatcaggggacctattcctgtgtggctacccattcaagtcacgggccccaagagtcccgggcggtcagcatatcaattatagagcccggcgaagaggggcccactgccggcgagggatttgataaggtgcgggaggccgaagattcacctcagcacatgtag

SEQ ID NO: 178507 - DNA, 366 bp, Artificial Sequence
  Description of Artificial Sequence: Synthetic coding sequence
atggccgccggcaccgccgtgggcgcctgggtgctggtgctgagcttgtggggcgctgtcgtgggggcgcaaaatataacagctcggattggtgagcccttggtgctgaagtgcaagggcgcacccaagaaacctccacagcggctagagtggaagctcaacactggccggacagaggcttggaaggtactttctccacaaggcggaggtccttgggattccgttgcaagggtgttgcctaacggtagtttatttctccctgcagtgggcatccaagacgaggggattttcaggtgccaggctatgaaccggaacgggaaggagacgaagtctaattggtggtggagccagaaagtggagcagtag

SEQ ID NO: 178508 - DNA, 402 bp, Artificial Sequence
  Description of Artificial Sequence: Synthetic coding sequence
atgaaggacggcgtgcccctgcccctgccccccagccccgtgctgatcctgcctgagatagggccccaggatcagggcacttatagttgcgtcgcaacacacagctcccatggcccacaggaaagtcgggcggtgtctatttctattatagagccaggcgaggaggggccaacggctggctctgtgggggggtccggactgggcacccttgctctggctctcggcatcctcggcgggctgggaaccgctgccttgctgattggtgttatcctttggcagaggagacaaaggcggggcgaagaacggaaggctcccgagaaccaagaggaggaggaagagagggcagaactcaatcaatctgaggaacctgaggcaggggagtccagtacaggtggcccttag

SEQ ID NO: 178509 - DNA, 387 bp, Artificial Sequence
  Description of Artificial Sequence: Synthetic coding sequence
atggccgccggcaccgccgtgggcgcctgggtgctggtgctgagcctgtggggagcagtggtgggcgctcagaacatcacagcacgcattggcgagccactcgtgttaaagtgcaagggggcacccaagaagccgccgcagcgtcttgagtggaagctcaacactggacgtacggaagcctggaaggtcctgagtccacagggaggtggcccatgggactctgtcgcgcgagtcctccccaacggttccctgtttctgcctgccgtaggaatacaggatgaagggatatttagatgtcaggctatgaatagaaacgggaaagagactaagagtaattatagagtgcgggtgtatcagttcgagaatttacataactactccctgtag

SEQ ID NO: 178510 - DNA, 1092 bp, Artificial Sequence
  Description of Artificial Sequence: Synthetic coding sequence
atggccgccggcaccgccgtgggcgcctgggtgctggtgctgagcttgtggggcgccgtggtgggtgctcagaatatcaccgccagaataggggagcctttagtgctgaaatgcaaaggagcaccaaaaaagccaccacagcgcctggagtggaaacttaacactgggcgcacggaggcttggaaggtcctgtctccccagggggggggaccttgggactccgtggctagggtactgcccaatggcagcttatttctccccgctgtgggcattcaagacgaaggaatatttaggtgtcaagctatgaaccgcaatggtaaggaaacaaagtcaaattaccgtgtacgcgtctatcagattcctggcaagcctgagattgttgactccgcctcggaactaacagccggcgtgccgaataaagttgtcgaggagtcaaggagaagcaggaaacgcccctgtgagcaggaggtcggtacctgcgtttccgaaggaagctacccagccggaacactatcttggcatctcgacgggaagcctctggtgcccaatgaaaaaggagtcagcgtcaaggaacaaaccagacggcatcccgagacgggcctattcactctgcagtccgaacttatggtgactccggcgcgcggcggcgatccacggcctactttttcttgttcttttagccccggtctcccacgtcatcgagctctgcggacagctccaattcaaccgagagtctgggaaccagttcccctggaggaagttcagctcgtcgtggaaccagaaggcggcgctgtggcacctggcggcactgtgacgttgacctgcgaggtgcccgctcagccaagccctcagatccactggatgaaagatggcgtacctttgcctctcccaccttcccctgtgctcattctgccagagatcggcccccaagaccagggaacatattcttgcgtggctacgcatagttctcatggcccccaggagagcagagctgtctccatctccataattgagccgggcgaggagggccccacggctggagagggcttcgacaaggtgcgcgaggctgaggatagtccccagcacatgtag

SEQ ID NO: 178511 - DNA, 1308 bp, Artificial Sequence
  Description of Artificial Sequence: Synthetic coding sequence
atgggcgccggcgagcgggtgcaggcccccccccgggccgaggccaccgctgggagaggtgcagatcgggcccggacactggaaggctctcgcatggcagccgggaccgcggtgggggcttgggtcctggtgctcagtctctggggcgcagtggtgggagcacagaacattactgctcgtattggagagcccttagtcttaaagtgcaagggcgcgcccaagaagccgccccagaggctggagtggaagcttaatacgggacgcacagaggcttggaaagtgctcagcccacaggggggcgggccatgggactctgtggcccgggttctcccaaacggaagtttattcttgccggccgttggaatacaagacgagggcatttttcggtgtcaggcaatgaacagaaacgggaaggagacaaagtccaattacagggtacgcgtgtaccagattcccggcaagccagaaatcgtagattcagcctcagaactcacagcgggagtccccaataaggttgggacttgcgttagtgagggatcctaccctgccggcacgttgtcctggcatctagacgggaaaccgcttgtgcccaacgagaagggagtgtcagtcaaggagcagactcgccggcaccccgaaacaggtctgtttacactgcaaagcgaactgatggtgacaccagcccgcggcggtgacccccgacccacattcagttgttccttttctccaggccttccacgtcaccgcgccctgagaacagcccccatccagcccagggtttgggaacctgtgccactcgaagaggtgcagctggtcgtggaacctgagggaggtgccgtggcccccggcggaacagtcacactcacctgtgaagtccccgcacagccctctccccagatccattggatgaaggacggagtccccctgccactccccccctctccagttttaattcttcccgaaattggtccacaggaccaagggacatacagttgtgtggccactcattcaagtcatggacctcaagagagccgggcggtaagcattagcatcatagagccgggcgaagaggggcctaccgctggatctgttggagggagtggcctgggtacccttgctctggccctgggtatcctgggcggattaggcaccgccgcgctgttgattggggtgatcctgtggcagaggagacagagaaggggggaggagcggaaggccccagaaaaccaggaagaagaggaggagcgcgctgagctgaaccagtcggaagagcctgaagctggagagagcagcacagggggcccctag

SEQ ID NO: 178512 - DNA, 462 bp, Artificial Sequence
  Description of Artificial Sequence: Synthetic coding sequence
atggccgccggcaccgccgtgggcgcctgggtgctggtgctgagcctgtggggtgcagtggtcggcgcccagaatatcaccgcacgcatcggagagccactcgtcttgaaatgcaagggcgcaccaaaaaaacccccccagagactggagtggaaactcaacacaggacggacggaagcatggaaggtgttgtcaccacagggaggcggtccctgggatagcgttgctcgcgtgctgcctaacagttcactgttcttacctgcagtggggatccaggatgagggcattctcggtggactcggaaccgccgcgctcttgattggcgtgattctgtggcagagacgtcagcgacggggcgaggagcggaaggcgcctgaaaaccaagaagaggaagaggaaagggcagaattaaaccagagtgaggagccagaagcaggtgagtcgtccaccggaggaccttag

SEQ ID NO: 178513 - DNA, 402 bp, Artificial Sequence
  Description of Artificial Sequence: Synthetic coding sequence
atgaaggacggcgtgcccctgcccctgccccccagccccgtgctgatccttcctgagataggacctcaggatcagggtacatacagttgcgtagcaacccacagctcacatggtcctcaggagtcccgagccgtgtctatatccatcatagaacctggggaggaagggcctaccgccggttccgtagggggcagcggccttggaacgctggccttagccctcggtattctgggcgggctcgggaccgcagcccttctgatcggagtaattctgtggcagcgacgacagagaaggggggaagagcggaaggcacccgaaaatcaagaagaggaagaggagagagctgagctgaaccaaagtgaggaacccgaagctggcgaaagtagtaccgggggcccttag

SEQ ID NO: 178514 - DNA, 885 bp, Artificial Sequence
  Description of Artificial Sequence: Synthetic coding sequence
atgaaccggaacggcaaggagaccaagagcaactaccgggtgcgggtgtatcaaattccaggaaagcccgagatcgtagactcagcgtccgagctgactgcaggagtgccgaacaaggtggggacgtgcgtcagcgaaggcagctaccctgcaggcactctttcgtggcatctggatggcaagccccttgtgcccaatgagaagggcgtgtccgtgaaggagcaaactcggagacaccctgaaaccggtctgtttacattacagagcgaactaatggtaacacctgcacgggggggcgacccaaggcctaccttctcatgcagcttctcaccagggctacccaggcaccgggctcttaggactgctccaatccaacctcgcgtctgggagccagtgccactcgaagaagtgcagctcgtggtcgagcctgagggcggcgccgtcgcacccggagggactgtgacactcacatgtgaggtccccgcgcagccatctcctcagattcactggatgaaagatggcgttccattacccctgcccccgagtccggtgctaattttgcctgaaatcggcccccaggaccaggggacatacagttgtgtggccacccacagttcgcacggacctcaggagagccgagccgtgagcatcagcattattgggagcgtcggaggatccggtcttggcactctcgccctggcgcttgggattctgggaggcctgggcactgccgctctgctgataggcgtcatcctctggcagagaagacagcgccggggcgaggaaagaaaagcaccagagaaccaggaggaggaggaagagcgggcagagctgaatcagagtgaagagcccgaggctggggagagcagcaccgggggcccatag

SEQ ID NO: 178515 - DNA, 1092 bp, Artificial Sequence
  Description of Artificial Sequence: Synthetic coding sequence
atggccgccggcaccgccgtgggcgcctgggtgctggtgctgagcctctggggggccgtagtaggagcgcagaacattaccgccagaataggagagccgttagtgctgaagtgcaagggagcacccaagaagccacctcagaggctagagtggaagctgaacactggccgcacagaggcgtggaaagttttatcaccccaggggggaggcccctgggacagtgtcgcgagggtgctgcctaatagcagcctgtttctgccagccgtgggcattcaggatgaggggattttccgatgccaggcaatgaaccgcaacgggaaagagacaaaaagcaattatcgagtgagagtttaccagattccggggaagcctgagattgtcgactcagcttctgaattgacagccggagttcctaacaaagtggtggaagaatcaagacggagtcggaaacggccttgtgaacaggaagtcgggacctgtgtgtcagaaggatcttacccagccggcactttgagctggcatttagatggcaaacctctggtgccgaacgaaaaaggggtttctgttaaagaacagacacgaagacacccggagacaggtctgtttaccctgcagagtgaactgatggtaacacctgctagggggggagatcccaggccaacgttctcatgttccttttcgccaggtttaccacgacaccgagcgttaagaacggcacctattcagccgcgggtctgggaaccagtccccctggaagaggtccaactcgtggtggagcccgaaggtggtgcagtagcacccggcgggacggtgaccctgacatgtgaagtgccagcccaaccgtctcctcagatccattggatgaaggacggcgttcccctgcctttgccacccagccccgtactcattctgcctgaaatagggccccaggaccagggcacctattcgtgtgtggcgacacactctagccacggcccacaggaatccagagcagtgagcatttccattattgagcccggtgaagaaggacctacggcaggtgaggggtttgataaggtgagagaagccgaggactcccctcagcacatgtag

SEQ ID NO: 178516 - DNA, 462 bp, Artificial Sequence
  Description of Artificial Sequence: Synthetic coding sequence
atggccgccggcaccgccgtgggcgcctgggtgctggtgctgagcctgtggggagcggtggtgggcgcccagaacatcaccgcaagaatcggagagccactggtgcttaagtgcaaaggggcacctaagaagcccccccagcgtctggaatggaagctgaacaccggaagaactgaagcctggaaagtcttatccccccagggcggcggcccctgggattcagtcgcaagagtcttacctaacggatccttgtttctgccggcagtgggtattcaggacgaaggtattctggggggcctgggaaccgcggcccttttgatcggcgttatcttgtggcagagaagacagcggaggggggaggagcgcaaagctcctgagaaccaagaggaagaagaggaacgcgccgagctgaatcagtccgaagaacccgaagcaggggagtcttccacaggcggaccctag

SEQ ID NO: 178517 - DNA, 387 bp, Artificial Sequence
  Description of Artificial Sequence: Synthetic coding sequence
atggccgccggcaccgccgtgggcgcctgggtgctggtgctgagcctgtggggagccgttgtgggagcccagaatataaccgctcgcattggcgagcccctcgtgctgaaatgtaaaggtgcaccaaagaagcctccacaacggctggaatggaagctcaatacgggacgaactgaagcttggaaggtactgagtcctcaagggggagggccatgggatagcgttgcacgcgtccttcccaacgggagcctgtttctgcccgccgtaggaatccaggatgaagggatttttagatgccaggccatgaaccggaacggtaaggagaccaaaagtaactatcgagtgcgtgtgtaccagtttgagaatctccataattactccctgtag

SEQ ID NO: 178518 - DNA, 2460 bp, Artificial Sequence
  Description of Artificial Sequence: Synthetic coding sequence
atgcccctgaccagcgccttccgggccgtggacaacgaccccggcataatagtgtggcgcatcgagaagatggaacttgctcttgtgcctgtgtcagcacacgggaacttctacgaaggcgactgctacgttatcttatccacccgacgggtagcctccctgctgagccaggacatccacttttggatcggcaaggattcttcccaggacgaacaatcctgcgccgctatctatacgacacagctcgatgactatcttgggggaagtcctgtgcagcatagggaggttcagtaccatgagagtgatacttttcgtggttatttcaagcaaggcatcatctataagcaggggggggtggcttctggaatgaaacatgtggagacaaatacctatgacgtcaagaggttgctacacgtcaagggaaagaggaatatcagggctaccgaagtggaaatgagttgggattccttcaatcgcggcgatgtcttcctgctggacctcggtaaggttattatccagtggaacggtcctgaatctaacagcggagagcgtctcaaggcaatgctattggcgaaagacattcgggacagagagagaggtgggagagctaaaatcggagtcatagagggagacaaagaggctgctagtccagagctcatgaaggttctgcaggatacactaggccgaagatctattattaagcctaccgtgcctgatgagataatagatcagaagcagaagtcaaccattatgctgtaccatatttccgacagcgcaggccaattggcggtcaccgaggtcgcaacgaggcccctggtacaggacctcctgaatcacgacgactgctacattctcgatcagtccggtactaagatatacgtgtggaaggggaagggcgctaccaaagccgaaaaacaagcagccatgtcaaaggccctggggttcatcaaaatgaaatcctatcctagctctacaaatgtggaaaccgtaaacgatggagctgaatccgccatgttcaaacagctgtttcagaaatggtccgtcaaagatcagaccatgggactgggaaaaacgttttcgataggtaaaatcgccaaggtttttcaagataaatttgatgtaactcttctgcatacaaagcctgaggtcgccgcccaggaaagaatggtcgacgatgggaatggaaaggtcgaggtgtggcgaattgagaaccttgagcttgtgcccgtggagtatcagtggtacggttttttctacggcggcgattgctacctggtcttgtacacttacgaggtgaatgggaaaccacatcacatcctgtatatctggcaggggcggcatgctagccaggacgagcttgctgccagcgcatatcaggctgtagaagtggataggcagtttgacggggctgccgttcaggtgcgggttcgcatgggaacagagcctagacacttcatggcgattttcaagggcaagctcgtcattttcgagggcggaacaagccggaagggtaacgccgaaccagacccgccagtccgtttgtttcagattcacggtaacgacaagagcaacacaaaagccgttgaggtgccagcctttgcctcttccctgaactctaatgatgtctttttgctcagaacccaggctgaacattacctgtggtatggcaagggaagttccggcgatgaacgagcgatggctaaagaactggcctccctgttatgcgacgggtcagagaacactgtggccgaaggccaggagcccgccgagttttgggacctccttggaggtaagactccgtacgcaaacgataagaggctgcaacaggagatactggacgtgcagtctcgtttgttcgagtgttcaaacaaaacaggccagtttgtcgtcactgagatcactgactttactcaggatgaccttaatcccaccgatgtgatgctgctggatacttgggaccaggtcttcctgtggatcggagccgaggctaacgccacagagaaggagagcgcattggccacggcccagcaatatttacatactcatccctccggacgagacccagatacccctatcttgattattaagcagggcttcgagcctcctatttttacggggtggttcctcgcctgggaccctaacatttggtccgcagggaaaacctatgagcaattgaaagaggaactgggtgacgccgctgcaatcatgcgaataacagcagacatgaaaaatgcaactttgagcctgaactcaaacgacagcgaacctaaatactaccctatcgccgtgctgctgaagaaccagaaccaggagctgccggaagatgttaatcccgcaaagaaggagaactacctgagcgagcaagatttcgtgtccgtgttcggaatcacgcgaggacagttcgctgccctgcccggttggaagcaactgcaaatgaagaaggaaaaaggtttattctag

SEQ ID NO: 178519 - DNA, 2439 bp, Artificial Sequence
  Description of Artificial Sequence: Synthetic coding sequence
atgagcagcaccggccaccccggcagctacaagatctggggcgagaaaatggagctggcattggtcccggtatctgcacatggaaacttctatgaaggcgattgctatgtcattctgagtacaaggcgggtggcatccctcctaagccaggatattcacttttggatcggcaaagattcgagtcaggatgaacagagttgtgcagccatatatacaactcagctggatgattatcttggaggatcccccgtgcagcaccgggaggtgcagtaccatgagagcgacacttttagagggtattttaaacagggaattatttacaagcagggcggtgtagcttccggcatgaaacacgtggaaaccaacacgtatgacgtaaagcgcctgctgcatgtgaaagggaaaagaaacatcagagccacagaggtcgaaatgtcctgggacagcttcaacagaggggatgtattcctcctcgatctgggtaaggtgattatccagtggaacggcccggagtccaacagtggagagcgcctcaaagctatgttgctggccaaagacatcagggatcgggagagaggagggagagccaaaattggagtaattgagggggacaaggaggctgcgtctcctgagctgatgaaggtgctacaggacacgctggggcgtaggagcatcatcaaaccgaccgttcctgacgagataatcgatcaaaaacaaaaatctaccatcatgctgtatcacatttcagactccgccggtcagttggccgtcactgaagtggctacgcgccctctggtgcaggacctgctcaatcatgacgattgttacatcctggaccaaagcggtacaaaaatctatgtatggaaaggcaagggagctaccaaggccgagaaacaggccgcgatgtcaaaggcccttggattcatcaagatgaagtcctaccccagctcgacaaatgtcgagactgtgaacgacggcgctgagtctgccatgttcaagcagctgtttcagaagtggagcgttaaagaccaaaccatgggcttgggtaaaacattttcaattggcaagatagccaaagtatttcaagacaaatttgatgtgaccttgctgcacaccaagcccgaggttgcagcacaagagcgcatggtggatgacggcaacgggaaagtggaagtgtggcgaatcgagaatctcgaacttgtaccggtcgagtaccagtggtatggatttttctatggaggagattgttacttggtcctgtacacctacgaagttaatgggaaacctcaccatattttatatatttggcagggaaggcacgcgagccaggacgagctcgccgccagtgcttaccaagctgtcgaggtggaccgccagtttgacggcgccgcagtgcaggttcgtgtgaggatggggacagagccgagacactttatggctatttttaagggaaagctagtcatctttgagggtgggactagtagaaagggcaatgccgagccagatccccccgttagactgttccaaatccatggcaacgacaagtctaacactaaggccgtcgaagttcccgcgtttgccagctccctcaacagcaacgacgtgttcctgcttaggactcaagcagagcactacctttggtatgggaagggttccagcggagatgagagggccatggctaaggaactggctagtctactatgcgacggcagcgaaaacaccgtggccgaggggcaggagcccgcggaattctgggacttacttggcgggaagacaccctatgccaacgacaagcgtttacagcaggagattctggatgtgcagtcccggctctttgaatgctcaaataagacggggcagtttgtggtgacagagattaccgattttacgcaggatgacctcaatccaacagacgttatgctgttggacacctgggaccaggttttcctgtggattggggcggaagctaatgccaccgaaaaggagagtgctctggctacagcacaacagtacctgcacacacatccatccggaagagaccccgacacaccaatcctcattatcaagcagggcttcgagcccccaattttcacagggtggttcctagcctgggatcccaacatctggagcgccgggaaaacctacgagcaacttaaagaggagctgggggatgctgccgcaatcatgaggataaccgcagacatgaaaaacgcaactctctcccttaattctaatgactcagagcctaaatattatcctatcgctgtgctgcttaaaaaccagaatcaggagctcccagaggacgtaaaccctgccaaaaaggagaattacctcagtgagcaggatttcgtgtctgtgttcgggattactaggggtcaatttgccgccctgcccggctggaagcagctgcaaatgaaaaaagagaaggggctcttctag

SEQ ID NO: 178520 - DNA, 474 bp, Artificial Sequence
  Description of Artificial Sequence: Synthetic coding sequence
atgcccctgaccagcgccttccgggccgtggacaacgaccccggcattatcgtgtggcgcattgagaagatggagctcgccctggttccagtttctgcccatggtaacttctatgaaggcgattgttacgtgattctttcaaccaggagggtagcaagtctgttgagtcaggatatccacttttggatagggaaggactcttcacaggacgaacaatcctgtgcagccatctacaccacccaattagatgattatctggggggcagtccagttcagcacagagaggttcagtaccatgaatccgatacttttagagggtacttcaagcaggggatcatctataaacaagggggcgtcgctagcggtatgaaacacgtcgaaacaaatacatacgacgtcaagcggctccttcacgtcaaagggaagcgcaatattcgagctactgaggtggagatgtcctgggatagtttctag

SEQ ID NO: 178521 - DNA, 2859 bp, Artificial Sequence
  Description of Artificial Sequence: Synthetic coding sequence
atgaagttcaagcggcggcaccaggccttccccagcttcttcaagatgaaggtgagcctgcccagcgaccccagctgcgtcgaggagatcctgagggagtctcagcacctgaccccaggtttcacgttacaaaagtggaatgaccctacaacccgcgctagtacgaaaagcgtctcattcaagagcatgctggaggacgacctcaaactgtccagcgacgaagacgacttggagcccgttaaaaccctaactacacaatgcactgctacggagctgtatcaggcagtggagaaggccaaaccgagaaacaatcccgtgaacccgccccttgccaccccccaaccccctcctgctgtccaggcctctgggggttcaggctccagtagtgaatcagagtccagttccgagagcgactctgacactgagagctctacaactgactccgagtccaacgaagcaccaagggtggccaccccagagcctgagccacccagcacaaacaagtggcaactggacaaatggctgaacaaggtcacttcccagaataagtccttcatttgcgggcagaacgaaacgcccatggaaacaattagccttccaccccctataattcaacccatggaagtgcagatgaaggtcaaaacaaatgctagtcaggttcccgcagagcctaaggagcggccacttttatccctgattagagagaaagccaggcctagacccacccagaagatccccgagactaaagccttgaaacataagctttccactacttccgaaactgtcagccagcgtactattggcaaaaagcaaccaaagaaagtcgaaaagaacacttcaacagatgagtttacttggcctaaaccaaatatcaccagctcaaccccaaaagagaaggagtcggttgaattgcatgatccgcccagggggcgcaacaaggccaccgcccataagccagctcctaggaaagaaccaaggcccaatatcccgctcgcccctgagaaaaagaaataccggggcccgggcaaaatcgtcccaaaatccagagaattcatcgaaactgactctagcacaagcgacagcaacaccgaccaggaggagaccctgcagatcaaggtcctcccgccttgcatcatttctgggggaaatacagcaaaatcaaaggaaatctgcggagcttcactgaccctaagtacactgatgagcagctctggatcaaacaacaacctgagtattagcaatgaagagcccaccttctctcccatacctgtcatgcaaacagagatcttatctccacttagggatcatgaaaacttgaagaacctgtgggtcaaaattgacctggacctactgagccgggtgcctggacatagtagtctgcacgccgccccagccaagcccgaccataaggaaaccgccaccaagcctaaaaggcagacggccgtgaccgctgtggaaaagcctgcccctaaaggcaagcgcaagcataaaccaatcgaggtagcggaaaagatccccgaaaaaaaacaaaggctggaagaggctaccaccatatgtctcctgcccccctgcatttcccccgctccgcctcataagccacctaatacaagggagaataactcctctagacgcgctaatcggagaaaggaagagaagctttttccaccacccttgtctcctcttcccgaagatccgccccggaggcgcaatgtttctgggaacaacggccctttcggtcaggacaagaatattgccatgacaggacaaatcactagtacaaaacccaagagaactgaaggcaaattctgtgccacgttcaagggaatttcggtgaacgaaggggatacaccgaagaaggccagtagcgctactatcacagtcactaataccgcaattgccacagctacggtgactgccacagcaatcgtcactacaactgttaccgccactgctacagctacagctactacaacgacaacgaccacaacgataagcactataactagtaccatcacgacagggctgatggactcttctcatctggagatgacaagctgggccgctctccctttgttgtcaagtagctccaccaatgtccgacgacctaagctaacgttcgatgactctgtgcataacgcggattactacatgcaggaggctaaaaagctgaagcacaaggctgacgccctgttcgagaagtttggaaaagccgtgaattatgcggacgcagcgttgtccttcacagaatgcggtaacgcgatggagagggaccccctagaggcgaagtccccgtatacaatgtattccgaaactgtagagctcctgagatatgccatgcgattaaaaaacttcgcaagtccactggccagcgatggcgacaagaaattggcagtcctttgttatcggtgcttaagcctcctttacctcagaatgtttaaactgaagaaagatcacgccatgaaatactcgcggtctcttatggaatatttcaaacagaatgcatccaaggtcgctcagataccaagcccctgggtgtccaacggaaagaacaccccgtcccccgtttccctgaacaacgtgagcccaatcaacgccatgggaaactgtaacaacggaccagttactatccctcagcgcattcaccatatggccgcatctcatgttaatatcacctcaaacgttctgcgcggctacgagcattgggatatggccgataagctcacccgcgaaaacaaggaatttttcggagatttagataccttgatgggaccactcacacagcactcatccatgacaaacctcgtgcgttacgtccgccaggggctatgctggctgcgtatcgatgctcatcttctctag

SEQ ID NO: 178522 - DNA, 3837 bp, Artificial Sequence
  Description of Artificial Sequence: Synthetic coding sequence
atggacctgttcgacttcttccgggactgggacctggagcagcagtgccattatgagcaagatcgctccgcccttaaaaagcgagagtgggaaaggcgcaatcaggaagttcagcaggaagacgatttgttctcgagcggatttgacctcttcggggaaccgtataagaccaataaaggggacgccctcgccaatcgggtccagaataccctgggaaactacgatgaaatgaaaaacctgctaaccaatcacagcaatcagaatcacctggttggcatcccaaagaactcggtacctcaaaacccgaacaataagaatgagcctagcttttttccagaacagaaaaataggatcattccaccccatcaagataatactcacccatcggcccctatgccaccacctagtgtcgtgattctgaatagtacgcttatccactccaaccggaagtcaaagccagaatggtccagagatagccacaacccaagcaccgtgctggcttcccaagcttcaggacagccgaacaagatgcagaccctcacgcaggaccaaagtcaggccaaattggaggattttttcgtgtatccagccgagcaaccacagatcggggaggtcgaggagagcaacccgtcagctaaagaggacagtaatcccaactccagcggggaagacgcattcaaagagatttttcagtccaatagtccagaggaaagtgagtttgccgtgcaggccccagggagtcccttggtggcaagttccctgttagccccatcttctggcctgtccgtgcagaattttccccccggtctgtactgtaaaacctcaatggggcaacagaagcccactgcctatgttaggcctatggatggtcaagaccaggcccctgatatctctcccacactcaagcccagtatcgaatttgagaacagctttggcaaccttagctttggcaccctgttagacggaaagccttcagctgcatcaagcaagacaaagctgcctaaattcaccattcttcaaacttccgaggtgagccttccctctgacccgtcctgtgtcgaggagatcctgcgcgaaagccagcatttgacacccggcttcacactgcagaaatggaacgaccccacaacaagagccagcacaaaatccgtatcgttcaaatctatgcttgaagacgaccttaagctgagcagcgatgaagatgatctcgaacccgttaagacactcaccacacagtgcacggctactgaactttatcaagcggttgaaaaagccaagcccaggaacaatcccgtgaaccccccactggccacccctcaaccccctcccgccgttcaggcttccggtggcagcggctcctcatcagagtctgaatccagtagcgagtccgatagtgacacagagagctcaacaactgactccgagtcaaatgaggcccctagagtggcgacccccgagcctgagccccctagtaccaacaaatggcaactcgataagtggctcaacaaggtgacctcccagaataagtcatttatatgtggacagaatgaaactcctatggaaacgatctctctgcctcctcctatcatccagcctatggaggtgcagatgaaggtcaagactaatgcctcacaggtgccggctgagccaaaggaacgacctctgctatctcttatccgcgagaaggcccgacccagacctactcagaagattcctgagaccaaggccctcaagcacaaattaagtaccacctcagagacagtgtcacaacggacgatcggtaaaaaacaacccaagaaagttgagaagaatacttcgactgatgagtttacttggcccaaaccgaacattacctcttctaccccgaaggagaaggagtccgttgaactgcatgatccgccgaggggtaggaataaggctacagcccataaacccgcccccaggaaggaacctcgcccgaatattcctctggctcccgaaaagaaaaaatacagaggccctggcaagattgttcccaagtcccgtgagtttatcgagaccgactcttcaacttctgatagcaacactgatcaggaggaaacactgcaaatcaaggtgctacctccatgcattatcagcggaggcaacacagccaagtctaaagaaatttgtggcgcatccctgactctttcaaccctcatgtcctcaagcgggagcaacaacaatctgtccataagtaatgaggagcccacattcagcccaattccggttatgcagactgagatcttatcacccctgcgcgaccacgagaaccttaagaacctgtgggtgaaaatcgatcttgacctgctgagccgtgttcccggccacagctcactgcatgcagcccccgccaaacctgaccacaaggagacagctaccaaaccgaagcgccaaacagcggtcaccgccgtggagaaaccggcccctaagggaaaaagaaaacacaagcccatcgaggtcgcagagaaaatacctgaaaagaagcagcgtttagaagaggccactaccatctgccttctgccaccttgtatctcaccagcgccaccgcacaagcctccaaacaccagagagaacaacagctctcgccgggccaacaggagaaaggaggaaaagctctttcctccacccctatcccccctccccgaggatcctcccaggaggcggaatgtgtcaggaaacaatggccctttcgggcaagacaagaacatagctatgacagggcagattacctcaactaagccaaagcgcaccgagggcaaattctgtgcaacattcaaagggatctctgtcaacgaaggagataccccgaaaaaggctagcagtgccacaattacggttactaatacagccatcgccacagccaccgtgacagcgaccgccatcgtaacaaccacagttacagctacggccacagccacggctactactaccaccacaacgactacaattagcactatcacatctacaattacaacaggcttgatggattccagccaccttgaaatgacgagctgggccgccctccccttgttatccagcagctcaactaatgttcggcgcccaaagcttacatttgacgactctgtgcacaatgccgattactatatgcaagaggctaaaaagctaaagcataaggccgatgccttgttcgagaagttcgggaaggcagttaactacgcagatgctgcactgagctttaccgaatgtggtaacgccatggaacgggaccccctcgaggccaaaagtccctacacaatgtactccgaaaccgtagaactgttgagatacgcaatgcggctcaagaattttgcatccccgctcgcaagcgacggtgataagaagctggcagtgttgtgttaccgatgcttgagtttgctgtacctccggatgttcaaattgaagaaagaccatgccatgaaatatagcagaagtctcatggaatattttaaacagaacgcttccaaagttgcccaaatcccttccccctgggtcagtaacggcaagaacacacccagccccgtgagcttaaataacgtgtcccctataaacgcgatggggaattgcaacaacggtccagtgacaatccctcagcgcatccatcacatggccgcgagccacgtcaatatcacttcaaatgtgctgcggggctacgaacattgggacatggcagataagctcacaagggaaaacaaggaattctttggagaccttgatacccttatgggaccgctgactcagcattcttctatgacaaatttagtcagatatgtacgccaaggactttgttggctccgaatcgatgcccacttattatag

SEQ ID NO: 178523 - DNA, 3831 bp, Artificial Sequence
  Description of Artificial Sequence: Synthetic coding sequence
atggacctgttcgacttcttccgggactgggacctggagcagcagtgtcattacgagcaggaccgcagtgccctcaaaaaacgggagtgggaacgccgaaaccaggaggtgcaacaagaagacgatctcttctcctctgggtttgatctgtttggggagccttataagaccaacaaaggagacgcccttgcgaacagggtgcaaaataccctgggaaattatgatgagatgaaaaacttgttgaccaaccattcaaaccaaaaccatctggtcggtattcctaaaaatagcgttcctcagaatcctaacaataagaatgagccttctttcttcccagaacagaaaaatcgtattatcccgcctcaccaggataacacccacccgtctgcccccatgcccccgccatctgtggtcattctgaactccactttaatccatagtaaccgaaagtccaaacccgagtggagccgggatagtcacaacccaagcacagtgctggcctcccaggcgtccggccaacctaataagatgcaaacactgactcaagatcagtcccaggccaagcttgaagatttctttgtttatccagctgaacagccacagatcggagaagtagaagaaagcaatcctagcgccaaagaagatagcaatcccaacagcagcggagaggacgcattcaaggagatatttcagtccaattcaccagaagaatcagagtttgccgtccaggcaccgggatctcccttggttgcctccagccttcttgcaccttcatctggactcagtgtgcagaatttcccgccaggattatattgtaagacctccatgggtcagcagaaacccaccgcctatgtgaggcccatggacggccaggatcaggcacctgatataagtcccacactgaagcccagcattgaatttgagaattcttttggaaacctctcatttggcactctcttagacggaaaaccaagcgcggcctcttcaaagaccaaactgccgaaattcacaatcttgcagacttcagaggtgtcactcccttcagacccatcttgcgtcgaggaaatcctccgcgaatctcagcacctgactcccgggtttaccctccaaaaatggaacgaccctaccacgagagcttccacaaagtcagtctctttcaaaagcatgctcgaggacgatttgaagctgagctctgatgaagatgatttggaaccagtcaagacactcacaacccagtgcaccgcaacggagttataccaagccgttgaaaaggctaagccgaggaacaaccccgtgaacccccctcttgcgactccacagccacctcctgccgtacaggcatcgggcggcagcggctcctcttctgagagcgagtcatccagcgagtctgactctgacaccgaatccagcacaacagactcagaatcaaatgaggctccccgagtcgcaacaccagaaccagaaccgcctagtacaaacaaatggcagctggataaatggctcaataaagttacatcccagaataagagctttatatgtggacagaacgagaccccgatggaaaccatctcactgccacctcctattatccagccaatggaggttcaaatgaaggtgaagaccaacgcctcgcaggtcccggccgagcctaaggagcgaccacttctgtcactcattagggaaaaagccagaccaagaccgacccagaaaatcccggagaccaaagctctgaagcacaagctgtctactactagtgaaactgtatctcaacgcaccatcggaaaaaaacagccaaagaaagtcgagaagaatacctcaacggatgagttcacgtggcccaagcctaatataacttcttccactcccaaagaaaaggagtccgtggagctgcatgatcccccacgaggccggaataaagccacagcacacaagccagcgccccgcaaagagccccggcctaatattcccctggccccagagaagaagaaatacagaggcccgggtaaaattgtccctaaaagtagggagttcattgagaccgactcttccacctcagacagtaacacggaccaggaggagacacttcagataaaagtgctcccaccttgcataatctcaggaggaaacactgctaagagtaaggagatctgtggagcgtcgctgactctctcgactctcatgtcatcaagtggtagtaacaacaacctgtcaatttctaacgaggaacctacatttagcccaattcctgttatgcagaccgaaattttatctcccctccgcgaccacgagaatctcaagaatctgtgggtaaaaatcgacctggacttgctgagccgggtaccaggacacagcagcctgcacgctgcaccagccaagcccgatcacaaagagacagccactaagcctaaacggcaaacagcagttaccgccgtcgagaaaccggcccctaaaggcaagcgaaagcacaaacccatagaggtcgctgagaaaattcccgagaagaaacaacgcctggaggaggcaacaactatttgtctcctgccaccctgcatcagcccggccccccctcataagccgcccaatactcgagaaaataactccagcaggcgagcaaacagacggaaggaggaaaagttatttcccccaccactgtcccctctaccagaagacccccccaggagacggaatgtgagtggaaacaacggcccgttcgggcaggacaaaaatattgccatgaccggccaaattacctccactaagcccaaacgaactgagggtaagttttgtgcaacatttaagggtatctctgagggagacacaccaaagaaggctagttcggctaccataactgtgacaaacacagctattgccaccgccaccgtgacagctacagctatcgttacaaccacagttacagctacagcaaccgccaccgcaaccaccacgactacaactacaaccatctccactattactagtacgataacaaccggactcatggattcgagccacctcgagatgacctcctgggcagccctccctctcctgtcaagctccagtacaaacgttcggagaccaaaactgacttttgatgactcagtccataacgctgactattacatgcaggaggccaagaagttgaaacacaaagccgatgcgctctttgaaaagtttggaaaggccgtaaactacgcagatgccgccttgagtttcaccgagtgtgggaacgctatggagagggatccgctggaagctaagtcgccatataccatgtactcagagactgttgaactgctacgctacgccatgagactgaaaaacttcgcttcacctctcgcatccgacggtgataaaaagctcgctgtgttgtgctacaggtgtctgagtttactatatttacggatgtttaagctgaagaaggaccacgccatgaagtattctcgctccttgatggaatatttcaagcagaacgcaagtaaggtagcccaaattcctagcccctgggtgagcaacgggaagaacaccccatcccctgtgagtctgaacaatgtctcccctatcaatgcaatgggtaattgtaacaatggtcctgtcactattccccaacgcattcatcacatggcggcaagccatgtaaacattacaagcaatgtcctccgcggctacgagcattgggatatggcagacaaactgactagagagaataaagaattcttcggcgacctggatactttaatgggacctctgacccagcacagctccatgacaaaccttgtgagatatgtgcgacagggcttgtgttggctacgaattgatgcacacttgttgtag

SEQ ID NO: 178524 - DNA, 1284 bp, Artificial Sequence
  Description of Artificial Sequence: Synthetic coding sequence
atggacctgttcgacttcttccgggactgggacctggagcagcagtgtcactacgagcaggacagatctgccctgaagaaacgcgagtgggagaggcgcaaccaagaggtccagcaggaggatgacttattctccagcggcttcgatttgtttggcgaaccgtacaaaaccaacaagggcgatgcactggcaaaccgcgtacagaataccctgggtaactacgacgagatgaagaatctcctgactaatcatagcaaccagaatcatttggtcggaatccccaagaactccgtgcctcaaaaccccaataacaaaaatgagccatctttctttccagaacagaaaaatcgtatcattccaccccaccaggataacacccacccaagcgctcccatgcctccaccaagtgtggttattttaaattctacattaatccactctaaccggaagagcaaaccagaatggagtagggattcacacaacccctcaacagtgttagcatcccaagcatccggacaacctaataaaatgcaaacattaactcaggatcaatctcaggccaaacttgaagatttcttcgtctaccctgctgagcagcctcaaatcggggaggtagaggagagtaacccctccgcaaaggaagatagtaatcccaacagcagcggtgaagacgcattcaaagaaatattccagagtaactccccagaggagtccgagtttgcagttcaggcccccgggtcaccccttgtagcatcaagcttgttggctccatcgagtggcctgtcagtgcaaaatttccctcctggcttgtattgtaagacaagcatgggccagcagaagcctaccgcttacgttcgacctatggatggccaagaccaggctcctgacataagtccaactctcaagcctagcatcgaattcgagaacagctttggtaacctaagcttcggtactctcctggatggcaagccatcggctgcttcctctaagacaaaactgcctaaattcaccatcctgcaaacgagcgaggtgagcctaccctccgacccttcttgcgtggaggagattctgcgtgagtcacaacatttgactcccgggttcaccctacagaagtggaacgatccaaccaccagagccagcacaaagatgctggaagacgacctgaagctgtcctcagacgaggatgatttggagcccgtgaagactctcacaacacagtgtacagcaaccgagctgtatcaagcggtcgagaaggccaagcccaggaacaacccagtcaaatag

SEQ ID NO: 178525 - DNA, 3936 bp, Artificial Sequence
  Description of Artificial Sequence: Synthetic coding sequence
atggacctgttcgacttcttccgggactgggacctggagcagcagtgtcattacgagcaggaccggagcgcacttaagaaaagggaatgggaacgtcgcaatcaggaagtgcagcaggaggatgacctgttttccagcggctttgatttgttcggagagccttacaaagtcgccgaatataccaacaaaggggacgctctcgccaatagagtgcagaataccctgggtaattatgacgagatgaagaatctcctgactaaccattccaaccaaaatcatctcgtggggatccccaagaacagcgtcccccagaatccaaataataagaacgaacctagcttttttccggagcagaaaaataggatcattcccccacatcaggacaatacacacccttctgcaccaatgcccccccctagtgtggtgatcttaaacagtacactcattcatagcaatagaaagtcgaagcccgagtggtcacgcgattctcacaacccttcaacagtgttggcaagccaagcaagtggccagcccaacaaaatgcagactttaacacaggaccagagccaggctaaactagaagactttttcgtctaccccgcggagcagccacagattggcgaggttgaagaatctaacccttcggccaaggaggactccaatccgaatagctccggggaggatgccttcaaggaaatcttccaaagtaacagccccgaggagtccgaatttgcagtgcaggcccctggctcgccactggtggcatcgagtcttttggcgcctagcagtggactgtccgttcagaactttccacctgggctctactgcaagacgagtatgggacagcaaaaacctacagcttatgtgcgtccgatggacgggcaggatcaggccccggatatcagcccaacactcaagccgtctatagagtttgagaactcctttggtaatttatccttcggcaccttattggacggtaagcccagtgctgcttcttccaagacgaagctgcccaaatttacaattctgcaaacgtcggaagtgagcctgccaagcgatccctcctgtgtagaggagattctccgtgaaatgacccattcctggcccaccccgctgacctcaatgcatacagcaggccattctgagcaatcaactttctcaattcctggacaagaaagccagcatcttacaccaggattcacacttcaaaagtggaacgatccgacaacacgggcgtctacaaaaagtgtgtcatttaaaagcatgcttgaggacgaccttaagctgagcagtgacgaggatgacctggagcctgtcaaaactcttactactcagtgcactgctaccgaactatatcaggccgtggaaaaggccaaacctcgcaataacccggtgaatccacctttagcaactcctcaaccaccccctgcggtgcaggcatcaggaggatcaggctcgtcctccgagagtgagagtagctccgaaagcgattctgacaccgagagctctaccacagattctgagtcgaacgaggccccaagagtcgccacaccagaacccgaacccccaagtaccaacaagtggcagttagataaatggcttaacaaggtcacttcccaaaacaagagttttatctgtgggcagaatgagactccaatggagaccatcagtctaccgcccccaatcatccaacccatggaagttcaaatgaaggtcaagaccaatgcgagccaagtgcccgcagagcccaaggagcgaccgctgctgtcgctcattagggagaaagccagaccacgacccacacagaagatcccggagactaaagctctaaagcacaaactgtctacgacaagtgagaccgtgagccagcggacgatcggaaagaaacagcctaaaaaagtcgagaaaaacaccagcacagacgaattcacctggccaaaaccaaacattaccagcagtaccccaaaggagaaggaaagtgtggagctccacgatcccccccggggccgcaacaaagcgaccgctcacaaaccggctccacgcaaagagccgcggcccaacatacctctggcccctgaaaagaaaaagtacaggggaccaggcaaaatcgttcctaaatcccgcgaattcattgagacggacagcagtacttcagacagcaatactgatcaagaagaaacgctgcagattaaagtattaccgccctgtattatcagtgggggcaacacagccaagtccaaggaaatctgtggcgcgtcgttgaccctgtcgaccctgatgtctagttctggttctaacaataacctgagtatctccaacgaagagcccacattcagccccatccccgtcatgcagacggagattctatcccctttgcgcgaccacgagaacctgaagaatctgtgggttaagattgatttggacctgctttcgagagtaccagggcattcttcgctgcacgccgctcctgccaagccggaccataaggagacagcgacgaagcccaaacgacagacggcagtgaccgccgtggaaaagccggcccccaagggtaagcggaagcataagccaatagaagtggccgagaaaattcccgagaagaagcagaggctggaagaagcaaccaccatctgcctgctccccccgtgcatttcaccagcaccgccacacaaacctcccaatacaagagagaataactcatctaggcgtgcgaaccggcggaaagaggaaaagctgttcccaccccctctttctccactgcccgaagacccgcctagacgaagaaacgtgagcggtaataacgggccattcggccaagacaaaaacattgcaatgaccggccaaatcacctccacgaagccaaaaaggactgagggtaaattctgtgccacctttaaaggtatctcagtcaacgaaggcgatacacccaaaaaggcctcttccgccacgattactgtaacaaacaccgccatcgcaaccgcaactgtaactgcgactgctatcgtaacgaccacagtgactgccacagcaacagcaaccgctaccactaccaccacaactacaactatttcaacgattacctcaacaattacaacgggcctgatggattcctctcacctggaaatgacctcctgggcagccctcccccttctgtcaagtagcagcacaaacgtccggcgccccaagttaacattcgacgacagcgtccataatgcggactactacatgcaggaagcaaaaaagctcaagcacaaagctgacgccctgttcgagaagttcggaaaggccgtcaactatgctgacgcggccctgtccttcacagagtgcggcaacgctatggaaagggatccattagaggccaagtccccatacactatgtacagcgagaccgtggaactattgcgatacgccatgcgtttgaaaaacttcgccagcccactcgccagtgatggcgataagaaactggctgtattgtgttaccgttgtttatcacttttgtacctgcgtatgttcaaactgaagaaagaccatgccatgaagtattctcgttccctaatggaatacttcaaacagaacgcttccaaggtggctcagatcccctccccctgggttagcaatggcaaaaatacccccagtccagtgtccttgaataatgtgtcccctattaacgcgatgggcaactgtaataacggtcctgtgactattccccagaggatccaccatatggctgcaagccatgtcaatatcacatctaatgtgctgagaggttatgagcactgggacatggcagacaaacttacaagagagaacaaagaattcttcggagaccttgataccctgatggggccactgacccagcacagttccatgacaaatcttgtaaggtacgtgcgacaaggactctgctggctgcgcatcgatgctcacttactgtag

SEQ ID NO: 178526 - DNA, 1410 bp, Artificial Sequence
  Description of Artificial Sequence: Synthetic coding sequence
atgagcgccctgaccccccccaccgacatgcccacccccaccaccgataagataactcaggccgctatggaaactatttatctgtgtaagtttcgagtgagtatggatggcgagtggttgtgtctacgggagctggacgatataagtctcacgccggatcctgaacctactcacgaggacccaaactacctgatggccaatgagagaatgaacctcatgaatatggctaagttatcaatcaagggcttgatcgagagtgcgctgaacttggggagaactctcgactctgactatgcccccctgcagcaattcttcgtggtgatggagcactgcttgaagcacggactgaaggcaaaaaagacattcttaggacagaataaaagtttctggggaccactcgagctggttgaaaagctcgttcctgaagctgcggaaataactgcctctgttaaagacctgcccgggttaaaaacccccgttggacgggggagagcctggttgcggttggctctaatgcagaaaaaactctctgagtatatgaaggctctcattaataagaaggaactcctgagcgagttttatgagccaaatgctttgatgatggaggaagaaggggcaataatcgcaggcctgctggtgggccttaatgtcatcgacgctaatttttgcatgaagggggaggatttagatagccaggtcggggtgattgatttctctatgtacctgaaggatggaaattctagtaaggggacagaaggagacgggcagattactgcaattctcgatcagaagaattacgtggaagagcttaatcgtcatttaaacgccaccgttaataacttacaggccaaagttgacgcgttggaaaagtccaatacaaaactgaccgaggaactggctgtggctaataacagaattatcaccctccaggaggaaatggaaagagtaaaagaggaatccagctatattctggagtcaaacagaaaaggaccaaagcaggatagaacggccgaaggtcaggcgctgtctgaggccagaaaacatttaaaggaggagacacagctgagactcgatgttgagaaagaactggaaatgcagatctcaatgaggcaggagatggagcttgctatgaagatgctggaaaaagatgtgtgcgagaagcaggacgcgctggtatcccttcgccagcagctcgacgaccttcgggctttgaagcacgagctcgcattcaaattgcagtcaagtgacttgggcgttaaacagaaaagtgagcttaactctcggctcgaggaaaagaccaatcagatggctgccactataaaacagttggagcagtcggaaaaggatctggttaagcaggctaagaccctgaatagtgccgcgaataagcttattcccaagcaccactag

SEQ ID NO: 178527 - DNA, 2394 bp, Artificial Sequence
  Description of Artificial Sequence: Synthetic coding sequence
atggcccaccggtgcctgcggctgtggggccggggcggctgctggcctcgcggcctacaacagttactggttcccggaggagtcggacccggcgagcagccttgcctgcgcaccctgtacaggttcgtgacaactcaggcgagagccagtagaaattccttgcttacagatattattgcagcctatcagagattttgctctcgcccacccaaagggtttgaaaagtactttccaaatgggaaaaacggaaaaaaggccagcgaacctaaggaagtgatgggagagaaaaaggagtcgaagccagcagccaccacgcgatcctctggtggggggggtggaggtggtggaaagcgcggcggaaagaaagatgatagccattggtggtccaggtttcagaaaggcgacataccctgggacgataaagacttcaggatgttctttctttggacggccctcttctggggcggcgtcatgttttatctcctgttaaagaggtctggtagggaaatcacgtggaaggactttgtgaataattacttgagtaaaggcgtggtggatcgcctggaggtggtcaacaagcggtttgtcagagtgacattcacccccgggaagacaccagtggatggacagtatgtttggttcaatatcggaagcgttgatacctttgagagaaacctggaaaccctgcagcaggagctgggcattgagggcgagaatcgggtccccgtggtctacattgcggaatctgatggatcttttctgctctcgatgctcccaaccgttctcataatcgccttcctgctgtataccattcgccgcggcccggcaggtataggccgaaccggccgagggatggggggactgttttcggtcggtgaaaccactgcaaaggtgctaaaagacgagattgatgtgaagttcaaagatgtcgctggatgtgaggaagctaaacttgagatcatggagttcgtcaactttctgaagaaccctaagcaataccaagacctgggcgcaaaaataccaaaaggcgcaatccttactggtccacccggtacaggaaagactttgttggccaaagccaccgccggtgaggctaatgtaccattcataaccgttagtggttctgaatttctcgagatgtttgtcggtgtgggaccagcacgcgtacgggacctgttcgcactcgcccgcaagaatgcaccatgcatactttttattgacgaaatcgatgccgtgggaaggaagaggggacgggggaacttcggcggacagagcgaacaggaaaatacactaaatcaactcctggtggagatggacggcttcaataccactactaatgtagtaatccttgccgggacaaaccgacccgatattctcgaccccgccctactgcgtcctggaagattcgatcgccagatctttattgggcccccagatatcaaggggcgcgccagtatcttcaaagtacatctgcggccgctgaagttggattctaccctagagaaggataaattggctcggaagttggcatcactcacccccgggttttccggcgccgatgtagcaaatgtgtgcaatgaggccgcccttatcgccgccaggcacctctctgattcaataaaccagaaacatttcgaacaggccatagagagagtaataggaggactggaaaagaaaacccaggtattgcaacctgaggagaaaaagactgtggcatatcacgaagcgggtcacgccgttgccggctggtatcttgaacatgccgacccactgctaaaggtatccatcatcccccggggaaagggcctcggctatgctcaataccttcctaaagagcagtatctctatactaaagaacagttgctggaccggatgtgcatgacactcggaggtagggtatcagaggagatttttttcggacggattaccaccggagcgcaagacgatctgcggaaggtcacccagagcgcttatgctcagatagttcagtttggaatgaacgagaaagtgggccaaatatctttcgacttgcctaggcagggggatatggtgctggaaaagccatactctgaggccaccgcccgcttgatagacgatgaagtgagaatacttatcaatgatgcttacaagcgcaccgtggccttgctaacagaaaaaaaagcggatgtggaaaaggtagcactcttgctcctcgagaaagaagtcctagacaagaatgatatggtcgagctcttgggcccccgacccttcgccgaaaagtcaacctatgaggaatttgttgagggtaccgggtctcttgacgaggataccagcctgccagaagggctgaaggactggaacaaagaaagggagaaggaaaaggaagagccccccggcgaaaaagtcgcaaattag

SEQ ID NO: 178528 - DNA, 2439 bp, Artificial Sequence
  Description of Artificial Sequence: Synthetic coding sequence
ggcgccggcggccggcggcggcgggtggagagcctgggcagcagcgtgtcacgccggagagcttccttgcctgggggtttaagccctagtcgggccaggtttccacgaccaccagtcgtggcttgtcccagacttcgcgagcagccatgcctcagaactctgtatagatttgtcacaacccaggctcgtgcatcaaggaacagccttctgactgatatcatcgccgcttatcagaggttttgctcgaggccacctaagggttttgagaagtactttccgaatggaaagaatggaaagaaagctagcgaacctaaagaggttatgggtgagaaaaaggagtctaagcctgctgcgaccacccgttcatccggcggggggggcgggggaggcgggaagagaggtggcaagaaagacgacagtcactggtggtctcgcttccagaagggagacattccttgggatgataaagactttaggatgttctttctgtggacagccctgttctggggcggcgtgatgttctacctacttctgaagcgaagcggcagagagatcacctggaaagatttcgtcaataattatttatctaagggcgtagtggaccgactggaagttgttaataagcgattcgtgcgggtaacattcacacctgggaaaacacccgtggatggccagtatgtctggttcaatattgggtctgtggacacgtttgaaagaaacctggagactctccagcaagagctggggattgagggtgagaatagggtgcctgtggtgtatatagctgaatcagatggcagtttcctgctatccatgcttcctactgtcctgatcattgctttcctgctgtataccattagacgtggccccgcagggattggcagaacaggcagggggatgggtgggcttttcagtgtaggggaaacaactgccaaggtacttaaggacgagatcgacgtaaagttcaaagatgtggccggatgcgaagaagccaagttagagatcatggagtttgtcaattttctgaaaaatcccaaacagtatcaggacctgggcgcaaagatacccaaaggagctatcctgacaggaccacccggtactggaaaaactctactggctaaggctacagccggggaggctaacgtcccatttatcacggttagtgggagcgagttcctggaaatgtttgtcggggtgggaccagctagggtgcgcgacctgttcgctctagccaggaagaatgctccctgcattctgttcatcgacgagattgatgccgtgggtagaaaaagggggagaggcaactttgggggacagtctgagcaagagaatacccttaatcaacttcttgtggagatggacgggtttaatacaacaactaacgtcgttatcttagctggcaccaatcggcccgatatcctcgatccagcgttactgaggcctggaagatttgaccggcagatttttatcgggcctccagatatcaagggcagggctagcatttttaaggtgcatctgagacccctgaagctagactctactctggagaaagacaagctcgcacgaaaactggcatccctgactcccggcttctccggagccgacgtggcaaacgtgtgcaatgaagctgccctgatcgcagctagacacttatccgactctatcaatcagaaacattttgagcaggccatagagcgggtgattgggggcttggagaagaaaactcaggtcctccagcccgaagagaagaagactgtggcctaccacgaagccgggcatgctgtggcaggctggtatctcgagcatgcagacccccttctgaaagttagtatcataccaagagggaagggcctcggttatgcccagtatctaccaaaagagcagtacctgtatacaaaagaacagctccttgaccgtatgtgcatgacattagggggccgggtatcagaggaaattttctttggacggatcacaaccggcgctcaggatgatctgagaaaggtgacacagagtgcttacgctcagatcgttcagttcgggatgaacgaaaaagtcggccagatatccttcgatcttcccaggcagggcgacatggttcttgagaaaccgtacagcgaagctacggccaggctaatcgacgacgaggtgcgaatactcattaatgacgcatacaagagaacagtggctctgctgaccgagaaaaaggccgacgtggaaaaagtggcgcttctcctgttggagaaggaggttctcgacaagaacgacatggtggagctgctgggccctcgtccattcgctgagaagtcaacctatgaggaattcgttgaaggtaccggctcactggacgaagatactagtctgcctgaaggattaaaggactggaacaaagagagggagaaggagaaagaggagccgcctggagagaaagtcgccaattag

SEQ ID NO: 178529 - DNA, 7251 bp, Artificial Sequence
  Description of Artificial Sequence: Synthetic coding sequence
atgaccaccctgctgtgggtgttcgtgaccctgcgggtgatcaccgcagctgttaccgtcgaaacatcagatcatgacaactccctgtcagtcagcatcccccagcctagcccgctgagagtgttgctgggcaccagtctgaccatcccatgctactttatcgacccaatgcacccagtgacaacggccccatccacagccccgcttgctcctcgtattaagtggtccagggtgtctaaggaaaaggaagtggtgttactggtggccacagaagggcgagtcagggtgaatagcgcataccaggataaagtgtcccttccgaattacccagcaattccgtccgacgccaccttggaggtgcaatcattgcgcagtaacgattctggcgtgtaccgttgtgaggtcatgcacggaatcgaagatagcgaggccactctggaagttgtagtgaaaggtatcgtgttccattatcgcgcaattagcactagatacactcttgatttcgatcgggcccagcgagcctgcctccagaattctgcaatcatcgcgaccccagagcagctgcaggccgcttacgaggacggttttcatcagtgcgatgcaggttggctggctgaccagaccgtgaggtatccaattcatacaccccgcgaaggatgttacggcgataaagatgagttccctggcgtgcgaacctatggtatcagggacaccaacgagacttatgatgtatattgtttcgctgaggagatggagggcgaagtattctatgctactagccctgagaaattcaccttccaggaagcagctaacgagtgccgacgtttgggcgcaaggctcgctacaacaggccagctttacctggcttggcaggccggtatggacatgtgtagtgccgggtggctagccgaccggagtgttagataccctattagcaaagcacgcccaaattgcggaggcaacctgttgggagtgaggactgtgtatgttcacgccaaccagaccgggtatccagacccatcaagccgatacgatgccatttgctacaccggtgaggatttcgtggatatcccagagaatttctttggagtgggcggggaggaagacattactgtccagacggtgacctggccagatatggaattaccccttccacgcaacattactgaaggggaagccagagggagcgtgattctgaccgtgaaacccatatttgaagtttctccaagcccattggaacctgaggaaccgtttacgtttgctcccgagattggcgccacggcttttgcggaggtagagaacgaaaccggcgaggccacccggccttggggattccccaccccgggcctgggcccggccacagctttcactagcgaggatctggtggttcaggtcactgcagttcctgggcagccccatcttcccggtggcgtcgtgttccactaccgaccaggcccgactaggtacagcctgacattcgaggaagctcaacaggcgtgccttcggaccggggctgtgatcgcaagtcctgaacagttgcaggccgcttacgaagccggatacgagcagtgcgatgctgggtggctgcgcgaccaaacagtgcgttatcccatcgtatccccacgaaccccgtgcgtgggtgacaaggactcatctcccggagtgcgcacatacggagtacgcccgtccactgagacctacgatgtctactgttttgtagaccggctggaaggcgaagtgttctttgcgaccagactggagcaattcaccttccaggaggcactcgaattctgcgagagccacaacgctacgctggctaccacaggccaactctacgccgcttggagcagaggcctggacaagtgctatgccggctggctcgccgatggcagtctgaggtatcccatcgtgacgccccggccagcctgtgggggagacaagcccggtgttcggaccgtgtacctgtatcccaatcagacgggcctgcccgatcctttaagccgtcaccacgccttctgtttccggggcataagcgctgtccctagccccggagaggaggagggtggcactcctacttccccttctggagtagaggaatggatcgttacccaggttgtgccgggcgtggccgcggtccccgtagaagaagagacaactgcagtgccctccggcgagacaactgccatactggagtttacaaccgaacccgagaaccagactgagtgggaacctgcctacacacccgtgggcacatccccgctgccagggatcctcccaacatggcctccaacaggagccgctaccgaggaatcgactgagggcccctccgcaaccgaggttcctagcgcaagcgaggaaccttctccgagcgaggttccctttccctctgaggaacctagcccctcagaagagcccttcccatcagtgagaccttttccatccgtagaattgtttccaagcgaggaaccatttcccagtaaggaacccagcccgtcggaggagccaagtgctagtgaggagccttatactccgagtccgcctgtcccctcttggacagaactgcctagtagcggagaggagtccggggcgccggatgtgagtggtgacttcacgggaagtggcgacgtttctgggcaccttgactttagcggccagctgtcaggcgatcgcgcctctggtttgccgagcggggatctcgactctagcgggttgacctctaccgtcggctctggcttacccgttgaaagtgggttgccgtccggtgacgaagaaaggatcgagtggccctctactccgacagtcggcgagctgcccagcggcgcagagattctagaaggctccgcaagtggcgtcggggatcttagcggcttgccatcaggcgaagtcttggagacctcagcctccggagtaggcgatctgtctggtctgccgagtggagaagttcttgagacgacagctcccggcgtcgaggacattagcggtcttccgtctggcgaagtgttagaaaccactgctccaggagtggaagacatatcgggactgccttctggggaggttctggagaccaccgctcccggcgtggaggacattagcggccttccttccggagaagtgttggaaacaaccgccccaggcgtggaggacatttccggcctgccttcaggtgaagttctcgaaacgacagcaccaggcgtggaggacatctctggtcttccgagcggtgaggttctcgaaaccgccgctccgggtgtagaagacatcagcggattgccaagtggggaagtgttggaaaccgcagcacccggcgtggaggacatcagcggcctgcccagcggggaggtgcttgaaacagccgccccgggggtggaggacatcagcggcctgccttccggggaggtgttagagaccgccgcgcctggcgtggaggatattagcggactccctagtggggaggtgctagaaaccgccgcccctggagttgaagatatatctggtttacctagcggggaggtcctggagactgccgcccccggcgtcgaggacatttcaggactgccctccggggaggtcttagagactgccgctcccggggttgaagatatcagtggattgccaagcggcgaagtactggaaactgcagctcctggcgtggaggatatctcaggactgcccagtggggaggtgctcgagaccgccgcacctggcgtcgaagatatctcgggactgccttcaggcgaagtgctcgagactgctgcacctggtgtggaagatatctctggccttccttccggtgaggtgcttgagactgccgcccccggcgtcgaagacattagcgggctgccctccggggaggtgctggagactacagcaccgggggtggaggagatctcaggcttgcccagcggcgaggtgcttgaaactactgcacctggtgtggatgaaatttctgggttacctagtggcgaggtcttggagactactgcaccaggtgtcgaagaaatcagtggcctgccttcgggggaagtactggaaacttctacttctgctgtcggcgacctcagtggattaccttccggcggtgaggtcctggaaattagcgtctcaggcgttgaggacatcagcggccttccaagtggggaagtagttgagacatctgcttccggcattgaagacgtgtccgaacttcccagtggcgaagggctggagacctccgctagtggtgtcgaggatctcagtcggttaccctcaggcgaggaggtgttggaaatttcagctagtggctttggcgatcttagtgggttgccgtcaggcggagaaggtctcgagacctcagcctccgaggtcggaacggacttgagcggactgccatctggacgggaaggcttagagaccagcgcgagtggggcagaggacctgtccggccttccaagcggcaaggaggatttggtcggtagtgctagtggtgacctggatctggggaaacttcccagcggaacattaggatcaggccaagctcccgagacgtccggactcccaagcgggttcagtggcgaatattcaggagttgacttgggctccggacctccttccggactgccagatttctcgggccttccatcagggttcccgactgtgtctctcgtggattcaacactggttgaggtggtcacagcaagcaccgcttctgaactcgagggaaggggtacgatcggtatctccggagcaggggagatatcaggactgccttccagtgaactggatatctcaggaagagcctccgggctgcccagcggcactgagctgtctggacaggctagcggcagtccagatgtatctggagaaataccaggcttgttcggggtgtcggggcagccatcaggattcccagatacttccggcgagacctccggcgtgactgaactgagcggtctgagtagcgggcagcccgggattagcggcgaagccagtggagtgctgtacgggacttcccagccgttcggtatcaccgacctgtctggagagacctctggtgtacctgatttgagcggtcagccgtctggtctgcccggcttttccggtgctacgtccggggtgcccgacctggtgagcggcaccaccagcgggtctggtgagagctccggcatcacctttgtcgataccagcttggttgaggtcgctccaacaactttcaaagaggaagaggggctgggaagtgtcgagctgtccggtctgccaagtggtgaagctgatctgtcgggaaagtcaggcatggtggacgtgtccggccagttctcggggacagtcgattcctcagggttcacatcgcagacccctgagttctccggcctgccaagcggcattgctgaggtgagcggcgaatcttcccgagccgagatcgggtcttctttaccctcaggagcttattacgggtctggaacaccaagctcgtttccgactgtgtccttggtggaccgcacccttgtcgagtccgtgactcaggccccaaccgcccaggaggcaggcgaagggccctctggaatccttgagctcagcggggcgcacagcggagcccctgacatgtccggtgagcatagcggattcctggacttgagcggcctgcagagcgggcttatcgagccttctggagaaccaccaggaaccccttacttctctggagattttgcctctactactaacgtgagcggcgaatccagcgtcgctatgggaacatccggggaggcatccggcctccccgaggtgaccttgattacctccgaattcgtcgagggcgtgaccgagccaaccatttctcaggaactagggcaacggccgcctgtgacccacactccgcaacttttcgaaagtagtggcaaggtgtcaacagccggcgatatatctggcgcaactcctgtgctccctggtagtggcgtcgaggtctcgtccgtgccagagtcttcttcagagacttccgcttacccggaggctggcttcggagccagtgccgccccagaagcttctcgcgaagactctgggtctcccgatctctctgaaaccactagtgctttccacgaggccaacttggagcgcagcagcggcctcggggtgtccgggtcaactctgactttccaagagggggaggcctccgccgcaccagaggtgtctggcgagagcaccacaacctctgatgtcggtaccgaggcccctggattacccagcgcaacccccactgcgtcaggggacagaacagaaatttccggggatctgagcggccacacttcccagcttggagtggtgatatctacctcaattccggagagtgagtggacccagcagacccagagacctgccgagacccacctggaaatcgagagcagttccctcctctactctggcgaggaaacacacacagtggaaaccgccacgagccctacggatgccagcatccctgcctctcctgagtggaagcgtgagagcgagtctaccgctgccgcccccgcccggtcatgcgccgaggagccctgtggcgctggcacatgtaaggagaccgaagggcacgtgatctgcttatgcccccctggatacacaggagaacattgcaacatcgaccaggaggtgtgtgaggaggggtggaataaataccagggccattgctatagacacttccctgatcgcgagacgtgggtggacgctgaaagacgatgtagagagcagcagtctcatctctcaagcatcgtgactcccgaggagcaggagttcgttaacaataacgctcaagattatcagtggatcggcttgaacgataggacgatcgagggagacttccgttggagtgacggccaccccatgcagtttgaaaattggcgaccaaatcagcccgataactttttcgccgccggagaggattgcgtggtcatgatctggcatgagaagggggaatggaatgatgtgccttgtaattaccacctgccattcacttgcaaaaaagggaccgtggcctgcggtgagcctcccgtggtggaacatgcccgaacattcggacagaagaaggaccggtacgaaattaattccctggtgagataccagtgtaccgagggtttcgtgcagcgccacatgcctaccattagatgtcagcccagtgggcattgggaagaacctcagatcacttgtaccgatccaaccacatacaagagacgcctccaaaagagatcctcacgccacccgagacgtagccgcccatcgacagcccattag

SEQ ID NO: 178530 - DNA, 7296 bp, Artificial Sequence
  Description of Artificial Sequence: Synthetic coding sequence
atgaccaccctgctgtgggtgttcgtgaccctgcgggtgatcaccgctgccgtgaccgttgaaacaagcgatcacgataattctctctccgttagcatcccccagccatctccactgagggtcctgttgggcacatctttgacgatcccttgctacttcattgatccaatgcatccagtcaccacagcaccgagtaccgctccattagctcccagaatcaaatggtctcgggtcagtaaagaaaaagaagtcgtgttgctggttgcaactgagggtcgcgtgcgcgtcaattccgcataccaggataaagtgtcattgcctaactacccagccattccctcagacgctacccttgaggtccagagcctgcgctccaacgacagtggtgtgtatcgttgcgaagttatgcacggcatcgaagatagtgaggcaacgttggaggttgtagtgaaagggatcgtgttccattatcgggcgatttccacccggtatacattagatttcgatagggcacagcgggcttgtttgcagaatagcgctatcatcgctactcccgagcaattacaagcagcctacgaggatggtttccaccagtgcgacgctggatggctcgctgatcaaacagtccgataccccattcacacaccgagagagggctgttatggagataaggatgaattcccaggcgtgagaacctacggaatacgagacacaaacgagacctacgacgtatactgctttgccgaagagatggagggcgaggtcttttacgcaacaagcccagaaaagttcacctttcaggaggctgctaatgagtgtcgaagactgggagcccggctcgccaccacaggccagctgtacctcgcatggcaagcgggtatggatatgtgtagtgccgggtggctggcagaccgcagtgttagatatcccatatctaaggcaaggcctaattgtggcggaaacttattgggcgtgcgcacagtgtacgtccatgccaaccagacagggtacccggatccttcctcaagatacgatgccatatgctacacaggggaagattttgtagatatccccgagaatttcttcggcgttggaggcgaggaagacatcaccgtgcagaccgttacttggccagatatggagctgccactcccaagaaatatcaccgagggcgaggcccggggatcggttatcctgacagtgaaaccaattttcgaagtgagcccatcccctctggaacctgaagagcccttcactttcgcccccgaaatcggtgcgaccgcgtttgcggaagtcgaaaatgagaccggagaggccacaaggccctggggctttcccacccctggacttggcccagctacagcattcaccagtgaggatcttgtcgtgcaggtgacagccgtgccaggacagcctcacctgccaggtggcgttgtgttccattaccgccccggtccaacccggtatagcttgacctttgaggaagcccaacaggcttgcctgcgcacaggggctgtgatagccagcccagagcagcttcaggctgcctacgaagccggatatgagcagtgtgatgccggttggctacgggatcagaccgttcgctaccccattgtctcaccccgtacaccttgcgtgggagataaggacagtagcccaggtgtgcgtacctacggtgtccggccaagcaccgagacctacgatgtgtattgctttgtggatcgtctggaaggagaggtcttctttgcgactaggctcgagcagtttacattccaggaagccctagaattttgtgaatcccataacgctacgctcgccaccacaggccagctctatgccgcctggtcaaggggcctcgacaagtgctacgcagggtggcttgccgacggatccctgcgctaccctatcgtaacccctcgacctgcctgcggaggggacaaacctggagttaggacggtgtatctctatcccaatcagaccggcctgcctgatcccctgagtcgacaccacgcattttgttttagaggtatatccgcggtgccctccccaggagaggaggaaggtggaacacctacaagcccttctggagtggaggagtggatcgtcacccaggttgtgccaggcgtggcagccgttccagtcgaggaagagaccaccgcagttccctccggggagactacagccatactggaattcacaacagagccggaaaaccaaaccgaatgggaaccggcctacacacctgttggaacatcacccctgcctggtatcttgcctacctggccacctacgggtgcggcgaccgaggaaagtacagagggtcccagtgcaacagaggtgccatcagccagcgaggagcctagcccgagcgaggtgcccttcccgagtgaagagccatccccttccgaggagccattcccctctgtgcgtccgttcccaagtgttgagctgttcccatctgaggaaccgtttccgtcaaaagagccttcacctagtgaggagccctcagcctctgaggaaccctatacaccttctccccccgtgccatcttggaccgaactgccttcaagcggcgaagaatccggagcacccgatgtgagcggggacttcaccgggtccggagacgtctccggacacctcgacttcagtggtcagctcagcggcgatcgagcctcaggactgccatctggagacctggacagttctggccttacaagcacagtgggtagcggcttgccagtcgaatccggactccctagcggtgacgaagagagaatagagtggcccagtactccgaccgtaggagagctcccctccggcgctgagattctagagggatctgcaagtggggtcggcgaccttagcggtcttccttctggtgaggtgctagaaacatccgcctctggcgtgggcgacctcagcggtcttccttccggcgaggtactcgagacaacagcgccgggcgtcgaagacatcagcgggctcccatccggggaagtactggagacaacagcccctggtgtggaggatatttccggcttaccatcaggtgaggtgttagagaccaccgcccctggcgtggaagatatatccggtttgccaagcggagaggttcttgagacaacagctcccggtgttgaagatatcagcggactgcccagcggggaagtcctggagaccaccgcgccgggcgtggaggatatttcgggtcttccttccggtgaggttcttgagactacggccccgggcgtcgaagatatttctgggctgccatcgggcgaggtattggagacggcagcgcctggcgtcgaagatatctccggactgccaagcggcgaggtgctcgagaccgctgccccgggcgtcgaggacatttctggcctgccctctggggaggtccttgaaacagctgcaccaggagttgaggacatctcgggcctgccgagcggggaggtcttagagacagcggcgcctggagtagaagacatttccggcctaccaagtggcgaagtcctggagactgcagctcccggcgtggaggatataagtggtttacccagcggcgaagtgcttgaaacagcggcccctggggtggaggacatctctggactgccttcaggcgaggtgctggagaccgctgcgcccggtgttgaggatatcagcggactgccctccggagaagtgctcgagaccgctgcgccaggggtcgaggatatttccggacttccatccggagaagttctggaaaccgcagccccaggcgttgaagacatcagcggtctgcccagtggtgaggtgcttgaaacagcagcacctggagtggaggacatttcaggcttaccaagcggagaggtgctggaaaccgcagcccctggggtcgaagacatttctggtttaccatccggtgaagtccttgaaacggcagccccaggggtggaagacataagcgggctgccaagcggcgaggtgctggagacagctgctcctggcgtggaagacataagcggattgcccagcggcgaggtgctggaaactgcagccccgggcgtagaggatataagtggactgccaagcggggaagttctggaaacagccgcccccggagtcgaagatatatccggactcccatctggggaggttttggaaaccgcggcaccgggagttgaggatatttccggactgccgtcaggggaagtcctggagaccaccgctccgggcgtggaggagattagtggcctcccgagcggcgaggtgctggagactactgcccctggtgtcgacgaaattagcggtctcccatctggcgaggttttggagacgaccgccccgggtgttgaagagataagcgggctcccgtctggagaggtgctggaaaccagcacctctgcggtcggtgacttgagcggactgccctctggaggagaggtgttggaaatctctgttagcggagtcgaggacatatccggtctcccatccggggaagtggtcgaaacaagcgctagcggcattgaggacgtcagcgagcttcctagcggagagggcctggagacatccgcctcgggcgtggaggacctgagccggctgccaagcggagaagaggttcttgagatcagcgcgagcggctttggggacctatctgggctgccatcaggtggtgagggactggagacatctgccagtgaagtcggaacggatctgtccgggctgcctagcggaagagagggcttggaaacgtcggcctccggggccgaggacctctccggccttccatccggaaaggaggacctagtggggagtgcctccggggacttagatcttggcaagttgccctcaggcacactgggctcagggcaagcacccgagacatccggcctcccatcggggttctccggcgagtacagtggagtggacttaggttcaggtccgcccagcggcctgcccgacttttcaggacttccttctggatttccgacagtctctctcgtggatagtaccctggtggaagtggtcacagcgtctacagcgtccgagctggagggaagagggacgatcggaattagcggtgccggcgaaatttccggacttccatcaagcgagctggatattagtggcagagcatcgggactcccatctggcacagagctctctggacaggcctcaggctctcccgacgttagcggtgagatccccgggctgtttggggtctccgggcagccctctgggttccctgacacatccggtgagacctctggcgttaccgaactgtctggactgtcaagcggccagcccggtatcagcggagaagcctcaggtgttctttacggcaccagccagccattcggaattactgatctttcaggcgagacatctggggtgccagacctctcagggcagcctagcgggcttccaggcttctcaggcgctacgtccggagttccagatcttgtgtctgggacgacaagtgggtcgggcgagtcctctgggataactttcgttgacacctctctggtggaagtagccccaacaacatttaaggaagaggagggtctgggaagtgtggaactttcaggtctgcccagcggtgaggcagacctctcaggcaagtcgggcatggtggatgtgagcggacagtttagcggcacggtcgactctagcgggttcacttctcagactccagagttctctggtttgccgagtggcatagccgaggtcagtggagagtcatcccgggcagagatagggtcatcccttccatctggcgcctattacgggagtggcacaccttccagtttccctacagtcagcctcgtcgacagaacccttgttgagagcgtcactcaggcaccaaccgctcaagaggccggagagggcccctccggaattctggaattgagcggcgctcactcaggcgcccctgatatgtccggcgaacactcgggtttcctggacctgtctggtttgcagtccggattgatcgagccgtctggggaaccaccgggtacaccctacttcagtggtgacttcgcctcgacaactaatgtgtctggagagtcttctgtcgcaatgggaacttcaggcgaggcctcaggtctgcctgaggtgacactcatcacttctgagtttgtggagggggtgaccgagccaactatcagtcaagaactaggccagaggcccccagtgacacacactccacagctgtttgagtccagcggcaaagtctcaaccgcaggtgacatcagcggagcaactccagtccttccgggtagcggggtggaagttagctcagtcccagaaagctcatccgagacctctgcgtaccctgaagcagggtttggcgcctctgctgcacctgaggcctcccgcgaggacagcgggtcccccgatctgtccgaaacgacatcggcttttcatgaagcgaacctcgagagaagctccggtttgggtgtgagtgggagcacactgacgttccaggaaggggaggcctccgccgctcccgaagtgtctggtgaatcgactacgacttctgacgtgggcactgaggccccgggcttaccctctgcaacccccactgcctccggcgatcgtaccgagatctcaggagatctgagcggtcacaccagccaacttggagtcgttattagcacatcaatccctgaaagcgagtggacgcagcagacccagagacctgctgaaactcaccttgagatcgaatcctcatccttgttatattccggcgaggagacccatactgttgagactgctacaagcccaacagacgcatcaataccggccagcccagagtggaagcgcgagtccgagtccactgccgccgatcaggaagtatgcgaggaaggttggaataaataccagggccactgctatcgccactttccagaccgtgagacgtgggtggacgcagagcgacgctgtcgggagcagcaatcccatctctcctctattgtcacccccgaggagcaggagttcgtcaataataacgcccaagactaccagtggataggactcaatgaccggaccattgaaggagactttagatggagcgacggccaccctatgcagttcgagaactggcggcccaatcaacctgataattttttcgctgctggtgaggattgcgtggtgatgatttggcatgaaaagggcgagtggaacgacgtgccatgtaactatcatcttccttttacttgtaagaagggcacagccaccacttacaagagacgcctgcagaaacggtcttctcgccaccctaggagatcccgaccctctacggcccactag

SEQ ID NO: 178531 - DNA, 7593 bp, Artificial Sequence
  Description of Artificial Sequence: Synthetic coding sequence
atgaccaccctgctgtgggtgttcgtgaccctgcgggtgatcaccgccgcagtcaccgtggaaacctctgaccacgataatagcctgtctgtcagcatcccacaaccttcacctctgcgagtgctgctgggtacctctctgaccatcccttgctacttcatcgatcctatgcatccggtcactacagccccttcgaccgcacccctggcgccacgaatcaagtggtcacgcgtaagtaaggagaaggaggtagtactattggttgccactgagggccgggtaagggtgaacagtgcctatcaggataaagtaagcctgcctaattatcccgccattccatccgatgccacccttgaagtgcaatccttacgctccaacgactctggggtctataggtgcgaggtaatgcacgggatcgaggatagcgaggctacactggaggtggtggtaaaaggtattgtgtttcactatcgggcaattagtacaaggtacacattggatttcgacagggcccagcgagcatgcctgcagaacagcgcgatcatcgcaactccggaacagctgcaggctgcatatgaggacgggtttcatcagtgcgatgcaggatggctagccgaccagaccgttaggtaccctatccatacccccagagaaggctgctatggggacaaggatgagttccctggggtgcggacttatgggatccgtgatacgaatgagacctacgacgtgtactgctttgcggaagagatggagggggaagtcttctatgcaacctcgccagagaagttcacattccaggaagccgctaatgagtgcagacggctgggagctcggctagccaccaccggtcagctgtatctggcttggcaagctgggatggacatgtgtagtgcagggtggctggccgatcgcagcgtgagataccccatcagcaaagccaggcccaactgcggcggtaatttgctgggtgttcgcactgtatacgtgcatgcgaaccagactgggtatcccgaccctagctcccggtacgacgcaatctgctataccggggaggactttgtggatatcccagaaaatttcttcggggtgggtggcgaggaggatatcacggtgcagacggtgacctggcccgacatggaactacccctgcctcggaatatcaccgagggcgaggctcgcgggagtgtgattctaacagtgaagcctattttcgaggtatccccctcccccctggaaccagaggaaccattcacgtttgctcccgaaataggggcaaccgccttcgcggaagtggaaaacgagacaggggaagcaactagaccatggggtttccctaccccaggactaggacccgctactgcgttcacctctgaggacctcgtcgtgcaggtcactgcagtgccggggcagccacatcttcccggcggcgtagtatttcactataggccgggacctactcggtactcacttacattcgaggaggctcagcaggcttgcctgcgtaccggcgccgttatcgcctctcccgaacagctacaggccgcatacgaggcaggctatgagcaatgtgacgccggctggctgcgagatcagacagtgaggtaccccatagtatctcccagaaccccatgtgttggggataaagattcaagtcccggggtaaggacctacggagttcggcccagcaccgaaacgtatgacgtatattgcttcgtcgataggctcgagggagaagtatttttcgctacaaggctggaacagtttacatttcaggaagccctggagttctgtgagtcgcacaatgcaactcttgcgaccaccgggcagttgtatgcggcctggtcaaggggtctggataagtgctatgcagggtggttagctgacggaagccttcgctaccctatcgtgacccctcgtcctgcttgcgggggcgacaaaccgggggtgcgtaccgtgtacctgtatccaaaccagactggattaccagacccccttagcagacaccatgccttctgttttagagggatctcggccgttcccagccctggcgaagaggagggcgggacaccaacatccccttctggcgttgaagaatggatcgttacacaggtcgtgcccggcgttgccgcagtgccagtcgaggaagaaaccaccgctgtcccctcaggagagacaacagccattctcgaattcaccacagagcccgaaaatcagacggaatgggaaccagcctacacaccagtgggaacaagccctttgcccggaatcctgccaacatggccccccactggagcagcgactgaggagagtacagaaggcccttccgccactgaagtaccaagtgcctctgaagaaccctccccctcagaagtgccttttcccagtgaggagcccagtccctcagaggaaccatttcctagtgtccggcccttccccagcgtcgaactgttccccagcgaagaaccttttccatcaaaggagcccagccccagtgaggagccaagcgcttcagaagagccatacaccccatcaccgcctgtgcctagctggacagaactgccatcgagcggtgaggaatctggggccccggacgtctctggggattttaccggcagcggagacgtgagcgggcacttagacttttcaggtcagctctccggcgacagagcatcaggcctgcccagcggcgatcttgattctagcggccttaccagcacagtgggctccggattacctgtcgagtctgggctgccctctggggacgaggaacgcattgaatggccctctacccctaccgttggggaactcccatctggagctgagattttggagggctccgcctcaggggtcggtgatctgtcgggcctccctagcggtgaagtgctcgagacatctgcgtctggcgttggtgacctctcgggccttccttccggcgaagtcctggagaccacagcccccggggtcgaagacattagtggcctgccgtcaggcgaagtgctcgagacaacggcacctggggtggaagatatctccggcttgccctccggagaagtgctcgaaaccaccgcccccggtgtggaagatatttccggcttgccaagtggagaggtgctcgagaccacagcccccggagtggaagatattagcggcctgccttctggtgaggtgctggagacgaccgccccaggagttgaggacatcagtggtttgccatcaggcgaagtcctggagaccacagccccaggggtggaggatatttcaggactgccctctggcgaggtcctcgaaacagccgctcctggcgtcgaggatataagcggcctgccgtccggagaggtgcttgaaactgcagctcctggcgtggaagatatcagtggactcccgtcgggcgaggtactggagacggctgctcccggcgtggaagacatctcagggttaccatccggggaggtcttggagacagccgcccccggggtggaagatatttccggactaccatccggggaagtgctcgagacagcggctcctggtgtggaagacatcagcggacttccttccggggaagtactggagacagctgccccaggagttgaggatattagcgggctccccagcggggaggtattggagacggctgcccccggagttgaagacatctccggcttacccagcggagaggttctggagactgctgcccccggagtggaggacatcagcggtctgccatccggcgaagtgttggagaccgctgccccaggagtggaggacatcagtggactcccctctggggaggtactggagactgcagcccccggcgtcgaggatatttccggtctgccctccggcgaggtcttggagaccgcagctcccggagtcgaagatatctccggactcccgagtggagaagtcctggagacagcagccccaggagtggaggatatatctgggcttccatccggcgaagttctagagacagccgcccccggcgtggaagacatttcaggtctcccatcgggggaggtgctcgagactgctgcccctggggtcgaggacatatcaggactgccatctggcgaggtcctggagacagccgctcctggagttgaggatatctctggtctgccctccggcgaggtgctggagactgctgcacccggcgtagaggatatttccggccttcccagcggggaagttctagaaacaaccgcgcccggagtagaggagattagcggcttgccttcaggagaagtcctagagaccacggcccctggcgtggatgagatttctggacttccctctggcgaagtgctggagaccaccgcccctggcgtggaagagatctctgggttgccatccggcgaggtactggagacttctactagcgctgtaggagatctttccggactgcccagtggcggagaggtcctggagattagcgtgtctggtgttgaagacatctctggcctgccaagtggcgaggtcgtggaaacatccgcatctggaatagaagacgtttcagaactgccctctggggagggtctggagacctccgcatctggagttgaagatttgtctagacttccatctggtgaagaggtgttggagatctccgcgtcggggtttggcgacctcagtggcctgcctagcggtggcgaaggcctcgagaccagcgcctcagaagtggggacagacctgagtggattgcctagtggacgggaaggtcttgaaacgagcgcttccggcgctgaggacctgtctggtctcccttcggggaaagaggatctggtgggcagcgcctccggggaccttgacttgggcaaattaccatccggcacacttgggtccggccaagcccctgaaacctcaggacttccatctgggttctccggtgagtacagcggagtcgacctcggcagtggacccccgagcggactccctgatttctcagggttgccttcaggattccctactgtgagcctggttgattctacattggttgaggttgtgacagcctccacggcatcagagctggaaggccgaggcacgattgggatatcaggggccggcgagatatctggcctccccagttctgaactagatatcagcggtcgcgcttcgggactccctagtggcactgaactatccggacaggcctctgggtcaccagacgtgagcggggaaattcctggtctgttcggggtctctggacagccttcaggcttccctgatactagcggagagacctccggagtgacagagctgtccggcttatcctccggccagccagggatcagcggagaagcgtccggtgtactgtatggtacatcacagcccttcgggattaccgacttgagcggggagacatcaggagtgcccgatctttctggtcaaccttctggactgcctgggttctccggcgccaccagtggcgttcctgatttggtgagcgggaccactagtgggtctggagaatcctcaggcatcacatttgtagacacctccctagtggaagtcgcccccactacattcaaagaagaagagggactcgggagtgtcgaactttccggacttccatccggcgaagcagatctcagcgggaaatctggcatggtcgacgtgtcgggccagtttagcggcacggtcgactccagtgggtttacgtcacagacccctgagtttagcgggctcccctctggcatcgccgaggtgagcggcgagagctcacgcgccgagatcggttcctccctgccctcaggggcttactacgggagcgggactccatcttcttttccaaccgtgagtctcgtggaccgcacattagtcgaatctgtcacacaggctcccactgcacaagaggcgggtgaaggcccatccgggatcctcgagttaagcggcgcacactcgggagccccggacatgtccggggaacatagcgggttcttggatttgtcgggcctgcagagcggcctcattgagccgagcggagagccacccgggaccccttacttcagcggcgacttcgcatcaaccacaaacgtgtcaggggagtcgagcgtggccatgggcaccagtggcgaagcttctggcttgccggaggtaactctcataacgagcgagttcgtggagggggtgactgaacccaccatctctcaggaactgggccagagacctcctgtgacgcatactccccagctcttcgaaagcagcggcaaggtctcaacggcaggagacatttcaggggcaaccccagtcttaccaggaagtggcgtggaggtgtcttcagttccggaaagttctagtgaaaccagcgcctatcctgaagcaggatttggcgctagtgctgcacccgaggcctctagagaggactccggtagccctgatttgtctgagaccacaagtgcttttcacgaggccaatcttgaacggtcttctggtctgggtgttagcggctcaacattgaccttccaagaaggcgaggcatctgccgcccctgaggtgtctggagaaagtaccacaacaagcgatgtggggactgaggcccccggcctgccctctgcgacgccaactgcctccggcgaccggacagaaatctcaggcgacttaagcggtcacacatcgcaactcggggtcgtcattagcacaagtatccctgaatccgagtggactcaacagacacaaaggcccgcggagacccaccttgaaattgagagttccagtctgctgtatagtggagaagagacacacactgtcgaaaccgcgacctcacctactgacgcttccattcccgcgagcccggaatggaagagggaaagcgaaagcacagccgcggcgcctgctcggtcttgcgcggaggagccatgcggtgccggcacgtgtaaagaaaccgaggggcacgttatctgcttgtgtccccccggatacactggcgagcactgtaacatcgatcaggaggtatgtgaggaaggatggaataagtatcaaggccactgctatagacacttcccggacagggaaacctgggtggatgctgaacggaggtgtagagagcagcagtctcatctttcatcaatagtaacaccagaggagcaggaatttgtgaacaataacgctcaagattaccagtggattggtctgaacgatcgaacaatcgagggtgatttccgttggagcgacggacacccaatgcagtttgaaaactggcgccccaaccagcccgataatttctttgccgcaggggaagattgcgtggtgatgatatggcacgagaagggagagtggaatgacgtcccatgcaactatcatctgccttttacctgtaaaaagggcaccgttgcttgcggggagcctccagtggtggaacacgccaggaccttcggacagaaaaaggatagatacgagattaactctctcgtgcgctaccagtgcaccgaggggtttgtccagagacatatgccgaccataagatgtcaaccctcaggtcattgggaggaaccgcaaattacctgcacagaccccacaacctacaaaagaagactccaaaagcgtagttcaaggcatccgcgaagaagtagaccatctaccgctcactag

SEQ ID NO: 178532 - DNA, 7479 bp, Artificial Sequence
  Description of Artificial Sequence: Synthetic coding sequence
atgaccaccctgctgtgggtgttcgtgaccctgcgggtgatcaccgccgccgttactgtcgaaacctctgaccatgacaactcccttagtgtttcaattccccaacccagcccactgagggttctgctcggaacctctctcactattccttgctacttcatcgaccccatgcaccctgttacaacagccccctcgacagcgcccctcgctcctcgtatcaagtggagccgggtttcaaaagaaaaggaagtcgtgcttctggtggctacagagggtcgagttagagtcaacagcgcctatcaggacaaggttagcctacctaactacccggcgatccccagtgacgctacactggaggtccaaagcttgagatctaacgacagtggagtgtaccgatgcgaggtaatgcacggcattgaggatagcgaggcaacgctcgaggtcgtcgtgaagggtatcgtttttcattacagggccatttctactcgttacacactggatttcgacagagctcagcgggcttgtctacagaactccgcgattatcgctacacctgagcagctccaggccgcttacgaggacggatttcaccagtgtgatgccgggtggttagcagaccagactgtgcgctacccgatacatacccccagagaagggtgctatggtgataaggacgagtttcctggcgtgcgtacatacggcataagagataccaacgaaacatatgacgtatactgttttgcagaggaaatggagggtgaggtcttttatgctacttcacctgaaaaatttaccttccaagaagcggccaatgagtgcaggcggttgggtgccaggctcgcgactacagggcagctgtatctggcctggcaggctggtatggatatgtgcagcgcaggctggctggctgatcgaagcgtccgttatcccatttcgaaagctaggccaaattgcggcgggaaccttctcggtgtacggactgtgtacgtgcatgccaatcaaaccggatacccagacccatcctcccgttacgacgctatctgctataccggggaagacttcgtggatatccctgagaacttcttcggagtgggaggtgaagaagacatcaccgtccagacagtcacatggcccgacatggaactgccgctgccacggaatatcaccgaaggcgaggccaggggctctgtcatactgaccgtcaagcccatttttgaagtgtctccatcccccctggagcctgaggagccatttacattcgctcccgaaatcggcgcaactgcttttgcagaggtcgagaacgagactggggaggcaactcgaccatggggcttccctacacctggtttagggccagctaccgccttcaccagcgaagacctagtcgtgcaagtgaccgccgtgcctgggcagccccaccttccgggcggcgtagtgtttcactacagacctggcccgacacgctacagcctgaccttcgaagaagcgcagcaggcctgccttcgcaccggtgctgtgatagcaagtcctgagcagctgcaggccgcttatgaggccggctacgagcaatgcgatgcaggttggctgcgagatcagactgttcggtaccccatagtttcaccgagaactccctgcgtaggcgacaaagactctagccctggagtgcggacctacggagtcaggcctagcaccgagacatacgacgtgtattgttttgtggacagactggagggggaggtgttttttgccacacgacttgagcagtttacatttcaggaggcacttgagttttgcgagtcccataacgcaactcttgccaccactgggcagctgtatgctgcgtggtcccgtggattggacaaatgctatgctgggtggctggctgacggctcgcttcggtacccaattgtcacccctcgtcccgcgtgtggcggggacaagcccggggtgcggaccgtgtacctctacccaaatcagactgggctccctgatcccctgtcaagacaccatgctttctgctttcggggtatctccgctgttccaagcccgggcgaagaggagggtgggacccctacatccccctctggcgtcgaggagtggatcgttactcaggtcgtccccggggttgctgccgtgcctgtggaagaagaaacaacagcagtgccgagcggcgagactactgctatcttggagtttaccaccgaaccagagaatcagactgaatgggagcctgcttatactcctgtcgggactagcccactcccaggaatcctgcccacctggccgccgactggggctgctactgaagagtccaccgagggcccgtcagcaactgaagtgcccagtgcttccgaagagccctcaccatcggaggtgccgttcccaagcgaagagccctcaccatcggaagaacctttcccaagtgtccgaccatttcctagtgtggaattgtttccctccgaggaaccttttccctcaaaggagccttctccttctgaagagccatcagcctctgaagaaccctacactccctcaccccctgtcccaagctggacagaactgccctctagtggagaagaaagcggggctcccgatgtctcgggtgattttactggctctggggacgtttccggacatctcgatttctccggtcaattgagcggagacagggcttctggtctcccctctggtgaccttgattcaagcgggctgaccagcacagtcggatctgggctgcccgtggaatcaggacttccttctggcgacgaggaacggatcgaatggccatccacaccaaccgtcggcgaactcccgagcggagcggaaatcctcgagggaagcgcctcaggtgtgggcgatctctccggcctgcctagcggggaagtgctggagactagcgccagcggagttggtgatttgagtgggctgccctcaggagaagtcttagaaacgactgcgcctggcgtcgaagacatttcaggacttccctccggggaggttctcgagaccaccgcgcccggagtcgaagacatttcaggattgccatctggcgaggtgctggaaaccaccgctcccggggttgaggatatatccggcctcccgtccggagaagtactggaaaccaccgcacccggagtcgaagacatcagcggcttacctagcggggaagtccttgaaactactgcgcccggagttgaggatattagtggcttgccttctggcgaggttctggagaccaccgctcccggtgtggaagacatcagcggattgccttccggcgaggtgctggagacagccgccccgggggtggaagatattagtggtctcccttccggggaagtgctcgagaccgccgcgcccggcgtagaggacatctctggcttgcctagcggggaggtcctcgagaccgctgcccccggagtagaagacataagcggactgccttcaggggaggtactagagaccgcagcacctggagtggaggatatttctggtctgcctagcggggaggttctggaaaccgcagccccaggcgttgaggacatctctggcctgccaagtggtgaggtgttagagacagctgctcccggagtggaagacatctccggattgcctagcggagaagtgttggagaccgcagcgccaggtgtggaagacataagcggtctgccttctggagaagtcctggagaccgccgcaccaggcgtagaagatatatctggccttccatccggcgaggtgctcgagaccgccgcacctggagtcgaggacataagcggtctcccctccggcgaagtgctggaaacggctgctcctggcgtcgaggatatctcgggactaccaagcggcgaggtgctagagaccgccgcccccggagtggaggatatcagcgggttgccttcaggcgaagtcctagagaccgccgcacctggcgtggaggacataagtggcctgcccagtggggaagttctggagacagccgcaccgggagtcgaagatatctccgggctgcccagcggcgaagtactggagaccgctgcaccaggcgtggaggatatcagcggactgccttcaggcgaggtgctggaaaccgccgcgcccggagtagaggacatcagcggattgccatccggtgaggtcctcgagactgcagcaccaggagtggaagatataagtggactccctagcggggaggtactggaaaccacagccccaggtgtggaagagattagtggtctgccttctggtgaagtgctcgaaaccaccgctcctggagtggacgagatcagcgggcttcctagtggtgaagttcttgagactaccgcgcccggtgtggaagaaatatcaggcctgccctctggcgaggttctagaaactagcaccagcgcagtgggggatttgtcaggcctgccttccgggggcgaggtgctggagataagcgtgagtggggtggaagacatctcgggccttccctctggcgaagtggtggaaactagcgcaagtggtatagaggacgtgtcagagctgccaagcggggaaggcctggaaaccagtgcctccggcgttgaggatctaagtcgcctcccgtccggggaagaagtacttgaaatttccgcatccggttttggagatctatccggtcttccctctggtggcgagggcctggaaacctcggctagcgaggtaggtaccgacctttctggactccctagcggccgtgaaggactggaaacatctgcctcgggggctgaggatctgagtggattgccatctggaaaagaggacctggtaggcagcgccagcggggacctcgatcttgggaagctcccaagtggaacgctgggctctggtcaggctcctgagacctcaggcctcccttcaggattttctggagagtactccggagtggaccttgggagcgggccaccctcagggctgccggactttagcggcctcccgtccgggtttcctaccgtaagcttagtcgactccactctcgtggaggtggtgactgcatctacagcttctgagcttgagggcaggggcacgattggcatatctggggcaggggagattagcggcttaccgtcatctgagctagatatttctggccgcgcaagtggccttccctctggcacagagttatcaggacaggcaagcggatcccctgatgtgagtggagaaataccgggcctctttggtgttagcggtcagccctcggggttcccagacacttcaggagaaacctccggcgtgactgaactctctggactttcatctggtcagcccgggatctccggtgaagcttccggcgtgctgtacggtacctctcagccatttggtattacagatctcagcggcgagaccagcggcgttcctgacttgagcggtcagccctccggcttgccagggtttagtggggccaccagtggcgttccagatcttgtgtcaggaacgacctcaggctcgggcgagtcttctgggatcacatttgttgacacttccttagtagaggtagcgcctactactttcaaggaggaggagggccttgggagcgtggaactcagtggtctcccttccggagaggccgacctgagcggtaagagcgggatggtggacgtgagcgggcagttctccgggacggtggacagttctggctttacatctcaaactcccgaattttctgggctgccaagcggcattgcggaggtctcaggcgaatcctcgagagccgagatcggcagctcactgccttccggagcatactatggttctggcacaccaagttcctttcctactgtcagtctggtggatagaactctagtcgagagcgttacccaggcaccgacagcgcaggaagcaggggagggtccatctggaattctcgagttaagcggggctcattccggggccccagacatgtctggcgaacatagcggctttctggatctgtctggtctccaaagtggcctcattgaaccctcgggcgagccgcctggcaccccttatttctccggcgactttgcctctacgaccaacgtgagcggagagtcatctgtcgctatgggaaccagcggggaggcttcaggcctgcctgaggtgacacttattacttccgagttcgtggagggcgtcacagagccaactattagccaggagctgggccagaggccccctgtgacgcacactccccagctctttgagagctctgggaaggtgagcacagcgggcgacattagcggtgccaccccagtacttccaggatcaggggttgaggttagcagtgtgcctgaaagtagctccgaaactagcgcctacccagaggctgggttcggcgccagcgcggcccctgaggcctccagagaggatagcgggagccccgacctgagcgagacaacctctgcattccatgaagcgaaccttgaacggtccagtggcctgggggtgtcaggatccacacttactttccaggaaggtgaggcttctgctgcacccgaggtcagcggtgagagcactactactagtgacgttgggactgaagctccaggattaccaagcgcaacacctaccgctagtggtgaccggaccgagatttcaggggacctgtcaggccatacgagtcagctgggggtcgttatctcgacatccatccccgaaagtgaatggacgcaacagactcagagacccgccgagacacacctggagatagaatccagtagcctgctgtattccggtgaagaaacccacactgtggagaccgccactagccccacagacgcttcgattcctgcttcgccagaatggaagcgagagtccgagtcgaccgcagccgaccaggaggtctgcgaagagggttggaacaagtaccaggggcactgctataggcatttccccgatagggaaacttgggtagacgcagagaggagatgccgggaacaacagtcccacctgagctcaatcgtcacacccgaagagcaggagtttgttaataataatgcccaagactaccagtggattgggttaaacgatagaacaatagagggggattttcgatggtcagatggccaccccatgcagtttgaaaactggcgccccaatcaaccggataatttttttgctgcaggcgaagactgtgttgtcatgatctggcatgagaagggcgaatggaatgacgtgccttgcaattaccacttgccttttacttgcaagaaaggaaccgtagcttgcggtgaacctcctgtcgtagaacacgctagaaccttcggtcaaaaaaaggatcgatatgagattaactctctcgtaaggtaccaatgtaccgaagggtttgttcagaggcacatgccaactataagatgccaaccatccggccactgggaggagccacagatcacatgcacggacccgacaacttacaagcggagactgcagaagcgaagcagtcggcatcctcgcagaagccgcccctccaccgcccattag

SEQ ID NO: 178533 - DNA, 7593 bp, Artificial Sequence
  Description of Artificial Sequence: Synthetic coding sequence
atgaccaccctgctgtgggtgttcgtgaccctgcgggtgatcaccgctgccgtgaccgtggaaactagtgaccacgataacagtctctcagtgagcatccctcagccatctccactgcgcgttcttcttggtacctcactgaccatcccgtgctactttatcgatccaatgcacccggtcacaacagccccatcaaccgccccgttggccccccgcataaagtggagccgagttagcaaagagaaagaagtagtattgctggtggcaaccgaagggcgggtgagggtcaatagtgcctaccaggataaggtgtctttacctaattaccccgcaattccatccgatgccacattagaagtgcagtctctgcgcagcaacgacagcggcgtctataggtgcgaagtaatgcacggtatcgaagattccgaagcaacgctggaagtcgtggttaagggcatcgtatttcactaccgggctatctcaactcggtacacactggattttgaccgagcccaaagggcatgtctgcagaacagcgcaatcattgccacgccagaacaactgcaagccgcctacgaggacgggtttcaccaatgtgacgcagggtggctggccgatcagacggtcagatacccaatacacaccccgcgggaaggctgttacggagataaggacgagtttcccggagtgcgcacatacgggattagagacactaacgagacatacgacgtttactgtttcgcggaggagatggaaggcgaagtgttttatgccacatctccagagaagttcacctttcaagaggccgctaatgagtgtaggcgactcggcgcgaggctggcgactaccggccagctttacctggcatggcaggctggtatggatatgtgtagtgcgggttggctggcagacagatctgtgcgctatcctatttccaaagcacgaccaaattgcggaggaaatctgttgggcgtaaggactgtctatgtgcacgccaatcaaacaggctatccagatccctcttcgagatatgacgcaatttgttacacaggagaggacttcgtggatatcccagagaacttctttggggtgggaggagaggaggacatcaccgtccagacggtcacgtggccagatatggagcttcccctgccgagaaatattaccgaaggagaagctaggggttccgttattctcacagtgaagcccatttttgaggtcagtccaagccctctggagccagaggagccttttaccttcgcccccgagattggggcaacggcatttgccgaagttgagaatgagaccggagaagctaccagaccctggggatttcccacgcccggcttggggccggctactgcattcacttcggaggatctcgtggttcaggtaaccgcggtgcctggccaaccgcacctgcccggcggtgtggtctttcattaccgcccgggtcctacgcgttactcccttacatttgaggaggcacaacaggcttgcctcaggaccggggccgtgattgcgagcccagagcaactccaggcagcctatgaggctggctatgaacagtgtgacgctggatggctgagggaccagaccgtacgctacccaatcgtgtcgcccagaactccttgtgtcggcgataaagactcctccccaggggtccgcacttatggggtgcgccccagtactgaaacttatgatgtgtattgcttcgtggacaggctcgagggagaagtgttcttcgcgaccaggttggaacagttcacatttcaggaagccctcgagttctgcgagtctcataatgctactctggcgacaaccgggcagctctacgcagcctggtctcgaggcctcgataaatgctacgcaggctggctggcggacggctctttgcggtatccaatagtcacgcccagacctgcatgtggaggagacaagcccggcgttagaaccgtttatctgtaccccaaccaaacagggctaccagatccgcttagccggcatcacgccttctgttttcgggggatatcagccgttccctctccaggggaggaagaggggggcacacccacatcacctagtggagttgaagaatggatagtaacccaggtggtgcccggggtagcggccgtgcctgtggaggaagagactaccgccgtgccaagcggagagactacggccatcttagaattcacaaccgaaccggaaaaccagaccgaatgggagcccgcatacactccagtaggtacaagccctctgccagggatccttccaacttggccacccactggggccgctaccgaagagagtacagaagggccatctgccaccgaggtgccctccgcgtctgaagaaccatcaccttctgaggttccatttccctccgaggagccttcacccagcgaggagccttttccctccgtgagaccttttcccagcgtggaactctttcccagcgaagaaccatttccgagcaaggagccttccccatcggaagagccatccgcctcggaagaaccttacaccccttcgccacctgtcccttcctggaccgagctgccttcgtcaggcgaggagagtggggctccggacgtgagtggggactttactggcagcggggacgttagcggccacttggacttttctggccagctgagcggcgatagagctagcgggctgccctccggggacttggatagcagtggcctgacatccaccgtaggctctggcctacccgttgagtcaggactgcccagcggggacgaggagcggatcgagtggccctctacaccgaccgttggcgaactcccctccggggcagaaatcctggagggaagtgcgagtggcgttggagacttgtctggtctgcctagtggtgaggtcctcgagacttccgcttccggggtgggagatctgtctggattgccaagcggcgaggtcctcgagacaactgccccaggggtggaagacatatcaggactgccctcgggggaggtcctggaaacaaccgcccccggcgtagaagacataagcggactgccttcaggagaagtgttagagacgaccgcccccggagtcgaggacataagcggattacctagtggcgaggttctggagacgacagctcccggcgtcgaagatatatctgggcttccgtcaggtgaagtgcttgaaacaactgcacccggcgtggaggacatctctgggcttccttcaggggaggttctggagactacagctcctggtgtggaagacatatctggactccctagcggggaagtgttggagactgctgctccgggggttgaggatataagtgggctgccttctggggaggtgctagagacagccgccccaggcgtcgaggacattagcggcctgccctcaggtgaggtgctggagacagcagcaccaggagtagaggatatctccggcctccctagcggggaggttcttgaaaccgcagcacccggggtcgaagatatctccgggctgccttccggcgaggtgctggagactgcagctccgggtgttgaggatatatccgggctgccttcgggcgaagtgcttgaaactgctgctcccggcgtcgaggacatatccgggctgccctctggcgaggtcttggagactgctgcaccaggggtcgaggacattagtggcctgccgtctggcgaagtcttggaaacagcggcgccgggagttgaagatattagcggattgccatcaggcgaggtcttagagacagccgcccccggagtcgaggatatctctggactgccatctggagaggttctcgagacagcagcacccggcgttgaagatatatctgggctaccgtcgggcgaagttctggagaccgcggcccctggggttgaagatatatcaggcttacccagtggtgaagtccttgagaccgccgctccaggggtagaggacattagtggactgccaagcggcgaggtgcttgaaaccgccgcacccggtgtggaagacatttctgggttacctagtggggaggtgctggagactgccgcccctggcgttgaagatatttccgggctgccctcaggagaggtgctggaaaccgcggcaccgggcgtagaagatatttctggtctgccctccggagaggtactggagacagcagcccctggagtggaagatatcagcggactgcctagcggcgaggttctcgaaaccacagcacccggggttgaagaaatttcgggtctgcctagtggcgaggtgctcgagactaccgctccaggggtagacgagatctcagggctgcctagcggagaagtccttgaaacaactgcacccggcgtcgaagagattagcggtctaccgtctggcgaagtgctggagacatccacatctgccgttggtgatctgagcggcctgcccagcggcggcgaggttctcgagattagtgtgagcggcgtggaagacatttccggcctaccttccggcgaagtggttgaaactagtgcaagcggtatcgaagatgttagcgaactgccttctggggaagggctggagacttccgcctctggcgttgaggacttaagtaggctgccgtctggagaagaagttctggaaatatctgctagcggattcggggacctgtccggccttccaagtggaggcgagggtctcgaaacatccgcctccgaggtgggtacagatctcagcggactgccatccggccgtgagggcttggaaacatccgcatctggggccgaagacctctcaggtttgccaagtggcaaggaagacctcgtcgggtccgcctcaggtgaccttgacctgggtaagctgccatccgggacgctgggcagcggtcaggctcccgagacttcaggcttgccatccgggtttagcggcgagtatagcggcgtggacctgggatctggccccccgagcggccttcccgatttttctggactgcctagcggatttcctaccgtaagtctcgtcgactctacacttgttgaggtggtcacagcctcaacggccagcgagctcgaaggccgcggcaccatcgggatatcaggcgcaggggaaatatcaggcttacccagttccgagctggatatatccggaagggcctcgggactgcccagcggcacagagcttagcggccaggcctcaggctcccctgatgtgagcggcgaaatccctggactgttcggggtctctggtcaaccttccgggtttcctgacacatctggagagaccagcggcgtaactgaactctccggactgtcaagtggacagccaggaatttctggcgaggcctcaggcgtgttgtacgggacttctcagcccttcggaatcactgatctgagcggcgaaacaagcggcgtgcccgacctaagtggccaaccgagtggcctaccagggttctccggggctacttctggcgtgcccgatctggtgagcggtactacctctggtagtggcgaaagctctgggattactttcgtggataccagccttgtagaggtggctcctaccacattcaaggaggaagaagggcttggatctgtggagctcagcggactcccatcaggcgaggccgacctgtccggcaaatcaggcatggtggacgtttcaggtcaattcagtgggacagtcgattcttcagggtttacaagtcagacgcctgagttttcgggtttacctagtggcatcgccgaggtgtctggcgagagctctcgagccgagattggttcaagcctgcccagtggagcgtattacggaagcggcaccccttcatcatttccaaccgtgagcctcgtggaccgcaccttggtagagtctgtcacacaggcgcccactgcacaggaggccggggagggcccaagcggaatcctcgaactcagcggggcgcattcgggggcgccggatatgagcggggagcactctgggtttctcgatctgtcaggactgcaatccggcttgattgagccttccggggagcctcccggcaccccttacttctcaggagacttcgcttctactacaaatgtgagtggggagagctcggtcgcaatgggtacatcgggcgaggcgtctggcctgccagaggttactctgatcacaagtgagtttgtagaaggcgtgaccgagcctactatatcccaggaactaggccagagaccccctgtgacacatacacctcagctgttcgagtcctccggaaaggtttccacggctggcgacatctctggcgcaacccctgtgcttccggggagtggtgtggaagtatcaagcgtcccggaaagcagctctgagaccagcgcgtatcccgaagccggctttggggcctctgccgcccctgaagctagtcgtgaggattctggcagccctgatctgtctgagacaacttctgcctttcatgaggctaatcttgagaggagtagcgggctgggtgtgagcgggagcacactgactttccaggagggagaggcctcagctgctccagaagtaagcggcgaatccacgactacctcggatgttggaactgaggcccccgggctgccttcagccacgcctactgcaagtggggaccgaactgaaattagcggggatctgagcggacatacttctcagctcggtgtggtgatttcaacctcaatacccgagagtgaatggacccagcagacgcagaggccagccgagactcatctggagatcgaaagctcctcattgctgtactctggggaggagacacataccgtggagacagccacatctccaactgatgcctccatccctgcgagtcctgaatggaagcgggagtccgagtcaacagcagccgctcctgcaaggtcatgcgccgaagagccttgtggggctggcacatgcaaagagactgagggccatgtcatctgcctgtgcccacccggttataccggcgaacattgtaacatcgaccaggaggtatgcgaagagggttggaacaagtatcagggacactgctatcggcattttccggacagagagacatgggtcgacgccgagcggcgctgtagggaacaacagagtcatctttcttcgattgtgactccagaggagcaggagttcgtaaacaataatgcacaggattatcagtggatcggactgaacgaccggacaattgaaggggatttcaggtggagcgatggccatcccatgcagtttgaaaactggagacctaaccagcccgataacttctttgccgcaggcgaagattgcgtggtgatgatttggcacgagaaaggagaatggaacgatgtcccctgcaactatcatctgcccttcacatgtaagaaaggtacggtcgcatgcggtgagccccctgttgtcgaacatgctaggactttcggtcagaagaaggatcggtacgaaatcaactctctggtgcgctatcagtgtaccgaggggtttgtgcagagacacatgccaaccattcggtgccaaccctcggggcactgggaggaaccccagatcacctgtactgatccaacaacctacaagaggcggctgcagaagcgctcaagcagacaccccaggaggtctaggccatctactgctcactag

SEQ ID NO: 178534 - DNA, 399 bp, Artificial Sequence
  Description of Artificial Sequence: Synthetic coding sequence
atgctgaccgccgccgtgctgagctgcgccctgctgctggccctgcccgccactcgaggggcccagatgggactagcccctatggagggaattcggaggcctgatcaggcgctacttcccgaactgccgggtctgggactgagagcgccacttaagaagactacggctgagcaagctgaagaggatctcctgcaggaagcccaggctctcgcagaagttttggatctccaggaccgggaacctcgatctagccgacgctgcgtgcgactgcacgagtcctgcctgggccaacaggtgccttgttgtgacccctgtgcaacatgttactgccgctttttcaatgctttttgctattgtagaaaactgggcaccgcgatgaacccatgtagcaggacctag

SEQ ID NO: 178535 - DNA, 399 bp, Artificial Sequence
  Description of Artificial Sequence: Synthetic coding sequence
atggacgtgacccggctgctgctggccaccctgctggtgttcctgtgcttcttcactgccaacagtcatctgccacccgaggagaagcttcgcgacgatagaagcttgagaagtaattcatccgtaaaccttcttgacgtcccaagcgtgtcaatcgtggctttgaataaaaaatctaaacaaatcggcagaaaggcagctgaaaagaaacgaagcagtaagaaggaagccagcatgaagaaagtagtgcgccccaggacacccctatctgcaccatgtgtcgccaccagaaatagctgcaagcctccggcccccgcgtgttgcgacccgtgcgctagctgtcagtgtcggtttttccgatctgcttgttcgtgtagagtgctgagcctcaattgttag

SEQ ID NO: 178536 - DNA, 936 bp, Artificial Sequence
  Description of Artificial Sequence: Synthetic coding sequence
atggccctggaggtggtgttcctggcccggggccccagcggcctgctgctgtacaacggacagaagaccgatgggaaaggagactttgtgagtctggcattgagggatcgtagactggagtttcgatacgacctgggtaaaggggctgccgtcatacgatctagggagcccgttacgctgggagcatggacacgggtgtcgctggaaagaaacggtcgaaaaggcgcactgagggtgggggacgggcctcgggtactcggagagagtccaaagtccagaaaggtcccccacactgtcctgaaccttaaggagcccctctatgtgggaggggcccctgacttttctaagctggcacgggcagctgcggtgtctagtgggttcgacggagcaattcagctcgtgtcgttagggggtaggcagctcctcactcccgagcacgtcctacggcaggtagacgtcacctctttcgctggccacccatgcacccgcgcgtccgggcacccgtgcctcaacggcgcttcatgtgtgccacgcgaggccgcttatgtatgtctctgccccggagggttctccggtccccattgcgaaaagggcctcgtcgagaagagcgcaggcgacgtagacaccctggcctttgatggcagaactttcgtagaatatctcaatgctgttacagagagtgagttggctaatgaaatccctgtgcctgaaaccctggattctggggctctgcactcagagaaagctctacagtcaaatcattttgaactctcactacgaaccgaggctactcaggggttggtgctctggagcgggaaagccacagagagggctgactatgtggccttggccatagtggatggtcatctccaactgagctacaacctggggtctcagccagtcgtcctccgaagcacggttcccgtgaatacttag

SEQ ID NO: 178537 - DNA, 6138 bp, Artificial Sequence
  Description of Artificial Sequence: Synthetic coding sequence
atggccggccggagccaccccggccccctgcggcccctgctgcccctgttggttgtcgctgcttgtgtccttcctggtgctgggggcacctgccccgagcgcgccctggaacgccgcgaagaagaggccaatgtcgttctgacagggaccgtggaggaaattctgaacgtggatcctgtacagcacacctactcttgcaaggttcgagtctggcggtacctaaagggtaaggatctcgtggctcgggagagcctcctagacggcggaaacaaagtggtgatctctggctttggagatccactgatttgtgataaccaggtctctacgggggacactcgtattttctttgtcaacccagctccaccatacctgtggcccgctcataaaaacgagctcatgttgaatagctctctcatgaggattaccctgcgaaatctggaagaggtagagttctgtgtggaagacaagcctggcactcatttcaccccagtgccgcccacccccccagatgcctgccggggaatgctgtgcggcttcggtgctgtatgcgaaccgaacgccgagggtccaggacgcgcttcctgcgtctgcaagaaatctccatgtccttctgttgttgcacccgtgtgtggttcagacgcatccacatattcaaacgagtgcgagctgcagcgtgcacagtgttcccagcaaagacggattagacttcttagccgcgggccatgtggttccagagacccatgtagcaatgtgacctgcagcttcgggagtacctgtgctcggtcggctgatggactcacagcctcctgtctctgtccggctacatgccgcggtgccccagagggaaccgtttgtgggagcgacggcgcagattatcccggggagtgccagcttctgagaagagcatgtgctagacaggagaatgtgttcaaaaagtttgacggaccgtgcgacccctgccaaggcgctcttccggaccccagcaggagctgccgcgtcaatccccgaacacggcggcctgaaatgctgctcaggcccgagtcatgccctgcgagacaggcgccagtgtgtggtgacgacggtgttacttatgaaaatgattgtgtgatggggcgaagcggcgcagctcggggcctcctcctccagaaggtccgctccggccagtgccagggacgcgaccagtgtccggaaccttgtcggttcaacgcagtatgccttagccgccgtgggcgccctcgatgttcatgcgaccgagtgacatgtgatggggcttatcggcccgtgtgcgctcaagatggacgcacatatgattccgattgttggcgccagcaagctgagtgccggcaacaaagagcaatcccatccaagcaccagggaccctgcgaccaagcccctagcccctgcctgggcgtacaatgcgctttcggagcaacatgtgcagtcaagaatggccaggctgcctgcgaatgcctccaggcttgcagcagtctgtatgaccctgtgtgcggttccgacggagtgacctacggaagcgcttgtgaacttgaagccacagcctgtactctggggagagagatccaggtggcaaggaaagggccatgtgaccgttgcgggcagtgtcggtttggagcactttgcgaagccgaaacaggaagatgtgtgtgccctagcgagtgcgtcgcactagcccagccagtctgtggctcggatggccacacataccccagcgaatgtatgctgcatgtacatgcctgcacacaccaaatcagcctccacgtggcgagtgctggaccctgtgagacatgtggagatgccgtctgcgcatttggtgcggtatgctccgccggtcagtgtgtatgtcctagatgtgagcatccccccccaggtccagtgtgtggaagcgatggcgtcacctacggtagcgcttgcgagttaagggaggcagcatgtctgcagcagacacagatcgaggaggcccgggctggcccatgtgagcaggcggagtgcggcagtggcgggagcggatcgggcgaagacggcgactgtgaacaagagttatgccggcagagaggcggaatctgggatgaggatagcgaggacgggccttgtgtgtgcgacttctcttgccaatccgtgcctgggtctccagtttgcggctctgatggagtgacttactcaacagaatgcgaattgaagaaagccaggtgcgaaagccagcggggcttgtacgtggctgcgcagggggcctgcagaggccctacatttgcacctctgccacccgttgccccgctacattgtgcccagacaccgtacgggtgctgtcaggataatatcacggcagctaggggtgtcggactggccggctgcccctcagcttgccaatgcaaccctcatggtagctatggcggcacctgtgacccagccacaggccagtgctcatgtaggcccggggtagggggccttagatgcgaccggtgcgagccaggcttttggaactttcgcggtatcgtgacggacggacgatccgggtgcacaccgtgcagttgtgatcctcagggggcagtcagagacgactgcgagcaaatgactgggctgtgctcttgcaagcccggggtggccggcccaaaatgtggacagtgcccggatggccgcgcactagggcccgcaggctgtgaggccgatgcaagcgctcccgcaacctgtgccgagatgagatgtgagtttggtgctcggtgcgtggaggagagcggcagtgctcactgcgtgtgcccaatgctgacttgcccagaggcaaatgcaaccaaggtctgtggaagcgacggagttacttacgggaatgaatgccaattaaaaaccattgcatgccgacagggactgcagatcagcattcagtccttgggaccctgccaggaggccgtggcaccctccacacatcccactagcgcttctgtgaccgtcacaacgcccggcctgctgttgagtcaggcactccccgcaccaccgggcgcgttgcctttggccccttctagcacagcccattctcagactactccacctccctcgtccaggccaaggacaaccgctagtgtgccacgtacgactgtctggccagtgctgacagtccctcctactgccccatcccctgctccaagtctagtcgcctctgcatttggagagtcaggcagcacagatgggagctcggatgaagaactctccggagatcaagaggcaagtggaggaggaagtggagggctggagccgctggaaggatccagtgttgctactcccgggcccccggtcgaacgggcatcttgttataattccgctttaggttgctgtagcgatggtaagacaccatccctggatgccgagggcagtaactgtcccgcgacaaaggtgtttcaaggggtcttagagctggagggggtagagggacaggagctcttctacacccccgaaatggcagatcctaaatccgagcttttcggagaaaccgcgcgctcaatagaaagcaccctggacgatctgttccgcaacagtgatgttaaaaaggacttccgttctgttcggttacgcgatctcggccctggcaaatctgttcgtgcaattgtggatgtgcatttcgacccaactacggcattcagagcccctgatgtagctcgagccctgctgcgccagatacaggtttctcggcgcagatcgctgggtgtccggagacctctgcaggagcatgtccggttcatggattttgactggttccctgcttttatcacgggagctacaagcggcgctattgctgcaggagcgaccgcgcgagccactaccgcctcacgtttacccagttctgcagtcacaccccgtgcccctcacccttctcatacctctcagcctgtggccaagaccaccgccgctcctacaactcgaaggccccccactacggcacctagccgggtgccgggcaggaggccaccagcaccccagcagccgcccaaaccatgcgacagtcagccatgctttcatggcggcacctgtcaggactgggctctgggagggggcttcacatgctcctgtcctgctgggcgaggcggagcagtgtgcgaaaaagtgcttggtgccccagttccggcctttgaaggccgctcttttctcgcttttcccactctgcgtgcttatcacacgttgcgcctcgcacttgaattccgggccctcgagcctcagggcctgctgttatacaatggcaacgccagaggtaaggattttctggctctcgcactcctggatggtagggttcagttgagatttgatacagggtccggccctgccgtgctcactagcgcggttccggtcgaacctggccaatggcatcgactcgagctgtcacggcactggaggcggggcaccctgtctgtggacggtgagacccccgtactaggcgagtctccttctgggacagacggcctcaaccttgacactgacctgtttgttgggggggtgcccgaagaccaagctgcagtggcgttggaacgcacgttcgtgggcgccggactccggggctgcatcagactgctcgatgtgaataatcagcgcctggagttaggcatcggtccgggcgctgcgacccggggctctggcgttggagagtgtggggaccatccttgcctgcctaacccatgtcacggaggggcgccatgccagaatctcgaagccggccgctttcactgccagtgcccaccagggcgcgtgggcccaacatgcgctgacgagaaatcaccatgccaacccaacccgtgtcatggtgcggctccctgcagggttctaccggagggcggggctcagtgtgaatgtccactcggccgtgagggaaccttctgtcagaccgcctccggccaagacggcagcggaccattcttggccgactttaacggctttagccaccttgagctcagggggttacacactttcgctcgcgacctgggagaaaaaatggcattggaagtcgtgttcctggctagaggaccgagtggcctgctgctgtacaatggacagaaaacagatggtaagggggacttcgtctctctggctcttagggacagacggttggagtttcgttatgacctgggaaagggagccgccgttatccggtctcgcgagcctgtgacactgggcgcctggacacgggttagtcttgaaagaaacggcaggaagggcgccctgcgggtgggtgatggaccgcgcgttctaggggagagtcctgtcccccacaccgttctcaatctgaaggagccactgtacgtcgggggcgctccagacttcagcaaactggcccgcgctgccgccgtcagttccggcttcgatggagccatccaactggtgtcactaggtgggcggcagctgttaacccctgaacatgtccttcgtcaggtggatgtaacatcttttgccggccatccttgtactcgggcctcaggccacccttgcctgaacggcgccagctgcgtgccacgggaagctgcatacgtgtgtctgtgccccggtgggttctccgggccacactgcgagaaggggcttgttgagaaatctgccggcgacgtggataccctggcattcgacggtcggacttttgtggagtacttgaacgcggtaactgagagcgagaaagctttacaatcaaaccatttcgaactgtctctgcggacagaggccacacaggggttggttctttggtccgggaaggcgaccgagagggctgattacgttgcacttgctatagttgatggtcatttgcagttgtcgtacaatctgggctctcaacctgtggtgctgcgcagtacagtacccgtgaataccaacaggtggctgcgcgtggtcgcccatcgggagcagcgggaaggcagtctgcaagtgggtaacgaagcacccgtcactggctcaagccccctgggtgccactcagctggacacagacggggcgttgtggttagggggtcttcccgagctgcctgtcggcccggctctgcctaaagcctacgggacaggcttcgtaggttgcttaagggacgtggtggtcggacgtcacccgctccacctgttggaagacgccgtgaccaagcccgaattgaggccatgtcctaccccttag

SEQ ID NO: 178538 - DNA, 816 bp, Artificial Sequence
  Description of Artificial Sequence: Synthetic coding sequence
tgacggtacgacctgggcaagggcgccgccgtgatccggagccgggagcctgtcacacttggagcttggacacgcgtcagcctggagcgaaatggccggaaaggtgcactgcgcgtgggagatggccctcgcgtgttaggagagtctccaaagagccgtaaggtccctcacactgtactcaacctgaaggagccactgtacgtgggaggcgccccagattttagcaagctggcgagagcagccgccgtatcctctgggtttgacggagcaattcagctcgtcagcctaggcggcagacagttactgactcccgaacatgtcctgcgccaagttgacgtcaccagttttgccgggcatccctgtaccagggcttctggtcacccctgcctaaacggcgcaagttgcgtgccacgcgaggccgcatatgtgtgcctttgccctggcggattcagcgggccacattgcgagaagggtttggtggaaaagtcagccggagacgtggacacactggcctttgatgggcgtacattcgtcgagtacctcaatgcagtgaccgagagcgagctggcaaatgaaattcccgtgcccgaaactctcgacagtggagctctgcacagcgagaaggctctgcagagtaaccacttcgagctaagcctgaggaccgaggccacccaaggcttggtgctgtggtcagggaaggccaccgagagagcagattatgtggccctggccatcgtcgatggacatctccagctctcttacaacctcggtagccaacctgtggtcctgcggagcacggtacccgttaatacttag

SEQ ID NO: 178539 - DNA, 462 bp, Artificial Sequence
  Description of Artificial Sequence: Synthetic coding sequence
atggccctggtgttcgtgtacggcaccctgaagcggggccagcccaaccacagggtgttgagggatggcgcgcacggctcagcagccttcagggcccgggggcggaccctggaaccataccctctagtgattgccggtgagcataacattccttggctgctgcacttgcctggctccggccgcctggtggagggcgaggtgtatgccgtggacgaacgaatgctacgattcttggacgacttcgagtcctgtcccgccctgtaccaaaggaccgtgctgcgcgtgcagctcctggaggatcgtgccccaggggctgaagaaccacccgctcctactgctgtacagtgttttgtctactctagagcaaccttcccaccagagtgggcacagctcccacatcacgattcttacgactccgaaggcccccacggattacgatacaatccacgcgagaaccggtag

SEQ ID NO: 178540 - DNA, 462 bp, Artificial Sequence
  Description of Artificial Sequence: Synthetic coding sequence
atggccctggtgttcgtgtacggcaccctgaagcggggccagcccaatcaccgggtcttgcgcgacggcgcccacgggtccgccgcttttcgggcccgtggaagaaccctcgagccgtaccccctggtgatcgcaggggaacacaacatcccctggttactccacctaccaggtagtgggcgcctggtcgagggtgaggtgtacgcagttgatgagaggatgttgagatttttggatgacttcgaaagctgccctgccctctatcaacggacagtactccgggtgcagttactcgaagacagggcacctggagccgaggagcctccggcgcctacagctgttcagtgtttcgtctattcccgggcaacgtttcctcctgagtgggctcagctgccccatcatgattcttacgattcagaaggcccgcacggcctccggtataaccctcgcgagaacaggtag

SEQ ID NO: 178541 - DNA, 879 bp, Artificial Sequence
  Description of Artificial Sequence: Synthetic coding sequence
atgaaccccttctggagcatgagcaccagcagcgtgcggaagcggagtgagggagaagagaagaccctgactggagatgtgaaaacgtctccccccagaaccgctcctaagaagcagctcccctccattcccaagaatgccctccctattacaaagccaactagccctgcccctgctgcacagagtaccaatggcacacacgcatcatatggtccgttttacctggagtacagcttattggcagagttcacgctcgtagtgaagcaaaaactgccaggcgtgtacgtgcagcctagctaccgttcagcactcatgtggttcggggttatctttatccggcatggtctgtatcaggatggagtcttcaagttcacagtgtacattcccgataattatcctgacggagactgccctcggctggtgtttgatatcccggtctttcacccacttgtggacccaacctccggggaactcgatgtgaagagggcttttgcaaaatggcgcagaaaccacaatcatatatggcaggtcttgatgtacgcgcgtcgagtattttataagattgatacagccagccctctgaaccccgaggctgccgtactctacgagaaagacattcagctgttcaagagcaaggtagttgattcagttaaagtttgcactgctaggctgtttgaccaaccaaagatcgaagacccatatgccattagcttttccccatggaatccgagcgttcacgatgaggctcgagagaaaatgctgacgcagaaaaagccagaagagcaacacaataaatctgtacacgtggctggcctgtcctgggtgaagcccggatccgtccagccctttagtaaggaagaaaagacggtcgccacttag

SEQ ID NO: 178542 - DNA, 879 bp, Artificial Sequence
  Description of Artificial Sequence: Synthetic coding sequence
atgaaccccttctggagcatgagcaccagcagcgtgcggaagcggtctgaaggggaagaaaaaactctgacaggagatgtgaagacttcccctccgcggactgcccctaaaaagcagctgcctagtattccgaagaacgccttgcccattacaaaaccaactagtcccgctcctgctgcacagagtacaaatggaacccacgcttcctacgggcccttctatttggagtactctctccttgctgaatttacgctggtggtgaagcagaagttgccgggcgtgtatgtccagccttcttaccgtagtgcccttatgtggttcggcgtcattttcatccggcacgggctgtatcaggacggagtgttcaagtttaccgtgtacatcccagataattaccccgatggggattgcccacgtttggtgttcgatattcccgtattccaccctctcgtcgaccctacatccggggagctcgacgtcaagagggctttcgcaaagtggcggcgaaaccacaatcacatctggcaggtgctgatgtacgcacgacgcgtcttctataaaattgatactgccagcccactcaatcctgaagccgccgttttgtatgagaaagatatccaattgtttaagtccaaagtggtcgatagtgtgaaggtgtgtaccgcccgtctttttgaccagcctaagattgaggatccgtatgcgatttcctttagcccgtggaatcctagcgtccacgatgaagccagagaaaagatgttaacccagaagaagcccgaagaacagcataataagtcggtacacgtggcggggcttagctgggtgaagccaggatctgtgcaaccgtttagcaaggaagagaagactgttgctacgtag

SEQ ID NO: 178543 - DNA, 1179 bp, Artificial Sequence
  Description of Artificial Sequence: Synthetic coding sequence
atggccagccacaagctgctggtgaccccccccaaggccctgctgaagccactcagcattccgaatcagctcctcttgggtccaggcccgtcgaatctcccaccaaggataatggcagcaggcgggcttcagatgatcggctctatgtcaaaggatatgtatcagatcatggacgagattaaggaaggtattcagtacgtgtttcagacccgaaatcctctgacactcgtgatttccggtagcggtcactgtgctctggaagctgcccttgtcaacgtcctagagcccggggactcctttctcgtcggggcaaatgggatttggggtcagagagcggtggacattggagagaggatcggggctcgcgtacatccaatgaccaaggaccccggtggccattacacccttcaggaggttgaagaaggtctggcccagcataagcctgtgctcttgttcctcacccatggcgagagcagcaccggcgtactgcaaccgctggatggctttggcgaactgtgtcatagatacaagtgcctgctcctggtcgatagcgtcgcatcccttggaggcacacccttgtacatggatcgccaaggcatcgacatattgtacagcggctctcagaaagctcttaacgcaccccccggcacttccttgataagctttagcgacaaggcaaagaaaaaaatgtacagcagaaaaaccaaaccctttagcttctacttggacattaaatggctggccaacttctggggctgcgatgaccagccaagaatgtaccaccataccatccccgtgataagcctatactccctgcgagaaagcctcgctctgatcgctgagcagggactggaaaacagctggaggcagcatcgtgaagccgccgcatacctgcatggccgactccaggctttaggcctgcagcttttcgtaaaggaccctgcactgagactgccaactgtgactactgtggccgttcccgccgggtatgattggcgggacattgtttcgtatgtcatagaccacttcgacattgagattatgggtgggctgggaccttctactgggaaagtactgcgcatagggttacttggctgtaatgcgactagggaaaatgtcgatcgagttacggaagcactccgtgccgcgctccagcactgtcccaagaaaaaactgtag

SEQ ID NO: 178544 - DNA, 3078 bp, Artificial Sequence
  Description of Artificial Sequence: Synthetic coding sequence
atggagcccttcaccaacgaccggctgcagctgccccggaacatgatcgagaactcgatgttcgaggaggaaccagacgtcgtggatctggccaaagagccatgtttgcatcctctagaaccagacgaagtcgagtacgagccacgaggaagcaggttgttagtgcgtgggctcggtgaacacgagatggaagaagacgaggaggattatgagagttctgctaagctactgggtatgtcattcatgaacaggtcgtccgggctcaggaattccgcaacaggatatcggcagtctcccgacggagcctgttcagtccccagcgcacgcaccatggtcgtgtgcgctttcgtcattgtggtagcagtgtccgtgattatggtcatctacctcctccccaggtgcacattcacaaaagaaggctgtcacaaaaagaatcaatccatcggcctgatccaaccattcgccacaaacggtaagctgtttccgtgggcccagatcaggctcccaactgcagtggtcccgctgcgttacgagttgagccttcatcccaacctgactagtatgactttccgcggctcagttacaatctctgtgcaggccctccaggttacctggaatattattctacacagtacagggcacaacatttctagggtgacttttatgtctgcagtgagcagtcaggagaagcaggccgaaatcttagagtacgcctaccatgggcagatagccattgtcgcccctgaagccctgctggccggccacaactataccctcaagattgaatactcggcaaacatatcaagctcctactatggcttctacggcttctcttacacggacgagtcaaatgagaagaaatacttcgctgctacccaatttgagccactggctgcccgcagcgcatttccctgtttcgatgagcccgcgttcaaggcgactttcattatcaagataattagggacgagcaatatactgcccttagtaatatgccgaaaaagtcttccgtagtgctggatgatgggctcgtgcaagatgaattttcagaatctgtgaagatgtcaacttacctggtggcatttatcgtgggagagatgaagaacttgtcacaagatgtgaacggcacactggtgtcaatctatgcagtgcctgaaaagattgggcaggtgcattacgctctggaaaccaccgttaagctgctggagtttttccagaactattttgaaattcaataccctttgaagaagcttgatctcgttgcaatccccgactttgaagccggggctatggagaattggggactgctcactttccgagaagaaaccctcctctacgactccaacacgagctccatggcggaccgaaagctggtcaccaagataatcgcccacgaactggcccaccaatggtttggcaacctggtgaccatgaagtggtggaatgacctgtggctgaatgaaggattcgcgactttcatggagtattttagtctggagaagatctttaaggaactgagcagctacgaggactttttagacgccaggtttaagaccatgaagaaagactctctgaattctagtcatccaattagttcctccgtgcagtcttccgaacagatagaggagatgtttgattcactgtcctacttcaagggaagcagcctgcttctcatgttaaagacgtatctctcggaggatgttttccagcacgcagtggtactctacttgcataatcattcatacgcaagcatccagtccgatgacctatgggattcttttaatgaggtgaccaaccaaactcttgatgtaaagcgcatgatgaagacttggaccctgcagaaaggctttccactcgtgaccgttcagaagaagggcaaggagcttttcattcagcaggagcggtttttccttaacatgaaacccgaaatccagccctctgatacttcatacctgtggcacatcccgctttcttacgtcacagagggacggaattattcaaaataccaaagcgtgagcctgcttgacaaaaaaagcggagtgataaacctgacagaagaggttttatgggttaaagtgaatatcaatatgaacggttattatattgtgcactacgcagatgatgactgggaagcgctcattcaccaactgaagattaatccctacgtgttgtcagacaaggacagggctaaccttatcaacaatatatttgagctggccgggttaggcaaagtgcccctgaaacgcgcatttgaccttataaactacctgggaaatgagaatcatacagctcccattactgaggccttgttccaaacggatctgatctataacctcctcgaaaaattaggctacatggaccttgccagtcggttggtaacacgggtattcaagctcttacagaaccagatccagcagcaaacatggactgacgagggaactccttccatgagggagctgcgtagcgcactcctggagtttgcctgcactcacaaccttgggaactgtagcaccacagctatgaagctgtttgacgattggatggctagtaacggtacccaatcgttgcctacagacgtaatgaccacagtttttaaagtcggtgccaaaactgataaaggctggagtttccttctgggaaagtacatttcgattggatccgaagccgaaaagaacaagattcttgaggcactcgcttcttcagaagatgtgaggaagttatactggctcatgaagtcatccctgaacggagataattttcggacccagaaactctctttcatcattcggaccgttgggagacactttcctggccatctattggcctgggatttcgtgaaagagaactggaacaaactggtccagaaattccctctggggagttatactatacagaacatcgttgcaggtagtacctatttgttttctactaagacacatctgtctgaagtgcaggcgtttttcgagaaccaaagtgaagctacattcaggcttcgctgcgttcaggaggccctcgaggtgatacaattgaatattcagtggatggagaaaaatctaaaatctctcacctggtggctctag

SEQ ID NO: 178545 - DNA, 2907 bp, Artificial Sequence
  Description of Artificial Sequence: Synthetic coding sequence
atggacagcaccctgaccgccagcgagatccggcagcggttcatcgatttctttaaacggaacgagcacacatacgttcatagcagcgcaaccatacccctggacgacccaacgctattgttcgccaatgctggcatgaaccagttcaaaccaattttcctgaataccatagacccaagtcatccaatggccaaactgtcccgtgcagcaaatactcaaaagtgcattcgcgccggcgggaaacacaacgacctcgacgatgtgggcaaagatgtctatcatcacacattttttgaaatgctgggaagttggtcctttggggactattttaaggaactcgcatgtaaaatggctctggaactcctcacacaagagttcgggataccaattgagaggctttatgtgacttactttggaggagatgaagccgccggtcttgaggccgacctcgagtgtaagcagatctggcagaacctgggcctcgatgacactaaaattctgccgggcaacatgaaggacaacttttgggagatgggcgacactggaccctgtggcccatgctctgagattcactacgaccgaattggggggagggacgccgctcatctggtgaaccaggatgatcccaacgtgctggagatttggaatctggtgtttattcaatataatcgtgaagctgatggcattcttaagcctctgcctaaaaaatccatcgacacaggaatgggcctcgagcgcctggtgtcagtactgcaaaataagatgtccaactacgacactgacctttttgtgccatattttgaggctattcagaaaggcactggcgctcgaccttacacaggtaaggtgggggccgaagacgctgacggaatcgatatggcctaccgcgtcctggcggaccacgcccggactataactgtggcccttgccgacggtggaagacccgataatacagggaggggatacgtgctgcgcagaatattgcgtcgagccgtgcggtacgcccatgaaaaactgaatgcctcccgcggattcttcgcaacactagtcgacgtggttgtgcagagcttgggggacgccttcccagagctgaagaaggatcccgacatggttaaagacatcattaacgaggaggaggtgcagttccttaaaaccttgtcacggggtcggcgcatactcgatagaaagattcagtctttaggggactctaaaaccattcctggtgacaccgcctggctgctttacgacacctacggattccccgttgacttgactggcctgatcgctgaagaaaaaggtctagtcgtcgatatggatgggttcgaagaggagcgtaagctcgcccaactgaaaagccaaggaaaaggggccgggggagaggacctcatcatgctcgacatttacgctatcgaggaactaagagcaagaggcctggaggtgactgatgactcaccaaaatacaactatcaccttgactcaagcgggtcctatgtattcgagaatacagtggccaccgtgatggctttgagacgggagaagatgttcgtggaggaggtgtcgaccggccaggagtgcggggtcgttctcgataagacctgtttttacgctgagcagggcggccaaatctacgatgaagggtaccttgtgaaagtcgatgacagcagcgaggacaagactgaatttaccgtcaaaaacgctcaggtccgtggaggttacgttttgcacatcggcacaatttacggcgacctgaaagtcggagaccaggtgtggctgtttatcgatgagcccagacgaaggcctattatgtctaatcacaccgctacccatattctgaacttcgctctacgctccgtgctgggagaggccgatcaaaagggctccttagtggctccggaccggctgcgctttgatttcacagctaaaggagcgatgagcactcagcagatcaaaaaggccgaagaaatcgcaaatgagatgatagaagcagccaaggccgtgtacacacaggattgtccattggcggccgctaaggcaattcagggactcagggccgtgttcgatgagacctaccccgatcccgtgagggttgtatctattggagtgcctgtatctgagttacttgacgacccaagcgggccagcagggagcctcaccagtgtcgagttctgtgggggtacacacctgcggaactcttcacatgccggcgcattcgtcatagtaaccgaggaagcgatagctaaggggattcgacggatcgtcgcggtgaccggagcagaggcccagaaggctttgcgcaaggcagaatctttgaaaaagtgtctgagtgtgatggaagctaaagtgaaagcccagactgcccccaataaagacgtccagcgcgaaattgccgacctgggagaggcgctagccaccgccgttatcccacagtggcaaaaagatgagctgcgggaaacactgaagtcgctcaaaaaggtgatggacgatctcgatagggcaagtaaagcagatgttcagaagcgggtgctcgagaaaacgaagcagttcatcgactctaacccaaatcagcccctcgttatcctcgagatggaaagcggggcttcagcaaaggcactgaacgaggcccttaaactgttcaagatgcatagtcctcagaccagtgccatgttgttcaccgtagacaatgaggccggtaaaattacctgcctgtgtcaggtgccacaaaacgcggccaacagaggtttaaaggcttccgaatgggtgcagcaggtgagcggcctgatggacgggaaggggggggggaaggatgtgtctgcacaagctacgggaaagaacgtaggctgtcttcaggaagcgctgcagctcgccacctccttcgcgcaactcaggctaggcgacgttaaaaattag

SEQ ID NO: 178546 - DNA, 2958 bp, Artificial Sequence
  Description of Artificial Sequence: Synthetic coding sequence
atggccgccagcgtggccgccgccgcccggcggctgcggcgggccataagacggagcccagcttggaggggtctgtcccacaggccattatccagtgagcctcctgcagcaaaggcttcagccgtgagggcagccttcctgaattttttccgggataggcatggtcacaggctggtgccgagcgcctctgtacgacctcgtggtgaccctagcctgttgttcgtaaacgcaggaatgaatcagtttaagcctatttttctcggaaccgtcgatccccgcagcgagatggctggctttcgtcgcgtagccaactctcagaaatgcgtccgagcaggcggtcaccacaatgacctggaggatgtgggaagagatctttctcatcacaccttctttgagatgttaggaaattgggccttcggcggagaatatttcaaggaagaagcgtgcaacatggcttgggaacttctgacccaggtgtacgggatccccgaggagcggctgtggatctcctacttcgacggcgatcctaaagccggcttggaccccgacctcgagactagagacatctggctaagtcttggggtgcccgctagcagagttctatcttttgggccacaggaaaatttttgggaaatgggagataccggcccatgtgggccatgcacagagatccattatgatttggctggaggagtcggcgcaccgcagctcgttgaactctggaacttggtgttcatgcagcacaaccgggaagccgacggatctttgcagccactgccccagcgccacgtggatacgggtatgggattagagcgattagtggccgtcctccaggggaagcatagcacctacgacacagatctttttagccctttgcttaacgcaatccagcaggggtgtagagcacccccatacctcggacgtgtaggggtggccgatgagggtcggactgacactgcatatcgggtggtggcagatcacatccgcacgctctctgtttgcatctcagatggaatttttccaggaatgtccggccccccactggtcttgagaagaatcttacggcgagccgttcggttcagtatggaaattttaaaggccccaccagggttcctgggctctctagtcccagtggtagtggaaaccttaggcgacgcttatccggaactgcagcggaactccgcgcaaattgctaatcttgtttcagaagacgaggcggcttttctggccagtttagaaaggggacggcggatcatcgaccggacgctgcggaccctgggcccatcggatatgtttcccgccgaggttgcctggtcattaagtctatgtggcgatcttggattgcccttagacatggtcgagctaatgctggaggagaagggggtgcaactcgatagtgcaggcctggagcggctcgcgcaagaggaagcccagcatagagctcgccaagcggaacccgtccagaagcagggtctgtggcttgatgtacacgccctgggcgagctacagcgccagggggtaccacccaccgatgatagcccgaagtacaactattcattgcgcccttctggtagctacgagttcgggacatgcgaagcacaggtactacagctctacaccgaggacggaacagccgttgcgagtgttgggaaagggcaaagatgtggcctgctgttggatagaacaaatttctacgccgagcaaggaggccaggcctcagaccgcggctaccttgttagggcaggacaagaagatgtcctctttcctgtggctcgtgcccaggtttgcggaggatttatcctacatgaagctgtcgcacccgaatgtttacgattgggcgatcaggtgcaactccacgtcgatgaggcatggagattgggctgtatggcaaagcatacagccacacacctgctgaactgggctttgcggcaaacacttggaccaggcactgagcaacaggggtcccatttaaatcccgaacagctacgactcgatgtcactacacagactcccttaacccccgagcagctgagagctgttgagaacacagttcaggaggcagtcggccaggatgaggcggtgtacatggaagaggtccctctggccctgactgcacaggtcccgggtctgagatcgttagacgaggtataccccgatcccgtgagggtcgttagcgtgggagtgcccgttgcccatgccctggaccctgcatctcaggcagccctgcagacatctgttgagttgtgttgcgggacccacttactgcgcactggcgctgtaggggatctggtaatcattggcgatcgacagctgagtaaggggactacccgtctgctcgcagtcactggtgaacaggcccagcaagccagagagctgggacagtccctggcgcaggaggttaaggccgctacagagagactcagcttgggttcaagagatgttgcagaagcattaaggctgtcaaaagacattggacgcttgattgaggctgtcgagaccgcagttatgccacagtggcagcgaagagagttgttggctactgtaaagatgctgcagcgccgcgccaataccgcgatccggaagctacagatgggacaggccgctaagaagacacaggaactactcgagaggcacagcaagggacccttgattgttgataccgttagtgcggaaagcctgagcgtgctagttaaggtcgtccgtcagttatgtgagcaggccccatctacatctgtcttactgctgtccccacagccgatgggaaaagtgctgtgcgcctgtcaggtcgcacaaggcgccatgcccacattcaccgcggaagcatgggctttagccgtgtgcagccacatgggtggtaaagcatggggctcccgggtggtcgcacaaggaactggttcaactacagaccttgaagccgctctatctattgctcaaacttacgccttatcacagctgtag

SEQ ID NO: 178547 - DNA, 1578 bp, Artificial Sequence
  Description of Artificial Sequence: Synthetic coding sequence
atggagttctgcgtggaggacagcaccgacgtgcacgtgctgatcgaggatcaccgcatcgtgtttagttgcaagaatgcggatggcgttgagctctacaacgagattgagttctatgctaaggttaattctaaggattctcaggacaaaagatcgagccggtctataacgtgttttgtaaggaaatggaaggaaaaagtcgcttggccaaggctgactaaagaagatattaagcccgtctggctgagcgtggactttgataattggcgcgactgggagggggatgaggaaatggaactggcacacgtggaacactacgcagagcttctcaaaaaggtcagcactaaacggccccccccagcaatggacgatctcgacttcacgaccaccgtagtgtcttgttgtccagctgagctgcaaaccgagggctccaacggcaagaaggaagtgctcagtgggtttcaggttgtcctcgaggataccgttctgtttccagaaggtgggggacaaccagacgacaggggcaccattaatgacatatctgtactgagggtgacccggcggggcgaacaggccgaccactttacgcaaacccctttggatccaggctcccaggtgttggtcagggttgattgggaaagacgcttcgatcacatgcagcaacactcagggcagcacttaatcactgccgtcgcagatcatctgttcaagctgaagaccacctcctgggaactgggacggtttcgttccgcgattgagctggatactccctctatgaccgccgagcaggtcgccgccatagaacaaagcgtcaatgagaaaattagagaccgcctgcctgtgaatgtcagagagctctccctggacgaccctgaggtggaacaggtcagtggccgagggctgccagacgatcatgctggacctataagggtggtcaatattgaaggcgtggacagcaacatgtgttgtggaacacatgtaagtaacctgagcgacctgcaggtcattaagatcctaggaactgagaaagggaaaaaaaaccgcactaatctgatattcctgtccggaaatcgggtgctgaaatggatggagcggagtcatggtaccgagaaagctttaacagcactgctcaagtgtggcgccgaggaccacgtggaagccgtcaagaagctccagaattcaactaaaatattgcagaagaacaatctgaacctcctgagggacctggcagtgcacatcgctcattccttacgaaatagccctgattggggcggagtagtgatcctgcatcggaaggaaggtgatagcgagttcatgaacatcattgccaacgagattggctcagaagaaactctgctcttcctgaccgtcggtgacgagaagggaggaggactctttttattggccggaccccccgcgtccgtagagactcttggaccccgcgtagcagaggttctggagggcaagggagccgggaagaagggtaggttccaaggcaaggcaaccaagatgagccggaggatggaggctcaggccctgctccaggactatatttccacacagagtgctaaagaatag

SEQ ID NO: 178548 - DNA, 1761 bp, Artificial Sequence
  Description of Artificial Sequence: Synthetic coding sequence
atgttcagcctgcccctgaactgcagccccgaccacatccggcggggctcatgttggggtaggccccaggacttgaaaattgcggctccagcttggaacagtaagtgccacccaggagccggtgccgcaatggcacgtcaacacgccagaaccctgtggtatgacaggcctaggtatgtgtttatggagttttgcgtggaggattccacggatgttcacgtgttgattgaagatcacaggatcgtgtttagctgtaaaaacgctgatggcgtggaactgtataatgaaattgagttctacgccaaggtgaactccaaagactctcaggataagcgctcgtcaaggtcaatcacctgtttcgtgcgaaagtggaaagagaaggtagcgtggccaagactgacgaaggaagacattaagcccgtctggctttccgtggactttgacaattggcgagactgggaaggtgacgaggagatggagttggcccacgtcgaacactatgccgagttgctgaaaaaggtgagcactaaacgccctcccccggccatggatgacctcgatttcaccacaaccgtagttagctgttgccctgcagaactacaaaccgagggctcaaacgggaagaaggaggtactctctgggttccaggtagtcctcgaagatactgtgctgttccccgagggagggggacagccggacgaccgtggtacgatcaacgacatctccgttctccgcgtcacaagaaggggcgaacaggccgatcattttacgcaaaccccattggatcccggtagtcaagtgctcgtccgcgtagactgggaaagaaggtttgatcacatgcagcagcattcaggccagcaccttatcactgcggttgcggaccatctgtttaaactgaaaacgaccagctgggagctcggacgatttaggtcggccatcgaactggacacaccgagcatgacagcagagcaggtcgcagccattgagcagagtgtaaacgagaagattcgagacagacttcctgttaatgtgcgagagctttcgctagacgaccccgaggttgaacaggtctccggccgggggctgccggacgaccatgcaggaccaatccgggttgtcaacatcgagggtgtggatagcaacatgtgttgtgggacacatgtgagtaatcttagcgatctgcaggtgattaaaatccttggcaccgagaaagggaaaaagaatagaaccaacctgatctttctgagtggaaatagggtcctgaaatggatggagcgcagccatggaacagagaaagcactcactgctcttttgaaatgcggtgctgaagaccatgtggaagctgtgaaaaagctccagaattccactaaaatcctccagaagaataacctgaatttactgcgagatctggccgtgcatattgcccacagtctcaggaacagtcccgattgggggggagttgtcatcctgcatagaaaagaaggagactccgaattcatgaacattatcgcgaacgaaatcggatccgaagaaacactgctgtttttgacagtcggcgacgaaaaaggcggggggctgtttttgctggccggtcctcccgcttccgtggagacgctgggacccagggtcgcggaggtgctggaggggaaaggggcaggcaaaaaagggcggttccagggaaaggcaacaaagatgagtcgtagaatggaagcgcaagcgctgctgcaggattatatcagcacccaatcagctaaggagtag

SEQ ID NO: 178549 - DNA, 1761 bp, Artificial Sequence
  Description of Artificial Sequence: Synthetic coding sequence
atgttcagcctgcccctgaactgcagccccgaccacatccggcggggttcatgttggggacgcccacaggacctgaaaattgccgctccagcttggaactccaagtgtcatcctggggctggcgcagctatggcaaggcagcatgcgaggacactctggtacgatcgtcccaggtacgtgttcatggaattctgtgtcgaagactcgacagatgtgcacgtgctgatcgaagatcataggatcgtcttcagttgtaaaaacgccgacggagtcgaactctacaatgaaatagagttctatgccaaggtcaattctaaggactctcaagacaagcgctcatctcgctccattacgtgtttcgtccggaaatggaaagagaaggtcgcctggcctagattgaccaaagaggacatcaaaccagtgtggctgagcgtcgattttgataactggagggactgggagggagacgaagaaatggagctggctcatgtggagcattatgctgagctgcttaaaaaggtgtccactaaaagaccccctccagccatggacgacctggattttacaacaaccgtcgttagctgctgtcccgcagaacttcagaccgagggcagtaatggaaagaaagaggtcctgagcggcttccaagtggtgctggaagatacagtgctgttccctgaggggggtggacaaccagatgatagggggaccattaacgacataagtgtactgcgtgtgaccagaaggggggaacaggccgatcactttacccaaacacccctcgacccaggcagccaggtcctggtcagggtcgactgggagagacggttcgaccacatgcaacagcactcggggcagcacctgatcaccgccgtggccgatcacctttttaagctaaagacgacttcttgggagctcgggagatttcgatcagccattgagctcgatacgcctagtatgactgccgagcaggtcgctgccatagagcaaagtgtgaatgagaagattcgggatcggcttcctgtcaatgtccgggaactctccctcgatgatccggaggttgagcaggtctcgggacgagggctgccggatgaccacgctggcccgattagggtcgtgaacatcgagggagtggactcaaacatgtgctgtggaacccatgtcagtaacctcagtgacctccaggtgatcaagatactcggaaccgagaaaggcaaaaagaatagaactaacctcatcttcttgagcggtaatagggttttaaagtggatggaaaggagtcacggcaccgaaaaggctttgacagctctgctgaagtgtggcgccgaggaccacgtggaggcagtgaaaaaactacagaattctactaagattctccagaagaataatctgaacctgctcagggaccttgcagttcatattgcccacagcctgaggaacagtcccgattggggtggagtggtaatcctgcacaggaaggagggtgacagcgaattcatgaatattattgctaatgagatcggcagtgaagagaccctcctctttctgacagttggagatgaaaagggcggaggactttttctgcttgccggccctcccgcgtccgtagagacccttggccctcgcgtcgccgaggtgctggaagggaaaggcgctgggaagaaaggacgctttcagggcaaggctactaagatgtcaagaagaatggaggcgcaggctcttctgcaggactacataagcacgcagtccgcaaaagagtag

SEQ ID NO: 178550 - DNA, 1239 bp, Artificial Sequence
  Description of Artificial Sequence: Synthetic coding sequence
atggccttctggtgccagcgggacagctacgcccgggagttcaccaccacagtggtgtcttgctgcccagccgagttacagacagaggggtccaacgggaagaaggaggtgctcagtgggtttcaggtggttctggaggacacagtgctatttccagagggagggggacagcctgacgatcggggcactattaatgacatctctgttctgagagtcacgcgccggggggagcaagcagaccactttacacagacaccacttgaccctgggtctcaggtactggtacgggtagactgggaaaggcgctttgaccacatgcagcaacattctggccagcatcttattacagctgtagcggaccacctctttaagctaaagaccacgagttgggaactgggcaggttcagatcagctattgaactggacactcctagtatgaccgctgaacaggtagccgcaatcgagcagtctgtgaacgaaaagatacgggataggcttcccgtgaacgtacgagaattatctctggatgaccctgaagtggagcaagtatctggaagaggattaccggatgaccatgcgggtccaatacgggtggtaaatatagaaggcgtggacagtaacatgtgttgcggtactcatgtttcaaatctgtcagacctgcaagttatcaagatcctcggcacagagaaggggaagaaaaaccgcactaaccttatatttttgagtgggaacagagttctgaaatggatggagcgttctcatggcactgagaaagctctgaccgccctacttaaatgtggcgccgaagatcacgttgaagctgtgaagaagctgcagaacagcacgaagattctccagaaaaacaatctgaacctcctacgggatctggccgtgcacatagctcacagcctgagaaacagccccgactggggaggcgtggtgatcctccacagaaaagaaggtgactccgaatttatgaatataatagccaatgagatcgggtctgaagaaacgttactttttctgaccgtgggagatgagaaaggaggcggcctcttccttctagccgggccacccgcaagtgtcgaaactctgggcccaagggttgctgaagtactcgaagggaaaggcgccgggaaaaagggcaggtttcagggcaaggcaactaagatgtcacgacgcatggaggctcaggcactgcttcaggactatatctctactcagagcgcaaaggagtag

SEQ ID NO: 178551 - DNA, 501 bp, Artificial Sequence
  Description of Artificial Sequence: Synthetic coding sequence
atgttcagcctgcccctgaactgcagccccgaccacatccggcggggcagttgttggggaagacctcaggacctgaaaatcgcagctccagcatggaacagcaagtgtcaccccggtgccggggccgctatggccaggcagcacgcccggaccctgtggtatgaccgtccacgctatgttttcatggagttttgcgttgaggattcgacggatgttcatgttcttatagaagatcatcggatcgtgttcagttgtaaaaatgcggacggggtggagctctacaatgaaattgagttttatgccaaagtgaatagcaaaccggtttggctaagtgtcgatttcgataattggcgcgactgggagggggacgaggaaatggagttagcccacgtcgagcactacgctgagctgctaaaaaaagtctcgacaaaacgaccccctcccgcaatggacgatctggatgatgactcggactctgccgatgacgctacttcaaactag

SEQ ID NO: 178552 - DNA, 399 bp, Artificial Sequence
  Description of Artificial Sequence: Synthetic coding sequence
atggagttctgcgtggaggacagcaccgacgtgcacgtgctgatcgaagatcatcggattgtgttttcatgcaagaacgccgatggcgtggaactttacaacgagattgagttttatgcgaaggtgaattctaaggactcccaggataagaggagctccaggtccatcacttgctttgtccggaagtggaaagagaaggtagcctggcctcggcttacaaaggaggacattaagcctgtttggctatcggtcgactttgacaactggcgggactgggaaggtgatgaagagatggagctggcccacgtcgaacactatgcggagcttctgaagaaggtgtccacaaaaagacctccacccgctatggacgacttagacttcacgaccaccgtagtgtag

SEQ ID NO: 178553 - DNA, 1830 bp, Artificial Sequence
  Description of Artificial Sequence: Synthetic coding sequence
atgaagtgggtgaccttcatcagcctgctgttcctgttcagcagcgcctacagccgcggagtcttccgtagggatgcccataaatctgaagtcgcgcataggtttaaggatctgggagaagagaattttaaagccctggtgttgattgctttcgctcagtacctgcaacaatgcccctttgaggaccatgtgaaattggttaatgaagtcaccgagtttgcgaagacttgcgtggccgacgagtctgctgagaattgcgacaagagcttgcatacgttgtttggcgataagctgtgcaccgtggcgacactccgtgagacctacggagagatggccgactgctgtgctaagcaggagcctgaacgtaacgagtgcttccttcagcacaaagatgacaacccgaatttaccgagattggtcaggcctgaagtggatgtaatgtgtacagccttccatgataatgaggaaacctttctgaaaaaatacctatacgaaatcgctcggcgacacccatatttctacgcacccgagctgcttttctttgccaagcgatataaagcagccttcacagaatgctgtcaagctgccgacaaagctgcctgtttgctgccaaaactggacgaactgcgtgatgaaggcaaggcctcttcggccaaacagcggctcaagtgtgcttctctgcagaagttcggggagcgggcgtttaaggcatgggcagtggctagattaagccaacgttttcccaaggctgagttcgctgaagtgtccaagctggttaccgatctgacaaaagttcatactgagtgttgccatggagatctccttgagtgtgctgacgatagagccgacctcgctaagtatatttgcgagaatcaagattccattagtagtaaattaaaggagtgttgcgaaaaacctctgctcgagaagagccactgcatagcggaggtcgaaaacgatgagatgccagctgacttgcccagtctagcggcagatttcgttgagtctaaagacgtgtgtaagaattacgcagaagctaaagacgtctttcttgggatgttcctatacgagtacgctaggaggcaccccgactatagtgtcgtgctgctcctgcggttagcgaagacttacgaaaccacactagagaagtgctgtgccgccgcagacccccacgagtgctatgctaaagtgttcgacgaatttaaacctctggttgaagagccccagaacctaatcaagcaaaactgcgagctattcgaacagctgggcgaatataagttccaaaacgctctgttggtaagatacacgaaaaaggttcctcaggtgtccacccccacccttgtcgaagtctctagaaatcttggaaaggtggggtctaagtgttgtaagcatcctgaagccaagagaatgccgtgtgctgaagactatctgtctgtcgtgctcaaccagctgtgcgtgctacatgagaagacacctgtcagtgatcgcgtgacaaaatgttgcaccgaaagtctcgtcaacagacgcccctgcttctctgccctggaggtcgatgaaacttacgtcccaaaggagttcaacgctgagacctttaccttccacgccgacatttgcacgctgagcgaaaaagagagacaaatcaaaaagcagacagctctcgtggagttggtgaagcataaaccaaaagccacgaaggagcagctgaaagccgtgatggacgactttgcggcgttcgttgagaagtgttgtaaagctgacgataaagagacatgcttcgcagaagaggggaagaagctcgtggcagcgagtcaggctgctttgggtctgtag

SEQ ID NO: 178554 - DNA, 1191 bp, Artificial Sequence
  Description of Artificial Sequence: Synthetic coding sequence
atgaagtgggtgaccttcatcagcctgctgttcctgttcagcagcgcctacagtagaggagtttttagacgcgacgcccataagtctgaagtcgcacatcgctttaaggatctaggcgaggaaaacttcaaagccctggtgcttatcgcttttgcccaatacctccagcagtgcccattcgaggaccacgtgaaactggtcaacgaggtcacagaattcgctaagacatgcgtcgccgatgagagtgccgaaaattgcgacaagtcactccatacgctattcggcgataaactctgcacggtagccactttgcgggagacttacggagagatggccgactgttgcgcgaagcaagaaccagaaaggaacgagtgctttctgcaacacaaagacgataatccaaatctgcctcggttagtgagacctgaagtggacgtcatgtgcacagccttccacgacaatgaggagacatttttaaagaaatacttgtacgagaccacgttggagaaatgctgcgcagcagccgatccccacgagtgctatgccaaagtgtttgatgaatttaagccgcttgtcgaggaaccccagaaccttatcaaacagaactgtgaactgttcgagcaacttggcgagtacaagtttcagaatgcattgctcgttcgatacactaaaaaggtaccgcaggtgtccacccccacattggtcgaggtctctcgaaatctagggaaagtgggttctaaatgctgcaagcaccctgaggccaaacggatgccctgtgccgaggactatctcagcgttgtgctaaaccagctgtgtgttcttcacgagaagactcctgtgtccgatagagtgaccaaatgctgcaccgaatcactcgttaatcgcagaccctgtttctctgcccttgaggttgacgagacctatgtgcccaaagaattcaatgccgagacctttacatttcacgcagatatttgtaccctctccgagaaggaaagacagataaagaaacagaccgctcttgtggaacttgttaagcataagcctaaagcaactaaagagcaactcaaggctgttatggatgattttgcagctttcgttgaaaaatgttgcaaagccgacgataaggagacgtgctttgcggaagagggcaagaaactggtggccgcttcgcaggctgcgctcggactgtag

SEQ ID NO: 178555 - DNA, 1254 bp, Artificial Sequence
  Description of Artificial Sequence: Synthetic coding sequence
atgaagtgggtgaccttcatcagcctgctgttcctgttcagcagcgcatattctcggggtgttttccggcgggatgctcacaagagcgaagtggcacaccgctttaaggatctgggtgaagagaacttcaaagccctcgccgtggcacgtttgtcccagaggtttcctaaagcagagttcgccgaggtatcgaagctagtcacggacctcacgaaagtccataccgagtgctgccacggggatctgcttgagtgcgcagatgaccgtgccgacctagcaaaatatatctgtgagaaccaagactcgatctccagcaagttaaaagaatgttgtgaaaagcccttgctggaaaagtcccactgcatcgcagaagttgaaaatgatgagatgcctgctgatctcccctccttagcagcggattttgtggaaagcaaagacgtttgtaagaattatgccgaggcaaaggatgtctttttagggatgttcctttatgaatacgcccgccgccaccccgattatagtgtcgtgctcctgcttcggttagccaagacctacgagaccaccctagagaagtgttgcgctgctgcggatcctcatgagtgctacgccaaagtgttcgatgaatttaaaccactcgtggaggagccccagaatctcattaaacagaattgcgagctgttcgaacagctgggtgaatacaaattccagaacgctctgttggtgcgatatacaaagaaggtgccacaggtcagtacccctacactggtcgaagtttccaggaatctcggcaaggttggatctaagtgctgcaaacaccccgaagcaaaaagaatgccatgcgcagaagattacctgtctgtagttctgaatcagctgtgcgtgctacacgagaagacaccagttagtgatagggtcactaaatgctgcaccgagagcctggtgaatcggcggccttgcttttctgcattggaggtggatgagacttacgtgcccaaggagtttaacgccgagacattcacttttcacgctgatatttgtacactgtccgagaaagagcgacaaatcaagaaacagactgccctcgtggagctggttaagcataaacctaaggcaacaaaggaacagcttaaggccgtcatggacgacttcgccgcttttgtggagaagtgttgcaaagcggatgacaaggaaacttgtttcgccgaggaagggaaaaagctggtggccgcatctcaggcggccctcggtctgtag

SEQ ID NO: 178556 - DNA, 1857 bp, Artificial Sequence
  Description of Artificial Sequence: Synthetic coding sequence
atgaagtgggtgaccttcatcagcctgctgttcctgttcagcagcgcgtactcccgaggagtgtttagacgagacgccttatttttgttttttttcccttgccctgacaagagcgaggtcgcacatcgatttaaggacctgggggaagaaaactttaaagcacttgtcctgatcgcattcgctcaatatctgcagcagtgtccatttgaagaccacgtgaaactcgtcaacgaggtgaccgagtttgccaagacttgcgtggccgatgagagtgctgagaactgtgataagagcctgcacacactgttcggagataagctgtgtacagtggctaccttgagggagacatacggagagatggccgattgctgtgccaaacaggagccggaacgtaacgaatgcttcctgcagcacaaggacgacaaccctaacttacctcggctggttcgcccggaggtggatgtgatgtgcaccgctttccatgataacgaggagacatttctcaagaagtatctgtacgagatcgcccgcagacacccatacttctacgctcccgaattactcttttttgctaaaaggtataaggccgcctttaccgagtgttgtcaggcagctgataaggctgcttgcctcttaccaaagctcgacgagttgagagacgaaggcaaagccagctctgcaaagcaaaggttgaagtgtgcatcattgcagaaatttggcgaaagggcattcaaggcttgggccgttgcaagactctcacaacggttccccaaagctgagttcgcagaggtgagcaaattagtgactgacttgaccaaagtgcataccgaatgttgccatggagatctcttggaatgcgctgatgacagggctgatttagccaaatacatctgcgaaaaccaggatagcatttctagtaaactgaaagagtgctgcgagaagccactgttagaaaaaagtcattgcatagcagaggtcgagaatgatgagatgcccgctgatttgcccagtctagcagccgattttgtagaaagtaaagacgtgtgtaaaaattacgccgaggccaaggatgtgtttcttggcatgttcctctacgagtacgccaggcgacacccagactactcagtcgtgctcctgctccgcctggctaagacctatgagacaactttggaaaagtgctgcgcagccgctgacccacatgagtgttacgccaaggtgtttgacgagttcaaacccctggtggaggagccacagaatctgatcaagcaaaactgtgaactgtttgaacagctgggcgagtataaattccagaatgccctgctggttcggtataccaagaaagtgcctcaagtgagtacacctacactagttgaagttagccggaacctagggaaagtcggtagcaaatgttgtaagcatcccgaggccaagcgtatgccctgcgcagaagattatctgtccgtggttttaaatcaactgtgcgttcttcacgagaagactcctgtaagcgaccgagtgacgaagtgttgtactgaaagccttgtcaatcgaagaccatgcttctcggctcttgaggtggacgaaacatatgttcctaaggagtttaatgcagagacattcacgttccatgctgatatctgcaccctgtccgagaaggaacgccagattaagaaacagactgcactggtcgagctggtcaaacacaaacctaaagccactaaggagcaactcaaagctgtgatggatgactttgccgcgtttgtggagaaatgttgtaaggccgatgacaaggaaacttgttttgccgaggaggggaagaagctggtcgccgcctcccaagccgcgttgggactctag

SEQ ID NO: 178557 - DNA, 1161 bp, Artificial Sequence
  Description of Artificial Sequence: Synthetic coding sequence
atgttcgccgagatccagatccaggacaaggaccggatgggcaccgccgggaaagtgatcaaatgtaaggccgctgtgctgtgggagcagaagcagcctttctcaattgaagaaatcgaggtggcgcctccgaaaacaaaagaggttcgaatcaaaatcctggctactggcatttgccgcaccgatgaccatgttatcaagggtaccatggtctccaagtttcctgttatcgtagggcatgaggctaccggcattgtagagagtatcggggaaggagtcactactgtaaagcccggagataaagtaataccactgttccttccacagtgtcgcgagtgtaacgcctgtagaaatccagacgggaacttatgcatcagaagtgacataactggcaggggagtcctcgctgacggtacaactaggtttacttgcaaaggcaagccggtgcatcactttatgaatacctctaccttcaccgaatacactgtggtggatgaatcttccgttgccaaaattgatgacgctgcgcctccagaaaaagtgtgcctgatcggctgtggcttttccaccggatatggggccgccgtaaaaacgggcaaagtgaaacccgggtcgacttgcgtcgtttttgggctcggcggtgtgggcctgtccgtgataatgggctgtaaatcagctggcgcgagtagaattatcggcatcgacctcaacaaagacaaatttgaaaaagcaatggcagtcggcgctacggagtgtatatctcccaaggattccacgaagcctatttccgaggtgctgagcgaaatgaccggcaacaacgtgggctacactttcgaggtcatcggacatttggaaacaatgatagacgccctagcgtcctgtcatatgaactatggcacatcagtcgtggtgggagtgcccccctctgccaagatgctcacgtacgatcctatgttgttattcactgggagaacttggaaaggatgtgtctttgggggcttgaagagtcgtgacgatgtgcccaagctcgtaaccgagttcctggctaagaaatttgacctcgaccagttgattacccacgtgttgccttttaagaaaatctcggaaggctttgagcttctcaactcaggtcagtccatccgaaccgtgcttactttttag

SEQ ID NO: 178558 - DNA, 1128 bp, Artificial Sequence
  Description of Artificial Sequence: Synthetic coding sequence
atgagcaccgccggcaaggtgatcaagtgcaaggccgccgtgctgtgggaggttaagaaacccttttcaatcgaggatgttgaagtggctccacccaaggcttacgaggtaagaatcaaaatggtggctgtcgggatttgccatacggacgatcatgttgtaagtggtaacctggtaactccactcccagtgatcctgggacacgaggcagcaggaattgtcgagagtgttggtgaaggcgtaactaccgtgaagccaggagataaggtcatccctctttttacacctcagtgcggaaaatgtcgcgtttgcaagaatccggaatccaactactgccttaaaaacgatctgggtaatcctcgcggcactctacaagatggtacccgacgctttacctgccgcgggaagcctatccatcactttcttggtacgtccaccttctcccagtacaccgtggtcgatgagaatgcagtggccaagattgacgctgcatccccgttagagaaagtgtgtttgattggctgtgggttcagcaccggctacggctctgctgtgaacgtggccaaggttacgcctggatccacgtgcgccgttttcggactggggggggtggggctgagcgccgtcatgggatgtaaggccgccggtgcagcaagaatcatcgccgtcgatattaataaagacaagttcgccaaggccaaggagcttggcgctaccgaatgcattaacccacaggattataagaagcctattcaggaagttctcaaagagatgaccgacgggggggtcgatttctcatttgaggtgatcgggagactagacaccatgatggcaagcctgctgtgctgtcatgaggcctgcgggacgtctgtgattgtaggggttccgcccgcgagtcaaaatctttcgatcaaccccatgctgctcttgactggaagaacatggaaaggtgcagtgtatggggggttcaaaagcaaggagggcataccaaagctggtcgccgatttcatggccaaaaagttctccctggatgccctgatcacccacgtcctgcccttcgaaaagattaatgagggttttgatctcctgcacagtgggaagagcattcgaacagttttaaccttctag

SEQ ID NO: 178559 - DNA, 1008 bp, Artificial Sequence
  Description of Artificial Sequence: Synthetic coding sequence
atggtggccgtgggcatctgccacaccgacgaccacgtggtgagcgggaacctggtaactcctttacccgtgatcttagggcacgaggctgcagggatcgttgagtcagtgggagaaggtgtgacaaccgtgaagcccggcgacaaggtgatacctctgttcacccctcagtgcggcaagtgtagggtatgtaaaaatcccgagagcaattattgcctcaaaaacgatttaggcaaccctcgcggaactctgcaggacgggacccggaggttcacatgccgaggcaagccgatccaccatttccttggcactagcaccttttcccagtacactgtggtcgatgagaacgctgttgccaagatcgacgcggcctctccactggagaaagtatgcctcattggatgcggcttttcgacgggctacgggtctgccgtgaatgtggccaaggtcactccaggctcaacttgcgcagtcttcggcttaggaggcgtggggctctcagctgttatgggatgtaaagccgctggagctgcgaggattattgccgtagacattaacaaggataagttcgcgaaagctaaagagctgggagcaacggaatgtatcaatccacaggactacaagaagcccatccaggaggtgctaaaagaaatgactgacgggggggtagatttttcatttgaggtcattggaagactggatactatgatggcttccctactttgctgccacgaagcgtgcgggacctcagttatagttggagttccacccgcctctcagaacctgtctattaatccaatgctgttgctgaccggaagaacttggaaaggcgccgtatatggtggtttcaaatccaaggaaggcatccctaagttagtggccgatttcatggccaaaaaattcagtctggatgccctgattacacacgtgctaccttttgagaagatcaatgagggatttgaccttctgcacagtggcaaaagcattcggacagtgttaacattctag

SEQ ID NO: 178560 - DNA, 1089 bp, Artificial Sequence
  Description of Artificial Sequence: Synthetic coding sequence
atgagcaccgccggcaaggtgatcaagtgcaaggccgccgtgctgtgggaggtaaagaagcctttttccattgaagacgtggaggtggcccccccaaaagcttacgaggtccgaatcaagatggtggcagtcggaatctgtcatacagatgaccacgtggtgagcggaaatctggtcactccgctgcctgttattctaggacacgaagccgccggaattgttgaatctgtgggtgagggtgtgaccaccgtgaaaccgggagacaaagtgatcccactgttcactccccagtgcggtaaatgccgcgtgtgcaaaaatcctgaatccaattactgccttaaaaatgatttaggaaaccctagaggaaagccaatacaccattttcttggtactagtacgttctctcagtataccgtcgtggatgaaaacgctgttgctaagatcgacgcggcttcccctctggagaaggtctgtctgattggctgcgggttctccaccggttatggcagtgccgttaatgtcgccaaagtgacacctggatctacctgcgctgtcttcggactggggggggtaggcctgtctgcagtaatgggatgcaaggccgcgggagccgctcgcattatcgcagtggatattaataaagataagttcgccaaggccaaggagctcggcgccaccgagtgcatcaatccacaggattataaaaaaccaatccaggaagtgttaaaagaaatgacagacggcggagtagacttttccttcgaagtgattggtagacttgacacaatgatggccagcctgctttgttgtcatgaggcttgtgggacaagcgttatcgtgggagtgcctcccgcatcccagaatttgtcaatcaaccccatgctcctcctgacaggtcgcacatggaagggcgcagtttacggggggttcaagtcgaaagagggaattcccaagctggtggcagacttcatggctaagaagtttagcctggatgccttgattacgcatgtgcttcccttcgagaaaattaatgaaggatttgatttgctccattcaggtaagagcattcggaccgtgctaacattctag

SEQ ID NO: 178561 - DNA, 1143 bp, Artificial Sequence
  Description of Artificial Sequence: Synthetic coding sequence
atgggcaccaagggcaaggtgatcaagtgcaaggccgccatcgcctgggaagccggcaagccactgtgtatcgaagaggtggaagtggcccccccaaaggctcacgaggtgcgtattcagatcattgccacctcactgtgtcacaccgacgctactgtaattgattccaagttcgaaggcttggcattccctgttatcgtaggacacgaggccgcagggatagttgagtcaattggaccaggagtcactaatgtgaagccaggagataaggtcattcccctgtatgcacccctgtgtcgtaagtgtaaattttgtctgtcaccgctaactaacctttgcgggaagatcagcaacctaaagagccccgcttccgatcagcagctgatggaggacaagaccagtaggttcacatgtaagggcaaaccagtgtaccactttttcggcacctcaacattctcacagtacacagttgtatccgatattaacctggcaaagattgacgatgatgcaaatcttgagagggtgtgcctcctaggctgcggtttctctacgggttacggggccgctattaacaacgccaaagtgaccccagggagtacctgcgccgtttttggcctgggcggtgtgggcctttcggccgtgatgggttgcaaggccgccggggcaagcaggattatcggcatagatatcaatagcgaaaaattcgtgaaggctaaggcactgggcgctaccgactgcttaaacccacgagatctgcacaagccaatccaggaggtcattatagagctgaccaaagggggcgtggatttcgctcttgactgcgcaggcggaagtgagaccatgaaggcagctctcgactgtactacggcaggctggggatcttgtacctttattggcgtggccgccggctctaaggggttaaccatcttccccgaggagctgattatcggaagaaccatcaatggaaccttttttggcggctggaagagtgtggatagcattcccaagcttgtcacagattataagaacaagaaatttaacctggatgccttagtcacccacaccttaccctttgataagatcagtgaagcttttgacctcatgaatcaggggaagtcagtcagaaccatactgattttttag

SEQ ID NO: 178562 - DNA, 1200 bp, Artificial Sequence
  Description of Artificial Sequence: Synthetic coding sequence
atgctggtgcggggcccccacttcgagctgcagcggtgcaagacccatttgttctctagtaattaccttactcaggttatcaaatgcaaagctgccatcgcatgggaggctggaaaaccactctgcatcgaggaagtggaggtagcaccacctaaagcccatgaagtcagaatacaaatcatcgcgacgagtttgtgccacacagatgctaccgtgatcgacagcaagtttgagggactggcctttcctgtaattgtgggacacgaagcggccggaatcgtagagtctatcggcccaggagtgacaaacgtaaaacccggggataaggtcataccactgtacgcgccactctgccgcaaatgcaaattctgcctctccccacttacgaacttgtgcggcaagataagtaatctgaagtccccagcttccgatcaacagctaatggaggataagaccagtcgctttacttgtaaagggaagcctgtctatcacttcttcggaacctccacgttttcccaatacactgttgtctcagacatcaacctggcaaaaattgacgatgacgccaacctcgagagagtatgtctgctgggatgcggtttcagtacaggctatggggccgcgatcaacaatgccaaggtgactcctgggtctacttgtgctgttttcggcctcggaggcgtaggtttgtcagccgttatgggctgtaaggccgctggagcgtctagaatcatcggtatcgatataaactcagaaaagttcgttaaggctaaagccttaggggccactgactgcttaaaccctcgcgacctccacaagccaatccaggaagtcattatcgaactcactaagggcggagtcgattttgctttagactgcgccggtgggtcagaaacaatgaaagcggcactcgactgtaccacagccggatggggctcatgtacttttattggcgtcgcagctggatctaaaggcctgacgatcttccccgaagagttaatcattggcaggacaatcaacggtacgttcttcggcgggtggaaaagtgttgacagcatacctaaactagtcaccgattataagaacaaaaaattcaacctcgacgcattagtcacacacactctccccttcgacaagatctctgaagctttcgatcttatgaaccagggtaagagcgttaggactattctcatcttttag

SEQ ID NO: 178563 - DNA, 1125 bp, Artificial Sequence
  Description of Artificial Sequence: Synthetic coding sequence
atggccaacgaggtgatcaagtgcaaggccgccgtggcctgggaggccgggaagccactgtccatagaggagattgaggtggcccctcctaaagctcatgaagtgagaattaagatcatcgcaaccgctgtgtgccacaccgacgcttacaccttgtccggtgctgaccccgagggctgcttcccagtaatcctcggccacgaaggagccggcatcgtagagtcggttggggagggggtgaccaaactgaaagcaggtgatacagttatccccctgtacataccccagtgtggagaatgcaaattctgcctgaacccgaagactaacctctgccaaaaaattagggttacccaaggtaaaggtctgatgccagacgggacttctcgcttcacctgcaaggggaagaccatcttgcactacatgggcacctccacatttagcgagtacacagttgtggccgacatttcggtggctaagatcgaccctcttgcacccttggacaaagtgtgtcttctcggctgcggtatctccacaggctacggcgccgctgtcaacacagctaagttggagccaggttctgtgtgcgctgtgttcggtctggggggggtgggtctcgccgtaattatggggtgcaaagttgccggagcttcaaggattataggagtcgacataaataaagacaagtttgcccgggcaaaagagtttggcgccaccgaatgtattaatccccaggacttttcaaaacccatccaagaggtgctgatcgaaatgacagatggcggggttgattactcctttgaatgtataggcaacgtcaaagttatgcgcgctgcactagaggcttgccataagggctggggggtttcagttgtagtgggcgtagctgctagcggcgaggaaatcgctacccggccctttcagctggtgacaggcagaacatggaagggaactgctttcggcggatggaagtctgtcgagagcgtgcccaagctcgtgtcagaatatatgagtaaaaagatcaaagtggacgagttcgtgacccacaacttaagttttgatgaaataaataaggcatttgagcttatgcattctgggaaaagtattaggaccgtcgttaagatctag

SEQ ID NO: 178564 - DNA, 1107 bp, Artificial Sequence
  Description of Artificial Sequence: Synthetic coding sequence
atgtgcaccaccggccaggtgatccggtgcaaggccgccatcctgtggaaacctggcgccccttttagtattgaagaagttgaagtggctccccctaaagccaaagaggtgagaattaaggtagttgctacagggctctgtgggacagaaatgaaggttctcggatcaaagcatctggacctgctctatcccaccattctgggccatgaaggggccggcattgtcgagtcaatcggagagggagtcagtacagtgaaaccaggcgacaaggtgatcacattgttcctcccccagtgcggtgagtgtacctcgtgtctcaattccgaaggaaacttctgtatccagttcaagcagtcaaaaacccagctcatgagcgacggcacgagtaggttcacctgtaaagggaagtctatctatcacttcggaaatacatctaccttttgtgaatacaccgtaatcaaagagatttctgtcgccaaaatcgatgctgtagcaccccttgagaaggtgtgcctgatcagctgtggattctccacaggcttcggtgcagctatcaacaccgcgaaggtgacccccggatccacatgcgctgtgtttgggctcggcggggtgggattgtctgttgttatgggctgtaaagccgccggggcagcccgcattatcggcgtggacgtcaacaaagagaagtttaagaaggcccaggagttgggcgccaccgaatgcctgaatccccaggatttaaagaagcccatacaggaagtgctatttgacatgacagatgccggcatcgacttttgtttcgaagctattgggaacctggatgtactggcagccgctctcgcctcttgcaacgaatcctatggcgtctgcgttgtggttggggttcttccagccagcgtccaactgaagatctccgggcaacttttcttcagcggccgctcactgaaggggagcgtattcggagggtggaaatctaggcagcacatccccaagctcgttgccgattacatggccgaaaaactaaacctcgacccactcatcacacatacgctgaaccttgataaaatcaacgaggcagtggaattgatgaagaccggcaagtggtag

SEQ ID NO: 178565 - DNA, 1128 bp, Artificial Sequence
  Description of Artificial Sequence: Synthetic coding sequence
atgtgcaccaccggccaggtgatccggtgcaaggccgccatcctgtggaaacccggggcgcctttctcaatcgaagaagtcgaggtggcccccccaaaagctaaggaagttagaataaaagtggtagctaccggcctgtgcggtacagaaatgaaagttttgggctctaaacatttggacctcctgtatccaacgatcttaggacatgagggtgccgggatcgttgaatccattggagagggcgtcagcacggtcaagccgggtgacaaggtaattactctcttcctgcctcagtgcggtgagtgtacttcctgtctgaattccgagggaaatttttgtatccagtttaaacagagtaaaacccagctgatgtctgatgggacatccaggttcacttgcaaagggaagtccatatatcattttggtaacactagcactttctgtgagtatactgtgattaaagagatctccgttgccaaaatcgacgccgtggcccctctcgaaaaagtttgccttatttcttgtggctttagtacagggtttggggcggctatcaacacagcaaaagttacccccggctctacttgtgctgtgtttggactgggcggagtgggattatctgtggtgatgggctgtaaagctgccggagctgcaaggatcataggtgttgacgtaaataaggaaaaatttaagaaggcccaggaacttggagccaccgaatgtcttaacccacaggatcttaagaaacctattcaagaggtcctttttgacatgaccgacgcagggattgacttttgttttgaggccatcggcaatttggatgtcttggccgctgccctcgcatcctgtaacgaaagctacggcgtgtgtgttgtcgtcggcgtgctacctgcctctgttcaattgaagatttcagggcaactattcttcagcgggcgctctctcaaaggttcagtgtttgggggatggaagtcgaggcagcatattcccaagctcgttgccgactacatggctgaaaagctgaacctggatcctctgatcacccatactctcaatctggacaagatcaatgaagccgtggagctgatgaagacgggcaagtgcattcgctgcattctcttgctttag

SEQ ID NO: 178566 - DNA, 501 bp, Artificial Sequence
  Description of Artificial Sequence: Synthetic coding sequence
atgggctgcaaggccgccggcgccgcccggatcatcggcgtggacgtgaataaagagaagttcaaaaaagctcaagagctgggcgctacagagtgtctaaatcctcaggatctaaagaaaccaattcaggaggtgctgttcgacatgactgacgccggtattgatttctgttttgaggccattggaaatctggatgtcctggcggcggccttggcgtcctgtaacgagtcctacggggtttgtgttgtcgtcggagtcttgcccgcctccgtacagctcaagatatcaggacagctgttctttagcgggcggtctcttaaagggtctgtgttcggaggctggaagtccaggcagcatattcctaaactcgttgccgactacatggccgaaaaacttaatctggaccccttgatcacccacacactcaacctagacaagatcaacgaggcagtcgagctgatgaagacaggaaagtgtataaggtgcattctgctgctctag

SEQ ID NO: 178567 - DNA, 1068 bp, Artificial Sequence
  Description of Artificial Sequence: Synthetic coding sequence
atggagcccgagaagcagaccgagatcagcgagttcttcctgcaggggctgagtgaaaaacccgaacatcagacgttgttgtttaccatgtttctgagcacctatcttgtaacgatcatcggtaacgcattgataatccttgcgatcataaccgacagtcacttgcacaccccaatgtacttcttcctgttcaacctttcgctcgtcgatacactgctaagtagcaccactgttcctaagatgctcgctaacatacaagcccagtctcgggccattcctttcgtcggctgcctcacacagatgtacgcttttcatctctttggcacaatggatagtttcctgttggcagtgatggcaatagatcggttcgtggccatcgtgcaccctcagaggtatcttgtcctaatgtgttcgcccgtgtgcggtctgctgctcggagcttcctggatgatcactaacttgcagagtctgattcacacttgtcttatggcccagctgactttctgcgcaggctcagaaatatcccactttttctgtgatctgatgccactgctgaagctatctggttccgacacacacaccaacgagctggtgattttcgccttcgggatcgtggtgggaacgtctccattcagttgtattctcctcagctacattcggattttttggacagtgttcaagatcccctctacacgcggtaagtggaaagccttctctacctgtggactgcacctgacagttgtttctctgtcatacgggaccattttcgcggtctatctgcagcctaccagcccctcctcttctcagaaggataaggcagcggccctgatgtgcggagtgttcatacctatgctgaacccattcatttatagcatccggaacaaagatatgaaggctgcgctgggcaagctcatcgggaaagtagctgtcccatgcccgagaccggaacaacttttagatgtgtaccacgtacctggatccctgctggcagcccgcgacactgagatgcaccccattccataccctggaggggtccaaagcctggcaggtaatagggatatggagtag

SEQ ID NO: 178568 - DNA, 1125 bp, Artificial Sequence
  Description of Artificial Sequence: Synthetic coding sequence
atgggcaccgccggcaaggtgatcaagtgcaaggccgccgtgctgtgggaacaaaagcagccattttccatcgaggagatcgaagtcgccccgcctaagactaaagaggtcaggatcaaaatcttagcaacaggaatttgcagaacagacgaccacgttatcaaaggcaccatggtcagtaagtttcctgtgattgtcgggcatgaagcaacaggcatcgttgagtccattggtgaaggcgtgaccaccgtgaaacccggcgataaggtgattccactcttcctgcctcagtgccgtgagtgtaacgcatgtagaaatcccgatggtaatttgtgtattcgctccgacataacaggcagaggcgttctcgccgacggtaccactcgcttcacctgcaaggggaagcccgtccaccactttatgaacacctccaccttcacggaatacactgtggtggacgagagtagcgttgctaaaatagatgacgccgcaccgcccgaaaaggtatgcctaattggatgcgggttcagcacaggatatggcgccgcagtaaaaacagggaaagtaaaacctggatccacgtgtgtggtcttcggtctgggtggcgtggggctgtcagtgataatggggtgcaagtccgccggggcaagtagaatcattggtattgacctaaataaagataagtttgagaaagctatggccgttggagctacagagtgcatatcccctaaagactcaacgaagcccatcagcgaggtactgtctgagatgacggggaacaatgtgggctatacttttgaagtgatcggtcacctggagactatgatcgatgccttggcctcctgccacatgaactatgggacatcggtggtggtcggagttccaccttcagcaaaaatgttaacttacgacccgatgctgttgtttacaggacggacgtggaaggggtgtgtcttcggaggtctgaagtcccgagatgatgtgcccaagctggtcacagaattcctggccaaaaaatttgacctcgaccagctgatcacacacgtgctgcctttcaagaagatctccgaaggctttgagctgctgaattcgggacagtcaattcgcacggttcttaccttctag

SEQ ID NO: 178569 - DNA, 1185 bp, Artificial Sequence
  Description of Artificial Sequence: Synthetic coding sequence
atgaagtgcctggtgagccggcacaccgtgcgggagaccctggacatggtttttcaacgaatgagcgtggaggccggcgtgatcaagtgcaaagccgccgtgctttgggagcagaaacaaccctttagcatcgaggagatcgaagtggctcctccaaagaccaaggaggtgagaatcaagatccttgctaccgggatctgtaggaccgatgaccatgttataaaagggacaatggtctccaagtttcccgtcatcgtgggtcacgaagcgacaggaattgtggagtcgataggggagggcgttacaactgtgaaaccaggagacaaggtgattccactgttcttaccacagtgcagagagtgcaacgcctgtagaaatccggatggcaacctgtgcataaggagcgatattacagggagaggcgtcctagctgatggcactacacgattcacatgcaagggcaaaccggtccatcattttatgaacacatctacgttcaccgaatacaccgttgtggatgagtccagcgtcgctaaaattgacgacgccgcccctcccgagaaagtgtgtctgattggctgtggattttccacagggtatggagccgccgtgaaaaccggcaaagtgaagcccgggtccacttgtgtcgtgttcggcctcggtggcgtgggcctgtctgttattatgggatgtaaaagcgccggcgcctcccggatcattggcattgacctgaataaggacaaatttgaaaaggccatggcggtgggggccaccgaatgcattagtccaaaggattctactaagcctatcagcgaagtgctcagtgagatgactgggaataatgttggttatacatttgaggtcataggccacctggaaacaatgatagatgcacttgcttcttgtcacatgaattacggcacttcagtcgtggtgggtgtcccacctagtgccaagatgcttacctacgatccgatgttactctttactggaaggacatggaaagggtgcgttttcggcggcttgaagagcagagacgacgttcccaaattggtgacagagttcctagctaagaaattcgaccttgaccagcttattactcatgttcttccattcaaaaaaatttcagagggattcgaactactgaactccggacaatccatcagaaccgttctgactttctag

SEQ ID NO: 178570 - DNA, 954 bp, Artificial Sequence
  Description of Artificial Sequence: Synthetic coding sequence
atggtgagcaagttccccgtgatcgtgggccacgaggccaccggcattgttgaaagtatcggagagggggtaaccaccgttaagcctggggacaaggtgatccctctgtttctgccacagtgcagggagtgcaatgcctgtcggaaccccgacggaaatctctgtatccggtccgacattaccgggcggggcgtgttggctgacgggacgacgcggttcacatgcaaaggcaagccagtgcatcactttatgaatacctcgaccttcaccgaatatacagtggtggacgaatcatccgtcgccaagatagacgatgctgccccgcctgaaaaggtgtgcttgataggttgcgggttttcaaccggctacggagccgccgtcaagaccggaaaagttaaaccaggatcaacctgcgtagtttttggcctcggaggggtgggactgtccgtgattatggggtgcaagtctgcaggtgctagccgcataattggaatagatttaaacaaggacaagtttgaaaaggctatggctgtgggagcaactgagtgcatcagtcccaaagactccacaaaaccgatatcagaagttctctcagagatgaccgggaacaacgtcggctatactttcgaagtgatcggacacctggagaccatgatagacgcgctagctagctgtcacatgaactacgggaccagcgtggtagtcggtgtacctccttcggcaaaaatgcttacttacgatcccatgctcctcttcaccggccgcacgtggaaaggctgcgtttttggtggactgaagtctcgcgatgatgtccccaaacttgtgactgagtttctagccaagaaattcgacctagatcagctcattacgcacgttttgccattcaagaaaatatcagagggctttgagctccttaacagcgggcaaagcatcagaacagtgctgaccttttag

SEQ ID NO: 178571 - DNA, 912 bp, Artificial Sequence
  Description of Artificial Sequence: Synthetic coding sequence
atggccgccgccgcccgggcccgggtggcctacctgctgcggcagcttcaaagggctgcctgccaatgcccaacacactcccacacgtactcacaggctccaggactatctccatccggcaaaacgaccgactatgccttcgagatggcggtgagtaatatccggtatggcgctgccgtgaccaaggaggtgggaatggacctgaaaaatatgggagcgaagaacgtgtgtctaatgacagataagaacctatctaagctcccccctgtgcaggtggcaatggatagtcttgtcaagaacggaattcccttcacagtttatgacaacgtccgagtcgagccgactgactcctctttcatggaagccatcgagttcgcgcaaaaaggcgcttttgatgcttacgtggccgtcggcggaggctccacgatggatacatgcaaggcagccaatctctatgcctccagcccacacagcgattttctggactatgtgagcgcgccaattggaaagggtaagccagtttcggtgcctttgaaaccgctgatcgctgtgcctaccacttcaggtactgggtcagaaactacaggcgttgctatctttgactacgaacatctgaaagtgaaaatcggcatcacgagtagggcaattaagcctacactcgggttgatcgaccccctgcacacattgcatatgcccgctcgggtcgtcgcaaactctggatttgatgtgctgtgtcacgccctggaatcttatactaccctgccttatcacctcaggtctccatgtcctagcaatcctattacccgcccagcctatcagggctcgaatccaatcagtgatatttgggcaatacacgctctgcggattgtggccaaatacctcaagagagcagtgaattctacagataaatag

SEQ ID NO: 178572 - DNA, 1404 bp, Artificial Sequence
  Description of Artificial Sequence: Synthetic coding sequence
atggccgccgccgcccgggcccgggtggcctacctgctgcggcagttgcagagggctgcttgccagtgtcccacccactctcacacctattctcaagctcctgggctttcaccctcaggaaaaaccactgactacgcctttgagatggcggtctcaaatattagatatggcgccgcagtgactaaagaggtcggcatggatttgaaaaatatgggagccaagaatgtgtgtctgatgactgacaagaacctctctaaactcccacccgtgcaggttgccatggactcactggtaaaaaacggcattcccttcaccgtttatgacaacgtgcgtgtggaacccacagactcctccttcatggaggccattgagttcgcccaaaagggagctttcgatgcatatgtggccgtgggcggaggctcaactatggatacgtgcaaggctgccaatctgtacgcctcatctcctcactccgattttctggactatgtcagtgcccccatcgggaagggaaagcccgtcagtgttcctctgaagcccctcattgccgtgccaaccacgtctggcacaggtagcgagaccacaggggtcgcaatatttgattacgaacacctgaaggtgaaaattgggattactagcagagcgatcaaacccacactcgggctgattgatccactgcatactctccatatgcctgctcgagtcgtcgcgaatagtggattcgatgttctttgtcacgccctcgaatcctataccaccttgccataccaccttcgatctccatgtccaagcaacccaattaccagaccggcctaccagggctcgaatcccatctctgacatctgggccatccacgctctgagaatcgtggcaaaatatctgaaaagagccgtgcgcaatcccgatgacctggaggcccgctctcacatgcacctggcctcggcctttgcaggaataggattcggaaacgcaggcgttcacctgtgtcatggcatgtcctatccaatctcagggctcgtaaagatgtataaagcgaaggactacaacgtagaccaccctctcgtcccccacggcctctccgtggtgctaacctccccagcggtgtttactttcaccgctcaaatgttccccgaaagacacttggagatggccgagatcctcggcgctgacacaagaacggcccgaattcaagacgcaggattggtcctggccgatacactgcggaagttcctctttgacttggatgtggatgacggcctcgcagcggttggttattcaaaagctgacatacccgcactcgtgaaaggcacactcccacaggaacgtgtcaccaaactggcaccctgtccgcagtctgaagaggatttggcagcattatttgaggccagcatgaagttgtattag

SEQ ID NO: 178573 - DNA, 2406 bp, Artificial Sequence
  Description of Artificial Sequence: Synthetic coding sequence
atgaagatcgccgtgatcggccagagcctgttcggccaggaggtgtattgccacctcaggaaggaggggcacgaagtagtcggtgtatttacagtgccggacaaggacggaaaggccgatccattgggtctcgaggcagagaaagatggtgtgcctgtttttaaatactctcgatggagggcaaaagggcaagccctgcctgacgtggtagccaagtatcaggccctgggggccgagctgaatgtcctgcccttttgctcccaattcatccccatggagattatatctgcaccacgccacgggtctatcatctaccacccatcactgttgccgaggcaccgcggagcgtcagcgatccacaactggatcagaggtaatgacaaggtccctggcgcctggacagaagcttgcgagcagaaattgactttttttaattccacccttaacactagcggcttagttccggaaggcgatgccttacccatacccggagctcatcgccccggggtcgtgaccaaggccgggctcatcctcttcggaaatgatgacaagatgttgctggtaaaaaatattcagctggaagatggcaagatgatcttagccagtaactttttcaagggagccgcatcttccgttctagagttaaccgaagccgaacttgttaccgccgaggcagtgcgctccgtctggcagagaattctaccaaaagttctggaggtggaagacagtaccgatttcttcaagtcaggggccgccagcgttgacgtcgtgcgcttggtggaggaggttaaggaactgtgcgacgggttggaacttgagaacgaagatgtttatatggcctcaaccttcggagactttatacagctgctagtaaggaagcttcggggggatgacgaggagggtgagtgcagcattgactatgtcgaaatggcagtcaataagcgaaccgtgcggatgccacatcagcttttcattggaggggaatttgtcgacgccgaaggtgccaagacgagcgagaccattaaccctacagatggcagcgttatctgtcaagtgtccctggcccaggtaacagacgtggataaggcggtcgcagcggcgaaggacgcctttgagaacggccgctggggtaaaattagcgcccgcgacagggggcggctcatgtaccgcctggctgacctcatggagcagcatcaagaggagctcgctacgatcgaggcccttgatgcaggtgctgtttatacactcgcactgaaaacccatgtgggcatgagcattcagacctttaggtactttgccggatggtgcgacaaaatacagggaagcaccattccaatcaatcaggcaagacctaatagaaatctgactctgacaagaaaagaacccgttggcgtgtgtggtattatcattccctggaattatccgctgatgatgctctcatggaagaccgccgcctgccttgccgcagggaacaccgttgtcatcaaacctgctcaggtaacaccgctgactgctctcaagttcgctgagctgaccctaaaggccggtattccgaagggagtggtcaacgttctgcccggtagcgggagtctcgttggacagcgcctgtcagatcaccctgacgtcagaaaaattggctttactggtagcaccgaggtgggcaagcacattatgaaaagttgcgctattagtaacgtcaagaaagtgtctctggagctcggcggcaagtccccactcatcattttcgccgactgcgacctgaacaaagctgtacaaatgggaatgtccagcgtgtttttcaacaaaggtgagaattgcatcgcggccggccggctcttcgttgaggactccattcatgatgagttcgtccggagagtcgtggaagaagtgaggaagatgaaggtgggtaacccgctcgacagggatactgaccatgggccacagaatcaccacgcacatctggtgaagctgatggaatactgccaacatggggttaaggagggcgcgacactcgtatgtggcggcaaccaggtacccagacctggattcttcttcgagcccacagtatttacggacgttgaagatcatatgttcattgccaaggaagaaagcttcggcccagtcatgatcatcagccgttttgccgacggggaccttgacgccgtgctgtctcgggctaacgccaccgagtttggactcgcgtctggcgtgtttactcgggatattaataaagctctgtatgtctccgataaactgcaggccggcacggtcttcgtaaacacttataataagactgacgttgcagccccatttggagggtttaaacagtccgggttcggcaaggatctgggagaggctgcccttaacgagtacctgagggtcaagacagtgactttcgagtactag

SEQ ID NO: 178574 - DNA, 1506 bp, Artificial Sequence
  Description of Artificial Sequence: Synthetic coding sequence
atgagcagcagcggcacccccgacctgcccgtgctgctgaccgacctgaaaattcaatacactaaaatcttcatcaacaacgaatggcatgattccgtgtcgggcaaaaaatttcctgtctttaatcccgccaccgaggaagaattgtgccaggttgaagaaggcgataaggaagatgtggataaggctgtgaaggctgcaagacaggcgttccagatcggcagtccatggcgaacaatggacgcctctgagagagggcggctcctctacaagctagctgacctcatcgagagagacagactcctgctcgccactatggagtcaatgaatggcggcaagctatattccaatgcttatttgaatgacctggccggctgcattaagacgctgagatactgcgccgggtgggcggacaagatccaaggtcgtactatacccattgatggcaatttttttacatatacgcgccacgagccaataggcgtatgtggacagatcatcccctggaatttccctctcgtcatgctgatctggaaaattggaccagccttatcttgcggcaatacagtggtagtgaagcctgcggagcaaacacccttgaccgcacttcatgtggcttccctgatcaaagaggccggcttcccaccaggcgttgtgaacattgtgcctggctacgggcccacagccggggcagccatcagctctcatatggatattgataaggtggccttcaccggttctacagaggtcggcaagctgataaaggaggctgctggtaaatctaacctgaaacgcgtgacgctcgaattgggagggaaaagcccatgcatagtgttagcagacgcggacctcgataacgcagtcgagtttgctcaccatggtgtgttttatcatcagggtcagtgctgcattgctgcctcacgtattttcgttgaggagagcatatatgacgaatttgtcaggaggtccgtcgagcgggctaagaagtacatactaggcaaccctctcacccctggcgtcacacaaggcccacagatcgacaaagagcagtatgacaaaatactggatcttatagaatcagggaaaaaagaaggtgcaaaactcgaatgcgggggtggaccttgggggaataagggatacttcgtgcaacccactgtgttctcaaatgtcacagatgagatgcggattgccaaagaagaaatattcggacccgtgcagcagattatgaaattcaaatcgctggacgacgtgatcaagagagccaataataccttctatggtctcagcgccggcgttttcacaaaggatatagacaaggccatcaccatttccagcgcgctgcaagcaggcacagtgtgggtaaattgctatggggtggtctctgcccagtgtccatttgggggattcaagatgtctggaaacggccgcgagttgggcgagtatgggtttcatgagtacaccgaagtcaagactgtcaccgttaagatctctcagaaaaatagctag

SEQ ID NO: 178575 - DNA, 693 bp, Artificial Sequence
  Description of Artificial Sequence: Synthetic coding sequence
atgagcagcagcggcacccccgacctgcccgtgctgctgaccgacttaaaaatccagtatacgaagatcttcataaataacgagtggcatgatagtgtatccggcaaaaagttccctgtcttcaatccagcaacagaggaggaactgtgtcaggtggaggagggcgataaagaagatgtcgacaaagcagtgaaggcggctcgccaggcctttcaaatcggtagtccctggcgaactatggatgcttctgaacgggggcgtttactctacaagctggctgatctcatcgaaagggatcgattgctgttggccacaatggaaagtatgaacgggggaaaactatacagcaatgcctacctgaacgacttggcaggttgcattaaaactcttcggtactgcgctggatgggctgataagattcaaggcagaaccatacccatcgatggaaatttttttacctacacccggcatgagcccatcggagtttgtggacaaataatcccttggaattttcccctggtgatgctcatatggaaaattggacctgccttgagttgtgggaacactgtggtcgtgaaacctgcagagcagacgcccctgacagctcttcacgtcgcttcacttatcaaggaagcaggttttcccccgggagtcgtaaacattgtgcccggctatggcgccagtgtggtgtag

SEQ ID NO: 178576 - DNA, 717 bp, Artificial Sequence
  Description of Artificial Sequence: Synthetic coding sequence
atgagcagcagcggcacccccgacctgcccgtgctgctgaccgaccttaagatccagtatacgaagatcttcataaacaacgaatggcacgattctgtaagtgggaaaaaatttcccgtcttcaatcctgccaccgaagaagagttgtgccaggtggaagagggggacaaagaggacgtcgataaagccgtgaaggctgctaggcaggctttccaaatcggctccccctggcgcactatggatgcaagcgaacgaggtaggctgctgtataagttggcagaccttatcgagcgggatcgcctccttctggccactatggagtccatgaacggtggcaagctatattctaatgcctacctaaatgatttggccggatgtatcaagactcttagatactgcgctgggtgggctgacaaaattcagggccgcacaatccccattgatgggaactttttcacgtacaccagacacgaaccaattggtgtgtgcggccagattataccctggaattttcctttggtgatgctaatttggaagatcggcccagccttaagttgcggaaataccgtcgttgtcaaacccgccgagcagactcctttgactgcgcttcatgtggcaagccttatcaaggaagcaggcttccccccaggcgtggtgaatattgtaccagggtatggtcccacagcaggggccgccatcagtagccacatggattag

SEQ ID NO: 178577 - DNA, 990 bp, Artificial Sequence
  Description of Artificial Sequence: Synthetic coding sequence
atcgccgagcccgtgacctgcgtgcccggcgccgagagcgagatgagttcttccggtacaccggatctgcccgtgttgctgacggatctgaagattcaatatactaagatcttcattaataatgaatggcatgactccgtgtcgggaaagaaattccctgttttcaatccagccacggaggaggagctctgtcaggtggaagaaggggacaaggaagatgtagataaggccgttaaggccgcccgacaagcctttcagattggctctccctggcgtaccatggacgccagcgaaagggggcgtcttctgtataagctggcagatttgatcgaaagagacagacttttgcttgcaacaatggagagcatgaatggtggtaagctatatagcaacgcatatctgaacgacctagccggatgtataaagacactgagatactgcgccggctgggccgacaagatacagggaaggaccataccaatcgacggcaattttttcacctacacccggcatgagcccatcggcgtgtgtgggcagatcatcccctggaacttccccctggtgatgctaatctggaagattggtcccgctttgtcatgcggaaataccgttgtggtcaaacccgccgagcagacgccgctgactgctttacacgtagcttcactgatcaaggaggcagggttccccccgggggtagtcaacattgtccctggctacggtcctaccgccggtgcggccattagctcacatatggacatagataaggtggctttcactggaagcacagaggtggggaagctgatcaaggaggccgctggcaagagtaatctgaaaagggtcactctggagttaggcggaaaatcgccttgtatagtgttggccgacgcagacctggataacgctgtggaatttgcgcaccacggggtcttctatcatcaaggccaatgctgtatcgccgcctctagattttgcgggcggattaacctgtag

SEQ ID NO: 178578 - DNA, 612 bp, Artificial Sequence
  Description of Artificial Sequence: Synthetic coding sequence
atgagcagcagcggcacccccgacctgcccgtgctgctgaccgacctgaaaattcagtatacaaagatctttattaataatgagtggcatgactctgtgagcggcaaaaaattccccgtttttaatcctgcaaccgaagaggagttgtgtcaagttgaggagggggacaaggaggacgtggacaaagccgttaaagctgcccgacaggccttccagatcggcagtccttggcggacaatggacgccagtgagaggggccgcttgttatacaagttggctgatctcattgaacgtgaccggttactcttggcgacaatggaatcgatgaatggcgggaagttatatagcaacgcttatcttaatgatttagccggctgcataaaaactttgcggtactgcgctggatgggcagataagatacaaggacggactattcctattgatggaaacttcttcacctatacccgccatgaacccatcggtgtgtgcgggcagatcattccctggaatttccccctggtcatgttgatctggaagattggccctgcactgtcgtgcggcaacacagtggtggtaaagcccgcggagcagacacctctgacagcgctgtag

SEQ ID NO: 178579 - DNA, 1557 bp, Artificial Sequence
  Description of Artificial Sequence: Synthetic coding sequence
atgaccagcagcaagatcgagatgcccggcgaggtgaaggccgaccccgccgccctgatggcatcactgcatctgctgccttccccaacgcctaacttagaaatcaaatacacgaagatcttcattaacaatgagtggcaaaattccgagtctggccgtgtcttcccggtctacaatcctgccaccggggaacaggtttgtgaagtgcaggaggctgacaaggccgatatcgataaagctgtgcaggctgccagattggcgttttctctcggcagtgtgtggcgacgaatggacgccagcgaaaggggacgcttgcttgacaaactggccgacctcgtggagcgcgatcgggccgtattggccacgatggagtcgttaaatggcggtaaaccctttctgcaggccttctatgtagatttacagggagttattaaaacatttaggtactacgcaggttgggcagacaagatccatggaatgacaattcctgtagacggagactacttcacctttacaaggcacgaacccattggggtgtgtggacaaataatcccttggaattttcctctgctgatgttcgcctggaaaattgcccctgccttgtgttgcggcaatacagtggtcatcaaaccagccgaacagacccccctgtccgccttatatatgggagctctgatcaaagaagctggattcccccccggcgtgataaacatcctccctgggtacggacccaccgctggggcggctatcgcttcccatatcggcatcgataagattgcatttactggcagtaccgaggtcggcaagctgatccaggaggccgctgggcggtctaacctgaagcgggtgaccctggagctcggcgggaaatctccaaatattattttcgctgacgccgacctcgattatgcagtcgagcaggcccaccagggcgtcttctttaatcaagggcagtgctgtactgcaggttctcgaatcttcgtcgaagaatccatctacgaggaattcgtgaggcgcagcgtggagcgcgcaaagcgacgggtggttgggtctccatttgatcccaccaccgagcagggtcctcagatagataaaaaacagtacaacaagatcctcgaactaattcagagtggcgtggccgaaggagccaagctagagtgtggtgggaaaggcctgggcagaaaaggcttcttcatcgagcctactgtcttcagtaacgtgactgatgacatgcgaatcgccaaggaagaaatattcggaccggtgcaagaaatcctaagattcaaaactatggacgaagtgatcgaacgagccaataacagtgacttcggcctagtggccgctgtcttcacaaatgacattaacaaggcacttactgtgtcatcagcgatgcaggctggaactgtgtggattaattgctataatgcccttaacgcccaaagcccctttggaggattcaagatgtctggtaacggaagagagatgggagagtttggactaagggagtactcagaagtgaagactgtgacggtcaagattcctcagaaaaactcttag

SEQ ID NO: 178580 - DNA, 1443 bp, Artificial Sequence
  Description of Artificial Sequence: Synthetic coding sequence
atgaccagcagcaagatcgagatgcccggcgaggtgaaggccgaccccgccgccctcatggcttcactccacctactaccttcacccacacccaacctcgaaatcaaatatacaaagatctttattaacaatgaatggcaaaacagcgagtccggaagagtttttccggtctataatcctgctaccggcgagcaggtgtgcgaagtgcaggaggcagacaaggccgacattgacaaggccgtccaagccgccaggctggctttctcattggggtccgtctggcggcgcatggatgcatccgaacgagggaggttgctcgataagttggctgatctggttgagcgcgaccgagcggtgctcgctacaatggagagtctgaacggcggtaagccttttcttcaggcattctacgtggatctgcagggtgtgattaaaactttccgctattacgccggctgggcggacaagattcatggaatgactatccctgttgatggtgattatttcacctttacacggcacgagcccataggtgtttgtggccagattattccgtggaactttcccctgctgatgttcgcatggaaaatcgctcctgcattgtgttgtggcaatacagtagtaattaaaccagccgagcagacgcccctgtcggctctctatatgggagccctcatcaaggaggtcgggaagttgattcaggaagcagctggtaggtcgaacctgaagagagtcactctggagctggggggcaaatcaccgaacatcatcttcgccgatgcggatctcgactatgcagtggagcaggctcaccagggcgtcttcttcaatcagggacagtgttgcacggcgggctcgaggatcttcgtggaggagagcatctacgaggagtttgtgcgccgctccgtcgagcgcgccaagcgtagggtggtaggctccccctttgacccgacaaccgaacaggggccccaaatcgataaaaagcagtacaacaagatcttggagctcatccagagcggcgtggcagaaggggcaaaattagaatgtggaggtaagggcttgggacgtaagggcttcttcatcgagccaactgtgttctctaatgtgaccgatgatatgaggattgccaaagaggaaatttttggcccggtacaggaaatactacgtttcaaaactatggacgaggttatcgaaagggccaataatagtgactttgggctcgtggccgccgtctttacgaatgacataaataaagcacttaccgtgtccagcgccatgcaggctggtactgtatggataaactgttataatgctctgaatgcacagagccccttcgggggatttaaaatgtccggcaacggcagagaaatgggggagtttggcctaagggaatactccgaggttaagaccgtgactgtcaagattcctcagaagaatagctag

SEQ ID NO: 178581 - DNA, 1494 bp, Artificial Sequence
  Description of Artificial Sequence: Synthetic coding sequence
atgaagaaccagtgcgagaccgtgtggctgaagagccccatcaagctgaaactgatttttattaataacgagtggcagaattcggaatctggccgtgtgttcccagtatacaaccctgcgaccggagagcaagtttgtgaagtccaggaggccgacaaagcagacatagacaaagccgtccaggccgcccggctggcattcagcctggggagcgtgtggaggaggatggatgcttcggagcgggggcgccttctcgacaaactggccgacttagtggagagggaccgcgccgtcctggcaactatggaatctcttaacggcggcaagcccttcctgcaggcattctacgtcgacttgcagggcgtgattaagacgttcagatactacgcaggttgggcagacaagattcatggaatgacaattccggtcgatggcgactacttcacgtttaccaggcacgaacctataggagtgtgtggacaaatcattccttggaactttccactgctgatgtttgcatggaagatcgcccccgctctgtgttgcggtaacactgtcgtgatcaagccagctgaacaaaccccattgagcgccttgtatatgggcgctcttatcaaagaagcaggttttcctccaggcgtcatcaatatactcccgggttatggcccaaccgcgggagccgccatcgcctcacacatcgggatagataagatagcctttacaggttcaacagaagtcggcaaactgatacaagaagccgccggcagaagcaatctgaagcgggtgacactggagctgggtgggaagtctcctaacatcatatttgctgatgccgatcttgactacgccgtcgaacaagcccaccaaggtgtgttctttaatcagggccagtgctgtacagcagggtcaaggatcttcgtagaagaaagcatatacgaggagtttgtgcggagaagtgtggaaagagctaaacgaagggtggtaggcagtccgtttgatcctacaactgagcagggcccgcagattgacaaaaaacagtataacaagattctagagttgatacagagcggagttgctgagggcgctaagctggaatgtgggggaaagggcctggggagaaaggggttcttcatcgagcctacagtgttcagcaatgtgaccgacgacatgcgcattgccaaggaagagatttttgggcccgtgcaggagatactgcggttcaaaaccatggacgaagtaatcgagagagcgaataattcggactttgggctcgtggccgcagtcttcaccaacgatatcaacaaagctctcacagtctcatcagcgatgcaggcaggaaccgtatggataaactgttataacgcgctgaatgcccagtctccattcgggggatttaagatgtctggcaatggcagagaaatgggtgagtttggactgcgcgagtatagcgaggtgaagactgtgactgtgaaaatccctcagaagaattcttag

SEQ ID NO: 178582 - DNA, 1470 bp, Artificial Sequence
  Description of Artificial Sequence: Synthetic coding sequence
atgaagggcaagaactgcaacgacgtgaagatcttcatcaacaacgagtggcaaaacagtgagtccggccgcgttttccccgtatataaccctgctactggagaacaggtttgtgaggttcaagaggcagacaaagccgatattgacaaagccgttcaggccgcccggctggcgttttcgctgggttcagtctggagacgcatggacgcttccgagcgcggcagactgctggataagttggcggacctagtggagagggatagagcggtgcttgccactatggaaagtctgaatggtggcaaaccgtttctgcaggcattctacgtagatctacaaggtgtcattaaaacattccggtattatgccggatgggccgacaagatccatgggatgacgatcccggtggatggagattacttcactttcactcgacacgaaccgataggtgtctgtggacaaatcatcccatggaattttcccctactcatgttcgcatggaaaatagcccccgctttatgctgcggaaatactgtggtaatcaagcccgccgaacagaccccattatccgcattgtatatgggcgcactgatcaaggaggcagggtttcctcccggcgtgatcaatattctccctgggtacgggcccacagcgggcgccgccatagcatcacacattgggatcgataagatcgcttttacaggctccacagaggtgggtaagctcatccaggaggccgccggcagatctaacctgaagcgtgtgaccctggagctaggcggtaaatccccaaacatcattttcgctgacgctgatctggattatgcagtggaacaggcgcaccagggggtgttcttcaaccagggacagtgttgcacagctggatctagaattttcgtggaagagtctatctatgaggaattcgtgcgacgtagcgttgaaagagccaagagacgagtggtgggatccccatttgatcctaccactgagcaaggccctcagatagataaaaagcagtacaataaaatcctggagcttatacagtcaggcgtggctgaaggcgccaagctcgaatgcggagggaaaggactgggcagaaagggctttttcatcgagcccacggtgttctcaaatgtgaccgacgatatgaggattgctaaagaggagatctttggcccagtgcaagagatccttcgctttaaaaccatggacgaggtgattgagcgcgctaataacagcgatttcgggctggtcgctgcggtgttcaccaatgacatcaacaaggctctgaccgtcagctcagccatgcaggccgggacggtttggataaactgttataacgcactgaacgcccagtctccatttggcgggttcaagatgagcgggaatggacgtgaaatgggggagtttgggctcagagaatactctgaggtgaagacggtaacggtgaaaattccacagaagaactcgtag

SEQ ID NO: 178583 - DNA, 30 bp, Artificial Sequence
  Description of Artificial Sequence: Synthetic coding sequence
atggacgccagcgagcggggccggctgtag

SEQ ID NO: 178584 - DNA, 1470 bp, Artificial Sequence
  Description of Artificial Sequence: Synthetic coding sequence
atgaagggccggaactggaagaccaccaagatcttcatcaacaacgaatggcagaactcagagtccggaagggtgttccccgtgtacaaccccgcgacaggcgaacaggtttgcgaagtacaggaagcagacaaggcagacatcgacaaggctgtccaagccgcaaggttggcgttttcgctggggtcagtttggcggcgcatggacgcttcagagcgcggtcgcctgctagataagttggccgatctagtcgaaagagaccgcgcagtgctcgccacgatggagtcactgaatggtgggaaaccttttcttcaggctttctacgtcgacttgcagggcgttattaaaacattcagatactacgccggctgggccgacaaaatccatggaatgactatacccgtggacggggactattttacttttacacgacatgaacccatcggagtttgcgggcaaatcataccgtggaattttcccctactgatgtttgcttggaaaatcgcccccgccctctgttgcggaaacaccgtggtgatcaagcctgccgagcagacccccctttccgctttgtacatgggtgctttaataaaagaagccggctttccacccggcgtgattaatatcctcccaggctatggccctactgcaggagccgccatcgcctcccatataggcattgataaaatcgccttcacaggtagcactgaggttggcaaactaatccaggaagctgcaggtagatcgaatctgaagagggtgacattagagctggggggaaaatcaccaaacataattttcgctgatgccgatctggactatgctgttgaacaagcccaccagggggttttcttcaaccagggccagtgttgtacagctgggagcaggatcttcgtagaagagtccatatacgaagaattcgtcagacgatccgtggaacgggcgaaaagacgagtagttggctctccattcgatcccacaacagaacaaggcccacagattgataagaaacagtacaacaaaatacttgagctgatccaaagtggggtcgcagagggagccaagttggagtgcggtggcaaaggcctgggaaggaagggcttttttatcgagccaacagtcttttccaatgtgaccgacgacatgaggatagcgaaagaagagatctttggtcccgtgcaggagattctgcggtttaagaccatggacgaggtgattgagagagcgaataatagtgacttcggcttagtcgctgcggtgtttaccaacgacattaacaaagcattgactgtcagcagcgccatgcaggcagggaccgtctggatcaactgctacaacgccctcaacgctcagtctccgttcggtggttttaaaatgagcggaaacgggcgcgaaatgggcgaattcggcctgcgcgagtattcagaggttaaaacagtgacagtaaaaatcccccagaaaaactcatag

SEQ ID NO: 178585 - DNA, 78 bp, Artificial Sequence
  Description of Artificial Sequence: Synthetic coding sequence
atggacgccagcgagcggggccggctgctggacaagctggccgacctggtcgagcgcgatagagccgttctcgcctag

SEQ ID NO: 178586 - DNA, 1269 bp, Artificial Sequence
  Description of Artificial Sequence: Synthetic coding sequence
atggacgccagcgagcggggccggctgctggacaagctggccgacctggtggaacgtgacagggcagtgttggcaaccatggaatccttgaatggggggaaaccattcctgcaggcattctacgtggacctccagggagttatcaaaacatttcgctattatgccgggtgggctgacaaaatacacgggatgacaattcccgttgatggcgactactttacattcactcggcacgagcccatcggcgtgtgtgggcagatcataccctggaattttccgctgctgatgttcgcctggaagatcgccccagcgctttgctgcggcaacacagtagtgatcaagccagccgaacagaccccactgtcagccctttacatgggagcactcattaaggaagcaggttttccccctggcgttatcaacatcctccctgggtacggaccaacagctggggctgcaattgcctcacacatcggcattgataagatcgcattcaccggcagcaccgaggtcggaaaactgatccaggaggcagccgggaggtcaaacttgaagcgtgttacgctcgagttgggcggaaaatcccccaatattatctttgccgacgctgacctggactatgcagtggaacaagctcatcagggggtttttttcaaccagggccagtgctgcaccgctgggtctcggatttttgtcgaagagtcgatttatgaggaatttgtgcggagatctgtggaacgggccaagcgtcgcgtggttgggtctcctttcgatcccaccacggagcagggcccgcaaatcgataagaaacaatataataaaattctggagctcattcagagcggggtcgccgagggtgctaaactagagtgcggcggtaaaggactgggacgaaaggggttcttcatcgaaccaactgttttttccaatgtcaccgacgatatgaggatagcaaaggaagagatcttcggacccgtgcaggaaatcctgcggtttaaaacaatggatgaagtaattgagcgcgcaaataactccgactttggactggtagccgctgtgtttactaacgacataaataaggctttaacagtaagttccgccatgcaggctggcacagtgtggatcaactgttacaatgcgttgaacgcccaatcccccttcggcgggttcaaaatgagcggcaacgggcgtgagatgggcgaattcgggctgagagaatattcagaggtgaagaccgtgaccgtgaaaatcccacagaaaaactcctag

SEQ ID NO: 178587 - DNA, 258 bp, Artificial Sequence
  Description of Artificial Sequence: Synthetic coding sequence
atggacgccagcgagcggggccggctgctggacaagctggccgaccttgtggaacgggatcgagccgtgctggccacaatggaatccctgaatgggggcaaaccatttcttcaggcattctacgttgatctgcagggcgtcattaagactttccggtactacgctggctgggcagataagatccacgggatgacaattccagtggacggagattattttacttttacacgccacgaacctattggcgtttgcggatag

SEQ ID NO: 178588 - DNA, 1539 bp, Artificial Sequence
  Description of Artificial Sequence: Synthetic coding sequence
atggccaccgccaacggcgccgtggagaacggccagcccgaccggaagcccccagccttaccccgccccattagaaatctggaagtgaaattcaccaagatcttcataaacaacgagtggcatgaaagcaaaagtggcaaaaaatttgccacatgcaacccgtccacacgcgagcagatctgcgaagtcgaagagggagataaacccgacgtcgataaggccgttgaagcggctcaagtggcctttcaaagaggcagtccctggcgcagactggatgcactatcacgcgggagattattgcaccagttggcagatttggtggagcgcgatagggccactctggcggcactcgaaaccatggacacaggcaaaccattcctgcatgcctttttcatcgatttggaaggctgtattcgtaccctgaggtacttcgctggctgggcggataagattcaagggaagaccataccaaccgatgacaatgtggtctgctttactagacatgaaccgatcggggtgtgcggcgccatcaccccctggaactttccactgctgatgttagtgtggaagctagccccggctttgtgctgcggtaatacgatggtgcttaaacctgccgaacagacacccctgacggctttgtatttagggtctctgatcaaggaggctgggtttcctcctggggttgtaaacattgttcccggtttcggccccacagtaggtgcagccatctctagccatccacagataaacaaaatcgctttcactggcagtactgaggtggggaagctcgtcaaggaggctgcctcaagaagtaacctcaagagggtgacattggaactcggcggaaaaaatccatgcatcgtgtgtgctgacgctgatctggacttggcggtcgagtgcgcacaccagggcgtgttctttaaccagggtcagtgttgcacagccgctagtcgcgtgttcgtcgaggagcaggtttactctgagttcgttcggagatccgtcgaatatgctaaaaagcggcccgtcggtgatccttttgatgtgaaaacagagcaggggccacagatcgatcagaaacagttcgataaaattctggaactgatcgagagtggaaaaaaggagggcgccaagttagagtgtggtggatctgctatggaagacaagggattgtttatcaagcccacagttttctctgaggttaccgataacatgagaatcgccaaagaggaaatcttcggccccgtgcagcctattctgaagttcaagagtattgaagaagtgatcaagagggccaactcaactgactacggtctgactgcagctgtctttactaagaacctggacaaggccctgaagcttgctagcgctctagagtctgggacggtttggatcaactgttacaacgctttgtatgctcaggctcccttcggtggctttaagatgtctggcaatggccgagagttgggcgagtacgccctagccgagtatacagaagtgaagactgtcacgataaaactgggggataaaaatccatag

SEQ ID NO: 178589 - DNA, 456 bp, Artificial Sequence
  Description of Artificial Sequence: Synthetic coding sequence
atggccaccgccaacggcgccgtggagaacggccagcccgaccggaaacctccagccttgccgcgccccattaggaatctggaggtaaagttcacaaaaatcttcattaataatgaatggcatgaatccaagtccggcaaaaaattcgccacgtgtaaccctagcaccagggagcaaatttgcgaggttgaggagggcgataaaccggacgttgataaggctgtggaagctgcacaggtcgcattccaaagaggtagcccttggcggcgtctggacgcgttgtctcgcgggagattgctgcatcagcttgcagatttagttgagagggaccgggctactctcgcagcactggagaccatggatactggcaagccttttttgcacgctttttttatcgacctggaaggttgtatcaggacgctgagacttatcaaaagctcttctacaaaatcttag

SEQ ID NO: 178590 - DNA, 1554 bp, Artificial Sequence
  Description of Artificial Sequence: Synthetic coding sequence
atgctgcggttcctggccccccggctgctgagcctgcagggccggacggcacgatattcaagtgccgcagcactgccctctcctattctgaaccctgacatcccctataatcagttgttcatcaacaatgagtggcaagatgcagtctctaaaaaaacatttcctacagtaaaccccacaactggggaagtgatcgggcacgtggctgagggagatagggccgacgtggaccgtgctgtaaaagcggcacgagaggcttttaggctcgggtcgccttggaggaggatggacgcttctgagcgtggcaggctactgaacaggctggcggatttggttgaaagagaccgggtctacttggccagtcttgagacactcgacaatgggaagcccttccaggagtcctatgcacttgatttagatgaagtcattaaagtgtatcgctactttgccggctgggccgataaatggcacggaaaaactatccccatggatggccaacatttttgctttacccgacacgaacccgtaggcgtctgcggccaaattattccgtggaatttcccgcttgtcatgcaaggctggaagctggccccggccctggctaccggaaacactgttgtcatgaaagtagccgaacaaacaccactgagcgcgctttacctggcctctctcataaaagaagccggatttccaccaggcgtcgtaaatatcattactggatacgggcccacagcaggggctgcaatcgctcaacatgtagacgttgacaaggtggccttcacaggttctaccgaggtcggtcacctcattcagaaggcagcaggcgactccaatctcaagagggttacattggaactgggcggtaaaagccccagcattgtccttgcagatgcagatatggagcacgcggtggagcagtgtcacgaggccctattctttaacatgggtcagtgctgctgtgctgggagcagaactttcgtcgaggaatcaatctataacgaattccttgagcggacagtggagaaagctaaacagagaaaagtgggcaatccctttgaactggatacgcaacagggacctcaggtggacaaggaacagttcgagcgtgtgctaggctatatccagttgggtcagaaggagggcgcaaaattgctctgcggtggtgagcggttcggcgaacgcggattttttatcaagcccacagtgttcgggggggtgcaggatgacatgcggatcgccaaggaggagatttttggcccagtgcaaccccttttcaagtttaaaaagattgaggaagtggttgaaagagcaaacaatacacgctacggcctggccgccgcagtctttacccgtgatttggacaaggctatgtacttcacacaggcactgcaagcaggtacagtctgggtgaacacttataacatcgtgacttgccacactcccttcggcggttttaaagagagcggcaatgggagagagctcggtgaagatgggctcaaggcttacacagaagtgaaaactgtcacaatcaaagtcccacagaagaattcatag

SEQ ID NO: 178591 - DNA, 657 bp, Artificial Sequence
  Description of Artificial Sequence: Synthetic coding sequence
atggagcacgccgtggagcagtgccacgaggccctgttcttcaacatgggacagtgctgctgtgcgggctcacgaacctttgttgaagagagcatctacaatgaattcctggaaaggacagtagagaaggctaagcagagaaaggtaggtaatccgttcgagctggacacccagcaaggcccacaggtcgacaaagagcagtttgaacgcgttctcggatacatccagctcggtcaaaaggaaggcgctaagttactttgcggaggtgagagattcggagagcgcggttttttcatcaaacctaccgtctttgggggtgtgcaggacgatatgcggattgcaaaagaagagattttcggacctgtgcagccgttgtttaagttcaagaagatagaggaggtcgttgagcgcgcaaataataccagatatggtctcgcagcagcggtttttactcgagacttggataaggccatgtattttactcaggctctgcaggctggcacggtgtgggttaatacatataacattgtgacttgccacaccccttttggaggctttaaggagtccgggaacgggcgcgagctgggagaggacggcctgaaggcttataccgaagtgaagactgttacaattaaggtcccacagaaaaacagctag

SEQ ID NO: 178592 - DNA, 2739 bp, Artificial Sequence
  Description of Artificial Sequence: Synthetic coding sequence
atggccggccccagcaacccccccgccaccatgaagatcgccgtgatcgggcagtccctctttgggcaagaagtctattgtcatctcagaaaggaaggccacgaagtggtgggcgtgttcaccgtgcccgataaagatggaaaggcggacccactcgggctggaggctgagaaggatggggtgccagtgttcaagtattcgcgatggcgcgctaagggacaggcattgcctgacgtggttgccaagtaccaggcactaggagctgaactcaatgtccttccattctgttcacagttcattcccatggagatcattagtgcgcctaggcatggtagcatcatctatcacccatcactgctccctcgacatcgcggcgccagcgcgatcaattggacattgattcatggagataagaaagggggcttcagtatcttttgggctgacgacggcttagacactggggatctgttacttcagaaggaatgcgaggtactgcccgacgatacggtctccaccctctataacaggtttctgttccccgaagggattaaggggatggtgcaggcggtgagactgatcgccgaggggaaggccccacgtcttcctcagcctgaagagggtgcaacatatgagggtatccagaagaaggaaaccgcaaaaattaattgggatcaaccagccgaagctattcataattggattcgagggaacgataaggtaccgggagcttggaccgaagcctgcgagcagaagctgaccttcttcaactcaacattgaataccagtgggctggttcctgagggcgatgcgctaccgatccctggggcgcacagaccgggtgttgtgaccaaggcaggcctgatactcttcggtaacgatgacaagatgctactggttaaaaacatccaacttgaggacggaaagatgattttagcgagcaacttcttcaagggagctgcctcaagtgtgctggagctgacggaggccgagctggtgacagccgaggcagtgagaagtgtgtggcaacgcatactgcccaaggtgcttgaggttgaagactccaccgatttcttcaagagtggggccgccagtgtagacgtggtgcgattggtggaagaggtgaaggagctttgcgacggactggagctggagaacgaggatgtgtacatggcaagtacgtttggggatttcattcagttactggtgaggaaacttcggggagacgacgaagaaggcgagtgtagcattgactatgtggaaatggctgtgaataagaggactgtgcgaatgccgcatcagctgttcataggtggcgaattcgtcgatgctgagggcgccaagaccagtgagaccattaaccccaccgacggctccgtcatctgccaggtgtcgctggcgcaggtcacagatgtcgataaggccgtggcggccgcaaaggatgcattcgaaaacgggcggtgggggaaaatctctgcgcgcgaccgcggtcggctaatgtatcgcctcgccgatctgatggagcaacatcaggaggaattagcgacgatcgaggccctcgacgccggcgcggtctacactctggccctgaaaacccacgttggaatgtctatacagacattccggtattttgctggatggtgcgacaagatccagggcagcacaatcccaatcaaccaggcgcggcccaacaggaacctgactctgacgcgaaaggaacctgtcggcgtgtgtggcatcattatcccatggaactacccactgatgatgttgagttggaaaaccgctgcctgcctcgcggcgggcaacacagtcgtgatcaagccagcccaagtgacccctctcactgccctgaaatttgccgaactcacccttaaggctggtatccctaagggggtcgtgaacgtgctgcctggttctggaagcctggtgggccagcggctgtcagatcaccctgacgttcgcaaaatcgggttcactggaagtaccgaagtcgggaaacatatcatgaagtcatgcgccatctccaatgtgaaaaaggtttcgttagagcttggggggaaaagtcccctcattatctttgctgactgtgacctcaataaggccgttcagatgggcatgtcatccgtatttttcaataagggagagaattgcatcgccgctggtcggctgttcgtggaagatagtatacacgacgagtttgtccgcagggttgtcgaggaggtgcgcaaaatgaaagtagggaatccactggaccgagacacagatcatgggcctcagaaccatcatgcccatttagtcaaactgatggagtattgtcagcatggagtaaaagaaggagccactttggtgtgcggagggaaccaggtcccacggcctggatttttcttcgaaccaactgtatttacagacgtcgaggatcatatgtttatcgctaaggaagaaagtttcggccccgtgatgatcatatctcggtttgcagacggcgatcttgacgccgtattgagtcgcgctaacgcaactgaattcggcctggcctcgggggtatttacccgcgacatcaataaggccttgtatgtcagtgataagcttcaggcaggtaccgtgttcgtgaatacgtataacaagacagacgtcgccgccccgttcggcggttttaaacagagcggcttcggaaaggatttaggtgaagcggcgctgaatgaataccttagagtgaagacagtaacttttgaatactag

SEQ ID NO: 178593 - DNA, 1518 bp, Artificial Sequence
  Description of Artificial Sequence: Synthetic coding sequence
atgaagatcgccgtgatcggccagagcctgttcggccaggaggtgtattgccatctgaggaaagagggccatgaggttgttggcgtgtttaccgtgcctgataaggacggcaaggccgaccccctaggtcttgaggccgaaaaagacggagtcccagtatttaaatatagtaggtggcgagccaagggacaagcactgcccgatgtagtggcaaagtaccaggccctcggcgcagagcttaacgtcctccctttctgttcacagttcatccccatggagataataagcgcccctcgccatggaagtattatctatcaccctagcctgctcccaaggcatcggggggccagcgcaatcaactggacattgatacacggggataagaaagggggtttctccatcttttgggcagacgacggccttgacaccggcgatctgctacttcagaaggagtgtgaggtcttacccgatgatacggtttctactctctataatcgattcctctttccggagggtattaaaggtatggtacaggccgtcagacttatagccgaagggaaggccccaaggttacctcaaccagaggagggagctacttatgagggaattcagaaaaaggagactgccaagatcaactgggatcagcccgccgaggcaattcataattggattagaggtaacgacaaagtgccaggcgcctggacagaagcctgcgagcagaagctcacattctttaatagcacattgaatacctctgggctggtgcccgagggagacgctctccctattcctggtgcccatcgaccaggcgtagtgaccaaagctgggctgattctttttggaaatgatgacaagatgctcctggtcaaaaacattcagctggaggacgggaagatgatactggcctcaaatttctttaagggggcagcttcttctgtgctcgagctcaccgaggctgagctggtgacggccgaggctgtgcgctcagtctggcagaggatcctacccaaagtgctcgaggtcgaggactccaccgacttttttaaaagcggcgctgcaagtgtcgacgttgtgagacttgtagaggaggtgaaagagctttgtgacggccttgagctcgagaatgaggatgtgtacatggcatcaacattcggagatttcatacaactgctggtgcgaaaactccgcggcgatgacgaagagggcgagtgtagcattgactacgtagaaatggctgtcaataagagaaccgttcgcatgcctcaccagctgtttatcggtggtgaatttgtagacgcggaaggcgcaaaaacctccgagaccatcaaccctactgacgggtctgtgatatgtcaggtaagcctagctcaggtgaccgatgtagataaagctgtggccgccgctaaagacgccttcgagaatggcagatggggcaaaatcagcgctagagacagagggcggctaatgtatcgagcgcccccatcacccagtacacgtccagaccccactgccacttag

SEQ ID NO: 178594 - DNA, 2709 bp, Artificial Sequence
  Description of Artificial Sequence: Synthetic coding sequence
atgaagatcgccgtgatcggccagagcctgttcggccaggaggtgtattgccatcttcgcaaggaggggcatgaagtcgtgggcgtgtttacggtcccggacaaagacgggaaggccgatcccctaggacttgaagctgaaaaggatggtgtaccggtgttcaaatatagccggtggcgggccaagggacaggcattgccagacgtcgtggctaaatatcaagcgctcggggcagagctgaatgtgttgccattctgttcacaattcatccctatggaaattatttctgcccccaggcacggtagcatcatataccatccatctctcttgccacgtcatcgaggagctagcgctatcaattggaccctcatccatggggacaagaagggagggtttagcatcttctgggccgacgacggattggataccggagatctgctgcttcaaaaagaatgcgaagtacttccagacgacaccgtgtcaaccctctacaataggttcctctttcccgagggaatcaagggaatggttcaagctgtgcgcctgatcgccgagggtaaggcgcctagactcccccaaccagaggagggagcaacctatgaaggaattcagaagaaagaaaccgcaaaaatcaattgggatcagcctgctgaggccatccacaactggatcaggggaaatgataaggtgcctggagcctggacggaggcgtgcgaacagaagctgacattcttcaactcaactctgaacacatcaggcctcgtgcccgagggagacgctttacctatccccggcgcgcacaggccaggagtggtgaccaaagctgggctcattctgtttgggaacgatgacaagatgctccttgttaaaaatatccagcttgaagatggaaagatgatccttgcctccaatttcttcaagggcgccgcgtcctctgtgctagagttgaccgaggctgagcttgtgactgctgaagccgtgcgaagcgtgtggcaacgcatcctacccaaagtcctggaggtcgaagactccaccgatttttttaagagcggagcagcctctgtggacgttgtcaggcttgtcgaggaggtgaaggaactctgcgatggcctggaattagaaaatgaggacgtttacatggcaagtacattcggagactttattcagctgttggtgcggaaactgcgcggggatgatgaggaaggagagtgttccatcgactacgtggagatggccgtaaataaaaggaccgttcgtatgccccaccagctcttcattggcggcgaattcgttgatgccgaaggcgctaaaacctcagagaccattaatcccacagacgggagtgtgatctgtcaggtcagccttgcacaggttacagacgttgataaggccgtggctgctgccaaggacgcttttgaaaatgggaggtggggcaaaatttctgctcgcgatcggggccgcctgatgtaccgcctcgcagacctaatggaacagcaccaggaagaactggccaccattgaggcactcgacgctggagccgtttacaccttggccctcaaaactcatgttggaatgtccatacaaacctttagatattttgccggctggtgcgacaaaatccaagggagcacaattcctattaatcaggctcgtcctaatagaaatctgaccctcactaggaaggagcctgtgggcgtgtgcggaataatcatcccttggaattaccctctgatgatgctgagctggaagaccgcagcttgcctcgctgcaggaaacacagtggtaatcaagcccgcccaggtgaccccacttactgccctcaagttcgctgaactaacactgaaagctggaattcccaagggggtggttaacgtactgcccggcagcggatctcttgtcggtcagaggctaagcgaccaccccgacgtccgtaaaataggttttacaggctctaccgaagttgggaagcacatcatgaagtcatgcgccattagcaatgtgaagaaggtcagcctggaactcggaggtaagagcccccttatcatttttgctgactgcgacttaaataaagcagtccagatggggatgtccagcgtgttcttcaacaagggcgaaaattgcattgccgcaggaaggctgttcgtggaggattccatacacgatgagttcgtccgccgggtcgttgaggaggtcagaaagatgaaggttggtaacccgctagatcgggacactgaccacggcccgcagaaccatcatgcccacttagtgaaactcatggagtattgtcagcacggcgtcaaagaaggtgctacgctcgtgtgtggcggtaaccaagtccctcgccccggcttttttttcgaaccaacagtcttcacagacgttgaggaccatatgttcattgccaaagaagaatcatttggtcctgtaatgatcatttctagatttgcagacggcgacctcgatgccgtcttgagccgggcaaatgccacagagttcgggctggctagtggagtttttactagagacattaacaaagcattgtatgtgagtgataagttgcaggctggtaccgtatttgtgaatacttacaataaaaccgacgtggccgcgccttttggcgggtttaaacagagcgggttcgggaaggacctcggcgaggcggccctgaatgagtatctccgagtgaaaaccgttacgttcgaatactag

SEQ ID NO: 178595 - DNA, 483 bp, Artificial Sequence
  Description of Artificial Sequence: Synthetic coding sequence
atggtgcaggccgtgcggctgatcgccgagggcaaggccccccggctcccccagcccgaagagggtgctacatacgaggggattcagaaaaaggaaactgccaaaatcaattgggatcagcccgcagaagctatccacaactggatcagaggaaacgataaagtcccgggagcgtggacggaggcctgtgagcagaaactgacctttttcaacagtaccctaaacaccagcggcttggtgccagagggtgacgctttgccaatcccaggcgcccatagaccaggggtggttacaaaagcaggccttattcttttcggaaacgacgacaagatggttcgggcgagactgtgggtgacatgtctcctgaaggcaacccacgctcctgtgctcgggcttcggccgcatcgtaagacgctcggatcgtcgggcgagaatggaaaaaatcagactcaggagggcacactaacactcatatgtccctag

SEQ ID NO: 178596 - DNA, 507 bp, Artificial Sequence
  Description of Artificial Sequence: Synthetic coding sequence
atgaagatcgccgtgatcggccagagcctgttcggccaggaggtgtactgtcatttgcgaaaggaaggccacgaagtggtgggtgtgtttacagttccagacaaagatggtaaggccgacccattagggttggaagccgagaaagacggggttcccgtgttcaagtactctcgatggcgagctaagggccaagctctccctgatgtggtggctaagtatcaggcactgggcgcagagttaaatgttttacctttctgcagccaatttatccccatggagataatcagcgccccccgtcacggatccataatctatcatccaagcctgctaccacgccatcgaggagctagcgccatcaactggacgctgatacacggcgataaaaagggtggtttttccatattttgggccgacgatggactggacacgggggacctgctgttacaaaaggaatgtgaggtactgcccgatgacaccgttagcactctctacaataggttcctgtag

SEQ ID NO: 178597 - DNA, 2709 bp, Artificial Sequence
  Description of Artificial Sequence: Synthetic coding sequence
atgaagatcgccgtgatcggccagagcctgttcggccaggaggtgtactgccatcttagaaaagagggtcacgaagtagtgggcgtgttcactgtccccgataaggacggtaaggctgaccccctcggcctggaagccgagaaagacggggtcccagtgtttaagtattcgagatggcgggcaaagggacaagcactgcctgatgtggtagcgaagtaccaagcacttggcgcggagctcaatgtactgcctttttgtagtcagtttattcccatggagatcatttccgctcccaggcacgggtctatcatctaccaccctagtcttctcccaaggcatcggggcgcatcagccatcaattggacactcatccacggggacaagaaaggtggcttcagtattttctgggccgatgatggcttggacactggcgacctgttgctgcaaaaagagtgtgaggtccttcccgatgacacagtctcaacactctataaccggttcctgttcccagaaggcatcaaggggatggtgcaggccgttagactgattgcggaggggaaggcacctcgcctcccacagcccgaagaaggcgccacatacgaagggatccaaaaaaaagagaccgccaaaattaattgggaccagccagcagaagccatccataattggattcgcggcaatgataaggtgcctggagcatggacagaggcgtgtgagcagaaactgacctttttcaatagcaccctgaacacttctggactcgtgcctgaaggggatgcattaccaattccaggggcccaccgcccaggcgtggttacgaaagctggattgatcctgttcggaaatgatgacaaaatgctgctagtcaagaacatccagttggaggacggaaagatgatactggcttcaaatttcttcaagggggcagccagcagtgtgcttgagctgaccgaggcagaacttgtgactgcggaggctgtgcggagtgtatggcagaggatcctcccgaaggtgctggaagtggaggactccactgacttttttaaaagcggggccgctagcgtggacgtggtgagactcgttgaggaagtgaaggaattgtgtgacgggctggagcttgagaacgaggacgtctacatggcctctacctttggggatttcatccagctgctggtgcgtaaactgcgtggtgatgacgaggagggcgagtgctctatcgactatgtcgagatggctgtgaacaagcgcaccgtgaggatgccccaccagctatttatcggcggcgagttcgtggacgcggaaggcgccaaaactagcgaaaccattaatccaactgatggttcagtgatatgccaggtgagcctggcacaagttaccgacgtcgacaaggctgtggctgccgccaaagacgcttttgagaacggccgctgggggaagatcagcgctagggaccggggtcgtctgatgtacagactggcagatctgatggagcaacaccaggaagaactagccacaattgaagcactagacgccggggccgtttatacactggcgctgaagactcacgtcggaatgagcatccagacctttcggtactttgctgggtggtgtgacaaaatacagggctctaccatcccaattaaccaggcacggccaaatagaaatctgaccttgactaggaaagagcctgttggcgtctgtggcattattatcccatggaactatccattaatgatgttgagctggaagactgcagcttgtctcgctgctggaaacacagtcgtgatcaagcccgctcaggtgactcctctgactgccctgaaatttgctgaacttactctgaaggctggcatccctaagggagtggtgaacgtactcccggggtcaggttctttggtcgggcagcgactgtccgaccatccagacgtgaggaagataggcttcactggatctaccgaagttggcaagcacataatgaagtcttgcgccatttctaacgttaaaaaggtgagcctggagttaggcggtaagtccccactaattattttcgctgattgtgacttgaacaaggcggttcagatgggaatgagctccgtgtttttcaacaaaggggaaaattgtatcgccgcaggcagattgtttgtagaggactcaattcatgacgagtttgtgcgccgagtggtagaggaagtcaggaaaatgaaggtgggcaatccactggatcgcgacaccgatcatggcccgcagaatcaccatgcacatctggtcaagctgatggagtactgtcaacatggcgtcaaagaaggcgcaaccctggtgtgcggtggcaatcaggtcccccgccctgggttcttcttcgagccaaccgttttcacagatgtggaggaccatatgtttatagctaaagaggagtccttcggacctgtgatgatcatttcacggtttgctgatggtgatctggatgcggtgctcagccgcgctaacgccacggagtttggactggcgtctggggtgtttacaagggatattaataaagctttatatgtgtccgacaagttgcaagctggtacagttttcgtgaatacatataacaaaacggatgtagccgccccttttggcggattcaagcagtcgggattcggcaaggaccttggggaggctgctctgaatgagtacctgcgcgtgaagaccgtaaccttcgagtattag

SEQ ID NO: 178598 - DNA, 474 bp, Artificial Sequence
  Description of Artificial Sequence: Synthetic coding sequence
atgaagatcgccgtgatcggccagagcctgttcggccaggaggtgtactgccatctgaggaaagagggtcatgaagttgtgggcgttttcacggtgcccgacaaggacgggaaagccgaccctctcggcctggaagctgagaaggacggggttcctgtgttcaaatattcacgatggcgtgctaaaggccaggcccttcccgatgtcgtagcaaaataccaagccctgggggctgaactcaatgtcctgcccttttgtagtcaattcattcccatggaaatcatcagcgccccaagacacggaagtataatttatcatccctccctccttccccgacatagaggcgcatcggccatcaattggacactgatccatggtgacaagaagggaggattctccattttctgggccgatgatggcctggataccggagatttgctactgcagaaggaatgtgaggtgctgccagattag

SEQ ID NO: 178599 - DNA, 534 bp, Artificial Sequence
  Description of Artificial Sequence: Synthetic coding sequence
atgaagatcgccgtgatcggccagagcctgttcggccaggaggtgtattgtcaccttaggaaggaaggtcatgaggtggtcggcgtctttacagtccccgacaaggacgggaaagccgaccctctgggactggaggccgagaaagacggggtccccgtctttaagtactcccgatggcgagcaaaggggcaggccctccccgatgtggtggcaaaatatcaggccctcggcgcggaattaaacgtcctgccattttgcagtcagtttattccaatggaaattatctccgccccgcggcatggaagtatcatctaccaccctagcttgctccctagacataggggcgcgtcagctatcaattggacccttatccatggggacaagaagggaggattcagcatattttgggccgacgacggtctcgacaccggcgacctgttgctgcagaaggagtgtgaagtcctccccgatgacacagtttctactctttataaccgattcctctttcctgaagggattaagggaatggtgtag

SEQ ID NO: 178600 - DNA, 303 bp, Artificial Sequence
  Description of Artificial Sequence: Synthetic coding sequence
atgaagatcgccgtgatcggccagagcctgttcggccaggaggtgtactgccatttaaggaaagaaggccatgaggtggtaggcgtgttcactgtgcctgacaaggatggtaaagcagaccctctgggtctggaggccgagaaggatggggtccccgtgtttaagtatagcagatggcgcgcgaaaggtcaagctctgccagatgtcgttgcaaagtatcaggccctgggggccgagctaaatgtgcttcccttctgtagtcagtttatacccatggaaattatcagcgcccccagacattag

SEQ ID NO: 178601 - DNA, 2409 bp, Artificial Sequence
  Description of Artificial Sequence: Synthetic coding sequence
atggccgccacccgggccggcccccgggcccgggagatcttcaccagcctcgagtacggccccgtgcctgagtcgcacgcctgcgcccttgcttggctggatacccaggatcgctgtctggggcattatgtgaatggcaaatggcttaagccagaacaccgtaacagcgtaccttgccaggatcccatcactggggagaacctcgcctcatgcctccaagcacaggctgaggacgtggctgcggcagtggaagccgctcgcatggctttcaaaggttggagcgcccacccaggcgtggtgagggcccagcacctgacccgcctggcagaagtgattcagaagcaccagcggcttttgtggactctcgagagcctcgtgaccggtcgggccgttagagaagtgagggatggagacgtgcagctggcccaacaactgctccattaccacgccatccaggctagtactcaggaagaggcccttgccggctgggagccaatgggagtcattgggcttatattgccaccgacattctctttcttagaaatgatgtggcgtatatgccccgcgttagccgttgggtgcacagtagttgccctggttccccctgcatctccagcccctttattactggctcagctggccggcgagctggggccttttcccggcatcctgaacgtgctcagcggtcccgcttcactggtaccaattctcgcctctcagcccggcattcggaaggtggccttctgtggcgcgcccgaagaggggcgggcattacgacggtccctggccggggaatgcgcagaacttggcctggcactaggtaccgagtcactcctgctcctgacagataccgcagacgtggactccgccgttgaaggcgtcgtagatgctgcctggagtgaccgcggtcccggcgggttacggttgctcattcaggagtctgtttgggatgaggccatgcggcgcctgcaggaaagaatgggcaggcttcgttccggcagaggcctggacggagctgtagatatgggagctcgcggggctgccgcgtgtgacctggtgcagcgatttgtgagagaagctcagagccagggcgctcaggtgttccaggcgggggacgtgccaagcgagcgccctttctaccctccaacactggtaagcaacctcccacctgcctctccatgcgctcaggtcgaggtaccttggcctgttgtcgtagcttccccttttaggacggctaaggaggctctgttagtagctaacgggacacccaggggcggaagtgcctctgtgtggtccgaacggctaggccaggctctggagctgggctacggattacaggttgggacagtgtggatcaacgcccatggcctgcgagatccaagtgtgcctacaggaggctgtaaggaatcaggctgctcatggcatgggggcccggacggcctgtacgagtaccttcgccctagcgggaccccggcacgcctcagttgcctcagcaaaaacctgaattacgacacatttggacttgccgttccaagcacgctgcctgccggaccagagattggaccgtccccggctcccccatacggcctctttgttggggggaggtttcaggctcctggtgcccgatcctcgcgacccatcagggacagcagtggcaatctccatggctacgtcgccgaagggggtgcgaaagacatccggggggcagttgaggctgcccatcaggctttcccaggctgggccgggcagtcccccggtgcccgggctgcgctgttgtgggcattggctgccgctctggaacgcagaaaatcaaccctggcatctaggctggaacgacagggagcagagctgaaggccgcagaagctgaagttgagttgtcggctagacgtctgcgggcatggggtgccagagtccaagcccagggacacacactacaggtggctggtcttcgcggcccagtgctgaggctacgcgagcctcttggcgtgctggcagtggtgtgccctgatgagtggccactccttgccttcgtgtccctgctcgccccagccttggcatatggaaataccgtggtaatggtccctagcgccgcctgtcccctgctggccctggaagtttgtcaggatatggcgactgtgttccccgccgggctggcgaatgtggtgacgggcgacagggaccatttgaccagatgcctggccctgcaccaggatgtgcaggcgatgtggtacttcggatcagcgcagggcagccaatttgttgagtgggcgagtgcagggaatttgaagcctgtttgggcttcacggggctgccccagagcttgggatcaggaggcagaaggtgccgggcccgagctgggcctcagagtggccagaacaaaagctttatggcttccaatgggcgattag

SEQ ID NO: 178602 - DNA, 1914 bp, Artificial Sequence
  Description of Artificial Sequence: Synthetic coding sequence
atgggcgtgatcggcctgatcctgccccccaccttcagcttcctggaaatgatgtggaggatatgccccgcgctggcagtcggctgtacagtagtcgctctggtaccacccgcctccccagcccctttattactggcccagttggcaggtgagctcgggccttttcccggtatcctgaatgttctcagcggccccgcttctcttgtgcctatattggcatcacagcccggcatcaggaaagtggcattttgcggagcacctgaggaggggcgggctcttaggcgtagcctggctggagagtgtgccgaactgggccttgccttaggtactgagtctctgcttttactgactgacacagctgacgtggacagcgcagtagagggagtagtagatgccgcctggtccgacaggggccctgggggactcaggctgctgattcaggagtctgtgtgggacgaggccatgaggcgcctgcaggagcgaatgggacgattgcgctctgggcgtggcttagacggggccgttgatatgggagccagaggagcagctgcctgtgacctggttcaacgtttcgttcgcgaagcccaaagtcagggcgcacaggtgtttcaagccggggatgtgccatcagaaagacccttttacccacctacgctcgtgagtaacctgcctcccgcctctccctgcgcgcaggtcgaggtgccatggcccgtggtagttgcttctccctttagaaccgccaaggaagcgctactggtggctaacggcacaccgcgaggcggctcagcatccgtgtggagcgagcggcttggccaggcactggaacttggatatgggctccaggtcgggactgtatggattaacgctcacggactgcgcgatccgagtgtcccgactgggggctgtaaggagtcagggtgttcatggcacggtggccctgatggtctgtatgaatatctgagaccttctgggacaccagcgcggcttagttgtctcagtaaaaacctgaactatgacacgttcggccttgctgtgccttcgaccctccccgccggtcctgaaatcgggcccagcccagccccaccatatggactttttgtaggagggcgatttcaagccccgggtgcccggtcatccaggcctattcgggatagcagcgggaacttacacgggtacgtcgctgagggaggcgcaaaagatattcggggagcagtggaggcagcccaccaggcttttcccgggtgggccgggcagtcgccgggtgccagggctgcacttctgtgggccttggcggctgcactcgagcgccgcaagtctaccttagcctccaggttggagcgtcagggggcagaactcaaggctgcagaagcagaagtcgaactcagtgcccgacgccttcgcgcctggggtgctagagtgcaagcccagggacacacgctacaggttgccggccttcgcggccccgtgctgcggctaagagaacctcttggagttttggcagtggtctgtccagatgagtggccactccttgccttcgtaagcctcctggccccggcgcttgcatatggcaacactgttgtgatggtaccaagcgctgcttgcccgctattagctctggaggtgtgccaggacatggctactgtttttccagctggactggctaacgtggtgacgggtgatagagaccatctgactaggtgccttgccctgcaccaggatgttcaggccatgtggtattttgggtccgcacagggatcccagttcgtggaatgggcgagcgccggcaacctcaagcctgtgtgggcttcgcgaggttgtccacgagcgtgggaccaggaagccgagggcgcaggccccgaattgggactgagagtagctcgcactaaggctttgtggctgcctatgggcgattag

SEQ ID NO: 178603 - DNA, 2256 bp, Artificial Sequence
  Description of Artificial Sequence: Synthetic coding sequence
atggccgccacccgggccggcccccgggcccgggagatcttcacctccttggagtatggccctgtgcccgagagccacgcgtgtgctctggcatggcttgatacccaggaccgctgtctagggcactatgtaaatgggaaatggctcaagcctgagcatcggaactccgtcccatgccaggatcctatcaccggtgaaaatctcgcgtcttgcctccaggctcaggcagaggatgtggcggccgctgtggaggctgctagaatggccttcaaagggtggtccgcacacccaggagtagtgcgcgcccaacacctgactaggctggccgaggtgattcagaagcaccagaggttactgtggacattggagagcctggtaactggccgggctgtgcgcgaggtcagagacggcgatgttcagctggcccaacagctcctccattatcacgcgattcaagcaagcactcaagaggaagctcttgcaggttgggagccaatgggcgttatcggtctcattctacctcccacatttagtttcttggagatgatgtggagaatctgccctgccttggccgtgggttgtactgtagtagctttggttccccctgcaagccctgctccgctgctcttggcccaactcgccggagagctaggccctttccccggaatcctgaacgtgctgagcgggccagcctccctggtgccaatcctggcctcgcagcccgggattcgcaaggtagccttttgcggcgctcctgaggggggtctgcgattactcatacaggaatcagtatgggacgaggctatgcgcaggctccaagagcggatgggacgcctaagaagtggcagggggttggatggcgccgtcgacatgggcgccaggggcgcagctgcatgtgacctggtgcagcggtttgtcagggaggcgcagagtcagggggcacaggtgttccaggccggggatgtgccttccgagaggccgttttacccaccgacactcgtcagcaaccttcccccagcctctccatgcgcacaggtggaagttccttggcccgtggttgttgctagtccttttcgcacagccaaggaggctctgctcgtggctaacgggaccccacgcgggggttcagctagcgtgtggtcggaacgattgggtcaggccctggagcttggatacgggctgcaggtgggaactgtatggatcaatgcacatggcctcagagaccccagtgtgcctacgggcggatgtaaagagagtggatgttcgtggcatggtggtccagacggtctgtatgagtacctgaggccctcaggtactccagcgcggctgagctgcctttcaaaaaacctcaattatgacacttttgggcttgctgtgccttccacactgcccgctggacctgagattggcccatcacctgcacctccctacggtctgttcgtgggcggacgatttcaagccccaggtgcccgttcttctcggccaatccgtgattcgtcaggcaatttgcacgggtacgttgcagagggcggcgcaaaagacattcgcggagccgtggaggccgcccatcaggccttcccaggatgggcgggacaaagcccaggtgcgcgcgctgctctgctgtgggctctggccgctgccctggagcggcgcaagtctacccttgcatcccgcttagagcggcaaggtgctgagctgaaggctgccgaagcggaagtcgagctgtccgctcgccgtctgcgcgcttggggcgccagagtgcaggcgcagggacataccctccaggtcgcaggacttaggggcccagttctgcgtctcagggaacccctgggcgttctggccgtggtgtgcccagatgaatggcctctgctagcgtttgtgagcctcttggcccctgctcttgcctatggtaacacggttgtaatggtgcctagtgctgcgtgcccgctgctggccctggaggtctgtcaggacatggccactgtgttccccgccggtctggccaacgtcgtaacaggtgaccgggaccatttaacccggtgtctggctctgcaccaggatgtgcaggccatgtggtactttggaagcgcccagggcagccaatttgtggagtgggcctccgcaggaaacctgaagcccgtgtgggcaagccgtggctgtcctcgtgcatgggaccaagaagccgagggcgcagggcctgaactgggtttgagggtggccaggactaaggccctatggttacctatgggtgactag

SEQ ID NO: 178604 - DNA, 1920 bp, Artificial Sequence
  Description of Artificial Sequence: Synthetic coding sequence
atgcggaccggcgtgatcggcctgatcctgccccccaccttcagctttttagagatgatgtggcggatctgccccgccttggccgtcggatgcactgtggtggcactggtccctccagcttctccagcccctctgctgcttgcacagctggctggcgaattggggccctttcccggcatcctgaatgtcctgagcggcccagccagtttggtgccaattttggcttctcaaccaggaatcaggaaagtcgctttttgtggggcacccgaagaaggtcgggcgctgcgtcgctctcttgccggcgagtgcgctgaactgggcctcgcgctgggaaccgagagtctgctgctgttgaccgacaccgcagacgtggacagtgctgtcgagggcgtagtagacgccgcctggtcggacagaggtcctggcggactgcgacttctgatccaagagagcgtgtgggatgaggctatgcgacgtctccaggagcggatgggaagacttcggtctggtcggggactggatggcgcggtggacatgggagccaggggcgctgccgcttgtgatttggtccagcgcttcgtacgtgaagcacaaagtcagggagctcaggtcttccaggctggcgacgtgccatcagagcggccattttatcctcctactttggtctccaatctgcctccagcctctccttgtgctcaggtggaggtaccgtggcctgtagtcgtcgcatcaccctttaggacagctaaggaagccctgttggttgcgaacgggaccccacggggaggcagcgcatctgtgtggtctgagagactgggacaagcccttgaacttggttacggcctgcaggttggaacagtgtggattaatgctcatgggctccgtgacccatctgtaccaaccggaggttgtaaggaaagcgggtgtagttggcatgggggacccgacgggctatatgaatacctgcgtccttctggcactccagccaggctctcatgtcttagcaagaacctaaactatgacacctttgggcttgccgtgccgagtacattgcccgctgggccagaaatcggtccgtccccagcccctccgtacggattattcgttggcggcaggttccaggcaccgggggcccggagctcacgacccatccgggatagctctggaaaccttcacggctatgtcgctgaggggggggccaaagatatccggggagccgtagaggccgcacaccaggcttttccaggctgggctggccagtcaccaggggcacgcgccgctctgctctgggccctggccgccgccttggaacggcgcaaatctaccctggcctcccggctcgaaagacagggggcagagcttaaagctgcggaagccgaggttgagttatcagctcggcggcttcgcgcctggggcgccagagttcaggcccagggtcacaccctacaggtggccgggcttagaggccctgtgctgcgactgagggaaccgcttggcgtgctcgctgttgtttgcccggatgaatggccattgcttgcattcgttagcctgctggcacccgcactcgcatatggcaatacagtggtgatggtgccatctgctgcgtgccctctcctggccctcgaagtgtgtcaggatatggcaacagtctttcccgctgggttagcaaatgtggtgacaggtgacagagatcacctgacccgctgtctggcactgcaccaggacgttcaagcaatgtggtatttcgggagcgcccaaggatcccagtttgtcgaatgggctagcgccggaaatctaaaaccagtgtgggcctcacgggggtgccctcgcgcttgggatcaggaggctgaaggggccggccccgaacttggcctccgggtagcccgcaccaaggccttgtggctcccaatgggcgattag

SEQ ID NO: 178605 - DNA, 2382 bp, Artificial Sequence
  Description of Artificial Sequence: Synthetic coding sequence
atgctgagccaggtgtaccggtgcggcttccagcccttcaaccagcacttgcttccttgggtcaagtgtacaacagtgttcagatcccactgcattcagccatctgtcatccggcacgtaagaagttggagcaatattcctttcatcaccgtacctctctcccggacccacggaaaatcgtttgcgcatagatcagagctgaagcatgctaaacgtattgttgtcaagctcggctccgcggtagtcactaggggagatgagtgcggtctagcactgggcaggctggcttctattgttgagcaagtaagcgtactgcaaaatcagggaagagaaatgatgctagttactagtggcgctgtagcattcggaaagcagaggctaaggcatgagattctactgtctcagagcgttcgtcaagcattgcatagcggccagaatcagttgaaggagatggccatccccgtcctcgaggccagagcctgcgcagccgctggacagtccggcctgatggccctgtacgaggctatgtttactcaatacagcatctgcgctgcccagattctggtcaccaatctcgacttccacgacgagcaaaaacgtagaaacttaaacggtaccctgcatgagctgctaagaatgaacatcgtgccaattgtgaacaccaacgacgccgtggttcctcctgccgaacccaattcggacttgcagggggtgattagtgtgaaggataatgatagtctggctgccagactggctgtggagatgaagacagatttgttaatagtcttaagcgatgtcgaggggctgtttgattccccccctggaagcgacgatgccaaactaattgatattttttatccaggtgaccaacaatccgtcacgtttgggaccaaaagcagagtcgggatgggaggcatggaagccaaggtgaaagctgccctctgggcactgcaaggcgggacatctgtcgttatcgctaacggaacacaccctaaggtcagtggacacgtcatcacagacattgttgaaggaaaaaaggtaggtacattcttttccgaggtaaaaccagctggacccacagtcgaacagcagggggaaatggctcgctcgggcggtcggatgctcgccactctcgagccagaacagcgcgccgaaatcattcaccacctggccgacttgctgaccgatcagagggacgagatactcctggcaaacaagaaagacctggaagaagccgagggaagacttgcggcccccctattgaagcgcctctccctaagcaccagcaagttaaattcactcgccatcggccttagacaaatagcggcttccagccaggacagcgtgggcagagtgctgcgacggactagaatcgccaagaaccttgagctggagcaggtcaccgtgcctataggcgtgctgctcgtcatcttcgaaagccggcccgactgcctgccgcaggtcgccgctttagccatcgcttctggcaacggcttactgctgaaaggcggcaaagaggccgcacacagcaataggattctgcatctcctgacacaagaggccctgtccattcatggggtgaaggaagcggtccaattggtgaacactagggaagaggtggaggatctgtgtaggctcgacaaaatgatagatcttattatccccagggggtccagtcagctagtgagagatattcaaaaggccgctaagggtattcccgtgatgggccactcagagggcatatgtcacatgtacgtggattccgaagcgtcggtggataaggtgaccagacttgtaagggattcaaaatgtgaatacccggctgcctgtaacgctctcgaaacccttctcattcatagagacttgcttaggacacctctctttgatcagattatagacatgctgcgcgtggaacaggttaaaatacatgcagggcccaaatttgcctcttatttgacgttctctccatctgaggtgaagagccttcgcactgaatatggcgatctggagctgtgcatagaagtagtcgataacgtgcaggatgcaattgatcacatacacaagtatggctcgagccatacagacgttatcgtgacagaagacgagaacactgccgaattctttctgcaacatgtagattctgcatgcgtgttctggaacgcatctacgcggttctccgacgggtacaggttcgggttgggtgctgaagtggggatttccacctcacgtattcacgcccgcggtccagtggggcttgagggcctactaaccaccaaatggttgctccggggtaaagatcacgtggtgtctgactttagtgaacacggatctctcaaatacctgcatgagaacctccctatcccccagcgaaacacaaactag

SEQ ID NO: 178606 - DNA, 2388 bp, Artificial Sequence
  Description of Artificial Sequence: Synthetic coding sequence
atgctgagccaggtgtaccggtgcggcttccagcccttcaaccagcatctcctgccttgggtaaaatgtacaaccgtgttcagaagccactgtatacagcccagtgtgatccggcacgtccggagttggagcaacatcccttttatcaccgtccctctgtctcggacccacggcaagtcatttgctcataggtctgagttgaagcatgccaagcgcatcgttgtcaaactcggatcagcagtggtgacccggggtgatgagtgcggcctggcccttgggagactcgcttctattgtcgagcaggtctcagtcctgcagaaccaagggcgagaaatgatgttggtcacctccggcgccgtggccttcggaaaacagaggcttaggcatgagatcctgctctctcaatctgtgcgccaggcactccatagcggccagaaccagttaaaagagatggctatcccggtcctagaagcaagagcctgtgccgctgctggccagagcggcttgatggctctgtacgaagcgatgtttacccaatattccatctgtgccgcgcagatcctggtcactaacctcgattttcacgatgagcagaaaaggaggaatcttaacggaaccctccacgaattgttgcgcatgaacatcgtgccaatcgtgaacacgaacgacgccgtcgtccctccggctgagcctaatagcgaccttcaaggcgtaaacgtgattagcgttaaggacaacgactctctggctgcaagattagccgtggagatgaagaccgacttgctaatagtcctgagtgacgttgaaggtctgtttgattccccaccaggctctgacgacgccaagctgatagacattttctatcctggggatcagcaaagcgtaacctttggtaccaagtcccgagtcggcatgggcggcatggaggccaaagtcaaggccgccctgtgggctcttcaagggggtacgtccgtggtaattgcaaatggcacacatcctaaggtgtccgggcatgtgattacagacattgtggaaggtaaaaaggttggtacatttttctcagaagtgaagcctgcaggccctaccgttgaacaacaaggcgaaatggcacgctcaggtggacggatgttggccacactagagcctgaacagcgtgccgaaatcatccatcacctggccgacctgttgacagatcaacgtgacgagatcttactagctaataagaaagatcttgaagaagctgaaggacgcctggcggctcctctactcaaacgcctgagcctcagcacaagcaaattgaactcattggcgattggcttgaggcagatcgccgcgagctctcaggattccgtgggtcgtgtgctgagacgtacgcgaatcgctaagaacctcgagctagagcaggtaacagttccaatcggcgttctgctggtcattttcgagagcagaccagattgcctcccccaggtggcagccctggcaattgcttcaggtaatggcctcctcctcaaagggggtaaagaggcagctcactcaaatcgtattctgcacctgcttactcaggaggcactgagtatccacggcgtcaaggaagcggtacagttggttaatacccgggaggaagttgaggatctatgccggctggacaaaatgatcgacctcattatcccaaggggcagctctcaattggttcgagacatccagaaggctgcaaagggcatacctgttatggggcacagcgaggggatatgccacatgtatgtcgactctgaagcaagtgtagataaggtcacaagattagtcagagatagcaagtgtgaatatcccgccgcatgtaatgccctggagactctgctcatccacagagacctgctacgcacaccccttttcgatcagatcatcgacatgctgcgcgtcgaacaggtaaaaattcatgcgggccctaagttcgcatcatatctgacattctccccgagcgaggttaagtcgctgcggacagagtacggggacctggagctatgcatcgaggtcgtcgataacgttcaggacgccatagatcacattcacaaatacgggtcttcccacaccgatgttatagtgactgaggacgagaacactgccgaatttttcttacaacacgtggactcggcctgcgtcttctggaatgcttcaactagattctcggatgggtacagatttgggctcggggccgaggtggggatatccactagtcgtatacatgcccgaggcccagtcggactcgagggtctgctgaccacgaaatggctgctccgaggcaaggatcacgtggttagtgacttctctgagcacgggtccctcaaatatcttcatgagaacctgccaattcctcagagaaatactaactag

SEQ ID NO: 178607 - DNA, 1554 bp, Artificial Sequence
  Description of Artificial Sequence: Synthetic coding sequence
atgctgcgggccgccgcccggttcggcccccggctgggccggcggcttctgtccgccgcagcgacacaggccgtgcccgctccaaaccagcagcctgaggtgttttgtaaccaaatctttatcaacaacgagtggcatgatgcagtaagccggaagacttttccaaccgtgaatccgagcactggggaggtgatttgccaagtcgcagagggcgacaaggaggacgtggacaaggcagtgaaggctgccagagctgctttccagctgggctccccttggcgccgaatggatgctagtcaccgtggccggcttctcaataggctggccgacctcatagagagagatagaacttacctggccgcactggagacactcgataacgggaagccctacgtaataagctacctggtggatctggacatggtgttgaagtgcctgcgctactacgccggatgggccgataagtaccatggtaaaaccatccccatcgatggtgatttctttagctacacccgccatgagccagtgggagtatgcggacagataatcccgtggaatttcccattactcatgcaagcttggaagttaggccccgcgctggccacaggaaatgtggtggtgatgaaagttgcggagcagacaccactgaccgctctatatgtggctaacctaatcaaggaggccggattcccgcctggggtagtgaacatcgttcccggtttcggcccaaccgcaggcgcagcaatagcatcccatgaagatgtggacaaagttgcatttaccggatccaccgagataggacgagtcatacaggtggctgcagggagctcaaacctgaaacgggtgacgcttgaattaggcgggaaatcccctaacataatcatgagcgatgcggacatggattgggccgtggagcaggcacacttcgcgctgttttttaatcagggccagtgctgctgtgccgggagccgcacgtttgttcaagaagacatctacgacgagttcgtggagcggagcgtggcgagagcaaagtcccgcgtagttggcaaccctttcgacagtaagacagaacagggaccccaggtggatgaaacacaattcaagaagatcctgggatacatcaataccggtaaacaggagggggccaagctcctttgcggcggcggcatcgctgccgatcgggggtatttcattcagccaaccgtttttggtgacgtacaggacggaatgaccattgccaaagaggagattttcggaccagttatgcagattttgaagtttaagactatcgaggaggtcgtcggtcgggcgaataattctacttatgggctcgccgctgccgtgtttacaaaagatctcgacaaagccaattatctgagtcaagcattgcaggccggtacagtctgggttaattgctacgacgtgttcggcgctcagtcgcccttcggcggctataaaatgagcggatcaggacgcgagttgggcgagtacggtcttcaagcctataccgaagtgaaaacagtgacggttaaagtccctcaaaagaattcctag

SEQ ID NO: 178608 - DNA, 1413 bp, Artificial Sequence
  Description of Artificial Sequence: Synthetic coding sequence
atgctgcgggccgccgcccggttcggcccccggctgggccggcggctgctcagtgcagccgccacccaggctgtgccagccccgaatcaacagccggaggtattctgcaaccaaatctttatcaataatgagtggcatgatgccgtgtctaggaaaacatttccgacagttaatcccagcaccggcgaggtaatctgccaggtcgcagagggcgacaaggccctcgagacacttgacaatggaaagccttatgttatctcttatcttgtggatctcgacatggtgctcaagtgtttacgttattatgccggctgggcggacaagtaccacgggaaaacaattccaatcgatggggacttcttttcatatacccgtcacgagcctgtgggcgtttgtgggcagattattccctggaatttccctctgttgatgcaggcctggaaactcggtcccgccctggcaaccggcaacgtggtagtaatgaaggtggctgagcaaacacctctcactgcgttgtacgtcgcgaatctgatcaaggaagcgggctttccccccggggtggtaaacattgtacccggctttggacctactgccggtgccgccatcgcaagtcatgaggatgtagacaaagtggcttttactggcagtactgaaatcggccgcgttatccaagtcgccgcgggcagctctaacctgaaaagagtcaccttggaactcgggggcaagagccccaatatcattatgagcgacgctgacatggactgggcagtcgaacaggctcattttgctctgttttttaaccagggccagtgttgctgcgcaggaagcagaacctttgtgcaggaagacatttatgatgagtttgtcgagcgctctgtggcccgggctaagagccgtgtggtcgggaatcccttcgactccaagaccgaacagggccctcaggtcgacgaaactcaattcaaaaagatcctcggatacattaacaccggcaagcaggaaggggctaagcttctatgtggcggaggcattgcagcggatcggggctactttatccaacccacagtgtttggcgacgttcaggacggaatgacaatcgccaaagaggaaattttcggcccggtgatgcagattctgaagtttaaaacaatcgaagaagtggtgggaagagcaaacaattctacctacgggttagccgccgcggtgtttacaaaggatctcgacaaagctaactatttatctcaggctctccaggctggcacagtctgggtgaattgctacgatgttttcggggctcagtctccatttggaggctataagatgagtgggtccgggagagaactgggagaatatgggctgcaggcctatacagaagtgaaaaccgtgacggtcaaggtcccacagaagaattcctag

SEQ ID NO: 178609 - DNA, 1989 bp, Artificial Sequence
  Description of Artificial Sequence: Synthetic coding sequence
atgcggggcgccggccccagcccccggcagagcccccggaccctgcggccagaccctgggcctgcgatgtcattctttaggcgtaaggtcaaagggaaagagcaggagaaaaccagtgatgtaaagtccattaaagccagcatctcagtccattctccacagaaatctaccaaaaatcatgccctgctcgaagccgcaggcccatcccatgtggcaatcaacgcaatctccgcaaatatggacagtttctcctccagccgcacggcaacactgaaaaaacaaccctcccacatggaagcggcccatttcggggatttaggcagaagttgtcttgattaccagacgcaagagaccaagtcatcattaagcaaaaccctggaacaggtgctgcacgacactatcgtcttaccctacttcatccagtttatggaactgagacgtatggaacacctcgtcaagttctggctcgaggccgaatcttttcacagtacaacatggagccggatcagggcacactccctcaatacggttaagcagtcctcactggccgagccagtatcgccttcaaagaagcacgagacaactgccagcttcctcacagacagtctggataaacggctcgaagattccgggtcagcccagttattcatgacacacagtgaaggcatcgatctgaacaatcgcaccaactcaacccaaaatcatctgcttctgtctcaggaatgtgattctgctcacagcttgcggctggagatggcaagggctggcacccaccaggtctctatggaaacccaggagtctagttcaactttaacggtcgcatcgcggaacagccctgctagcccacttaaggaactctctgggaagctgatgaaatctatagagcaggacgccgtaaataccttcaccaaatacattagtcctgatgctgctaaacccattcccatcacagaggcaatgaggaatgatatcattgctcgcatttgtggcgaggacgggcaggtcgatcccaattgttttgtcttagctcagtctatagtttttagtgctatggagcaggaacacttcagtgagtttctgcgctctcaccacttttgcaagtaccaaatagaggtgttaaccagcgggaccgtatatctggccgatattctcttttgcgagagcgccctgttctattttagcgagtatatggaaaaggaagacgccgtcaacatcctccaattctggctggcggcagacaatttccagtcacagcttgcagccaagaaaggtcagtatgatggccaagaggctcagaacgatgcaatgattctctacgataagtatttttccttgcaggctacgcatcccctgggtttcgatgatgtggtgcggctagaaatagaatctaacatttgtcgggaagggggacccttgccaaattgcttcactactcccctgcggcaggcttggactacgatggagaaagtctttctgcccggcttcctgagttctaacctctactacaaatacctgaacgatttaatacacagtgttcggggggacgaatttctcgggggtaatgttagccttaccgcgcctgggagcgtgggtccaccagacgaaagtcaccccggaagcagtgactcctctgcctcccagtcatcggtgaagaaggcctccatcaaaatcctgaaaaactttgatgaggccataattgttgatgccgcctccctcgaccccgagtcactctatcaaaggacatatgctggaaagatgaccttcgggagggtcagtgaccttggacaattcatcagagaatccgagcccgaaccagatgtgcggaagagcaagggttctatgttcagtcaggctatgaagaagtgggtgcagggtaacacagacgaggctcaagaagagttggcttggaagatcgcaaagatgattgtgagtgacatcatgcagcaagcgcaatacgaccagccactggaaaagtcaacgaagctatag

SEQ ID NO: 178610 - DNA, 1536 bp, Artificial Sequence
  Description of Artificial Sequence: Synthetic coding sequence
gaggtgcagcggaccccccaccccaccttcgagtacttcttcttcttgtccagaaagctgcccggccaggagctgcagggtctaaacggcagggaggcaggcagcctgaatacatcacccttaggctcttgccgttccaggtcaccctcatatcgcgagcgcttatgccagagaagacacgagcaagatcaacgcgggagagaggcaagaccaagacgtctccaggggcgcacccgcccactgcaattcagaattcaacagcttgaagccctgcagaggctgatccaggaacaggagcaggagctggttggggccctggctgccgacctgcataaaaacgagtggaacgcctattacgaggaggtcgtctacgttctggaggagatcgagtatatgatccagaagctgcccgagtgggccgctgatgagccagtggaaaaaaccccccagacacagcaggatgagctgtatatccattctgagcctctcggtgttgtgttggtgatcggcacctggaactaccccttcaacctgaccattcaaccaatggtgggggccatcgccgcaggaaacagcgtagtcctgaagcccagtgaactatccgagaacatggctagcctcctagccacaataattcctcagtatctagacaaggatctctatccggtgattaacggcggagtgcctgagaccaccgagttgcttaaagaaaggtttgaccacattctctacactgggtcaaccggagttggcaagataattatgacagccgcagccaagcatctgactcccgtgaccttggagctcggtgggaaatccccttgttacgtggacaagaattgtgacctcgacgtcgcgtgtcggcgtatcgcttggggcaaattcatgaactcaggacagacttgcgttgccccagattatatcctgtgcgaccccagcattcagaaccagatcgtggagaagttgaagaaatctctgaaagaattctatggagaagacgccaagaagtccagagactacgggcgcattattagcgcccggcacttccagcgagtaatggggctcatcgagggccagaaagtagcctatgggggcacaggtgatgccgcgactcgctatatagcaccgactatcttaaccgatgtggaccctcagtcgcctgtaatgcaggaagagatcttcggcccggtgctgcctatcgtgtgtgtgagatcccttgaagaggcaattcagttcataaaccaaagagaaaaaccccttgccctgtatatgttctcaagtaatgataaggttattaaaaaaatgatagccgagactagtagtggcggagtagctgccaacgacgtgatcgtgcacatcaccctgcacagcctcccttttgggggtgtgggcaactctggcatggggagttaccatggcaaaaaatcttttgagacgttttctcaccgccgctcctgcctggtgagaccactgatgaatgatgaggggttgaaggtgcgataccccccctctcccgcaaaaatgacacagcactag

SEQ ID NO: 178611 - DNA, 1170 bp, Artificial Sequence
  Description of Artificial Sequence: Synthetic coding sequence
atgagcaagatcagcgaggccgtgaagcgggcccgggccgccttctctagtgggcgaactcgacccctgcagtttagaatacaacagctggaggccctgcaacgtctgattcaggaacaggagcaagaactggtgggcgctctcgctgctgacttacacaagaacgaatggaatgcttactacgaggaggtggtttacgtccttgaggagatcgagtacatgattcagaagctgccagagtgggccgccgatgaaccagtagagaagactccccagacccaacaggatgaactgtatatccattccgagcccctcggagtggtgctagtgatcggaacctggaactatccctttaatctaacaattcagccgatggtcggagctattgccgctggcaacagcgttgtgctgaagccttcagaacttagtgagaatatggcctcactcctggcaacgattattcctcaatatctagataaggatctctaccccgtcatcaacggcggtgttcctgagaccaccgaattactgaaggagcgctttgaccacatcttgtatactggttctaccggggtgggaaaaatcataatgacagccgctgctaagcacttaaccccagtgacactggagttagggggaaagagcccctgctatgtcgacaaaaactgcgacttggacgtggcctgtagaagaatcgcctggggtaagtttatgaattcaggacagacgtgtgtggctcctgattacattctgtgcgatccatcaattcagaaccagatagtggaaaagctgaagaagtctttaaaagaaatatttggacccgttctcccaatcgtatgcgttcgaagtctcgaagaagccattcaatttatcaatcagcgggaaaagcctctcgctctctacatgttttctagcaacgataaggtgattaaaaaaatgatcgccgagacgtcaagtggaggggtcgcggccaacgacgtaattgtgcacataactttacactccttgcccttcggcggggtggggaactccgggatggggagctaccatgggaagaaatctttcgagactttctctcatagacggtcatgtttggttcgtccacttatgaatgacgaagggctgaaagtgcggtaccccccgagtccggccaagatgactcagcattag

SEQ ID NO: 178612 - DNA, 693 bp, Artificial Sequence
  Description of Artificial Sequence: Synthetic coding sequence
atgagcaagatcagcgaggccgtgaagcgggcccgggccgccttcagcagcgggaggacgcggcctcttcaatttcggatccagcaactggaggcacttcagcggctgatacaggagcaggagcaggagttggtcggagcgttggctgctgatctgcacaaaaacgagtggaacgcctactacgaggaggtggtgtacgttctggaggagattgaatacatgatacaaaaactgcctgaatgggctgccgatgagccagtcgagaagacaccacagactcagcaggacgaactgtatatccattcagagcccctgggagtagtgctcgtcataggtacttggaattatccgttcaatctgacgattcaaccaatggtaggcgccattgccgctggcaattcggtggtgttgaaacccagcgagctctctgaaaacatggcaagcctgctggcaaccattattccccagtaccttgacaaggacctctacccggttattaatggcggtgtaccggaaaccacggaactgctgaaggagaggtttgatcatatcctgtatacagggagtacaggtgtaggaaaaataattatgacagccgctgccaagcacctgacccccgtgactctggaactgggcggaaagagcccgtgttatgtcgataagaattgcgacttggacgttgcctgtcgttag

SEQ ID NO: 178613 - DNA, 1119 bp, Artificial Sequence
  Description of Artificial Sequence: Synthetic coding sequence
atgagcaagatcagcgaggccgtgaagcgggcccgggccgccttcagcagtgggaggacgaggcccctgcagtttcgcattcagcaattggaggccctgcagcgcctgatccaagaacaggaacaggagctggtgggtgctctcgctgctgacctgcacaaaaatgaatggaatgcatactacgaggaggtggtgtacgtgctggaggagattgagtacatgatccaaaagttgccagagtgggccgcagatgaacccgtggagaaaaccccccagacccagcaggacgagctttatatccacagcgagcccttaggtgttgtcctggtgattggcacatggaactatccatttaatcttacaatccagcctatggtgggtgcaattgctgctggcaatagcgttgtcctgaaaccctctgagctttctgaaaatatggcttccctactcgctactataatcccacagtatttggacaaggacctttacccggtgatcaatggcggtgtgcctgagactactgagctactaaaagagcgcttcgatcacattctctacacaggcagtactggagttgggaagatcataatgactgcggcagccaagcacctgacccctgtgacccttgagctgggggggaaatctccttgctatgtggataagaattgcgatcttgatgtggcatgtaggaggatcgcttgggggaagttcatgaattccggacaaacttgtgtggcccctgactacattctctgcgatccaagcatacagaaccaaattgtggagaaattaaagaaatcgttgaaggagttctatggggaggacgccaaaaaatcccgagactatgggcggattatcagcgccagacactttcagcgggtgatggggttgatcgagggacagaaagtggcctacggtggcaccggtgacgccgccaccagatacatcgcccccaccattctaaccgacgtggacccccagagcccagtgatgcaggaagagattttcggaccagtcctgcccatcgtgtgcgttcggtccctggaagaagccatccagttcattaaccagagagagaaaccactggcgctttacatgtttagcagcaacgataaatag

SEQ ID NO: 178614 - DNA, 1362 bp, Artificial Sequence
  Description of Artificial Sequence: Synthetic coding sequence
atgagcaagatcagcgaggccgtgaagcgggcccgggccgccttctcatccggccgtacgagacctttacagttccgcatacagcagctggaggcgctgcagaggctaatccaggagcaagagcaggagcttgtcggtgctctcgcggcagacctgcataagaacgagtggaacgcctattacgaggaagtggtgtatgtgttggaagaaatagaatatatgatccagaagctgccagaatgggctgcagatgagccggttgagaagactccacaaactcagcaggacgagctgtatatacatagtgagccactgggggtcgtgctcgtaattggcacctggaattatccctttaacctcacaatacaacccatggtaggggcaatcgccgccgggaactcggttgtcttaaaaccctctgagttgtcagagaatatggccagcctgctcgcaactattataccgcagtatttagataaggatctgtatcccgtcatcaatgggggagtgccagaaaccacagagttgctgaaggaaaggtttgaccacattctatatacaggcagtacgggcgtaggcaaaatcataatgacagcggcagctaaacaccttacacccgtgacccttgagttggggggcaagtctccatgttacgtcgacaaaaattgcgacctggacgtcgcttgccgtagaatcgcttggggtaagtttatgaattctggacaaacttgtgtggctcccgattatatcttgtgcgacccttcgatccaaaatcagattgtggagaaattgaaaaagtccctgaaggaattctacggcgaggacgcaaaaaagtcccgagactatggaagaataatctctgcccggcactttcagagggtgatgggcctgatcgaaggtcagaaggtggcctatggcggcaccggggatgctgccacacgctacatcgctccaacaatcctgactgatgtcgacccccaatctccagtgatgcaggaggagatcttcggccctgtgctacccattgtgtgcgtacggagcttagaggaggccatccagttcatcaatcagcgcgagaaacccctagcgctatacatgttctctagcaacgataaagtgatcaaaaaaatgattgccgaaacaagttccggcggcgttgccgccaacgacgtaatagtgcatatcaccctgcactcattaccgttcgggggagttggcaattctggaatggggagttatcacggcaaaaaatccttcgagacgttcagccatcggcgctcctgcttagttcgtccactgatgaatgacgagggactcaaagtgaggtatcctccatcgcccgcaaagatgacccagcattag

SEQ ID NO: 178615 - DNA, 1362 bp, Artificial Sequence
  Description of Artificial Sequence: Synthetic coding sequence
atgagcaagatcagcgaggccgtgaagcgggcccgggccgccttctcttctgggagaacccgcccactgcaatttcggatccagcaactggaagccctacagcggctgatccaggaacaggaacaggagctagttggcgcgctggccgcggacctccataagaatgaatggaatgcttattatgaagaggttgtctacgtccttgaggagatagaatacatgatacagaagttacccgagtgggccgctgatgaacccgtggaaaaaacgcctcagactcagcaagatgagctatatattcacagtgaacccttgggtgtggtacttgtaatcggaacctggaactatcccttcaatctaacaattcagccaatggtcggcgccattgcagccgggaatagcgttgtgctgaagccttctgaactgagcgaaaatatggcctcacttttagcaacaatcatcccgcagtatctggacaaagacttatatcccgtcattaatggaggtgtccccgaaaccacagagctgctgaaagagagatttgatcacattctttacacagggtctacaggcgtgggcaagatcatcatgacagcagcagcgaagcatctaacccctgtgacactcgagttgggggggaaaagtccttgctacgttgacaagaattgtgatttggatgttgcttgccgcaggatagcctggggaaaattcatgaactccggccagacgtgtgtcgcaccggattatatcctttgcgacccttctattcagaaccagatcgtggagaagcttaaaaagtctctcaaggaattttatggggaggatgcaaaaaagtcccgggactatggccggattatttctgcccgccatttccagagggtgatgggtctgattgagggacagaaggtggcatacggtgggactggggacgctgctacgcgctatattgccccgaccattctcacagacgtggatccccagtctcccgtgatgcaggaagagatatttgggccagtgctccccattgtctgtgtgcggtcactggaggaggcaattcagttcatcaatcagagggaaaagcccttagcactgtacatgttctccagtaatgacaaagtgatcaagaagatgatcgctgagacctcctcaggaggtgtcgcggctaacgacgtaatcgtacatattacacttcactccctgccctttggcggtgtcgggaactcaggcatgggaagctatcacgggaagaagtcctttgagacattttcccacaggcgctcctgcttagtcaggcccctgatgaatgatgaaggtctgaaagtccggtacccaccctcgccagccaagatgacacagcattag

SEQ ID NO: 178616 - DNA, 1203 bp, Artificial Sequence
  Description of Artificial Sequence: Synthetic coding sequence
atgatccagaagctgcccgagtgggccgccgacgagcccgtggagaagactcctcaaacacagcaggacgagctctacattcacagtgaacccctaggggtggtactagtcataggtacttggaattatccattcaaccttaccatacagccaatggtgggcgcgatcgctgccgggaacagcgtggttctgaagccgtccgaactcagtgaaaatatggcttcccttttggcaacaatcatccctcagtacctcgacaaagatctgtacccagtgatcaacggaggagtgccagagactactgagcttcttaaggagcgatttgatcatattctgtataccgggtccaccggcgtgggtaagataattatgactgctgccgctaagcatctaactcccgttactctggagcttggaggaaagagtccatgctacgtggataagaattgcgatttggacgtcgcatgtaggcggatcgcttggggcaagtttatgaatagtggccagacatgtgtggcgcccgattatatcctctgcgatccgtctattcagaaccagatcgtggagaagctcaaaaagtctctgaaggagttttacggggaggatgctaaaaaatcccgtgattatggaaggataatcagcgctaggcatttccagagagttatgggattgatcgagggacagaaggttgcgtatggggggactggcgatgctgccacacgatatattgcacctaccatcctcacagacgttgatcctcagtccccagtgatgcaggaggaaattttcggaccagttctgcctatcgtgtgtgtacgaagcctagaggaagccatccagttcatcaaccaacgcgagaagcctctcgccctgtatatgttcagtagcaacgataaggttattaagaagatgatcgcggagacaagttccggcggggtggcagccaacgacgtgatcgtccacatcactttgcatagccttccatttggaggagtcggtaatagcgggatggggagctaccatggcaagaaatcattcgaaaccttcagccaccgtcgtagctgtctggtgcgtcccctgatgaacgatgagggcctcaaggttaggtacccacctagtcctgcaaagatgacccaacactggctttcatggccgtgggaaaacagaagctgtagcccctcccccgccccactcctgtgctag

SEQ ID NO: 178617 - DNA, 1458 bp, Artificial Sequence
  Description of Artificial Sequence: Synthetic coding sequence
atggagctggaggtgcggcgggtgcggcaggccttcctgagcggcagaagcagaccattacgattcagactgcaacagcttgaggctctgcgccggatggtgcaggagcgcgaaaaggatattttgacggccatcgcagctgacctgtgtaaatccgagttcaacgtatattctcaggaggtgataaccgttttaggcgagatcgacttcatgctggagaacctgcccgagtgggttaccgcaaagcctgtgaaaaagaatgtgcttactatgcttgacgaagcatacattcaacctcagccccttggtgttgtccttataattggcgcttggaactatccatttgtactcacaattcagcctctaataggcgcaatcgcggctggcaacgcagtcattatcaaaccaagtgaactgtccgagaatacagctaaaattctggctaaactgttgccccaatacctcgatcaagatttgtacattgttattaacgggggcgtggaagagaccacagagctgctgaagcagcgatttgaccacattttttatacaggtaacacagcggttggcaagatcgtcatggaagctgcagctaagcacctcactcccgtcactttggagctgggcgggaaatccccttgctacattgataaagactgcgatctggacatcgtgtgccgccgaattacttggggcaagtacatgaactgcggacagacatgcatcgcccctgactacatcctgtgcgaggcgtcacttcagaatcaaatcgtgtggaagatcaaagagacggtgaaagaattctacggtgagaatatcaaggagagccccgattatgaacgcattataaatctgagacatttcaagcggattctgagtctcctggaagggcagaaaattgcctttgggggcgaaacagacgaggccacacgctatatagcccccactgtgctgacagacgtggatcccaagaccaaagtcatgcaggaggagatttttggacctattctgccaatagtgccagtgaaaaatgttgacgaggctattaatttcatcaatgagcgcgaaaagccactggccttatacgtgttcagccataaccacaaactgattaaacggatgatagatgagacctccagtgggggagtcacaggcaacgatgtgattatgcattttactctcaattcttttcctttcggcggagttgggagttcagggatgggagcttatcatggtaaacatagctttgacacattctcacaccagcgcccctgcctactgaaatccctcaaaagggagggtgccaataaactgagatacccaccgaattctcagtcaaaggttgactgggggaagttttttctgttaaagcggttcaataaagagaaactgggtttgctactgctaacttttctgggaattgtggcagcggtacttgtgaaagcggagtactattag

SEQ ID NO: 178618 - DNA, 1527 bp, Artificial Sequence
  Description of Artificial Sequence: Synthetic coding sequence
atggagctggaggtgcggcgggtgcggcaggccttcctgagcggccggagtcgccctttgcgtttccgtctacagcagctggaagcgctgcgacggatggtgcaagagcgagaaaaggacattctgaccgccattgccgctgacctgtgcaagagcgagttcaatgtgtattcacaggaggtcataaccgtcctgggcgagattgattttatgctagagaaccttcctgagtgggtaacagccaagcccgttaagaagaacgttcttacgatgctggatgaggcgtatatccagccacagcctctcggtgtggtgctgatcatcggcgcttggaactatccattcgtgctgaccatacagcctctgatcggtgctatcgccgccggcaatgccgtaatcattaaacccagcgagctgtctgagaacactgcgaagatcttggccaaactcctaccccaatatctggaccaagacctgtatatcgtgatcaacggcggagtcgaagagacaaccgagttgctcaagcagagatttgatcacatcttctacaccgggaacaccgcagtgggcaagattgtcatggaggccgccgcaaagcacctcacaccagtcacattagagttggggggaaagagcccttgctacatcgacaaggattgtgacctggatatcgtgtgtcggaggataacatggggcaaatacatgaattgtggccagacctgcatagcccctgattacatcctctgtgaagcaagcttacaaaaccagattgtgtggaagataaaggaaacggtgaaagagttttacggcgagaacattaaagagtccccggactacgagcggatcatcaatctccggcactttaagagaatcctctctcttcttgaagggcagaagattgccttcggtggtgaaactgacgaggctactagatatatcgcacccacggtgctgacagacgtagacccaaaaaccaaggtgatgcaggaggagatattcggaccaattttaccgatcgttcccgtgaagaatgtggatgaagccatcaacttcatcaatgaacgtgagaagcctctggcgctgtatgtattctcccataatcacaagcttatcaagagaatgattgacgaaacttcttcaggtggcgtgacagggaatgacgtgatcatgcattttaccctgaactccttcccttttgggggggtgggctcatccgggatgggagcgtatcacggcaagcattcattcgacactttcagccaccagcgtccatgccttctgaagtcacttaaacgtgagggggccaataagctccgctatcctcctaatagccagtctaaggtggactggggtaagttttttttgcttaagcgcttcaacaaagagaaactcggcctgctgttactgacgttcttaggcatcgttgctgcagtgctggtgaagaaataccaagcagtgctcagaaggaaagccttgcttattttccttgtggtgcaccgccttcggtggtcatcaaagcaaagatag

SEQ ID NO: 178619 - DNA, 1458 bp, Artificial Sequence
  Description of Artificial Sequence: Synthetic coding sequence
atggagctggaggtgcggcgggtgcggcaggccttcctgagcggccgctccaggccattgcgttttagattacagcagcttgaagcgctcagacggatggtgcaggagcgcgagaaggacattctcacagctatcgccgccgacctctgtaaaagtgagtttaacgtttactcacaggaagtaatcacggttttaggagaaattgatttcatgctggagaacctaccagagtgggtcacagcaaagccagtgaagaaaaatgtcctgaccatgctagatgaagcttacatacaaccacagccccttggtgtcgtactcatcatcggtgcatggaattatccatttgtcctgacaatccagcctcttatcggcgccatagccgccggtaatgccgtcattatcaaaccttccgaattaagcgagaacacagcaaagattttggcaaagctcttgccccagtatttggatcaagacctgtacattgtgatcaacggaggagtcgaagagacgactgaattgcttaagcagcgttttgaccatattttctatacgggaaacactgccgtgggcaaaatcgtgatggaggcagctgctaaacacctgaccccggtgacattagagctcggaggtaaaagcccctgctatatcgacaaagattgcgacttggacattgtctgtcggcgtattacgtggggtaaatacatgaactgcgggcaaacatgcatagcaccagactacattttatgtgaagccagcctgcagaatcagatcgtctggaaaatcaaggaaaccgtaaaagagttctatggcgagaacatcaaggagagccccgactatgagcgcattatcaaccttcggcattttaaacgcatcttatccctactggagggccagaagatcgcctttggcggcgagacggatgaggccacacggtatatagcaccaactgtcctgacggatgtggatcccaagaccaaggtgatgcaggaagaaattttcggcccaatcctcccaatcgtgccagtcaagaacgtcgatgaagccattaacttcatcaacgagcgggagaagccccttgcactttatgttttcagccataaccataaactgataaagaggatgatcgatgagacctcctcaggaggtgtaaccggcaacgacgtgataatgcacttcactctcaatagttttccgttcggcggggtgggctcctctgggatgggggcgtaccacgggaagcattctttcgacaccttttcgcaccagaggccttgcctcctcaaatctttaaaacgtgagggagccaacaaactgcgttatccccccaacagccaatcaaaggttgactggggcaagttcttcctcttgaagcgcttcaacaaggagaaactgggcctgctgttattaacctttctgggaatagtggcagccgtactagtcaaagccgagtactactag

SEQ ID NO: 178620 - DNA, 501 bp, Artificial Sequence
  Description of Artificial Sequence: Synthetic coding sequence
atggagctggaggtgcggcgggtgcggcaggccttcctgagcggcagatcacgtcccctcaggtttaggttgcagcagttggaagccttacgtcggatggtgcaggagcgggagaaggatattctgaccgcaatcgccgccgatctgtgcaaatcggagttcaatgtctactctcaggaggtgattacagtgctgggagaaatcgacttcatgctcgagaacctgccagagtgggtgacagctaaacccgtgaagaagaatgtcctcacaatgctcgatgaggcctacattcagcctcagcccctcggggtagtcctcataatcggtgcttggaattacccatttgtacttacaatccaacctctgattggggccattgctgctgggaacgctgtgataatcaaacccagcgagttgtctgaaaatacagcaaaaattttggccaaattgctgccacagtaccttgatcaggacttgtatatcgtcataaatggaggctag

SEQ ID NO: 178621 - DNA, 1158 bp, Artificial Sequence
  Description of Artificial Sequence: Synthetic coding sequence
atgaaggacgagccccggagcaccaacctgttcatgaagctggactcagtgtttatatggaaagaaccctttggcttagtgctgattattgcaccctggaattaccccctcaacctgactttggttttgttagtcggtgcgctggccgcgggctcttgtgtagttctgaagccaagtgaaatttcacagggcactgaaaaagtactagcagaagtcctcccacagtatttagaccaaagctgtttcgccgtggtgcttgggggccctcaagagacaggtcagttgctggagcataagttggactacatattcttcacaggctcaccccgcgtcggcaagattgtgatgacagctgccaccaagcacttgactcccgttacactcgaattggggggcaaaaatccctgttacgtggacgacaattgtgatccccagaccgtggctaatcgggtggcttggttttgttatttcaacgccgggcagacctgtgtggctcctgactacgtgctctgttccccagagatgcaggagagactactgccagcgcttcaaagtactatcacaaggttctacggggatgaccctcagagctctccaaacttagggcacattatcaatcagaagcagtttcaacggctgagggccttgctcggctgttcacgtgtagcgatcggggggcaaagtaatgaaagcgacaggtatatcgctccaaccgtgctcgttgacgtccaagagacggaacccgttatgcaagaagagatttttggaccaatactgccaattgtcaatgtgcagtcagtggatgaagctatcaaattcatcaacaggcaggagaaacctctggccctgtacgctttttctaactccagccaggttgtgaatcagatgttggagcgcaccagctctggatcctttggaggcaacgaaggcttcacatacatttcactgctctcagtacctttcggaggcgtgggtcacagcggcatgggacggtaccatgggaaatttacatttgacactttcagccatcacagaacatgcctcctagctccttctgggctggaaaagctaaaggagatccactaccccccctacacagactggaaccagcagcttctgcggtggggaatgggctcccaatcttgtacacttctctag

SEQ ID NO: 178622 - DNA, 447 bp, Artificial Sequence
  Description of Artificial Sequence: Synthetic coding sequence
atgaaggacgagccccggagcaccaacctgttcatgaagctggactccgtatttatttggaaagagcccttcgggctggtgctcatcattgccccatggaactatccgcttaatcttacactcgtactgttagtcggggctttagcggcaggttcgtgtgtggtgctgaagccttccgagataagccaggggacagaaaaagttctggccgaggtcctgcctcagtatctggatcagtcctgtttcgccgtggtgttgggcggcccacaggaaaccgggcagctcttggaacacaagttggactatatcttctttaccggatcacctagagtcgggaaaattgtcatgacggctgctacgaaacacctgaccccggtgacactcgaactcggcggtaaaaatccatgttacgtcgacgataattgtgatccacagacagtggcttag

SEQ ID NO: 178623 - DNA, 288 bp, Artificial Sequence
  Description of Artificial Sequence: Synthetic coding sequence
atgaaggacgagccccggagcaccaacctgttcatgaagctggactctgtgttcatatggaaggagccctttgggctggtcctaatcatcgcaccatggaactacccactcaatttgacactggtgctgctcgtaggcgctctggccgcaggatcctgcgtggtgctaaaaccatctgagatttctcaaggaacagagaaggtgttggctgaggtgttgcctcagtacctggatcagtcttgttttgccgtggtcctcggcggtccccaggaaactggccagctgtag

SEQ ID NO: 178624 - DNA, 1158 bp, Artificial Sequence
  Description of Artificial Sequence: Synthetic coding sequence
atgaaggacgagccccggagcaccaacctgttcatgaagctggactcagtgtttatctggaaagaaccgtttggcctggtgctgatcatcgctccttggaactatcccctaaacctcacattagttctgctggtcggggcgctagcggccgggtcctgtgtggttctgaaaccgtctgaaatctctcaggggaccgaaaaagtactggccgaagtgctccctcaatacctggaccagagctgcttcgccgtagtgcttggcggtccccaggagaccggtcagctcttggaacacaagctcgattacattttctttactggcagtcctagagttggcaaaattgttatgaccgcggccactaagcatctgacacctgttacgctcgagttgggcggaaagaacccttgttatgttgacgataactgtgaccctcagactgttgccaatcgtgtcgcctggttctgttacttcaatgccggccagacttgcgtcgcccctgattatgtcctgtgctctcccgaaatgcaggaacgcctccttcccgccctccagtccaccattaccagattctatggcgacgatcctcagtcctcgcctaacttagggcacatcattaatcagaaacagtttcaacgcttgcgagctcttctcggctgcagtagagttgctataggtggacagagcaacgagagtgaccggtacatcgccccaaccgtcctggttgacgttcaagaaacagagccagtcatgcaggaggagattttcggacccatcctgcccattgtgaacgtacaatccgtggacgaggccatcaagtttattaacagacaggaaaagccactcgccctttacgcctttagtaattcttctcaggtggtgaatcagatgctcgaacgcactagctctggttctttcgggggtaacgaaggcttcacctacattagcctgctgagtgttcccttcggcggagttggacactctggaatgggcaggtatcacggaaagtttacatttgataccttcagccaccatcgaacttgtctcttagctccttctggccttgaaaagctcaaagaaatccactatcccccatacacagattggaaccagcagctactgcgctggggcatggggtcccagtcctgtacactgttatag

SEQ ID NO: 178625 - DNA, 1692 bp, Artificial Sequence
  Description of Artificial Sequence: Synthetic coding sequence
atgctgctgcccgcccccgccctgcggcgggccctgctgagccggccgtggacgggcgcagggctcagatggaaacatacatccagcctgaaagtcgctaacgagcccgtgctggcttttacacagggctctcccgagagggacgctctgcaaaaggcgttgaaggacctcaaggggagaatggaagctataccctgtgtggtcggcgacgaggaagtgtggactagcgacgttcagtaccaggtgagccctttcaaccatggtcataaggttgcaaaattctgttacgctgataagagcttgctgaataaggcaatagaagcagcactggcagcccgcaaggagtgggacctgaaacctatagcggaccgtgcccagattttcctgaaagctgccgacatgctgtcaggacctaggcgagccgagatcttggctaaaaccatggtcggacagggcaagacagtgatacaggccgagattgacgcagcagcggagcttatcgacttctttagattcaacgccaaatacgcagttgaactggagggacagcagcctataagcgtgccacccagtaccaattcgacagtataccgcggcctagagggatttgttgccgccatatcacccttcaactttacggcaataggcgggaatctagccggagcccccgcactgatggggaacgtggtgctgtggaagccctccgacaccgcgatgcttgccagttatgccgtctatagaatactacgtgaggccggactacccccaaatattatacaatttgtcccagctgacggcccccttttcggagatactgtgacatccagcgagcatctgtgcggcatcaacttcactggttctgtgcctacctttaagcatctgtggaagcaggtggctcagaacctagatcgctttcatactttccccaggctagccggagaatgtgggggaaagaactttcatttcgtccaccggtctgccgacgtcgagtccgtcgtttccggcacccttaggtccgcctttgagtacggagggcagaagtgttcagcctgcagtagattgtacgttcctcacagtctgtggccacagatcaagggccggcttttagaagaacattcccgaattaaagttggagaccctgccgaggatttcggcacctttttttccgcggtcattgacgccaagtctttcgcgcgaatcaaaaaatggctggagcatgctcgtagcagcccatcactcactatactcgccggcggtaagtgtgatgattcggttggatacttcgtcgaaccttgcatagtggaaagcaaagatccgcaagaacctattatgaaagaggagattttcgggcccgtgctgagcgtatatgtttatccagacgacaaatacaaagaaactttgcagctggtggattccacgacctcgtatggactgacaggtgccgtgttctcacaggataaagatgtcgtgcaggaggccactaaagtgctgcggaacgccgctggcaacttttacattaatgacaaaagcactgggagtattgtggggcagcagccctttgggggagcaagggcttcaggaacaaacgacaagcccggaggcccacactacatcctacggtggacatcaccacaggtcatcaaagagactcacaaacctctgggtgattggagctatgcctacatgcagtag

SEQ ID NO: 178626 - DNA, 588 bp, Artificial Sequence
  Description of Artificial Sequence: Synthetic coding sequence
atggaggccatcccctgcgtggtgggcgacgaggaggtgtggacctctgacgtgcagtatcaggtatccccctttaatcacggccataaagtagctaaattctgctacgccgataaaagtctcttgaataaggccattgaggcggctctcgccgccagaaaagaatgggatttgaagcctatcgccgatagagcacagatctttctaaaagccgccgacatgttgtccggcccgcggagggctgagattcttgccaaaacaatggtaggacaaggcaagaccgttattcaggccgagatcgatgctgccgccgaactaatcgactttttccgttttaacgcaaaatatgctgtagagctggagggacagcagccaatttccgtcccgccttccaccaacagcacagtctatagaggcctcgagggttttgtggccgccattagcccgttcaacttcaccgccatcggaggcaacctcgcaggtgcgcctgccttaatgctcagggaaggggtggtgactcttccattatgccaaatgaccaagctcaggcacacggccgtcacgtatcttgcgcgactgtcagattag

SEQ ID NO: 178627 - DNA, 633 bp, Artificial Sequence
  Description of Artificial Sequence: Synthetic coding sequence
atgctgctgcccgcccccgccctgcggcgggccctgctgagccggccctggacgggcgctggactgcgctggaagcatactagctccctgaaggtggctaacgagcccgtgctggcgttcacgcaggggtctccagagagagatgcgcttcagaaggcactgaaggaccttaaaggcagaatggaagccattccctgtgtggttggtgacgaagaagtgtggacctccgacgtccagtatcaggtgagttcgctgctgaataaggcgatcgaagctgctctagccgcccgtaaagagtgggacctgaaacccatcgctgaccgcgcccagattttcttgaaagcagcagatatgctcagcggcccccggcgtgctgagattctcgcaaagaccatggtggggcaggggaagacagtaatccaagctgagattgatgccgccgccgagcttatagatttctttaggtttaatgcgaagtatgccgtcgaactagaaggccagcagccaatttctgttcctccgagtaccaatagcactgtgtataggggcctggagggttttgtggccgcaattagcccatttaatttcacagctatcggaggaaacttagcgggcgctcccgcgctcatgtag

SEQ ID NO: 178628 - DNA, 1692 bp, Artificial Sequence
  Description of Artificial Sequence: Synthetic coding sequence
atgctgctgcccgcccccgccctgcggcgggccctgctgagccggccctggactggcgcgggcctgcggtggaaacacaccagtagtttgaaagtagccaacgaacccgtgctggcatttacccagggatccccagagagggatgcactgcaaaaggcactcaaagatcttaaaggccgtatggaggccattccatgtgtggtaggcgacgaggaggtatggacctcagacgttcagtatcaagtgtcccccttcaatcacgggcacaaggtggctaaattttgttatgccgataaatcccttctcaataaagcaatcgaagcagctctcgctgcccgcaaggaatgggacttaaagcccatcgctgacagggcacagatcttccttaaggccgccgatatgctgtcgggccctcggcgagccgagatccttgccaagaccatggtcgggcaggggaagaccgttatccaagcagagatagacgccgcagctgaactcatcgacttctttagattcaatgctaaatatgcagtcgagctcgagggccagcagcccatcagcgtgccgccttccacaaacagcactgtgtacagaggcctggaggggtttgttgccgcgattagccctttcaatttcactgccatcggcggcaatttggccggggcccccgccctcatgggaaatgttgtactgtggaagcctagtgacactgcgatgctggctagttacgcagtgtataggatcctgagagaggctgggctcccacctaacatcatccagttcgtgccagcagacgggccactgttcggtgataccgtgaccagttcagaacatctctgtggcataaactttacggggagcgttcccacctttaagcacctgtggaaacaggtggcccaaaacttggacagatttcacactttcccgcgcttggccggggaatgcgggggcaagaatttccactttgtgcaccggtccgcggacgtggaatcggttgtgtctgggacacttcgctccgcttttgagtacggagggcagaaatgtagtgcatgcagcaggctatatgtccctcactctctttggcctcagatcaaaggtcggttgctggaggagcactcacgcataaaagttggtgatcctgccgaggactttgggactttcttttccgccgtgatcgacgcaaagtcctttgcccgcattaaaaagtggcttgaacatgcccgttcctcaccgtccttgacaatcctggccggcggtaaatgcgatgactctgtgggctattttgtggaaccatgtatcgtggagtccaaggatccacaggagcctataatgaaggaggaaatattcggaccagtgctctctgtttatgtgtatcccgacgacaaatacaaagaaacactacaattagtggatagcaccacctcctatggacttacgggggccgtcttctcccaggataaggacgtggtgcaggaagcaactaaggttctgcggaacgccgcagggaatttctacattaacgacaaatcgactggcagtatcgtaggtcagcagcccttcggcggtgccagggcatctggcaccaacgataagcctggggggcctcactacatcttgcggtggaccagcccccaggtgatcaaggagacccacaagcccctgggggactggtcttatgcatacatgcaatag

SEQ ID NO: 178629 - DNA, 645 bp, Artificial Sequence
  Description of Artificial Sequence: Synthetic coding sequence
atgctgctgcccgcccccgccctgcggcgggccctgctgagccggccttggactggtgccggccttcggtggaaacacacaagctcgttaaaagtcgcaaatgagcctgttctcgccttcactcaggggtcgcccgaaagagacgccctgcagaaggcacttaaggacctgaaaggcaggatggaggctataccctgcgtggttggagacgaggaagtgtggacctccgacgtgcagtatcaggtctccagcctcctgaataaggcgattgaggctgctttggctgccagaaaggaatgggacttgaaacctattgccgatcgcgcccagatatttcttaaggcagccgatatgttaagtggacctcgcagggctgagatactcgcaaaaactatggtaggtcaaggaaagactgttattcaggcggagatcgacgccgctgccgaactcattgattttttccgctttaacgcaaaatatgccgtcgaactcgagggtcagcagccaatctctgtcccgccgtccaccaacagtacagtgtatcgagggctggaagggtttgtggccgccatttcaccctttaacttcacagccatcggcggcaacttggcaggagcccccgcactgatggttaggtgtggatag

SEQ ID NO: 178630 - DNA, 462 bp, Artificial Sequence
  Description of Artificial Sequence: Synthetic coding sequence
aacaaggccatcgaggccgccctggccgcccggaaggagtgggacctaaaaccaattgcagaccgggctcagattttcctgaaagctgccgacatgctctctggcccccgaagggccgagatcctggctaagactatggtgggtcaaggaaaaacagtaatacaggctgagatcgacgctgccgctgaattaatcgatttttttagatttaacgcgaaatacgccgttgagctcgaggggcagcagcctatttctgtgcctccctcaactaatagcacagtgtatcggggtttggagggtttcgtggcggcaatttcgcccttcaacttcaccgctattggcgggaatcttgccggggccccagccttgatgctccgcgagggcgtggtgaccttgccactgtgccagatgacaaaacttcgccacactgccgtgacgtacctcgccagactctccgattag

SEQ ID NO: 178631 - DNA, 1512 bp, Artificial Sequence
  Description of Artificial Sequence: Synthetic coding sequence
atggaggccatcccctgcgtggtgggcgacgaggaggtgtggaccagcgacgtgcaataccaggtcagccctttcaatcatggacataaggtggccaagttctgttatgctgacaagtcacttctgaacaaggcaatcgaggccgctctggccgcaaggaaagagtgggatctaaagcctattgcagacagggcccaaatttttctgaaggctgccgacatgctgtctggcccacgacgggccgagattcttgccaagacaatggtgggccaaggtaaaaccgttattcaagctgagattgacgctgctgccgaactgattgactttttccgctttaatgctaagtatgctgtggagctcgaaggtcagcagccgatatccgtcccgccctctacaaactccaccgtttacaggggcctcgagggatttgtagccgcaatctctccatttaactttaccgccatcggtggaaacctggccggcgcgccagccctcatgggaaatgtcgtcctgtggaagccctctgacaccgcaatgctggcatcctacgcagtgtaccgcatcctgagggaggccgggctgccaccaaatattatacagtttgtaccagccgacggaccattgtttggagatacagtgacatcaagtgagcacctgtgtggaatcaactttaccggcagcgtacctacgttcaagcatctgtggaagcaggtcgcacagaatctggacaggtttcatacctttccgagactcgcaggggagtgcggaggcaagaatttccattttgtccacagaagcgctgatgtggagtcagtggtcagtggaacccttaggtccgctttcgagtacggtggccaaaagtgttctgcctgctccagattatatgtgccccactccttgtggcctcagattaaagggcgcctcctagaggagcatagccgcataaaggtgggcgaccctgccgaggatttcggcacattcttcagcgccgtgattgatgctaaaagtttcgcacgaattaagaagtggctggagcacgcccgctcttcccccagcttgactatattggctggagggaaatgcgacgacagcgttggatatttcgtcgagccctgtatcgttgagtctaaggatccacaggagcctatcatgaaggaggaaatctttggccccgtgctgtccgtgtatgtttatccggacgataagtataaggagaccttgcagctcgtagactctaccacatcatatggattgaccggcgccgtgttttctcaagacaaggacgtggtgcaggaggccaccaaagttttaaggaacgccgccgggaacttctatatcaacgataagtctactgggagtatcgtcggtcagcagccttttggcggagctcgggcttccggaaccaatgacaaacccggcggcccgcattatattttaagatggacctccccacaggtgattaaggagactcataagccactcggcgattggtcctacgcgtatatgcaatag

SEQ ID NO: 178632 - DNA, 1539 bp, Artificial Sequence
  Description of Artificial Sequence: Synthetic coding sequence
atgctgctgcccgcccccgccctgcggcgggccctgctgagccggccctggacaggcgcggggctgcgttggaaacacacctcaagccttaaagttgctaacgagcctgtgttggccttcacacagggatcgcccgagagagacgccctgcagaaagcactcaaggatcttaagggccggatggaggccataccgtgcgtggtgggggatgaggaagtctggaccagtgacgtgcagtaccaggtgtcaccctttaaccacggacataaggtcgctaagttctgctacgcggataagagcttgctcaataaggccattgaggctgcactggcagctaggaaggaatgggacctgaaaccaatcgccgatcgagcccagatctttctcaaagccgcagacatgctctccgggccaagaagagcagagattctggccaagaccatggtcggtcaagggaagacagttatccaagctgagattgacgcggccgcagagttgatcgatttctttagatttaatgccaagtatgccgtagagctggaaggtcagcagccaatcagcgtgcccccctccacgaatagcaccgtgtaccgcggactagaggggttcgtcgccgcgatttcaccatttaactttaccgccatcggaggcaatcttgccggtgccccagcccttatggggaatgttgtcctttggaaaccctccgacactgccatgctcgcctcatacgcggtttaccgaatactgagagaagccggtttgccaccaaatatcatacagttcgtgcccgccgacgggccactgtttggagacaccgtgacgagctcagagcacctgtgcggcatcaactttacagggagtgtgcctacatttaagcatctgtggaaacaagtagcccaaaatctggaccgcttccatactttcccccgtcttgcaggggagtgcggggggaagaattttcatttcgtgcatcgatcggccgacgtggagtcagtagtttccggtacactgcgaagtgccttcgagtatggcggccaaaaatgctccgcttgcagcagactgtatgtcccgcacagtctgtggccccagattaagggccgtcttttggaggaacactcacgtataaaagtcggagaccccgccgaagatttcggaactttcttcagcgctgtcattgacgccaaggaaatctttggtccagtcttgtccgtgtacgtgtatccagacgataaatacaaagagacgctacagttggtggattctacaacgagctatgggctgacaggtgccgtcttttcacaggataaggacgtggtccaggaggccaccaaggtattgcgaaatgcagccggtaacttttatatcaacgacaagtcgaccggctccatagtaggacaacagccatttggtggcgcccgcgcctcaggcactaatgacaaaccaggaggcccccactatattctgagatggacatctccccaggtgataaaagaaacccacaaacctttaggcgattggtcttacgcctatatgcaatag

SEQ ID NO: 178633 - DNA, 1647 bp, Artificial Sequence
  Description of Artificial Sequence: Synthetic coding sequence
atggccacctgcatctggctgcggagctgcggcgcccggcggctgggctctacctttcccgggtgtagactgcgacccagggcaggtggattagtgcctgcctcggggccagcgcctggaccagctcagctcaggtgttacgcagggcgattagcagggttatccgccgcactcttaaggacggactcattcgttggaggaaggtggctcccagccgccgccacgtttcccgtacaggaccctgcttccggtgctgccttgggaatggttgctgattgcggcgtccgggaggccagggcggcagttagggcggcctatgaggctttctgccgatggagagaagtcagcgccaaagaaagaagctccctgctgcgcaagtggtataaccttatgatacaaaataaggatgatctggcacgtatcatcactgccgagtctggaaaacccctgaaagaagcccacggcgagattctgtattctgccttcttcctcgagtggttcagtgaagaggccagacgcgtatacggagatataatccatacgcctgcgaaagaccgacgggcccttgtgttgaagcaacccatcggcgtggccgcagttatcacaccatggaatttcccaagcgcaatgattacaaggaaggttggagctgcactagccgcgggatgtaccgtcgtagttaaaccagcagaggacaccccattttctgccttggctctcgcggaggtcaaccagggtttcttgcttgaccttgaccccctccttctagcttcccaggcaggcatcccttcaggcgtgtacaacgtcattccctgcagtcggaagaatgctaaggaagtgggcgaggcaatttgtaccgacccgctggtctctaaaatcagttttaccggatccacgactaccggcaagatcctccttcaccatgcggctaacagtgtaaagagggtctcaatggagttgggcggcctcgcgccatttattgttttcgattcagccaatgtcgatcaggcagtggcaggagccatggcctctaaattccgtaatacgggccaaacttgtgtctgttccaaccagtttcttgttcagcgcgggatccatgacgcatttgtgaaggcatttgctgaagcaatgaagaaaaatctccgcgtcggaaatgggtttgaagaaggaacgacccaagggccactgatcaacgagaaggctgtcgagaaggttgagaaacaggttaatgacgcagtgagcaaaggagccaccgtcgtgacagggggtaagcgtcaccagctcgggaagaatttcttcgaacccacactcctgtgcaatgtgactcaagacatgctttgtacccatgaggaaacctttggcccactggcccccgtcatcaagttcgatacagaggaggaggccatagccatagctaacgcggctgatgtcggcctagccgggtacttttattcccaagaccctgcccaaatctggcgtgtggccgaacagctggaagtgggcatggtgggcgttaacgaggggctcatttcatctgtcgaatgtcccttcggaggcgtgaaacagagcggcctggggagagaaggaagcaaatacgggattgacgagtatctggagctgaagtacgtgtgttacgggggcctgtag

SEQ ID NO: 178634 - DNA, 1608 bp, Artificial Sequence
  Description of Artificial Sequence: Synthetic coding sequence
atggccacctgcatctggctgcggagctgcggcgcccggcggctgggatcaacattccctgggtgtagactgaggccgcgggccgggggcctcgttccagcttcaggaccagcacccggacctgcacagctgcgatgttatgcagggaggctggcaggactgtccgctgccctgctccggacagactccttcgtagggggccgctggctgccggctgccgccacctttcccgtgcaggaccccgcctctggcgccgctctggggatggtggccgactgtggtgtgagagaggcccgggccgcagtgagggccgcatacgaggccttctgcaggtggcgagaggtctcagcaaaggagcggtccagcctcctaaggaaatggtataacctcatgattcagaacaaagacgatctcgctagaataataaccgccgagtcaggaaaacctctgaaagaagcccacggcgagattctgtactcagctttctttctggaatggttttcggaggaagctcgacgggtgtatggggatatcatccatacacccgcaaaagacaggagggcactggtactcaaacaaccaataggcgtggccgccgtgatcacaccatggaatttcccctccgctatgattacacgcaaagtcggggctgcgttggctgcgggctgtacggttgtggtgaagcccgccgaagacacacccttctccgcactcgcactggctgaactggccagtcaggcagggatccccagcggtgtctataacgtcattccctgtagcaggaaaaacgccaaggaggtaggcgaagccatttgcaccgacccactggtcagtaagataagcttcacgggatccacaacaaccgggaagatactgttacatcacgccgccaactctgtgaaacgcgtgtctatggagttagggggcctggctccattcatcgtgttcgattcggccaatgtcgaccaggcagttgcaggcgcaatggccagtaagtttagaaataccggccagacttgcgtgtgctctaaccagttcttagtgcaacgcggaattcacgacgcattcgtcaaggccttcgcggaagcgatgaaaaagaacctcagggtcggtaatggttttgaagagggcacaacacaagggcctctgatcaacgaaaaggcagtggaaaaggtagaaaaacaagttaacgacgcagtgagtaaaggagccaccgtggtgactggcggaaagagacatcaattggggaagaacttcttcgagcccactttgttgtgcaacgtgacacaggatatgttgtgtacccatgaagaaacttttgggcctcttgcaccagtcataaagttcgacaccgaggaggaggctattgccatcgctaacgccgctgacgtgggactcgcaggttacttctactcccaggatcccgctcagatttggcgggttgctgagcagctcgaagtggggatggtgggcgtcaatgagggactgatcagctctgtggagtgcccttttggtggggtgaagcagtccggactcggccgagaaggttctaaatacggaatcgacgagtaccttgaactgaaatacgtctgctatggaggtctatag

SEQ ID NO: 178635 - DNA, 1344 bp, Artificial Sequence
  Description of Artificial Sequence: Synthetic coding sequence
atggtggccgactgcggcgtgcgggaggcccgggccgccgtgcgggccgcatatgaggccttctgtcgttggcgggaggtctccgcaaaggagagatcctccctactccggaagtggtacaaccttatgatacagaataaggatgaccttgccaggataattactgccgaaagtggaaagcccctcaaagaggcgcacggagagatcttgtactcggccttctttctggagtggttttccgaggaggcgaggagggtatatggcgacattatccacacccccgccaaggaccgccgggcactggttctaaaacagcccatcggggtggccgccgtgatcaccccatggaacttcccgagcgcgatgattactcgtaaagtgggggccgccttggccgcaggctgtactgttgtggtcaagccagcggaagataccccattcagtgctctcgcgttggccgagctcgcatcacaagcagggatccccagcggtgtctacaacgttatcccatgtagcaggaagaatgctaaagaagtgggggaggctatatgtaccgatcctttagtcagcaaaatttcctttacagggagtacaacgaccgggaagattctcctgcaccacgcggcaaacagtgtcaaacgcgtgtctatggagctcggaggtctggccccttttatcgtgtttgattcagccaacgtggatcaggccgttgccggagccatggccagtaaattccgaaatacaggccagacatgtgtctgctctaatcagtttctggtacaaagaggaatacatgacgcattcgtcaaggctttcgcagaggcaatgaaaaagaacttgagagttggcaacggcttcgaagagggtaccacccaagggccactcattaatgagaaagcagtcgagaaggtggagaaacaagtcaacgacgctgtatctaaaggggcaaccgttgtgacagggggtaaacgccaccagctgggtaagaacttctttgagcctacattactctgtaatgttacacaggacatgctctgcacccatgaagagacgttcggacctctggccccggtgattaagttcgacaccgaggaagaggccattgctattgccaatgcggctgacgtgggactggccggatatttctattctcaagatccagcacagatctggagggtggccgaacagcttgaggtcggaatggttggtgtgaacgagggtctaataagctccgtggagtgcccattcggtggtgtcaaacagagtggtctagggcgtgagggttccaagtacggcatcgacgaatacctggagctgaaatacgtctgctacggcggactgtag

SEQ ID NO: 178636 - DNA, 1608 bp, Artificial Sequence
  Description of Artificial Sequence: Synthetic coding sequence
atggccgccctgctggccgccgccgccgtgcgggcccggatcctgcaggtgagttctaaggtgaaaagctcacccacctggtatagtgcttcctcgttctcctcatccgtgcccaccgttaaactcttcattgggggtaaattcgtggaatcaaagagtgataagtggattgatatacacaatcctgctacgaacgaagtgatcggtagagtgccgcaggcaactaaagctgagatggacgccgcaatcgcctcttgcaaacgggcatttccagcgtgggcagacacgagcgtcctttcacgacagcaggtgctgctgcgataccagcagctgattaaggagaatctgaaagagatcgcaaagctgataaccctggaacaggggaagacactggcagatgctgagggcgacgtgttcagggggctgcaagtcgttgaacatgcctgcagtgtgacctctctgatgatgggtgaaactatgccctccataaccaaggatatggatttgtatagctacagactgcccctgggcgtatgcgcaggtatcgcaccttttaatttccccgctatgattcctctttggatgtttcctatggcgatggtgtgtggaaacactttcctgatgaagccatctgagagggtcccaggggctacaatgttgctggccaaacttctgcaggactcaggagcacctgatggaaccctcaacattatccacggtcagcacgaagccgttaactttatttgtgaccaccccgacatcaaggccatatcttttgtgggctcgaataaagcaggggagtatattttcgagcggggttcacgccatggcaaaagggtgcaggccaatatgggcgctaaaaatcacggcgtcgtcatgcctgacgcaaacaaggaaaacaccctcaatcaactcgtaggcgccgcatttggggcagcaggacagagatgcatggctctgagcaccgctgtcttagttggcgaggccaagaaatggctcccggaactggtcgaacacgccaagaatctgagagttaatgccggagaccagcccggagcagatttgggaccgttgattacgccccaggcaaaggaacgggtctgcaatctgatagatagcggaaccaaagagggtgcctcaatcctgctggatggtaggaagatcaaagtgaaagggtacgaaaatggaaattttgtggggcccacaatcatctctaacgtaaagcccaatatgacgtgttacaaagaagaaatcttcggccctgttcttgtagtgttggagacagagaccttggacgaggccatccaaatagtgaacaataacccgtacggaaacgggacggccatcttcaccacaaacggagctaccgcacgaaaatatgcacacttagtggacgttggacaggtgggcgtgaacgttcctatcccggtcccattgccaatgtttagcttcaccggctcacggagctccttcaggggcgatacaaatttttacgggaaacaagggatccagttttatacccagctgaagacaatcactagccagtggaaggaggaggacgccactttatcctcccccgccgtcgtaatgcccactatggggaggtag

SEQ ID NO: 178637 - DNA, 1620 bp, Artificial Sequence
  Description of Artificial Sequence: Synthetic coding sequence
atgtggcggctgccccgggccctgtgcgtgcacgccgccaagaccagtaaactgagcggtccatggagtagacctgcagcatttatgtccactttattgatcaatcaaccccagtacgcctggttaaaggaactcgggctgcgcgaggaaaatgagggggtgtacaatggaagctggggtggacgcggggaagtgataaccacctactgcccagccaataatgagcctatagcacgtgtgagacaggcttctgtggccgactacgaggagactgtgaaaaaagctagggaggcttggaagatatgggcagacattccagccccaaagcggggtgagatcgtgaggcagataggcgacgctttgagagaaaaaatccaagtcctggggtctttggtgagccttgaaatgggcaaaattctggtagaaggagtcggtgaagttcaagagtatgtggacatctgcgactatgcagtaggtctcagcagaatgatcggcgggccaatcctgccttctgagcgatccggtcatgctcttatcgagcaatggaatcctgtcggcctggttggcattattacagcattcaacttccccgtggctgtgtatggatggaataatgccatagctatgatttgcggaaatgtttgcctttggaagggggcgcctacaacgagcctaatctcggtggcagttactaaaataatcgctaaagttctagaggacaacaagctgcctggggcaatctgctcacttacgtgtgggggggccgatatcggtaccgccatggctaaggacgagcgcgtgaacctgttaagttttacaggttccacccaggtggggaagcaggtcggactgatggtgcaggaaaggttcggaaggtccctgctggaactgggaggcaataacgccatcatcgcatttgaagatgcagatctctctctggtcgtcccgagcgctctgttcgctgccgtcggcaccgcgggacagaggtgtacaactgcccgtagactgtttatacatgaaagcatccatgacgaagtggtcaaccgactcaagaaagcgtatgcccagatccgggtgggtaacccctgggacccaaacgtgttatatggcccactccatactaagcaggctgtatccatgttccttggagctgttgaagaggccaagaaagaaggcggtactgtagtctacgggggaaaagttatggatcggccgggcaattacgttgagccaaccattgtcacggggctcggacatgacgccagcatcgcacacactgaaaccttcgcaccaatcttatatgttttcaaatttaaaaacgaggaagaagtcttcgcctggaataacgaggtcaagcaaggcctgagctcctcgatcttcacaaaagacctcggacggatctttaggtggctcggacctaaggggtctgattgtgggatagtgaatgtgaatataccaaccagcggcgcggaaattggaggagccttcggcggcgaaaaacacacaggtggcgggagagagtccggcagtgacgcctggaaacagtacatgcgccgctctacttgtaccatcaattacagcaaggatttaccattagcccaaggcattaagttccaatag

SEQ ID NO: 178638 - DNA, 1044 bp, Artificial Sequence
  Description of Artificial Sequence: Synthetic coding sequence
atgtggcggctgccccgggccctgtgcgtgcacgccgccaagacctctaaattgagtggaccttggtcaaggcccgctgcctttatgtcaactagtctgatctctgtggcggtgacaaagataatcgccaaggtcctggaagacaacaaattaccgggcgcgatttgctccctcacgtgtgggggggcagatatcggcacagctatggccaaggacgaacgagtaaaccttctgtcttttacggggagtacccaggttggtaaacaggtcggcctcatggttcaggagagattcgggaggtcactgctggagttgggcgggaacaacgctatcattgcgttcgaagacgccgacttgtccctcgtggtacccagcgccctgttcgccgccgtgggaacagccggccaacgctgtaccacagctaggcggctttttattcacgagtctattcacgacgaggtggtgaaccgacttaagaaggcttatgctcaaataagagtgggcaacccgtgggatccgaacgtactgtacggcccactacataccaagcaggcagtgagcatgtttttgggggctgtagaggaagccaagaaagaagggggtacagtggtatacggcggaaaagtgatggatcggccagggaattacgtggagccaaccattgtgactggcctcggacatgatgcctccatagcccacactgaaactttcgcaccaattttgtatgtgtttaaattcaagaacgaagaagaggtgttcgcatggaataacgaggttaaacagggactgagttcttccatcttcacgaaagaccttggtcggatctttaggtggctcggacccaaagggagcgattgtgggatcgtgaacgttaatatacccacctccggcgctgaaatcggcggcgctttcggtggagaaaaacataccggcggaggacgagagtccggaagcgatgcgtggaaacagtatatgaggagaagtacgtgcactattaattacagcaaggaccttcccctggcacaaggcattaaattccagtag

SEQ ID NO: 178639 - DNA, 1509 bp, Artificial Sequence
  Description of Artificial Sequence: Synthetic coding sequence
atgggcagccccggccggggcgccggcctgtacttcagcagcagccagggtctcggtctcataccatcgcctggactgagcatgtggagacttccaagagccctctgtgtgcatgccgcaaaaacatccaagctgagcggaccttggagccgtcccgcagcgttcatgtcaacattactgattaatcagccccagtatgcctggttgaaagaactgggcctcagggaggagaatgagggtgtatacaatggcagctggggaggcaggggcgaagtgatcaccacatattgcccggcgaacaacgagcccatcgctcgcgtccgccaagcatccgtcgccgattatgaggagaccgtcaaaaaggctcgcgaagcttggaagatttgggctgacattcccgccccaaaacgaggcgaaatcgtccggcagattggggatgcgctgcgggagaagattcaagttcttggctctcttgtttccttagaaatgggaaaaatattagtggagggggtgggggaggtacaggagtacgtcgacatttgcgattatgccgtaggcctgtcccggatgattggcggccctatccttcctagcgagcgctcaggacacgcactgattgagcagtggaatcccgttgggctcgtggggattattaccgcatttaacttccccgttgccgtgtatggttggaacaacgcaattgcaatgatctgtggcaacgtctgtctgtggaagggagccccaaccacttctttgattagtgtggccgtaacaaagatcatcgctaaggtgctcgaagacaacaaactgcctggcgccatatgtagcctcacatgcgggggcgccgacataggcactgccatggctaaggatgagcgggtgaaccttttaagttttactggctctacgcaggtaggaaagcaagtagggttgatggtccaggagcgctttgggcggtcactgctggagttgggtggaaataatgctatcatagcttttgaggacgccgacctttccttggtggtcccatcagcactgttcgcggccgtcgggacagctggacagaggtgtactaccgctcgacgtttagtaatggatcgccctgggaactacgtcgagcccaccattgtcaccggactaggccatgacgcaagcatagcacatactgagacctttgctccaattctgtacgtcttcaagtttaagaacgaggaggaagtgttcgcttggaacaacgaggtcaagcagggcctgtcgagcagcatcttcaccaaggacctggggcggatttttcgatggttggggccgaagggctccgattgcgggattgtaaacgtcaatatccctacgtccggcgctgagataggcggcgccttcggcggcgaaaaacatacaggcgggggaagggagtcaggttccgacgcttggaaacagtacatgcggcggtctacatgcaccatcaactactctaaggacctgccccttgcccagggaataaaatttcagtag

SEQ ID NO: 178640 - DNA, 1314 bp, Artificial Sequence
  Description of Artificial Sequence: Synthetic coding sequence
atggccggcaccaacgccctgctgatgctggagaacttcatcgacggcaagttcctcccttgttcatcatatattgactcttacgaccccagtaccggggaagtctattgtcgtgtccctaattccggaaaggatgagatagaggcagccgtcaaggccgcacgagaagcattccccagttggtcttctcgcagcccacaagaacgcagtagggtgcttaaccaggtcgccgaccttctggaacagtccctggaagagtttgcacaagctgaatcaaaggatcagggaaaaaccctcgcactggctagaacaatggatattccccggtccgtccagaattttaggttctttgccagcagctccctgcaccatactagtgaatgcacgcagatggaccaccttggttgcatgcattataccgtgagagctccagtcggtgtcggcgtcccccctggcgtggtgaatatcgtattcggcactggtcccagagtcggggaggctttagtgtcccatcctgaagtacctctgatcagcttcaccggctcgcaaccgacagcagaaagaatcactcaattaagcgctccacactgcaagaagttatcacttgaacttggcggcaagaatcctgcaatcatctttgaggatgctaaccttgatgaatgcattcctgcaaccgtccggagctccttcgccaaccagggggagatttgtctttgtacaagccggatctttgtgcagaagagcatatattccgaattcttgaagagatttgtggaagctacccggaagtggaaggtggggatcccatcggatcctttggtcagcatcggcgcactaatcagcaaggctcatttagagaaggtgcggagctacgttaaaagggcactggccgaaggagctcagatttggtgcggagagggtgtggacaagctgtccctgccggccagaaaccaggcaggttactttatgctcccgacagtgatcacagatatcaaagacgaatcatgctgcatgacagaggagatatttggaccagtgacctgcgtggtgccgttcgactccgaagaggaggtcatcgagcgggctaacaatgttaagtacggattggcagcaaccgtgtggtcatcaaacgtgggcagggttcaccgcgtggcgaagaaattgcagagtgggctggtgtggaccaactgttggcttatacgggaacttaatcttccctttggaggcatgaaatcgtcagggattggaagggaaggcgctaaggacagttatgattttttcactgagattaagactatcactgttaagcactag

SEQ ID NO: 178641 - DNA, 1464 bp, Artificial Sequence
  Description of Artificial Sequence: Synthetic coding sequence
atggccggcaccaacgccctgctgatgctggagaacttcatcgacgggaagttcctgccttgctccagctacatcgacagctacgacccttcaacaggcgaagtatattgcagggttcccaactcaggcaaggacgagatcgaagctgcagtgaaggctgcacgcgaagcgttcccaagttggtcctctaggtccccacaggaaagatcccgcgtgcttaatcaggtggcagatctgctcgagcagagtctagaagagtttgctcaggccgagtcaaaggaccaggggaagactctcgctttggctagaactatggatatcccccgaagcgtgcagaatttccgcttttttgcttcttcttcactgcaccatacatcagaatgtactcagatggaccatctagggtgtatgcactatacggtgagagcccccgtgggtgttgctggtctcatatctccttggaaccttcccctgtacctcttaacatggaaaatcgcccctgccatggcggctggcaacaccgtgattgccaagccaagtgagctgaccagtgtgacagcatggatgctctgcaagctgttggataaggccggagtgcctccaggggtggtgaacattgtttttgggactggtcctagagtaggagaagccttggtttcccacccagaggttccgcttatctccttcactggctcccagccaacagcggagcggattacgcagttgtctgccccccactgtaagaagctgagcctcgaattaggagggaagaaccctgccatcatttttgaggatgccaatctggatgagtgtattcctgccacagtgcgatcctcattcgccaaccaaggcgagatttgcctgtgcacatctcgcatctttgttcaaaagagtatctactccgaattcctcaaacggttcgtggaggcaacacgaaagtggaaggtagggatcccttctgacccactcgtgtccatcggtgccctgattagtaaagcacatttagaaaaggttcggagctacgttaaacgggcactcgcagagggcgcccaaatctggtgcggagagggagtcgacaagctgtctttgcccgcccgtaaccaggccggctattttatgctgccaaccgtgataacggacattaaagatgaatcatgttgtatgaccgaggagatttttgggcccgtgacttgcgtagtgccattcgattcggaggaagaggtgatcgagcgcgcgaataacgtgaaatacggcctggcagccaccgtttggagcagcaatgttggacgcgtccatcgggtggctaagaagctgcagagcgggctggtgtggacaaactgttggctgattcgcgagctgaacttgccctttgggggcatgaagagcagcgggattggccgggagggagctaaggactcatatgacttctttacagagattaaaacaatcacagtgaagcactag

SEQ ID NO: 178642 - DNA, 1302 bp, Artificial Sequence
  Description of Artificial Sequence: Synthetic coding sequence
atggccggcaccaacgccctgctgatgctggagaacttcatcgacggcaaattcctgccctgctcctcatacatcgactcctacgatccaagcactggagaggtttactgcagagtgccaaatagtggcaaggacgagattgaggccgccgtgaaggctgcacgagaggcgtttcctagttggtccagtagaagtcctcaagaaaggtctcgagttctgaaccaggtggctgatcttctggagcagtccctcgaggaattcgctcaagccgagtcgaaagatcaggggaaaacactggccctggctagaactatggatattccccggtctgtgcagaattttagattttttgcttctagctctttgcaccatacgagcgagtgtactcagatggatcacctgggttgtatgcactacacggtacgggcccctgtcggcgtcgctggactgataagtccctggaatttacccctctacctcttaacatggaagattgcacccgcaatggcagcagggaacactgtcattgctaagccatctgagctaacatccgtgacagcttggatgctctgtaaactcttggataaagctggagtgcctccaggagtggttaacattgttttcggcaccggaccgcgggtaggagaggccctcgtctctcaccccgaggtgccactcatcagttttaccggatcccagcctaccgcggaacggattacacagctctccgcacctcattgcaaaaaactgagcctggagcttggtggcaagaatccggcgataattttcgaggatgccaaccttgacgagtgcatcccagcaacggtgagatcttcatttgctaaccaagtaagatcatacgtcaaaagggcgctggccgaaggggcccagatttggtgtggagagggagtggataaactttcgttgccagcacggaaccaggcaggatactttatgcttccaaccgtgatcacggacattaaggatgagtcgtgttgcatgaccgaagaaatattcggccctgtcacttgcgtggtgcccttcgattcagaggaagaagttattgaaagagccaacaacgtcaagtacggcctggccgcgactgtgtggtccagtaacgttggaagggtgcacagagtcgcaaaaaagctacaatcaggccttgtgtggacgaattgctggcttatccgcgagctgaatctaccctttgggggaatgaaaagcagtgggatcggtagagagggggccaaggacagctacgactttttcactgagatcaagaccatcaccgttaagcactag

SEQ ID NO: 178643 - DNA, 1557 bp, Artificial Sequence
  Description of Artificial Sequence: Synthetic coding sequence
atgttcctgcgggccggcctggccgccctgagccccctgctgcggtcgctgcgtccttctccagtggcggccatgagcacaggaacctttgttgtttcccagcccctgaattatcggggaggcgcccgagtggaaccagctgatgcctcaggcacggaaaaggcttttgagccagccaccggccgtgtgatcgcaactttcacgtgctcgggagagaaagaggtcaatctcgccgttcagaacgcaaaggcagcattcaagatctggtctcagaagtctggcatggaacggtgtagaatattactggaggctgccaggataatcagggagcgagaggatgaaatcgctaccatggaatgtattaataatggcaagtccatctttgaagctcgcctggacatagacatctcatggcagtgcctggagtactacgccggattggccgccagtatggcaggagaacacattcaactgccaggcgggagtttcgggtatacccggcgggaacccttgggcgtttgcgttggcattggagcctggaactatcccttccaaattgcctcttggaagtcagctcctgccctcgcgtgtggaaatgcaatggtcttcaaaccatcccccttcacgcccgtgagcgcactgttactggcagagatctattccgaggctggcgtgcctcctggcctctttaacgtggtccagggaggagctgcgacaggccaatttttatgtcagcatcccgatgtcgccaaggttagcttcaccggctccgttcccacggggatgaaaatcatggagatgagcgctaaagggattaagcccgtcaccctcgagttgggcggaaaatcgcctcttattatcttctccgactgcgacatgaataacgccgtcaagggggccctgatggctaatttcctgacacaaggccaggtttgttgcaatggaacccgagtgtttgttcaaaaggagatcctagataagtttacggaggaagtggttaagcaaacacaacggatcaaaataggggatccccttctggaagatacccgcatgggacctctgattaaccggccacatttagaacgtgtattagggtttgttaaagtagcaaaggagcaaggggccaaagtcctgtgcggaggagacatttatgtccctgaagaccccaaattgaaggatggctactacatgcggccttgtgtgttgactaattgtcgggacgatatgacttgtgttaaagaagagatatttggtcctgttatgtctattctgtcgtttgacacagaagctgaagttcttgagcgcgccaacgacaccacatttgggcttgccgctggcgtttttacacgcgacatacagcgggcgcatcgagtcgttgcagagctccaagcaggcacatgcttcataaataattacaacgtcagcccagtggagctgccgttcggaggctacaagaaaagcgggtttggccgggaaaacggcagggtgacaattgagtattattcccagctcaagaccgtgtgcgttgagatgggagatgtagaaagcgcattctag

SEQ ID NO: 178644 - DNA, 1275 bp, Artificial Sequence
  Description of Artificial Sequence: Synthetic coding sequence
atggagcggtgccggatcctgctggaggccgcccggatcatccgggagcgggaggatgagattgccactatggaatgcattaataatgggaagagcatcttcgaggccaggctcgacatcgacatctcctggcagtgcctggagtactatgctggtctcgccgcctcgatggccggagaacacatccaactccccggcggtagtttcggatatacgcgccgtgaaccgttaggagtgtgtgtcggcatcggagcatggaactatccatttcagatcgcctcatggaagagtgccccagcgctggcctgcggaaatgctatggtctttaaaccgtctccttttacccctgtgtcagctcttctcctggctgagatatatagcgaggcaggagttccacccggattatttaacgtggtccagggtggcgccgctactgggcagtttctgtgtcagcatcctgacgtggccaaggtgtcattcaccgggagtgttccaaccggtatgaagattatggagatgagcgccaaagggattaaaccggtcacactcgagttgggtggaaaatcccccctgattatattctcagactgtgatatgaacaacgccgtgaagggggccttaatggccaacttccttactcagggacaggtttgctgtaacgggacaagagtttttgtgcagaaggagatcctcgacaaattcaccgaagaggtggtcaaacaaacccagaggattaagatcggtgacccccttctagaggataccagaatggggcccctcatcaacagacctcacctggagagagtcctgggattcgtaaaggtggccaaagaacagggcgccaaagtgctttgtgggggcgatatctacgtaccagaggacccaaaacttaaagacgggtactatatgcgaccgtgcgtccttactaactgcagagatgacatgacttgtgtaaaggaggagatcttcggacctgtcatgagcattctgtctttcgataccgaagctgaagtgctggagcgggccaacgatacgactttcggactggctgctggcgtctttacgcgcgacattcagagagcacacagagtggtcgcggaacttcaggctgggacttgttttatcaataattataacgtgtctccagtagagttgccttttggtgggtacaagaaaagtggattcgggagagagaatgggcgcgtaactatcgaatactacagtcagctgaaaacggtctgcgttgagatgggcgatgtggagagtgctttttag

SEQ ID NO: 178645 - DNA, 4017 bp, Artificial Sequence
  Description of Artificial Sequence: Synthetic coding sequence
atggaccgggccagcgagctgctgttctacgtgaacggccggaaggtcatcgagaagaatgtggaccccgagaccatgttactgccttaccttcgtaagaaactgagactgactggaacgaagtacgggtgcggcggtggcggatgcggtgcatgcactgtaatgatctcccggtataatcctatcaccaaaagaattcgacaccatccagctaacgcctgcctgatccctatctgtagcctgtacggcgctgccgtgacgacagtggaaggtatcggctccacccacacgaggatccacccggtccaggaacggatcgccaaatgccatggaacccagtgcgggttctgtacgcctgggatggtcatgtccatttacacattgctgcggaatcacccagaacccactcttgatcagctcaccgatgctctgggcggcaacctctgccgatgcaccggatatagacctatcatagatgcctgcaagactttctgcaagacgtcaggctgttgccagtccaaagagaatggagtctgctgtctcgaccaggggatcaatggcctccctgagttcgaagagggtagcaaaacatctccaaaactctttgccgaagaggagttcctgcctctcgatcccacccaggagctcattttccccccggagcttatgattatggctgaaaagcagtcacagagaaccagagtattcggctcagagcgaatgatgtggttcagccctgtaactctgaaagagctgctggaatttaaatttaaatatccccaggcccctgtgataatgggtaacacctcggttgggcccgaggtgaagttcaaaggggtctttcaccctgttatcatctctcccgatagaatcgaggaactatccgtcgtcaaccacgcctataatgggctcactttaggtgcagggctttctctggcacaggttaaagatatcctagccgacgtggtgcagaagctgccagaagaaaaaacacagatgtatcatgcgcttctgaagcatcttggaacgctcgcaggttcacagattagaaatatggcatctctcggcggacatattatcagtagacacccagatagcgacctcaaccctatcctggccgttggtaattgtaccctgaatttactgtccaaggaagggaagagacagattcccttaaacgagcagtttctgtcaaagtgtccaaacgccgacctaaagcctcaggagatcctggtctctgtgaacatcccttacagccgcaagtgggagtttgtcagcgcattccgccaggcgcagcgccaagagaatgccctcgccatcgtcaattccggtatgagagtgttctttggcgagggtgatggcataatccgcgagttgtgtataagctatggaggagtcggccccgccacaatatgcgccaaaaattcttgccaaaagctgatcggaaggcattggaacgagcagatgctggatatcgcctgccgtctcattttgaacgaggtgtccctgctgggatccgcccccggaggaaaagtggagtttaagcgaacgctaattattagttttttatttaagttctatctggaagttagtcagatactgaagaaaatggaccccgtgcattacccttcactggccgacaaatacgaatctgcactggaggacttacattccaagcaccactgctcaactctgaagtaccaaaacatagggccgaaacagcatccggaggaccctattggacacccgattatgcacctaagcggcgtcaagcacgcaactggcgaggccatctattgcgacgacatgccattggtggaccaggagttgtttctgacctttgtaacttctagtcgcgcccatgcaaagatcgtcagcattgacctttccgaggccctgagtatgccaggtgtggtcgatatcatgactgccgaacacctgagcgacgttaactctttctgtttcttcacagaggccgagaagtttttagctacagataaggtgttttgcgtgggacaactggtctgcgcagtgctcgctgactcagaggtacaggccaagagagccgcaaaacgggtaaagattgtgtatcaagatctggaaccccttattttaaccattgaagagtccattcagcataattcatcatttaaacctgaacgcaagctggaatatggaaatgtggacgaggcatttaaggtggtcgaccagatccttgagggggagattcacatgggcggtcaggagcacttttacatggaaacccagtcaatgctggtggtccctaaaggagaggaccaggaaatggatgtctacgtgagcacccaatttccaaaatatattcaggatattgtggcgtccacactaaaacttcctgccaataaggtcatgtgtcatgttagacgggttggcggggcattcgggggaaaagttctcaaaacaggcattattgctgccgtcactgctttcgccgccaataagcacggccgggccgtcaggtgcgttctagaaagaggagaagacatgctcattacaggcggaagacacccctatttgggcaaatacaaggccgggttcatgaacgacggccgcattctggctctcgacatggagcactactctaacgccggggcctccctggacgaatccctgtttgtgattgaaatgggtctgctcaaaatggacaacgcctacaagttcccaaacctgaggtgtcgaggttgggcatgtaggacaaacctgccatcaaatactgcctttcgtggattcggcttcccccaggccgccctgatcaccgaaagttgcattactgaggtcgccgctaaatgcggactgtctccagagaaggtgagaatcatcaatatgtataaggaaatcgatcagacaccttataagcaagaaattaacgctaagaatctgattcagtgttggcgagagtgcatggcaatgtcatcatattccttacggaaagtcgccgttgaaaagtttaacgcagagaactactggaaaaaaaaaggcttggcaatggtaccactcaagttcccggttggcctggggtcaagagcagcggggcaggcagcagctcttgttcacatatatctagatggaagtgtgttggtcactcacggcggaatcgagatgggacagggcgtgcataccaaaatgatccaggtagtaagcagagagctccgaatgccgatgtccaacgtgcaccttcgcggaacctccacggaaactgtgccaaatgcaaatataagcggtggaagtgtggtggccgacctcaatggcctggccgtaaaagacgcttgtcaaacactgctaaagcggttagagccaatcattagcaaaaatcctaaaggaacctggaaggactgggcccagaccgccttcgacgagagcattaacttgagcgcagttggctacttcagaggctatgagagtgatatgaactgggagaaaggggaaggacagcccttcgaatatttcgtctatggggcagcctgttcagaggtagagatcgactgcctgacgggcgaccataaaaatatacgcaccgatatcgttatggacgtggggtgttctattaacccagcgatcgacattggccaaatcgagggagctttcattcagggcatgggcttgtatacgatcgaagagctgaattacagccctcagggtattctccacacgagagggcctgaccagtataagatacccgccatatgcgatatgcctaccgaacttcacatcgccttgctccccccaagccagaattccaatactctctactcatcaaagggcctgggtgaatcaggcgtgttcctgggatgctctgtgttctttgcaatccacgatgccgtctccgcagcgaggcaggaacgcgggttacacggccctctcactctcaattctcccctcacgcctgagaagatacggatggcttgcgaggataagtttacgaagatgatccccagagacgagccaggaagctatgtcccttggaatgtgcccatttag

SEQ ID NO: 178646 - DNA, 456 bp, Artificial Sequence
  Description of Artificial Sequence: Synthetic coding sequence
atgctgctgccctacctgcggaagaagctgcggctgaccggcaccaagtacggatgtggcgggggcggttgcggggcttgtacagtcatgatctctcggtacaacccgattacaaaacgtatacggcatcacccagccaacgcttgcctgatccccatctgtagcttgtatggtgcagccgtgacgacagtggaaggcatcggttccacacacacaagaatccaccccgttcaagagcggatcgcaaagtgtcacggaacccaatgtgggttctgcaccccgggaatggtgatgagcatctacactctattacggaaccaccctgaaccaaccctggaccagctgaccgatgcactgggaggcaacctgtgtagatgtaccggctaccggcccattatcgatgcatgtaagactttttgcaagacgtccggatgttgtcagtctaaggaaaactag

SEQ ID NO: 178647 - DNA, 858 bp, Artificial Sequence
  Description of Artificial Sequence: Synthetic coding sequence
atggacctgagcgccgccagccaccggatccccctgagcgacggcaatagcataccaataattggactgggaacttacagcgagccaaagtccacgcccaagggcgcctgtgctacttcagtgaaagtcgcaatcgatacaggctacaggcacattgacggggcgtatatctaccagaacgaacatgaagttggcgaagcaataagagagaagattgcagaggggaaagtgcggcgtgaggacatcttctattgcggtaagctgtgggcaactaaccacgttccggaaatggtccggcctactctggaacgtactttgagagtgctccagctggactatgtggacctgtatatcatagaggttcctatggcgttcaagcctggggatgaaatttatccccgggatgagaacggcaaatggttgtaccataagagcaacctctgcgcgacatgggaggtggagtgccacccttacttcacacagccaaaactgctgaaattttgccaacagcacgatatcgtcattactgcttattctccgctgggtacaagccggaaccctatctgggtaaacgtctcctcccctccccttctgaaagacgctctgctgaactcgctcgggaagagatacaataagactgctgcccagattgtgttacgcttcaacatccagcggggcgtagtggtaattcctaaatccttcaatcttgaacgaattaaggagaattttcagattttcgacttttcactcacagaggaggaaatgaaagatatagaggccttgaataaaaacgtccgattcgtggagctgctgatgtggcgggatcatccggagtatccgttccatgatgagtactag

SEQ ID NO: 178648 - DNA, 873 bp, Artificial Sequence
  Description of Artificial Sequence: Synthetic coding sequence
atggacctgagcgccgccagccaccggatccccctgagcgacggcaactctatcccgattatcggtctgggcacatactccgagccaaaaagtacaccgaagggtgcatgcgcgacaagtgtgaaagtggccatagatactgggtaccgccatatagatggcgcctatatttaccagaacgaacatgaggtgggagaggctatccgcgaaaagatcgctgagggcaaagtgaggagggaggacatcttctactgcggaaagctatgggctacaaaccacgtgccggagatggtgcgccctacactagaaagaacattgcgagtcctccagctcgattatgtcgacctgtacatcatagaggtgcccatggcttttaagcctggcgatgagatctatcccagagacgaaaatggcaaatggttgtatcataagtctaatctgtgcgctacgtgggaggcgatggaagcttgcaaagatgctggactggttaaatcgctcggcgtttctaactttaatcgcagacagcttgagctgatactgaataaacctggcctaaagcacaaaccggtgagcaaccaagtggaatgccatccttattttacccagccgaagttactgaagttttgtcagcagcacgacatcgttatcactgcttactctccactagggacaagtaggaaccctatttgggttaatgttagttcacctcctttgctgaaggatgctctcctcaacagtctggggaagagatacaacaaaaccgctgcccaaattgttcttcgctttaacattcagcgaggggttgttgtgatccctaaaagtttcaaccttgagagaatcaaggagaacttccaagtcgcgcgatcaagctag

SEQ ID NO: 178649 - DNA, 978 bp, Artificial Sequence
  Description of Artificial Sequence: Synthetic coding sequence
atggccgccagctgcgtgctgctgcacaccggccagaagatgcccttgattggtttgggaacgtggaagagcgagccagggcaggtaaaggccgcagtgaagtatgcactcagcgttggatacaggcacattgattgcgccgctatctacggaaacgagccagaaatcggggaggcacttaaagaggacgtaggtccagggaaggccgtcccacgcgaggaactgtttgtcacatccaagttgtggaacacaaaacaccacccagaagatgttgaaccagcattaaggaaaactctcgcagacctgcagctggagtatcttgatctgtacctgatgcattggccttatgcatttgaacggggcgataacccgttccctaagaacgcggatggtaccatctgctacgactcaactcattataaggagacctggaaggctttggaagccctcgtagctaaagggttggtacaggcgttggggctgtccaacttcaactcccgtcagatcgatgacatcctttctgttgccagcgttcgccccgctgttctgcaggtggagtgtcatccctacttggcacaaaatgaactgattgctcactgccaggcaagaggtttagaagttacagcttactcccccctcggctcaagcgaccgggcctggcgggacccagacgagcctgtcctgttggaggagcccgtggtcctcgcactagccgagaaatacggccgatctccggctcaaatcctgcttcggtggcaggtccaacggaaggtcatctgcatccctaagagcattacgccctccaggatcctccagaacattaaggtgttcgattttaccttttcgccagaagaaatgaaacaactgaatgctctgaacaaaaattggaggtacatagttccgatgctgacagtagacgggaagagggtgcccagagatgcaggccatcctctgtacccattcaatgacccctattag

SEQ ID NO: 178650 - DNA, 978 bp, Artificial Sequence
  Description of Artificial Sequence: Synthetic coding sequence
atggccgccagctgcgtgctgctgcacaccggccagaagatgcccctgataggtctgggtacctggaagagcgagcccggccaggtcaaggctgctgttaaatacgctctgagcgtggggtaccggcatatagactgtgctgccatctatggcaacgagcccgaaatcggcgaagctctcaaagaggacgtaggccctggcaaggccgtccctagggaggaattgttcgtgacttccaaactgtggaacaccaagcatcacccagaggacgtggagccggcattgcggaagacactggccgacctccaacttgaataccttgatctctatcttatgcactggccgtacgcctttgagcgcggtgacaatccattcccaaaaaatgcggacgggacaatctgctatgattctacgcactacaaagagacctggaaagcactggaggccctggtggccaaaggcttggttcaggccctggggctctccaacttcaactcccgccagatcgatgacattctgagtgtagctagtgtgagaccagcagtgctgcaagtcgagtgccatccttatctcgcacagaacgagctgattgcccactgccaggctcgcggtttggaggttactgcctattcacctcttggaagcagcgaccgggcctggagagaccccgatgagcctgtgctcttggaagagcctgtagtcctggcactggctgagaagtacgggcgctcccctgctcagattctgcttagatggcaggtacagcgcaaggtgatctgtatccctaagtctataacaccttcacgaatacttcagaatataaaagttttcgatttcactttttctccagaggagatgaagcagcttaatgccttgaataagaactggcgctatattgtgcctatgctgacggtggatgggaagagagtgccaagagacgccggccatcccctttaccccttcaatgacccttactag

SEQ ID NO: 178651 - DNA, 444 bp, Artificial Sequence
  Description of Artificial Sequence: Synthetic coding sequence
atggccgccagctgcgtgctgctgcacaccggccagaagatgcccttaatcggtctgggcacttggaaaagtgagcccggacaagtgaaggccgccgtgaagtatgctttgtcggtggggtatcgtcacattgactgtgccgcaatctacggaaacgagccagagatcggcgaggccctgaaggaagacgtcggacctggaaaggcggtaccccgggaagaactatttgtaacaagcaaattgtggaataccaagcaccatcccgaggacgtggagcccgcgttgaggaaaaccctcgcagacttgcagttagagtatttagatttgtatttgatgcattggccatatgcctttgagcggggggacaacccattcccgaagaacgcagacgggactatctgctatgattccacccattacaaggagacttggaaagcgctctag

SEQ ID NO: 178652 - DNA, 951 bp, Artificial Sequence
  Description of Artificial Sequence: Synthetic coding sequence
atggccagccggctgctgctgaacaacggcgccaagatgcccatccttggattaggaacttggaagtccccgcctgggcaggtgacggaagccgtcaaggtggctatcgatgtcggataccggcacatcgactgcgcccatgtgtaccaaaatgaaaacgaggtcggggttgcgatccaggaaaaactgcgggaacaggtagttaagagagaagaactgtttattgtatccaaactttggtgcacgtaccacgagaaaggccttgtgaaaggggcctgccagaagacattatcagatctcaaacttgattatttggatctgtaccttatccactggccaaccggctttaagccaggcaaggagttttttcctctggatgaatccggaaacgttgttccttctgacaccaacatactggatacctgggcagccatggaagagttggtcgacgagggcctagtgaaggctattggaatctccaattttaaccatctacaagtggagatgattctgaacaaaccaggcttgaaatacaagcccgctgtcaatcagattgagtgtcacccgtacctcacccaggagaagctcatacagtattgtcagagcaaaggcatagtggtgactgcctattccccattaggatccccagatcgaccttgggccaagcccgaggacccatcactgctggaagatccacgcatcaaggctattgccgccaaacataacaagaccaccgcccaggtgctgatcagatttcccatgcagcggaacctggtggttatccccaagtccgtgacccctgaaagaatcgcagaaaatttcaaagtttttgacttcgagctgtccagccaggacatgaccactcttctgagctacaaccggaactggagggtctgtgctctactctcatgcacctctcataaggactacccttttcacgaggagttctag

SEQ ID NO: 178653 - DNA, 618 bp, Artificial Sequence
  Description of Artificial Sequence: Synthetic coding sequence
atgggcgtggtgagcctgttcctgtgcatcgtggagcagatcttcaccagcagtaagaagattcagtttcggggaatcttcatggcaaaggtccctaaatctaaggctctggaggcgacgaagctggcaatcgaagctggtttccggcacatcgattccgcgcacctgtacaacaacgaggaacaggtcgggctcgcaattaggtccaagatcgcggatgggtccgtcaaaagggaggacatattttacacttccaaactgtggtgtaacagccatcggcccgagcttgttaggccggccctggaacggagtctaaaaaacttgcagttagactacgtcgacttgtacctgattcattttcctgtcagtgttaaacctggcgaggaggtgatacccaaggacgaaaatgggaagattttgtttgacaccgtggacctctgtgcgacctgggaggctgtggaaaagtgcaaggacgccgggctagccaaaagcataggggtctctaactttaaccgccgtcagctagagatgatcctcaacaaaccagggctcaagtacaagcccgtttgcaaccagccgagggataattcgatcttttcattgagcccagattggtag

SEQ ID NO: 178654 - DNA, 972 bp, Artificial Sequence
  Description of Artificial Sequence: Synthetic coding sequence
atggacagcaagtaccagtgcgtgaagctgaacgacggccacttcatgccagtgctaggttttggaacatatgcacctgccgaggtacccaaatccaaggcactagaggccaccaagttggccatcgaagccggcttccgccacattgattctgcccacctgtacaataacgaggaacaagttggactggctatcagaagtaagatcgccgacggctcagtcaagagggaagatatcttctatacatcaaaactgtggtgcaactctcaccggccagagctggtccggcccgccctggagcgtagccttaaaaacctgcagttagattatgttgatctgtacctgatccacttcccggtttccgtgaagcctggtgaggaagtgatccccaaggacgaaaacggcaaaatcctcttcgataccgtggatctttgtgcgacctgggaggctgttgaaaagtgcaaggatgccggactggcaaaaagcattggggtaagcaattttaacagaaggcaattagaaatgatccttaacaaacccggacttaagtacaaacccgtatgtaaccaggtcgaatgccacccctactttaatcagcggaaacttttagatttctgcaaaagtaaggacatagttctagtagcttattccgccctcggaagtcaccgggaagagccttgggtagaccccaatagccccgtgctcctggaggaccctgtgctgtgcgctctggccaagaagcataagcgtactcccgctctcatcgccttacggtaccagctgcagagaggagtggtcgtacttgctaaaagctacaacgagcagcgcattagacagaatgtccaagtctttgaatttcagctgacatcggaagagatgaaggccattgatggcctcaaccgcaacgtgaggtacctgaccctggacatctttgccgggccccctaattatccgttctccgacgaatactag

SEQ ID NO: 178655 - DNA, 972 bp, Artificial Sequence
  Description of Artificial Sequence: Synthetic coding sequence
atggacagcaagtaccagtgcgtgaagctgaacgacggccacttcatgccggtgctcggcttcggcacctacgcaccagccgaggttcctaagtctaaggccctggaggcaactaagctcgcaattgaggccggtttccggcacatcgattctgcccacctatataataacgaggagcaggtggggctggccatcagatcaaaaatcgccgacggttcagtgaagagagaggatatcttttacacttccaaactttggtgcaactcccatcggccagagctggttcggccagccctggagaggtccctcaaaaacctgcagcttgactacgttgatctttaccttatccacttcccagtgtctgtgaaacctggggaggaggtcattcctaaggatgaaaacgggaaaattttatttgacacggtcgatctgtgcgctacttgggaggctgtcgagaaatgtaaagacgcgggtctggcaaagagtatcggcgtatcgaacttcaatcggcgacagctggagatgattcttaacaagcccggcctgaagtacaaacccgtgtgtaatcaggtcgaatgccatccttacttcaatcagcggaaactgctggacttttgtaaatccaaagacatcgtgctggtagcttattctgcactgggcagccacagggaggagccctgggtggatcccaattctcctgttctgctggaggatccagttctttgtgcgttagctaagaagcacaagcgtacccctgccttgatagctctgcgttatcagctgcagcggggcgtggtggtgctggcaaaatcctacaacgagcagagaattagacagaatgtgcaggtctttgaatttcagcttacatccgaagagatgaaggctatagatggactcaatcggaatgtccgctatttgactctcgatattttcgctggccctcctaattacccattctccgacgagtattag

SEQ ID NO: 178656 - DNA, 747 bp, Artificial Sequence
  Description of Artificial Sequence: Synthetic coding sequence
tgaagcaagtaccagtgcgtgaagctgaacgacggccacttcatgccagtgctgggcttcgggacttacgcccctgccgaggtgggtctggccattagaagcaagatcgcagacggaagcgtaaaaagggaagacatcttttatacaagtaaactatggtgcaattctcatcggcctgagctagtgaggccagctctggagaggtctttaaagaacctccagttggactatgtggacttatacctcattcattttcctgtcagcgttaagcctggtgaggaggtgattccaaaggacgaaaacgggaagattctctttgacaccgttgacctatgtgctacatgggaagctgtcgaaaagtgcaaagacgccggtctcgccaaatccatcggtgtctctaatttcaatcgccggcaactcgaaatgatattaaacaaacctgggctcaagtataagccagtgtgcaatcaagtcgagtgtcatccttatttcaaccagagaaagcttttggatttttgtaaatctaaggatatcgtcctggttgcctattcagccttggggagccaccgggaagagccgtgggtggacccaaatagtcccgtgttgctggaggaccccgtcctgtgtgctctcgccaagaagcacaaacgtacccctgccctgatcgcgctacgctaccagctgcagaggggagtcgttgttctggctaaatcttataatgaacagcgcatccggcaaaatgtgtag

SEQ ID NO: 178657 - DNA, 972 bp, Artificial Sequence
  Description of Artificial Sequence: Synthetic coding sequence
atggacagcaagtaccagtgcgtgaagctgaacgacggccacttcatgcctgtgctgggtttcggcacctatgcccctgccgaagtgccaaaaagcaaggccctggaagcagtgaagctggcaatcgaggctggattccatcacatcgactccgcacatgtctataacaatgaggagcaggtgggactggccattagaagcaaaatcgccgatggatcagtgaagcgggaggacattttttatacatcaaaattgtggtcaaatagtcataggcccgagctggtcaggccagcacttgaacgctctctcaagaacttgcagttggattacgtagacctgtatctgattcactttcctgtgtcagtgaagccaggcgaggaagtgatcccaaaagacgaaaatggaaaaatcctcttcgacaccgtggacttatgcgcaacttgggaggcaatggagaagtgtaaggatgctggtctcgcaaagtccatcggcgtgtccaactttaaccatcggttgctcgagatgattctgaacaagcccggactcaaatacaagccggtgtgcaaccaagtagagtgccatccctatttcaaccagcgtaagttattagacttttgtaagagcaaagatatcgtgctcgtcgcgtattctgcccttgggagtcatcgagaagaaccatgggttgatccaaactcaccagtgctattggaggatcctgtgctgtgcgcactggcaaagaagcacaaacgcactcccgccctgatcgcactgcgctaccagctgcagcggggcgtggtggtgcttgcaaagagctacaacgagcagaggattaggcagaacgtgcaggtcttcgagttccagctgacaagtgaggaaatgaaggccatcgacggcttgaacagaaatgtgagatacttgacgctggacatcttcgccgggccacccaattatcctttttccgatgagtactag

SEQ ID NO: 178658 - DNA, 972 bp, Artificial Sequence
  Description of Artificial Sequence: Synthetic coding sequence
atggacagcaagtaccagtgcgtgaagctgaacgacggccacttcatgcctgtgttaggcttcggtacgtacgccccggctgaggtaccgaaaagcaaagctctggaggccgttaaacttgcgattgaggcaggatttcaccatatcgattccgcccatgtctataacaatgaggaacaggttggccttgctatccgctcaaaaattgctgacggcagcgtgaagcgggaagatattttttatacaagcaagctatggtccaactctcacagaccagagttggtgagaccagccctagagcggagtctgaaaaacctgcagcttgattacgttgatctgtacctgatacacttccctgtgtcagtgaagcctggggaagaagttatacctaaagatgaaaatggaaagatccttttcgacaccgtggatctgtgcgccacgtgggaggccatggagaagtgtaaggacgctggactcgcaaagagcattggcgtgtcaaacttcaaccatcgcctactggagatgattttgaacaaacctggacttaagtacaaaccagtgtgcaaccaagtcgaatgccatccatatttcaatcaacgcaaactcctggatttctgtaagtccaaggatatagtcctggtggcctacagcgctctgggctcccaccgtgaagaaccctgggtggaccctaattctccagtgttattggaggatcctgtactctgcgccctggctaaaaagcataagcgcacccccgctcttatcgccttacgatatcagctacaacgtggcgtggtggtcctcgcaaagtcgtacaacgagcagagaataagacagaacgtccaggtcttcgagtttcagcttacgagtgaggagatgaaggcaatcgacggcctgaacaggaatgttagatatctgactctggatatttttgcaggacctcctaactatccattcagtgatgagtattag

SEQ ID NO: 178659 - DNA, 894 bp, Artificial Sequence
  Description of Artificial Sequence: Synthetic coding sequence
atggacagcaagtaccagtgcgtgaagctgaacgacggccacttcatgcctgtgctagggttcggaacctatgctcccgccgaggtgccaaaatcaaaggccctggaggcagttaaactcgctatcgaggctggctttcaccatattgatagtgctcatgtctacaataacgaggagcaggtgggtttggccattaggagtaaaattgcagacggaagcgtaaagcgggaggacatcttttacacctcaaagctgtggtccaattcccatcgtcccgagctggtgaggcccgcccttgagagaagtttgaagaatctgcagctggattacgtcgacttgtacttaatacactttccggtttcagtcaaggctatggagaaatgtaaagacgcaggccttgctaagtccataggcgtatcgaactttaatcaccgcttattagaaatgatcctgaataagcccgggctgaaatataagcccgtgtgcaaccaggtggagtgtcatccctactttaatcagcggaagctgctcgacttttgcaagtctaaagacattgtactggttgcctacagcgctctcgggtcgcaccgagaggagccttgggtggaccccaattcccctgttctgttggaagaccccgttctctgcgctctggctaagaagcacaagaggactcccgccctgatcgcactccgataccagcttcagcgcggcgtggttgtactcgccaagtcttataatgagcagaggattcggcaaaatgtgcaggtgtttgaatttcagctcacgtccgaggaaatgaaggcaattgacggactgaatagaaatgtgcgctatctcaccctggacattttcgccggcccacccaattatcccttttccgacgaatattag

SEQ ID NO: 178660 - DNA, 420 bp, Artificial Sequence
  Description of Artificial Sequence: Synthetic coding sequence
atggacagcaagtaccagtgcgtgaagctgaacgacggccacttcatgccagttctcgggttcggtacctatgcgcctgccgaagttccaaaatccaaggcactcgaggccgtaaaacttgcaatcgaagctggatttcatcatattgatagcgcccacgtctacaacaatgaggagcaagtgggtctggcgatccgctccaagatcgctgatgggtctgtgaaaagggaggacatattctacacatccaaactgtggtccaactctcaccgcccagaactggtgcggcccgcactagaaaggtccctgaagaacctgcagcttgactatgtggacctctacctgatccacttccctgtttccgtgaaggaagacatcggcattctgacttggaaaaaatcacccaagcacaactcctag

SEQ ID NO: 178661 - DNA, 972 bp, Artificial Sequence
  Description of Artificial Sequence: Synthetic coding sequence
atggacagcaagcaccagtgcgtgaagctgaacgacggccacttcatgcccgtactgggctttggtacgtacgctcctccagaagtgccccgtagcaaagctcttgaggtcaccaagctcgcaatcgaagctgggtttaggcacattgactccgcacacctctataacaatgaggaacaggtaggattggccattaggagcaaaatcgccgatggtagcgtaaaacgagaagatatcttttatacatcaaagctatggagcacattccatcgtcccgagctggtgcgtcctgctcttgagaattctcttaagaaagcgcagctggactatgtggacttgtatcttattcattcacccatgagcctgaaacctggggaggagctaagccccactgacgagaacggaaaagttatatttgacattgtggacctgtgcacaacgtgggaggctatggagaagtgcaaagatgcaggtcttgcaaagagcattggggtctctaactttaaccgaaggcagctggagatgatcctgaacaagccaggtttgaaatacaaacctgtctgcaatcaggtggagtgtcacccgtatttcaatcgcagcaaactgctcgatttctgcaagagtaaggacatagtgttggtggcttactctgccctcggctctcagagagacaagcgctgggtggatccaaattctcccgttttactagaagaccctgtgctctgcgcgcttgctaaaaagcacaagcgcacgcccgcattgatcgccctgaggtaccagctgcagaggggcgtcgtcgtcctcgcgaaatcttacaatgagcagcgaattcgccagaacgtgcaggtatttgaatttcagctgaccgctgaagatatgaaagccatagatggcctcgacagaaatcttcactattttaattcggattcatttgccagccaccctaactacccttacagcgacgaatattag

SEQ ID NO: 178662 - DNA, 615 bp, Artificial Sequence
  Description of Artificial Sequence: Synthetic coding sequence
atgagcctgaagcccggcgaggagctgagccccaccgacgagaacgggaaggtcatttttgatatcgtggacttgtgtaccacatgggaggccatggagaaatgtaaagatgctggcctggctaaatccattggggtgtccaattttaacagaagacagctggagatgattctcaacaagcccggcctgaagtataaacccgtctgtaatcaggtggagtgccatccttactttaacaggagtaagctcttggatttttgcaagagcaaggatatcgtactcgtggcatatagtgctctcggcagccagcgcgacaagcgctgggtcgaccccaactcacccgtcctattggaggatcccgtactttgtgctctggccaagaagcacaagcgaacaccagcactgatcgcacttcgctaccagctccagcgaggcgttgtggtactagccaagtcctacaatgaacaacgaattcgccaaaatgtccaggtgtttgagtttcagctcacagctgaagacatgaaggctatcgacggcctcgatagaaacctccactacttcaattctgactcattcgcctcccaccccaattatccttacagcgatgagtactag

SEQ ID NO: 178663 - DNA, 972 bp, Artificial Sequence
  Description of Artificial Sequence: Synthetic coding sequence
atggaccccaagtaccagcgggtggagctgaacgacggccacttcatgccggtgcttgggttcgggacttacgcacccccagaagttccgcgtaatcgggccgtcgaagtgacgaagcttgcaatagaagccgggttcaggcatatcgattcggcgtacttatacaacaacgaggagcaggttggcctggctatccgttctaagattgccgacgggtccgttaagcgtgaagatatcttctacacgtcaaaattatggtgcaccttctttcagccccagatggttcagcctgcattggagagctcactcaagaagctgcagctcgattatgtggatctctacctgttgcacttcccaatggctcttaagccgggggaaaccccgcttccgaaggacgagaacgggaaagtgatcttcgatacagttgacctctcagccacgtgggaggtcatggagaaatgcaaggacgccggcctcgcaaaatcaatcggtgtgagcaactttaactgccggcagctcgaaatgatcctgaataagcccggcttgaaatataaaccagtgtgcaatcaagtcgagtgccatccctacctgaatcagagcaagttgttagatttttgcaagtctaaggacattgtccttgtcgcccattctgcactcgggacccagcggcacaaactctgggtagatcctaacagcccagtcttgcttgaagatcctgtgctctgtgcactggccaaaaaacacaaacagacccccgcactaatagctctaaggtaccagctgcaaagaggtgtagtggtgttggcgaaaagctataacgaacaaaggataagggaaaacatccaggtgttcgaattccagctcacttcagaggatatgaaagttctggatgggctgaatcgtaattacaggtacgtcgtgatggattttctgatggaccaccccgattacccattttcggacgaatactag

SEQ ID NO: 178664 - DNA, 972 bp, Artificial Sequence
  Description of Artificial Sequence: Synthetic coding sequence
atggaccccaagtaccagcgggtggagctgaacgacggccacttcatgcctgtcctcggctttgggacctacgctccccccgaggtgcctcggaatagggccgttgaagtgactaagctggcaattgaagctggctttagacacattgacagcgcatatctgtacaacaatgaagagcaagtgggtctggccatcaggtcaaagatcgccgacggtagcgtgaagcgggaagatattttttatacatccaaactctggtgcacattcttccagcctcaaatggttcaacccgcgttggagagctcactgaagaagcttcagcttgattacgtcgatctttacctcttgcattttcctatggccctgaagcctggtgagacccctctacccaaggacgaaaacggaaaggtaatattcgacacagtcgatctcagcgctacttgggaggtcatggaaaaatgtaaagatgctgggcttgcaaagtcaattggggttagcaactttaactgtcgccagctggaaatgattctgaacaagccgggactaaaatataagcctgtctgtaaccaggtcgagtgtcacccttatctgaatcaaagcaagctccttgatttttgtaaatccaaagacattgtgttagtagctcatagtgccctcggaacacagagacacaaactctgggtagacccgaattccccagttctgcttgaggatcctgttctgtgcgcactcgccaagaagcataaacagactcccgcactgatcgccctccggtaccagctgcagaggggagtggtggtgctggccaaaagctacaacgagcagcgtatccgcgagaatattcaggtgtttgagtttcagcttaccagcgaggacatgaaagtgcttgacggcctcaatcgcaactaccggtacgtggtgatggatttccttatggatcacccagactaccccttctccgacgaatactag

SEQ ID NO: 178665 - DNA, 381 bp, Artificial Sequence
  Description of Artificial Sequence: Synthetic coding sequence
atggaccccaagtaccagcgggtggagctgaacgacggccacttcatgcccgtgttggggttcggcacatatgcccctcctgaggtgccgcgcaaccgtgccgttgaagtcacgaaactggccatagaagccggcttccgccacatcgactccgcttatctctataataacgaggagcaggttgggctggctattcgcagcaagattgcagacggctccgttaagcgcgaggacatcttctatacctccaagctgtggtgcactttcttccagccccaaatggtgcagccagcactcgagagcagtctcaagaagttgcagctggattacgtcgacctgtacctgctgcatttccccatggctttgaaaagtacaacgtag

SEQ ID NO: 178666 - DNA, 981 bp, Artificial Sequence
  Description of Artificial Sequence: Synthetic coding sequence
atggacctgagcgccgccagccaccggatccccctgagcgacggcaactccattccaattatcggtcttggcacctacagtgagcccaaaagcacgcctaagggtgcctgtgccacatccgtgaaagttgcaatcgatacagggtatagacatatagatggtgcctatatctaccagaacgagcacgaagtcggcgaagcaatcagagagaagattgcagaaggtaaagtgcgccgggaagatatattctactgcggaaaactttgggccacgaatcacgtgcccgaaatggtgagacccacattagaaagaacccttcgagtgctacaactggactacgtcgatttgtatattatagaggtgcctatggctttcaaacccggtgacgagatataccccagagatgaaaatggaaaatggctgtaccataagtcaaacctgtgcgctacctgggaggccatggaggcttgcaaggacgccggccttgttaaatcactgggcgtatcaaattttaaccgtcggcagctcgagctgattctcaacaaaccaggactgaaacataagccggtttcaaatcaggttgagtgccatccctacttcactcagcccaagctgctcaaattctgtcagcagcacgacatcgtgattacggcttactctccgctcggaactagtagaaacccgatctgggttaacgtgtcttccccacctctgctcaaagatgccttgcttaatagcttggggaaacgctacaataagactgctgcccagattgtcctgcgcttcaacatccagcgaggagtcgtggttattcccaagtcttttaacctggaacggatcaaagagaactttcagatctttgatttcagtttgaccgaagaagagatgaaagatattgaggcactgaacaagaatgtgcgatttgttgagttattgatgtggcgtgaccaccctgaatatcccttccacgacgaatattag

SEQ ID NO: 178667 - DNA, 441 bp, Artificial Sequence
  Description of Artificial Sequence: Synthetic coding sequence
atggccttcaagcccggcgacgagatctacccccgggacgagaacgggaaatggctgtaccataagtctaacttgtgcgccacgtgggaggccatggaagcttgcaaggatgcaggcctcgtcaagagtttgggggtttccaactttaaccgacggcagctggaattaattctgaataagcccggcctcaaacataaacctgtcagcaatcaggtcgaatgccacccgtatttcacacagcctaaacttttgaagttctgtcagcagcacgacattgtcattactgcctattctcctctgggcacttcaaggaatccaatttggaggcagttgcacaaactggccctgcttgatctacctatactgcgcgtgacgctccattcagtgcacacacttcactcggaaaagcttgtgacgggtgacttgcagtgcccgggttag

SEQ ID NO: 178668 - DNA, 672 bp, Artificial Sequence
  Description of Artificial Sequence: Synthetic coding sequence
atggcccaccggttccccgccctgacccaggagcagaagaaggactcgcagggtaaactgttcaggaacatactcaaagaaaagggtatagtggtaggaatcaagttagatcaagggggggcaccattagcaggtacaaacaaagagactaccatacagggactggacgggctgtctgagaggtgtgcccaatataagaaagacggagtggacttcggaaagtggcgggctgttttgcggatcgccgaccagtgccccagctccctggccattcaagagaatgcaaatgcacttgcaaggtatgccagcatctgtcagcaaaacgggctcgttcctatagttgagccagaagtgattccggacggcgatcacgatctcgagcactgtcaatacgtaactgagaaggtcttagcagccgtgtacaaggccctgaatgaccatcatgtctaccttgaaggaacactgctcaagcctaacatggtgaccgcgggccacgcctgcacaaagaagtataccccagagcaggtggccatggccactgttaccgccctgcaccggacagtgccagccgcggttcctgggatatgcttcctctcagggggcatgtctgaggaggatgccaccctcaacctgaacgccataccaacgagagtgcaatgccccccagcatag

SEQ ID NO: 178669 - DNA, 1095 bp, Artificial Sequence
  Description of Artificial Sequence: Synthetic coding sequence
atggcccaccggttccccgccctgacccaggagcagaagaaggagctgagcgagatcgctcagtccatcgtggcaaatgggaaaggtatccttgctgcggatgagagcgttggcaccatgggcaaccgtttgcagcgcattaaggtggagaatacagaagaaaatcggcgccagtttcgtgaaattctcttctctgtcgactccagcattaatcagtcaattggtggggtaatcctttttcatgaaactttgtaccaaaaggatagccaaggtaaactgttccgcaacattttgaaggagaagggaatcgtggtcggaatcaaactggatcagggtggcgccccactagcggggaccaacaaagagactacgatccaggggttagacggtctgagcgagcgatgcgctcagtacaagaaagatggagtggactttggaaagtggcgcgccgtactccgcattgcagaccaatgcccctcttcccttgcaatccaggagaacgccaatgcgctcgctagatacgcctccatctgccagcagaatggtcttgtacccattgttgaaccagaggtgattcctgatggcgatcatgacctggaacactgtcagtatgtcacggagaaagttttggccgctgtgtataaggcgctgaacgatcaccacgtgtacctggaaggaaccctactaaagcctaatatggtgaccgcgggccatgcatgtacaaaaaagtacacaccggagcaggtggcaatggccaccgttacagcactgcacagaacggtcccggctgctgtcccagggatatgttttttgtcaggcgggatgtctgaagaggatgcaaccctcaatctgaacgctattaatctttgcccgctcccaaagccatggaagctctcatttagctacggtcgggcccttcaggccagtgcgctcgctgcttggggtggaaaggcagctaacaaggaggcaactcaggaagcattcatgaagagggctatggcaaattgccaggccgccaaaggccagtacgtgcacaccgggagcagtggagcagcctctactcagtccctgttcaccgcttgctatacttactag

SEQ ID NO: 178670 - DNA, 951 bp, Artificial Sequence
  Description of Artificial Sequence: Synthetic coding sequence
atggcccaccggttccccgccctgacccaggagcagaagaaggagctttccgaaattgctcagagtatcgtagccaatggaaaaggcattctcgccgccgacgagagcgtcggtacaatgggaaatcgactgcaacgaattaaggttgagaatacagaggagaaccggcgacaattccgggagatcttgttcagcgttgatagctccataaatcaatcaattggcggcgttattctgttccatgaaactctctatcagaaggatagtcagggcaagctgttcaggaatatcctcaaagagaaggggatcgtggtgggaatcaagctggaccagggaggcgctcccctggccgggaccaacaaggagacaactatccagggcctcgacggtctgtccgagaggtgcgcgcaatataagaaggatggcgtagattttggaaaatggagggctgtgctccgcattgccgatcagtgcccatcatctctggccatccaggagaatgccaatgctctcgcccgatacgccagcatttgccagcaaaatggcctagtgcctattgtcgaacccgaagtcattcccgatggggaccatgacctggaacactgtcagtatgtcactgaaaaggtactggctgctgtctataaggcactaaacgaccaccacgtctacctggaaggcactttattaaagcccaacatggtgaccgcaggacatgcctgcacgaaaaaatataccccagagcaggtggccatggctactgtgactgcactccaccggaccgtccccgctgccgtaccaggcatctgttttctgagcggtgggatgtctgaagaggatgccaccttaaacttgaatgccatcaacttgtgcccgctgcctaagccttggaagctctctttctccggtgtggctcgactgcagacaagacgacagccccgtagactgctttag

SEQ ID NO: 178671 - DNA, 1947 bp, Artificial Sequence
  Description of Artificial Sequence: Synthetic coding sequence
atggtgagcctgccccccccccagagcgacgtgaccctgcccggccctacccgattagagggtgagaggcaaggcgatctcatgcaagctccagggcttcccggcagccctgcccctcagagcaaacacgccggattttcatgctctagcttcgtgagtgatgggccaccagaacgcacaccctctctgccaccacactcccctcgcattgcgagccctggcccagaacaggtgcaggggcactgtcctgccggtcctggtccaggtcccttcagattatcccccagcgacaagtacccagggtttggtttcgaggaagccgctgcaagttcaccaggtagattcttaaaaggatcccatgcccctttccacccgtacaagaggccatttcacgaggacgtctttccggaagccgagaccactttagcactaaaaggacatagtttcaagaccccaggaccactggaggcttttgaagaaatccccgttgatgtcgccgaggcagaggctttcctcccaggattttcggctgaagcctggtgtaacgggctgccctacccttctcaggagcacgggccccaggttcttggcagcgaagtaaaggtgaagcctcctgtgttagaatcaggagccggtatgttctgctaccaacctccactgcagcacatgtattgctcatcccagccaccctttcaccagtattcccctggaggcggctcctatccaatcccttacttaggctcctcccattatcaataccagcggatggctccccaggcatccaccgatggacaccaacccctctttccaaaacccatttacagctacagtatcctcatcttcatggccttgaagaattccaaaactgggtccttgccagtaagcgaaatttacaacttcatgaccgagcacttcccttatttcaaaactgcccctgatggctggaagaattcggtgcgccacaaccttagcctgaataagtgctttgagaaggttgagaacaagagcggatcaagcagcagaaaaggatgcttgtgggctctgaaccctgcaaaaattgataagatgcaggaggaactacagaagtggaaacgtaaagaccctatagctgtaagaaagtcaatggccaagcccgaggagttagatagtctgattggtgacaagcgagaaaagctcggcagcccgctcctcggctgcccgccacccggactctccgggtctggcccaatccgaccacttgcacccccggcaggcctttccccaccacttcactccttgcaccctgcacccggcccaatcccgggcaagaatcccctgcaggacttgctgatgggccataccccatcgtgctatggtcagacctacctgcatctgagcccgggtctggcccccccagggcctccccagccattgttccctcagcccgatgggcatttagaattgcgggcccagcccggcactccccaagactctccccttccagcacacacacccccatcacacagcgccaaactgctcgccgagccctcacctgccagaactatgcatgacacattgttacctgacggcgatctcggcaccgacctcgacgccataaatccaagcctgactgactttgatttccaagggaacctttgggaacagctgaaggacgacagtcttgccctagatccgctggtgcttgttacatctagtcctacctcttcctctatgcctcctccacagccacccccacattgctttcctcctggcccttgcttgaccgaaacaggatccggggccggagatctagcggcacctggttctggcggctccggggccttgggcgaccttcatctgaccacgctgtatagcgccttcatggagctcgagcctacaccccccacggcccccgcagggcccagcgtatatctcagcccatcttccaaaccggtcgccttggcgtag

SEQ ID NO: 178672 - DNA, 1095 bp, Artificial Sequence
  Description of Artificial Sequence: Synthetic coding sequence
atgccccacagctaccccgccctgagcgccgagcagaagaaggagctgagcgacattgcactcaggattgtggcacccggcaagggcattctggctgcggacgaatccgtcgggtccatggccaagaggctgtcacagataggcgttgagaacactgaggagaaccgaagactgtatagacaggtgctgttttccgctgatgaccgtgtgaaaaaatgcattgggggcgtgatttttttccatgagaccctgtatcagaaagacgacaatggagtgcctttcgtgcgcaccatacaggacaaaggcatcgttgttggaatcaaggtagataaaggagttgtgccactggctggtacggacggcgaaactactacacaaggcctggacgggctctcagaacgatgtgcacagtacaagaaagatggcgctgactttgcgaagtggaggtgtgtcctcaaaatctctgaaaggaccccttctgccctggctatccttgagaatgcaaacgtgctcgctaggtatgcctccatatgtcagcagaacggcatagttcccatcgtggaaccagaaatcctgccagacggagaccacgatctgaagcggtgccagtatgtgaccgaaaaagtgcttgccgcagtgtacaaagccttgtccgaccaccatgtatatctggaggggactcttttaaaaccgaatatggtgactcccggtcacgcatgcccgataaagtacaccccagaggaaatcgctatggccacggtgactgccctacgccgcaccgtgcccccggcagtaccaggggttaccttcttatctgggggacaatcggaggaggaggcctcttttaatctgaacgctattaatcgctgccctctgccccgcccttgggcactgaccttcagttacggcagagccctccaggcttctgctctcaacgcttggcgaggtcagcgggataatgccggagcagccactgaagagttcatcaagcgggcagaggtgaatggcctggcagcacaggggaagtacgagggctccggagaggatggaggagcggcagcgcaatctctgtacatcgctaatcatgcttactag

SEQ ID NO: 178673 - DNA, 450 bp, Artificial Sequence
  Description of Artificial Sequence: Synthetic coding sequence
atgccccacagctaccccgccctgagcgccgagcagaagaaggagttatcagatatcgccctgcgtattgtcgcgcccggcaagggaatactggctgcagacgaatccgtaggttccatggctaagaggctttctcaaatcggggtcgaaaacaccgaggaaaacagaagattgtacaggcaagtgctgttcagtgccgacgacagagtcaaaaagtgtattggtggcgttatctttttccacgagacgctataccagaaggatgataatggtgtgcctttcgtgcggacgatccaggacaaaggcatcgtggtaggcatcaaagtagataagggagtggtcccactggccggcactgacggagaaaccactacacagggcttagatggactgtctgaaaggtgtgctcagtacaagaaggatggtgcggatttcgcaaaatggcgctag

SEQ ID NO: 178674 - DNA, 795 bp, Artificial Sequence
  Description of Artificial Sequence: Synthetic coding sequence
atgcccagcatcttcgcctaccagagcagcgaggtggactggtgcgagtctaacttccagtacagtgaattggtggctgagttttataacactttttccaatattccttttttcatcttcgggcccctcatgatgttgctgatgcacccatatgctcaaaagagatcccgttacatctacgtggtgtgggtcctctttatgattatcggcttgttctctatgtatttccacatgacactttctttcctgggtcagctgctcgatgaaattgcaatactttggctgctcgggtccggctacagcatctggatgccacgatgctattttccatcctttctgggtggtaaccgatcacagttcatacgactggtctttatcacgactgtagtgtcgacactcctttctttcttgaggccaacggtgaatgcttacgccctgaattctattgcgcttcatattctgtacattgtgtgtcaggaatataggaagaccagcaataaagaacttcggcacctgatagaagtgagcgtggtgctgtgggcagtcgccctgacaagctggataagcgatagattactgtgcagcttctggcagcgcattcacttcttttaccttcactctatctggcacgttctgatctccatcacctttccatacggaatggtcaccatggctctggtggatgccaactacgaaatgcccggagagactctcaaagttcggtattggccccgtgatagttggcctgtgggtcttccatacgttgagataagaggagatgacaaagattgttag

SEQ ID NO: 178675 - DNA, 828 bp, Artificial Sequence
  Description of Artificial Sequence: Synthetic coding sequence
atgggcgccccccactggtgggaccagctgcaggccggcagcagcgaggtcgactggtgcgaagataactataccattgtcccagctatcgccgagttttataataccatttctaacgtcctgttcttcatcttgccgcccatctgcatgtgcctgtttcgtcagtacgcgacctgcttcaacagtgggatttacttgatctggacccttctggtggtggtgggaatcggatcagtgtatttccacgctacactgtcattccttggtcaaatgctggacgaactagccgttctgtgggtgttgatgtgtgcgctggctatgtggtttccccggcgctacctgcccaagatcttccgtaacgatcggggacgcttcaaggtggtggtgtccgtgctgagcgctgtgactacatgtctggccttcgtgaagcccgccattaacaacatctccctcatgaccttgggagttccctgcactgccctgctgattgctgagctgaagcggtgtgacaacatgcgggtgttcaagctggggctattcagcggcttgtggtggacgctggccctattctgctggatttcagaccgagccttttgcgagttgctctcaagctttaattttccttacttgcactgtatgtggcatatcttaatatgcctggcggcatatctcggttgcgtctgtttcgcatatttcgatgcggcgtcagaaatacctgagcagggacctgtcattaagttctggcccaatgagaagtgggcctttattggggtcccatatgtgagcctattgtgtgcgaataagaaatcctctgtaaaaattacttag

SEQ ID NO: 178676 - DNA, 423 bp, Artificial Sequence
  Description of Artificial Sequence: Synthetic coding sequence
atgtgcctgttccggcagtacgccacctgcttcaacagcggcatctaccttatctggacgctgctggttgtggtggggattggctctgtttacttccacgcaactctatcatttctggggcagatgctagacgagttggccgtgctctgggtgcttatgtgtgctcttgccatgtggtttcctaggaggtacctcccaaagatttttagaaacgaccgcggtagattcaaagtagttgtcagcgtgctcagcgcagttaccacatgtctggcttttgtgaaacccgccattaacaacattagcctgatgacactcggtgtgccctgtacagccctgctcattgcagagctcaagagacatgagcgcaaccaaagacggcgacaccgaaaagggggtcaacagggtggcggggataaggtgtag

SEQ ID NO: 178677 - DNA, 1587 bp, Artificial Sequence
  Description of Artificial Sequence: Synthetic coding sequence
atgcagggcccctgggtgctgctgctgctgggcctgcggctgcagctttccctgggcgtcattccggccgaggaagagaatccagcattttggaatagacaggctgctgaagcactggatgcagccaaaaaattgcagccaattcagaaggtggcaaagaacctgattctgttcctgggcgacggtctgggggttcccacagtcacagcaacaagaatccttaagggacaaaagaatgggaaactggggcccgagacaccactagcaatggaccgcttcccttacctggccctgagcaagacttataatgtggataggcaggttccagattcagctgcaacagccactgcatacctctgtggtgttaaggctaattttcagaccatcgggctgagcgcagccgcacgtttcaatcagtgtaataccacacgtggcaacgaagtcatctccgtaatgaacagagcgaagcaagcaggtaagtcagtcggcgtggttaccacaacgagggtccagcatgccagtcctgccggcacctatgcccacactgtgaaccgcaactggtacagcgacgctgacatgcccgccagcgcccgccaagaaggatgccaggacattgcaactcagctaatcagcaacatggacatcgatgtcatcctgggaggcggccggaagtatatgttccccatgggtacccctgacccagagtatcctgccgacgcctcccagaatggcatcagacttgatggcaagaatctggtccaggaatggctagccaaacaccaaggcgcttggtacgtgtggaacagaaccgaactgatgcaagcatcgcttgatcagtccgtcacccacctgatgggtttgtttgagcctggagacaccaagtatgagattcatcgagatcccacgcttgatccatctcttatggagatgacagaggctgcactcagattgttgtctcgtaatcctcgcggcttctacctgttcgtcgaaggcgggagaattgatcacggtcaccacgagggcgtggcataccaggccttaactgaggccgtgatgtttgacgatgcaatcgaacgggctgggcagctcacgtccgaggaggacacactgactctggtcacggccgaccatagccatgttttctcttttgggggttacactctgaggggatcttcaatcttcggtctggctccctctaaagcccaggacagtaaagcctatacatccatcctttacgggaacgggcccggctatgtgtttaattcaggcgttagacccgacgtgaatgagtccgagagcggttcaccagactatcaacagcaggctgctgtcccactgtctagcgagacgcacgggggtgaagacgttgcagtcttcgcccggggaccgcaggcccacctcgtccacggagttcaggaacaaagttttgtggcacacgtgatggcctttgcggcctgcctggagccatacactgcttgtgaccttgctcctcccgcatgtaccactgacgcagctcaccccgtggctgcatctttgcctcttttggcaggcaccttactgctgctgggcgcctccgccgctccctag

SEQ ID NO: 178678 - DNA, 513 bp, Artificial Sequence
  Description of Artificial Sequence: Synthetic coding sequence
atggaccgggccatcggccaggccggcagcctgaccagcagcgaggacacgctgacagtcgtaacggccgaccactcccacgtcttcacctttggcggttacactcctcgtggcaactctatattcggtcttgccccaatgctctctgacacagataaaaagccatttacggccattctctacgggaatgggcctgggtataaggtggtggggggggagcgggaaaacgtctccatggtagactacgcccataataattatcaggcccaatctgctgttcccctgcgccacgagacacacggcggagaggatgtcgcagtattctctaagggaccgatggcccacttgcttcacggagtacatgagcagaactacgtgccccatgtcatggcatacgccgcatgcatcggggccaatcttggacattgcgcccccgctagtagtgctggttcattggccgctggaccacttttgcttgcattagcactctaccccctgtcagtcttgttttag

SEQ ID NO: 178679 - DNA, 513 bp, Artificial Sequence
  Description of Artificial Sequence: Synthetic coding sequence
atggaccgggccatcggccaggccggcagcctgaccagcagcgaggacacgctgactgtggttacagccgaccacagccatgtgtttacttttggggggtataccccgcgtggtaatagcattttcggtttggcccccatgcttagtgacaccgataaaaaaccttttactgccattttgtatggcaacggccctggctacaaggttgtgggcggggaacgagagaatgtgagtatggtggactatgcccataataattatcaggcccagagcgcggttcctctgaggcacgaaacacatggaggtgaggatgtggctgtgttcagcaaggggccgatggcacatttactccacggggtgcatgaacagaattacgtgccccacgtcatggcctatgctgcttgcatcggggccaacctcgggcattgtgcccctgcgtcctcagccggcagccttgccgctggacctctgttgttggcattggctctctatccactatctgtcctcttctag

SEQ ID NO: 178680 - DNA, 1575 bp, Artificial Sequence
  Description of Artificial Sequence: Synthetic coding sequence
atgatcagccccttcctggtgctggccatcggcacctgcctgaccaactcattggtgccagaaaaggagaaggacccaaaatattggagagatcaggcccaagagactcttaagtacgcactggaactacagaagcttaacacgaacgtggctaaaaacgtgattatgtttctgggagatgggatgggcgtcagtaccgtgacagccgcacggattttaaaaggacaactccaccataacccaggcgaggagacacgcctggaaatggacaagtttccttttgtggccctgagcaaaacatataacaccaacgcccaggtccccgatagcgctggcacagcaactgcatacctttgcggggttaaagcaaacgaggggaccgtgggggtctccgccgccacagagagaagtaggtgcaataccacacagggcaatgaggttacttctatattaagatgggccaaagatgcaggtaaaagtgttgggattgtcacaaccactagagttaaccatgcgacaccctccgcggcatacgcccactcggctgatcgggattggtactcagacaatgagatgcctcctgaggctctgagccaagggtgtaaggacatcgcatatcagctgatgcacaatattcgcgatattgacgtaatcatgggcggcggccgcaagtatatgtaccccaaaaataaaacagatgtggagtacgagagcgacgagaaagcacgcggaacccgtctcgatggcttggacctggtggatacatggaagtccttcaaaccaagatataagcattcccacttcatatggaaccgtactgagctgttgacgttagaccctcacaacgttgactaccttctgggcctctttgagcccggagatatgcagtatgagctcaatcggaacaatgtgacggatccttccctctctgaaatggttgtggttgctattcaaatcctccgcaagaatccgaagggttttttcctcttggtggagggtggcagaatcgatcatggtcatcatgaaggcaaagctaagcaagcgcttcatgaagcggtcgagatggacagagctattgggcaggccgggagcctgacaagcagcgaagatactctaaccgtggtgacagctgatcatagccacgtgtttaccttcggtggctacacacctcgaggcaattccatattcggtctggctcccatgttgtccgacactgacaagaaacctttcaccgccatcctctacggcaatggacccggatacaaagttgttggaggcgaaagggaaaatgtctcaatggtggattacgcacataacaactatcaagcccagagcgcggtacccctgcgacatgagacgcatggaggcgaagacgtggcagtcttctcaaagggacccatggctcatctgttacacggggtgcatgaacagaactacgtgccccacgtgatggcctacgcagcttgcataggcgcaaatctagggcattgcgctccggcctcttctgctgggtctctggcagccggaccgctgctgttagccctcgccctgtatcccctgagcgtactgttttag

SEQ ID NO: 178681 - DNA, 1575 bp, Artificial Sequence
  Description of Artificial Sequence: Synthetic coding sequence
atgatcagccccttcctggtgctggccatcggcacctgcctgaccaactcactggtacctgaaaaagaaaaggaccctaaatactggcgcgaccaggcccaggaaacgctaaagtacgcactggaacttcaaaagctcaatactaacgtggccaaaaacgtgataatgttcctaggagatggaatgggggtcagcacagtgaccgcagctcgaattttaaaaggtcaattgcaccataaccccggcgaagaaactcgtttagagatggataaattcccttttgtggcattgtctaaaacatataacaccaatgctcaagttccggactcagccgggactgcaaccgcctacctttgcggggtgaaagccaatgagggcactgtgggggtgtctgcagccaccgagcggagcaggtgcaatacgacgcaaggtaacgaggtgacctcaatcctgcgatgggcgaaggacgcagggaagagcgtcggaatcgttacgactacgcgtgtaaatcatgccacaccttccgccgcctacgcccattcagcagaccgggattggtacagcgataacgaaatgccaccagaggccctgtcccagggatgtaaagacatcgcttaccagctgatgcacaacatcagggacatagacgtcataatgggaggcggcaggaagtacatgtatccgaagaacaagacggatgtggagtacgaaagtgatgaaaaggccaggggaactcgattggatggcttggacctcgtcgacacatggaagagcttcaagcctcgctacaagcacagccacttcatatggaacaggaccgagctgctgaccctggatccccacaatgtcgattacctcctcgggttgtttgagccaggagacatgcagtatgagctcaatcgcaataacgtgactgatccatcactgagtgaaatggtcgtcgtagccatacagattctgcgcaaaaaccctaagggatttttcctgctggtggagggcggtagaatcgaccatggccaccatgagggcaaggccaagcaggctctgcatgaagctgtggagatggaccgggcgatcggacaggccgggtccctgacgtcgagcgaggacacactgactgtggttactgccgaccattcacacgtctttacctttgggggctacacaccgcgtgggaacagtatctttggtctggcacctatgctgagtgacacggacaagaagccgttcactgctatcctttacggaaacggccctggctacaaggtggtgggaggagagcgagaaaacgtatctatggtggattatgctcataacaattaccaagcgcaatcagccgttcctctgcggcacgaaacccacggcggagaagacgttgccgtgttcagtaaggggccgatggctcatctgcttcacggagtgcatgagcagaattatgtccctcatgtaatggcgtatgctgcctgcataggtgccaatctcgggcattgcgcacccgcaagcagcgcgggctcgttggcggcaggaccactactgctggctctcgccctttaccctctgagtgttctcttctag

SEQ ID NO: 178682 - DNA, 1575 bp, Artificial Sequence
  Description of Artificial Sequence: Synthetic coding sequence
atgatcagccccttcctggtgctggccatcggcacctgcctgaccaattctctcgtgcccgagaaggagaaggacccaaagtactggcgagaccaagcccaagaaaccctcaagtatgctttggagctgcagaaacttaacacgaacgtggctaagaacgtaataatgtttctgggtgacggaatgggcgtcagtactgttactgccgcaaggattcttaaaggtcaactgcatcacaatccgggtgaggaaactcgattggaaatggataagttccccttcgtagccctgtccaagacatacaatactaatgcacaagttccggatagcgccgggactgccaccgcttacctttgtggcgtgaaggccaatgaggggaccgttggcgtttccgcggcgaccgagcggtcccgctgtaacaccacacagggcaatgaagtgaccagtattcttaggtgggctaaggacgccggtaagagtgtggggatagttaccacgactcgggtgaaccatgccactccctcagcagcctatgcccactctgctgatagagattggtatagcgacaacgaaatgcctccggaggctctgagccaaggatgcaaagacattgcttatcagctgatgcataacatccgggacattgacgtgatcatggggggtgggagaaagtacatgtaccctaaaaacaagacagacgtggagtacgaaagcgatgagaaggctaggggcacacggctggacgggctggatctggttgatacatggaagtctttcaagcccagatacaaacactcacacttcatctggaaccggacagaactactgacattggatccgcacaatgtcgactatctattgggactcttcgagccaggtgacatgcagtatgagctgaaccggaacaacgtgacagacccctccctgtccgaaatggtcgtcgtggccatccaaatcctgaggaagaatccgaagggattcttcctactggtcgaggggggacggatcgatcacggccaccacgaaggcaaggccaagcaggcactgcacgaagctgtggaaatggatagagccattgggcaagctggatctttgacttcctccgaggataccctgactgtggtgactgccgatcattcacatgttttcacattcggggggtacaccccaaggggcaacagcattttcggactggctcccatgctgtctgatactgataaaaagccatttacagcaatactgtatgggaatggacccgggtataaagtggtcggcggagagagggagaatgtttcaatggttgattacgcccataataactaccaggctcagtcggctgttcccttgaggcacgagactcacggaggagaggatgtggctgtgttttcaaaggggccaatggcacacctactgcatggtgtgcacgagcagaactacgtccctcacgtgatggcatacgccgcttgtattggtgctaacctgggacattgcgcccccgcctccagcgccgggagcctggccgccggccctcttcttctcgcgttggccctgtaccccctgagcgttctcttctag

SEQ ID NO: 178683 - DNA, 1344 bp, Artificial Sequence
  Description of Artificial Sequence: Synthetic coding sequence
atgccctggagcttccggagcagcacccccacctggctgcggatgagctcctgctcttgggagatgacctataataccaacgcacaagtccctgattccgctgggactgccaccgcgtacctgtgcggcgttaaggcaaatgaaggtactgtcggagtatcagccgccaccgaaaggtcaaggtgtaacaccacgcaggggaacgaggtgaccagcatcctcagatgggctaaggatgccggcaaaagtgtggggatcgtgacaacaaccagagttaaccacgcaactccaagtgccgcctacgctcacagcgctgaccgggactggtactcagacaacgaaatgccccccgaggctctgagtcaggggtgcaaggacatcgcctatcagctgatgcataacattagggacattgatgtgattatgggcggtggtaggaagtacatgtatccaaaaaacaaaaccgatgttgaatatgagtccgacgaaaaggcccgaggaaccagattggatgggctggacctggttgacacatggaagtctttcaagccaaggtacaagcacagccatttcatatggaaccgaacagaactcctgactctcgacccccacaatgtcgactatcttctagggctgtttgaaccaggggatatgcagtatgaacttaaccggaacaatgtcacagatcctagtctgtcggaaatggtcgtcgtggctatccaaattctacgaaagaacccaaagggcttctttttactggttgagggcggccgcattgaccatgggcaccacgaagggaaggccaagcaggcgttacacgaggctgtggagatggaccgcgccattggccaagcggggtccctgacaagcagcgaggataccctgacagtcgtgaccgcagatcattcacacgtcttcaccttcgggggttatacccctaggggcaattcaatttttggactagcccccatgctgtcagatacggacaagaagccatttacagccatcctgtacgggaatggccctggatataaggtggtggggggggagcgggaaaacgtgtccatggtggactacgcccacaacaactatcaagctcagagtgcggttcccttgaggcacgagacacatggaggggaagacgtcgccgtctttagcaaaggaccgatggctcacctgctccacggcgtacatgaacagaactatgtaccacatgtcatggcatacgccgcgtgtatcggcgccaacctcggacactgcgcacctgccagctccgccggctccctcgccgctgggccgcttcttctggctttagccctttatccgctgagcgtgttgttctag

SEQ ID NO: 178684 - DNA, 1410 bp, Artificial Sequence
  Description of Artificial Sequence: Synthetic coding sequence
atgttcctgggcgacggcatgggcgtgagcaccgtgaccgccgccaggatcctcaagggccagctgcaccataacccaggggaggagaccaggctcgagatggacaaattcccattcgtggccctttccaagacatataatacaaacgctcaggtcccggactcagccgggacggcgaccgcatacctttgtggcgtcaaggccaacgagggaactgtgggtgtttcggccgcaaccgagagatctagatgcaatacaacacagggaaacgaggtgacttccatcttaaggtgggccaaagacgccgggaagtctgtgggtatcgtgaccaccacccgggtcaaccatgcaacccctagtgccgcttatgcccattccgccgaccgcgactggtatagcgacaatgagatgcctcctgaggccctgtcacagggttgtaaggacatcgcctaccagctgatgcataacatccgtgacattgacgtcattatgggaggtgggcgtaaatacatgtatcccaaaaataagacggacgtcgagtatgagtccgacgaaaaggctagaggcaccaggctggatgggctcgacctggtggatacttggaaatcatttaagccaagatataagcatagtcacttcatctggaaccgaactgagctactgactctggatcctcataacgttgactacctcctgggcctctttgaaccaggggacatgcaatacgaactcaatcgcaacaacgtgacagacccctccctctcagagatggttgtcgtcgctattcaaatattgagaaagaatcccaaagggttctttctgctggttgaagggggcaggatcgaccacgggcaccacgaggggaaggcgaagcaggcgcttcacgaagcagtagaaatggaccgggcaattggacaggcgggatcgctgaccagttcagaagatacactcacggtggtgaccgctgaccatagccatgtgtttacatttggtggatacactcccagaggaaacagtatctttggtctcgccccaatgctgtcagatacagacaagaaacctttcacagcaattctctacgggaatggccctggttacaaagttgtgggtggcgaacgagagaacgtgtctatggtcgactatgcgcataataattaccaggcccagtccgcagtgcccctgcgacacgagacacacggcggcgaagacgtggcggtcttttcgaaggggcctatggcacatctgctgcatggggttcacgaacagaattatgtgccgcacgtcatggcctacgccgcttgtattggcgcgaacctgggccattgtgcccctgcctcctctgcgggctcgctggccgcagggccgttactattggcgctagcactgtatccgttgtcggtactcttttag

SEQ ID NO: 178685 - DNA, 1608 bp, Artificial Sequence
  Description of Artificial Sequence: Synthetic coding sequence
atgctgggcccctgcatgctgctgctgctgctgctgctgggcctgcggctccaactctccctggggattattccggtggaagaggaaaaccctgacttctggaatagagaagccgcagaagccttgggcgccgctaagaaactgcagccagcgcagaccgcggctaagaatctcatcatttttcttggagacggaatgggagtatccactgtcactgcagcacgaatcctgaagggacagaagaaagataaactcgggccagagattcctctggcaatggatcgcttcccttatgttgccctttcaaaaacatataatgtggataaacatgtccccgactctggcgcaaccgccacagcatacctatgtggtgttaaaggcaattttcaaacaattgggctgtccgccgctgcgagatttaaccagtgtaataccacccgtggaaacgaggtcatttctgttatgaatcgtgcgaagaaggccggcaaatcggtgggtgtggtgactaccactcgggtgcagcatgcatcgcccgcggggacatatgctcacacagttaaccgcaactggtatagcgatgcagacgtgcctgcgtcagccaggcaggagggctgtcaggacatcgccactcagctgattagcaacatggatatcgacgtgatcctgggtggtggccggaaatatatgtttcggatgggtacacccgatcccgagtatcctgacgattacagccaaggcggaacccgactggatggaaagaatctagtccaggagtggctggcaaagaggcagggcgccagatacgtgtggaatcggaccgaactgatgcaggcctccctggaccctagcgtcacacatcttatgggcctctttgaaccaggcgacatgaagtacgaaatccatagagacagcacattggaccccagcctaatggagatgactgaggccgctctgcgccttctgtcacgaaatcctcgagggttttttctgttcgtggaggggggacgcatcgatcatggccaccacgagtcccgtgcctacagagcgctgacggaaaccatcatgttcgatgacgctattgaaagggctggacagctcacatccgaggaagataccttgagcctggtaaccgcggatcactcccatgtcttcagcttcggaggatatcccttgcgtggctcaagcatcttcgggctggcacctggaaaggctagagatcggaaagcctacaccgtgctgctatacggaaatggtccaggctacgtgctgaaagatggagcccgacctgacgtgacagagagcgaatcagggagtcccgagtacaggcaacaatccgcagtgccattagatgaagagacacacgcaggcgaggatgtggctgtcttcgcccgggggccacaggcccacctggttcatggcgtccaggagcagaccttcatcgctcacgtgatggcctttgccgcgtgcctcgaaccgtacaccgcttgcgacctggctccgcccgcaggaacaactgatgctgctcaccctgggcgatcagtggtcccagcattgctgcctcttctggccggtaccttactcttactggaaacagccaccgcaccatag

SEQ ID NO: 178686 - DNA, 1599 bp, Artificial Sequence
  Description of Artificial Sequence: Synthetic coding sequence
atgcagggcccctgggtgctgctgctgctgggcctgcggctgcagctctccttgggcataattcccgtcgaagaggagaatccggacttttggaacagacaagccgctgaggcactgggggctgccaagaagttgcagcccgcccagacagccgccaagaatctgattatatttctgggcgatgggatgggggtgtcaaccgtcactgctgctagaatcttaaagggacagaaaaaagacaagttaggaccagaaacatttctggcgatggatagatttccttacgtggccctcagcaaaacctacagcgtggacaagcatgtgccagacagcggcgctactgctacagcctacctctgcggtgttaaggggaatttccaaacaattggtttatctgcagcggctcgttttaatcagtgtaacacgacccgcgggaatgaggtgattagtgtgatgaaccgtgcaaaaaaagcaggtaagtcggtcggcgtggttacaaccactagggtgcagcatgcgagtcctgcaggcgcgtacgcgcatacagtcaacaggaattggtactctgacgccgatgtaccagcgagtgccagacaagaaggctgtcaggatattgccactcagctgatctccaacatggatatagacgtcatactgggggggggacgaaaatacatgttcccgatggggaccccagatcccgaatatccagacgactactcacaaggggggactcggctcgatggaaagaacctcgttcaggaatggctcgccaaacaccagggagcccgttacgtgtggaatcgtacggagcttcttcaggcctcacttgacccaagcgtcacccacctgatgggtttgtttgaacctggagacatgaaatacgagatacatcgcgactctacactggatccatccctgatggaaatgactgaggccgccctgctcctcttgtctaggaacccacggggtttttttctcttcgtagagggagggcggatcgaccacgggcaccatgaaagcagagcttaccgggcattgacagagaccataatgttcgacgacgccatagaaagggcaggccagctgacctcagaagaagacaccctctcattggtcactgcagatcatagtcacgttttttcatttggaggctatccgcttcgtggctcctctatttttggcctcgccccaggcaaggcgcgtgatagaaaggcgtacacagtcctgctgtatggaaacgggccagggtacgtgctgaaagacggcgcccggcctgacgtaaccgagtcggagtctgggtccccagaatatcggcagcagtcggctgttcctctggacggcgaaacacacgcgggagaagatgtggcggtttttgcccgagggccacaggcacacctggtacacggtgtacaggagcagacgttcatcgcccacgtgatggcttttgctgcttgtctcgagccttacaccgcatgtgacctagcacctagagcaggcaccacggatgccgctcatcccggcccttccgttgtccccgcgctgctgcctcttctggcagggaccttgttgctgctcggaacagctaccgccccgtag

SEQ ID NO: 178687 - DNA, 474 bp, Artificial Sequence
  Description of Artificial Sequence: Synthetic coding sequence
atggaccggttcctggtgaagggcgcccagggcggcctgctgcggaagcaggaggaacaggagcccactggggaggagcccgcggtattgggcggagacaaggagagcacacgcaaaagacctagacgtgaagctccgggcaacggaggtcacagcgccggcccaagttggaggcatatcagggccgaaggcctagattgcagttatacggtgttattcggtaaggctgaagcagatgaaattttccaggagctggagaaggaagtggagtactttactggcattaaaatggcagtgacaacttcagggtccaccgagatgatgaaagaaaactggccactgggcgctcctctgcccctctctccatccgtgccagctgaaacgctgagcagtggaataaggataccagtggggaaagccccccccggaggctggcgttggagtggctgtaggtggccaaccggggcttattag

SEQ ID NO: 178688 - DNA, 2958 bp, Artificial Sequence
  Description of Artificial Sequence: Synthetic coding sequence
atgatccggcacgccggcgcccccgcccggggcgaccccaccggccctgtgccagtggtagggaaaggcgaggaagaggaggaggaagacggcatgagactgtgtttgcctgccaatcctaaaaattgtctcccacatcgcagaggaatcagcatcctggaaaaactcatcaaaacatgccccgtctggcttcagttatctctgggtcaagctgaggtggcaagaatacttcaccgcgtggttgctggaatgtttcttgttcgccgagacagcagcagtaagcagctggttctctgcgtgcatttcccgtccctgaatgaatccagtgccgaggttctggagtacacgatcaaagaggagaagagcatattatacctggaaggaagcgctctagtgttcgaggatatcttcagactgatagccttttactgcgtgagcagagatttactgcctttcacactaagacttccgcaagccatactcgaggcttcttccttcacagatctggagacgattgcgaacctcgggttagggttctgggacagcagcctcaaccctccacaagaaagggggaagcctgccgagcctcctcgcgatagggcccctgggttcccgctggtgtcttctcttagaccaaccgcccacgacgcaaattgcgcatgcgagatcgagctgtcagtgggaaacgaccgcctgtggttcgtaaatcctattttcatcgaagactgctccagtgccttacccactgatcaacctccgttgggtaattgccccgcacggcctctgcccccaacctccgacgcaacctccccaacttctcggtgggcacctcgccggcctccaccacccccacccgtacttcctctgcaaccctgctcacccgcgcagcccccagtgctacccgcactggccccagcgcccgcatgccccctgcctacatccccaccagtgccggccccgcacgttacaccccacgccccaggcccgcctgaccatccaaaccagccccctatgatgacttgtgaaagactgccatgccccaccgccgggctggggcccctgagggaagaggcaatgaaaccaggcgccgccagcagtcccttgcagcaagtcccagcgcctccactgcctgcaaagaagaacctgcccactgcccctcccaggagacgtgttagcgagcgggtgtcattggaggatcagtccccgggtatggccgcagaaggcgatcagttgtctctaccaccacaaggcacgtctgatggcccagaagacacccccagagagtctactgaacagggccaagacaccgaggtgaaagcttctgacccccatagcatgccagaactgcccagaaccgccaagcaacctcccgttcctccgcccaggaaaaagcgaatcagtcggcaactcgcttcgactctgcctgcccccctcgagaatgctgaactctgcacacaggctatggctctggagacaccgacccccggccctcctagggagggtcagtcaccggcttcacaggcgggtacacagcaccccccagcgcaggctacagcccactcccagagttccccagaatttaagggcagtctcgctagcctctcggactcattgggggtcagtgtgatggcaacagatcaggattcgtactcgacatcaagcacagaggaggagctggagcagttctcttctccgagtgtgaagaagaagcccagtatgatactcgggaaagcaagacatcgtcttagcttcgcatccttctcatcaatgttccacgcgttcctgtccaataatcgcaagctatataaaaaagttgtggagctagctcaggacaaaggctcctatttcggatctttagtacaggattataaggtgtatagtctagaaatgatggctcgccaaacttcttcaacagagatgctgcaggaaatcaggaccatgatgacccagctaaagagctatttactgcagagcacagagctgaaagcgctcgtcgatcccgccctgcacagcgaggaggaacttgaagcgattgtggaatctgccctgtacaaatgtgtgctgaaacccttgaaagaggccattaattcttgcctccatcagattcactctaaagatgggagtctgcagcagctcaaggagaatcagctggtgatcctggccactaccactactgacttgggagtaaccacaagcgtccccgaggttccaatgatggagaagattcttcagaagttcaccagtatgcataaggcctactctcctgaaaagaagatcagtattcttctcaagacgtgtaagttgatctatgacagcatggctcttgggaaccctggcaagccctacggagctgacgacttcttgcccgtcttaatgtatgtgctggcccgcagcaatctcaccgaaatgttactgaatgttgaatatatgatggaactgatggatcccgcccttcagcttggcgagggcagttactacctcacgactacctacggcgcactcgaacatatcaaatcatatgacaagataaccgtgactagacagctctccgtggaagtgcaggacagcatccatagatgggagagaagaagaacactcaacaaagctagagcgtcccgatcaagtgttcaggatttcatctgtgtgtcatatctggaacctgagcaacaagcccgcacccttgcttcgagggcagacactcaggcacaggccctgtgcgcccagtgtgccgagaagttcgccgtggagcggcctcaagcacatagactgttcgttttggtagatggcagatgcttccagttggcagacgatgctcttcctcactgcatcaaaggatatttactgaggtcagaaccgaaacgtgatttccattttgtttacagaccactcgatggagggggcggtgggggcggcggaagcccaccctgtctggtggtgcgagagcccaattttctctag

SEQ ID NO: 178689 - DNA, 786 bp, Artificial Sequence
  Description of Artificial Sequence: Synthetic coding sequence
atggaccggttcctggtgaagggcgcccagggcggcctgctgcggaaacaagaggagcaggagcctactggcgaagaacccgctgtactgggtggcgataaagaatctacacgcaaacgtccacggagagaagctcccggaaacggaggacattcagcagggccgagttggagacacatccgcgccgaggggctggattgcagctatactgtgctcttcgggaaggctgaggctgatgagatcttccaagagctggagaaagaagtggagtattttacaggcgctctggccagggttcaggtttttggcaaatggcatagcgtgccgcgtaagcaagctacctatggggatgccggattgacctacaccttttccggtctaacgctgtcacccaaaccttggataccggtgctggagcggatacgcgatcatgtatcaggggtaaccggacagacgttcaactttgttcttataaacaggtacaaggacggttgcgaccacatcggtgagcacagagacgacgagcgtgaattggcaccaggctctcccatcgcttccgtcagcttcggcgcttgtagagactttgtatttagacataaggactcccgcggcaagagtcctagtcggagagtggccgtggtgcgccttccactggcacacggcagcctgctgatgatgaaccaccctaccaatactcattggtaccactctctgcctgtgagaaagaaagtcttggcgccaagagttaatctcacatttagaaagatcttgctgactaagaagtag

SEQ ID NO: 178690 - DNA, 786 bp, Artificial Sequence
  Description of Artificial Sequence: Synthetic coding sequence
atggaccggttcctggtgaagggcgcccagggcggcctgctgcggaaacaggaggaacaggaaccaactggagaagaaccggccgtgctgggcggagataaggagagcacccggaagcgtcccagacgtgaagcacctggaaacggaggccattcagctggcccctcgtggaggcacatccgcgcagagggcctcgactgctcctatactgtgctgttcggcaaagcggaagcagacgagattttccaggagctggagaaggaggttgagtacttcacaggagccctggcccgtgtccaagtctttggtaaatggcactctgttcctaggaagcaggcgacgtacggcgatgcaggtttgacctacacattttccggcttaaccttgagccctaagccttggataccggtactggaaaggattagagaccatgtctctggggtgactgggcagaccttcaacttcgtcttaataaaccgttacaaggacgggtgtgaccatataggcgagcaccgagatgacgaacgtgagctcgctcccggctcacccatcgcttctgttagcttcggagcctgtcgggactttgtgttcaggcacaaggactcacgcggcaagtcgccttcacggcgtgtggccgtcgtgagactgccgcttgcgcacggatcgctcctgatgatgaatcacccaaccaacacgcattggtaccacagcctgccggtgcgtaagaaagttctggcgccgagagtaaacctcactttcaggaaaatactgctgacgaagaaatag

SEQ ID NO: 178691 - DNA, 786 bp, Artificial Sequence
  Description of Artificial Sequence: Synthetic coding sequence
atggaccggttcctggtgaagggcgcccagggcggcctgctgcggaaacaggaggagcaagagcctactggcgaggagcctgcagtgcttggcggggacaaggaaagtacccgcaagcgtcctagacgcgaagccccaggtaacggcggacattcagcaggacccagctggcggcacatccgggcggagggacttgattgcagctacacagtgctcttcggaaaggctgaagctgacgaaatcttccaggaattggagaaggaggtcgagtattttaccggcgcgcttgctcgagtccaggtttttgggaagtggcattctgttcctcgaaaacaggccacatatggagacgcagggctgacctatacctttagcggactaactcttagtccaaaaccctggatccctgtgcttgaaagaataagggatcacgttagcggcgtcacaggacaaacattcaactttgtgctgatcaataggtataaggacgggtgcgatcatatcggcgaacaccgtgatgacgagagagagctggcgcctgggtccccgatcgcctccgtgtcctttggcgcatgccgggatttcgtctttcggcacaaggattctcgagggaagtccccatctcggagagtggctgtggtgcggctgccgttagcacatggctccctcttgatgatgaaccatcccacaaatacccactggtaccatagtctgcctgtccgtaaaaaagttctggccccacgcgtaaatctgacattccgcaaaatcctgctcacaaaaaaatag

SEQ ID NO: 178692 - DNA, 453 bp, Artificial Sequence
  Description of Artificial Sequence: Synthetic coding sequence
atggaccggttcctggtgaagggcgcccagggcggcctgctgcggaagcaggaagaacaggagcccacgggggaagaacccgctgtgctagggggtgacaaggagtcgaccaggaaaaggccccggcgggaagctcccggtaacggtggacactctgccggcccctcctggcgccatattagggcagaaggactggactgcagttacaccgtcctgttcggaaaagccgaggccgatgagatttttcaggaattagaaaaggaggtggagtacttcactggagccttggcacgtgtccaggtctttggcaaatggcactccgtcccaaggaaacaggccacttatggcgacgccgggctgacctacacattctctggcctgaccttgtctcctaagccctggatacccgtgttagagcgaattcgagatcacgtgagcggcgtgactggatag

SEQ ID NO: 178693 - DNA, 366 bp, Artificial Sequence
  Description of Artificial Sequence: Synthetic coding sequence
atggaccggttcctggtgaagggcgcccagggcggcctgctgcggaagcaggaggagcaggagcctacgggcgaggaaccagccgtgttaggcggcgataaagagagcacaaggaaaaggcctaggagggaggccccagggaatggtggtcactcagcaggaccctcttggcgccacatccgggccgagggactcgattgctcctacacagtgttgtttggtaaggccgaagcagacgaaatatttcaggaactcgaaaaagaggttgaatatttcactggagcccttgccagggtacaggtgttcggcaaatggcacagtgttcctcgcaagcaggctacctatggcgacgctggcttaacctag

SEQ ID NO: 178694 - DNA, 483 bp, Artificial Sequence
  Description of Artificial Sequence: Synthetic coding sequence
atggaccggttcctggtgaagggcgcccagggcggcctgctgcggaagcaagaggagcaggaacccactggcgaggaacctgccgtgcttggcggagataaagagtccactagaaaaagacccagaagggaggccccggggaatggggggcactctgcaggcccaagctggaggcacatcagagctgaggggttagactgctcatataccgttctgttcgggaaggccgaggcagacgagatattccaagaactggagaaagaggtggaatatttcacaggagccctggctagggtgcaggtctttggtaagtggcactccgtgccaagaaagcaggccacatatggagacgctggacttacatataccttctccggtcttactcttagtcccaagccctggatacccgtgttggaaaggatacgggaccacgtgtccggcgtcacaggacagacgttcaacttcgttttgatcaatagatag

SEQ ID NO: 178695 - DNA, 861 bp, Artificial Sequence
  Description of Artificial Sequence: Synthetic coding sequence
atggaggagaagcggcggcgggcccgggtgcagggcgcctgggccgcgcccgtcaaatcacaggcaattgctcaaccggctactactgcaaaaagccatctgcaccagaaacctgggcaaacgtggaagaacaaggagcatcatttgtccgatcgtgaattcgtatttaaagaaccgcagcaggttgttaggagagctccagagccaagagtaatcgatcgggagggggtgtacgagatcagccttagtcctaccggggtctcccgggtttgcttgtacccgggttttgttgatgttaaagaggccgattggatacttgaacagctgtgccaggatgtgccatggaaacaacgcacaggaatccgggaggatatcacctaccagcaacccagattgacagcatggtacggggagctgccttacacgtattcaagaattacaatggaacccaacccacattggcatcctgttctccggacgctcaagaatcgaatcgaggagaatacaggacacaccttcaacagcttgttgtgtaacttgtaccgaaatgagaaggattccgtggattggcattccgacgatgaaccctcattggggcggtgccctatcattgcaagcttgtcttttggagctactagaacatttgagatgaggaaaaaaccaccccccgaagagaatggggactacacctacgtggagcgagtgaagatcccgctagaccatgggacccttctgattatggagggagcaacccaagcggactggcaacatcgcgtgccaaaggaataccactcacgagaaccaagggttaacctgacgttccgcaccgtttaccctgacccccgaggcgctccttggtag

SEQ ID NO: 178696 - DNA, 513 bp, Artificial Sequence
  Description of Artificial Sequence: Synthetic coding sequence
atggaggagaagcggcggcgggcccgggtgcagggcgcctgggccgcaccggttaagtcccaggccatcgctcaacccgctactactgccaaatcccatcttcatcaaaaacccgggcagacctggaaaaacaaggagcatcacttgtcagaccgcgagttcgtatttaaggagccccaacaagtcgtgaggcgggcacctgagccaagagtaatcgaggagggagtgtatgagatttcattgtcacccacgggtgtttccagagtttgtctctaccctggtttcgtggatgtcaaagaggctgactggatcttggagcagttatgccaagacgtgccttggaagcaacggactggcattagggaggactcgatcttgcagctgacgttcaaaaaaagtgcacctgtctctggcacagccacggctccccagtcctgctggtacgagcgaccatcaccaccgcatatccctggccctgccatcttgactcgcacccggctgtgggcaccgtag

SEQ ID NO: 178697 - DNA, 183 bp, Artificial Sequence
  Description of Artificial Sequence: Synthetic coding sequence
atggaggagaagcggcggcgggcccgggtgcagggcgcctgggccgcccccgttaagtcccaagccatcgcccagccggctactacagcgaaatcacacctgcaccagaaaccaggacaaacttggaagaacaaggagcaccatttgtctgacagggaattcgtgttcaaagaaccccagtag

SEQ ID NO: 178698 - DNA, 909 bp, Artificial Sequence
  Description of Artificial Sequence: Synthetic coding sequence
atggccgccgccgccgccgagacccccgaggtgctgcgggagtgcggctgcaagggtatccggacatgtctgatttgcgaacgacagcgtggatcagatccaccatgggagctgcctccagccaagacttaccgctttatttactgcagcgacacggggtgggcagtcgggactgaagagagcgacttcgagggatgggcctttccctttcccggtgtgatgctgatagaggactttgtcacacgggaggaggaggcagaacttgtccgcctgatggaccgggatccctggaaactctcacagtctggccgacgcaagcaggattacggccctaaggtgaactttcgaaaacagaaacttaagaccgaaggcttctgtggcctgccatccttcagccgggaggtggtgagacgaatgggcctctacccgggactcgagggcttccggccagtggagcagtgcaatctggactactgtccagagaggggttcagcgatcgatccccatctggatgatgcttggctctggggagaacgtctggtttctctgaatctgctcagccctacagtcctttccatgtgtcgcgaagcccccgggtccttgctgctgtgtagcgccccttccgccgctcccgaagccctagtggactcagtgattgcaccaagcagatcagtgctgtgccaggaagtggaagtggcaatcccacttcctgcccggtcattgcttgtgttaacaggggctgcgaggcaccaatggaaacatgccatccatcggcggcacatcgaggcccggagggtgtgtgtgacattccgcgaactgagcgcagagttcggtcctggcggaagacaacaagaactgggccaggagttgctcaggatcgccctatccttccaaggacgacccgtctag

SEQ ID NO: 178699 - DNA, 1377 bp, Artificial Sequence
  Description of Artificial Sequence: Synthetic coding sequence
atggccgccgccagcggctacaccgacctgcgggagaagctgaagtccatgacatcgcgcgacaattataaagctggtagtagagaggctgcagcagctgccgctgctgccgtagctgctgcagccgcggcggctgccgccgcagaaccgtaccctgtctctggagccaaacggaaatatcaggaggactcagatccggagagaagcgattacgaagagcagcaactccagaaggaggaggaggccagaaaggtgaagtcaggtataaggcagatgcgccttttctcacaagacgaatgcgcaaagatcgaggcacggatcgacgaggtggtatcaagagctgagaagggattgtacaacgaacacaccgttgatcgtgctccgctccggaataagtatttcttcggggaagggtatacttacggagcccagctgcaaaagaggggacctggacaggagcgtctgtacccacccggcgacgtggatgaaatccctgaatgggttcatcagctcgtcatacagaaactggtggaacacagagtgattcccgaggggtttgtgaacagcgccgtgattaatgactatcagcctggtggctgcatcgtgagccatgtggatcccatccacatttttgagcgaccgatcgtgtcagtgtcttttttcagcgactcagccctgtgctttggctgtaagtttcagtttaaaccaattcgggtgtctgagccggtgttatccttacccgtccggcgaggttcagtcacagtgctgagtggctacgctgctgatgaaataactcattgcattcgtccccaggacatcaaagaaagaagagcggttatcatcctgaggaagacgcgacttgatgcaccgaggctagagactaaatccctaagtagcagcgtcctgcccccttcatatgcgtctgaccggttaagcggtaacaacagagatcctgcactaaaaccaaagcggagccacagaaaggccgaccccgacgcagctcaccgaccgcggatactggagatggacaaggaagaaaatcgtcggtcggtactgcttcctacccaccgtaggcgaggatcattcagttctgagaattattggaggaagagttacgagagctccgaggactgtagcgaagcagcgggcagcccgggcaactcagggtccagccttaggtcctgcccttctttttgtttcgaaggtttcgtgtttgttcactggggcgtgtttgtattctgcttcctgttctttctcattctttatatctttccatggttttgttgtctgcttgggctgaagaatcgtatcggtcaagacttgggatcccacatccttggcattccccctggctggaaaggttgttggcaccagtag

SEQ ID NO: 178700 - DNA, 1185 bp, Artificial Sequence
  Description of Artificial Sequence: Synthetic coding sequence
atggccgccgccagcggctacaccgacctgcgggagaagctgaagtctatgacgagcagggataactacaaagccggatcacgggaggcagcggccgccgccgccgccgcagttgcagctgctgctgccgcagccgccgcagctgagccctaccctgtttccggcgctaaacgcaaataccaggaggatagcgacccagagagatccgactacgaagaacagcagctgcagaaggaggaagaagcacgcaaggtaaagagcgggatcagacagatgcgactgttttcccaagacgagtgcgctaaaatcgaggcacggattgatgaggtggtctctagggccgaaaagggactctataacgagcacacagtggacagagccccactccgcaataagtatttttttggggaaggctatacgtatggcgcgcaattgcaaaagcgaggccctggccaggaacgcctctacccccccggggacgtggacgagattcccgagtgggtacaccagctcgtaatccagaagctagttgagcaccgggttatccccgaaggcttcgtgaattctgctgttatcaatgattatcagccagggggttgtattgtgtcccacgtggatcccattcatatattcgaaagacccattgtgtcagtatcgttcttctcagacagcgctctgtgcttcggctgcaagttccagtttaagccgatccgcgtgagcgagcctgtgctgtctctgcccgttcggcgtgggagcgtaaccgtcctgtccgggtatgctgccgatgagattacccactgtattcgaccgcaggacatcaaggagcggcgtgcggtgattattctacgtaaaactagattagacgcgcccaggctcgagaccaaaagtctgtccagcagcgtgctaccaccgagctatgcttcagaccggctaagtggtaacaacagggatcctgcccttaagccaaaacgatcgcacaggaaggctgaccccgacgccgctcaccgaccacgaatccttgagatggacaaggaggaaaatcgccggtctgttcttctcccgacacacagaagacgggggtcgttttcttcagaaaactattggcgaaaaagttacgagagtagcgaggactgttccgaggctgctgggagcccagccagaaaggtgaagatgaggcgccactag

SEQ ID NO: 178701 - DNA, 1152 bp, Artificial Sequence
  Description of Artificial Sequence: Synthetic coding sequence
atgcggcggtgccggcggccctgccccgccggccggggcgagggcggcggtggacggagccccgccgctgctgcagccgttgcagccgccgcagccgcggcagccgcagctgagccgtaccctgtatccggagctaagagaaaataccaggaagattccgatccagagcgatctgattatgaagagcagcagcttcagaaagaggaagaggcccggaaggtcaagtcagggatcagacagatgaggctgttttcccaggatgagtgtgccaagatcgaagcacggattgatgaagtcgtgtcgagagcagagaaaggtttgtacaatgaacatacagtggaccgggcccccctgcgcaacaagtactttttcggtgaggggtacacctatggcgctcagctccagaaacggggccctggtcaagaacgtttataccctcccggggatgtagacgaaatcccagaatgggttcaccagctggttatccaaaagcttgttgaacaccgagtgatccccgagggtttcgtgaattccgctgtcatcaatgactaccagcccgggggctgtatcgtctcacacgtggatcccatccatatctttgaaaggccaattgtgagcgtgtcttttttcagcgattcagcactgtgctttggatgcaaattccagtttaaacctatcagggtttctgaaccggtcttgagcttgccagtgagaagggggtctgttaccgtcttgtcgggctacgcagctgatgaaatcacacactgcattcgcccacaggacataaaagaaagacgggcagttatcatcctgcggaagacccgactggacgcaccccgactggaaactaaaagcctgtctagttcagtgctgcctcctagctatgcctccgatagactttctggtaataatcgagaccctgccctcaaacctaaacggtctcatcggaaagcagacccagacgccgcacatcgaccacgcattctggaaatggacaaggaggagaatcgtcgatccgtgttgctccccacacatcgcagaaggggaagcttctctagcgagaactactggagaaaatcctatgagagttcagaagattgtagcgaagctgctggcagtcccgccaggaaagtgaagatgcgacggcactag

SEQ ID NO: 178702 - DNA, 717 bp, Artificial Sequence
  Description of Artificial Sequence: Synthetic coding sequence
atggaggagcaggacgcccgggtgcccgccctggagcccttccgggtggagcaggccccaccagtgatttattacgttcctgactttatctccaaggaggaggaggagtatctactgaggcaagtgttcaatgccccaaagccgaaatggacacagctgtccggccgaaaactgcagaattgggggggcctgccccatcctcggggcatggtccccgaacggctgccaccctggctgcaaaggtacgtcgacaaagtgagcaacctttcactgttcgggggtctgccagccaaccacgtgcttgtcaaccaatacctgccaggggagggcataatgccccacgaagacgggccactctactacccaaccgtgagtacaattagcctagggtctcacacagtcctcgacttctacgaacctcggagaccggaagatgatgacccaactgagcaaccacgcccaccaccgaggccaacgacctccttgctgttagaaccccgttccttgctagtgctgcggggtccggcctacactcgccttctgcacggaattgccgctgcgagagttgatgcactggacgccgcaagctctcccccaaatgccgcggcatgcccttcagcccgccccggggcatgtctggttcgtgggacgcgggtttcactgaccatccggagagttcctcgcgtcctcagagccggtctccttcttgggaagtag

SEQ ID NO: 178703 - DNA, 801 bp, Artificial Sequence
  Description of Artificial Sequence: Synthetic coding sequence
atggccggccggggcatgggcatgctgaacctggagatcggcggcgacgctggagggcgtataggatgtaaggaactggttttaatggaagagcaagatgcccgcgttcctgcccttgagcctttcagagtcgagcaggccccacctgtgatctattacgtgcccgatttcatctcaaaagaggaggaggaatatctgctgcgtcaagtgttcaacgctcctaagccaaaatggacccagttgagcggccggaagttgcaaaactggggtgggctgccccatccacgtggcatggtgccagagcggcttcccccctggcttcagcggtatgtcgacaaagtcagtaacttgagtttgtttggcggactcccagctaatcacgttttggttaatcagtacctgcccggagagggaatcatgccacatgaggatggacccctgtactacccaacggtctctaccatcagtctgggaagccatacagtgctggacttctatgaaccacgtagacctgaggacgacgacccgaccgagcaacccagaccccctccccgaccgaccacctccctgctgttggaaccgagaagcctcctcgtgcttcgtggcccagcttacaccaggctcctgcatggaattgcagccgctcgggtcgatgcactggacgcggcctctagccccccaaacgccgccgcctgccccagcgctcgacctggtgcatgtctggtacgcggaacaagagtatcactcactatccgccgagtgccccgtgtgttgagagctggcttactcttgggcaaatag

SEQ ID NO: 178704 - DNA, 717 bp, Artificial Sequence
  Description of Artificial Sequence: Synthetic coding sequence
atggaggagcaggacgcccgggtgcccgccctggagcccttccgggttgagcaggccccgccagtcatttattacgttcccgattttatcagcaaggaggaggaggagtatctgcttcggcaggtttttaatgcccctaagccgaaatggactcagttatctggtaggaaactgcagaactgggggggattgcctcacccccgagggatggtgcctgagagattacccccgtggctgcagcgctatgttgacaaggtctcaaacttgagcctgttcggtggccttcctgccaaccacgtgttggttaatcagtacctgcctggggaaggaatcatgcctcatgaggacgggcctctgtactatcccacggtgtctaccatctctctgggatcacacacagtactggacttttacgagccacgacgtccagaggacgacgaccctacagagcagccccgaccacctcctcgcccgactactagtctgctgttggaacctcgcagtttgttggtgctgcggggcccagcctacacacgtctgttacacggcattgccgctgcgcgggtggatgccctggatgctgcttctagtccaccaaatgctgctgcctgccctagcgcacgcccaggagcttgtctcgtgagggggacacgggtgtcattgacgattcgcagggtgccacgtgtcttacgggccgggttacttctcggcaagtag

SEQ ID NO: 178705 - DNA, 666 bp, Artificial Sequence
  Description of Artificial Sequence: Synthetic coding sequence
atggccggcaccggcctgctggccctgcggaccctgcccggcccctcctgggtgcgcgggagtggaccatctgttctgtccaggctccaggatgcagcggtggtccggccagggttcctgtctaccgctgaggaagaaaccctgtcccgggagcttgaaccggagctgcgccgtagaagatatgaatacgatcattgggatgcagcgattcatggcttccgcgaaaccgagaagtcccgctggagcgaggctagcagggcaattctccagagggttcaggcagcggcattcgggcccggtcaaacactcctgtcgtccgtccacgtccttgatctggaagcgcgcggctatattaagcctcacgtggactctatcaagttttgtggtgctaccattgccgggctctccttgctcagtccgtcagtaatgcggctcgttcatacccaggagcccggagaatggctggagctgctgctggaacccggaagtctctatattctgcgtgggtcggcccgctatgatttctcccacgagatcttacgagatgaagagtcctttttcggcgagcggcgcatccccaggggccgcaggattagtgtcatatgcaggagtttacccgaaggcatgggcccaggggaatcaggccagcctccacccgcctgctag

SEQ ID NO: 178706 - DNA, 1995 bp, Artificial Sequence
  Description of Artificial Sequence: Synthetic coding sequence
atggacagcaaccaccagagcaactacaagctgagcaagaccgagaaaaaattccttaggaaacaaatcaaggccaaacacaccctgttgcgccacgagggcatcgagactgtatcctatgcgacgcagtccttggtggtagcaaatggcggtctgggcaacggagtctccagaaaccaactgttacccgtactggaaaaatgtggcctcgtggacgcgcttcttatgcctccaaacaagccatattcttttgctcgctaccgaacaaccgaagagagtaagcgcgcatatgtgacgctcaatggtaaagaagtagtcgacgatctggggcaaaagatcacactctacctgaactttgtcgagaaagtccaatggaaagagctcagacctcaggcactgccacccggcctgatggtggtggaagaaataatcagcagtgaagaagaaaaaatgttgctagagtctgtagattggaccgaggataccgacaatcagaactcccagaagagtctgaagcacaggcgcgtgaagcatttcggttacgagttccactacgaaaataacaacgtcgacaaggataaacctctgtctggcggcctgccagatatctgtgaatccttcctcgagaaatggctgcgtaaaggctacattaagcataaaccggaccagatgacgatcaaccaatacgagccgggtcaaggaattcctgcccacatcgacacgcattccgctttcgaagacgagattgttagcctgtccctgggaagcgagattgtgatggacttcaagcaccctgacggaatagctgttcccgtgatgctcccacgccggtccttgctggttatgacaggagaatctcggtatctctggacccatggcattacttgtcggaagttcgatactgtacaggcctcagaatccctgaaatccggaatcatcaccagtgacgtgggagacttgaccttgtctaaacgggggcttcgcacctcctttacattcagaaaagtgcgccagacgccatgtaattgctcgtatcctctcgtgtgcgatagtcagagaaaggagactccacccagttttccagaatcagacaaagaagccagtcggctggagcaagagtacgttcatcaggtgtatgaggaaatcgccggccatttctcgagcactaggcacactccctggccccacatcgtcgagtttctcaaggcattgccatccggatccatagtggccgatatcggctgtgggaatgggaagtacctgggtatcaataaagagctctatatgattggctgtgaccggagtcaaaacctagtggacatctgcagagagcgtcagtttcaggcattcgtttgtgacgccctggcagtgcccgtgaggtccgggagctgtgacgcttgcatttctattgcggtaatccaccacttcgcaacagctgagagacgcgttgcagccctccaagagattgtgagacttctcaggccaggcggtaaagctctcatctacgtctgggcgatggagcaggagtataataagcagaagtccaagtacttgagaggcaatcgaaattcccagggcaagaaagaagagatgaactccgacacaagtgtccagcggtcgctagtcgagcagatgcgagacatgggcagcagagacagcgccagttccgtgccacggatcaatgacagtcaggagggtgggtgtaattctagacaggtttccaactctaagcttcccgtgcacgtcaaccggacatctttttattcccaggacgttctggtcccatggcacctgaagggcaaccctgacaaaggtaaaccggtggaacccttcgggccgatcggcagccaggacccctccccagtgttccaccggtactaccatgtttttagagaaggagaacttgagggcgcgtgccggaccgtgtccgatgtgagaatcctgcagtcatactacgatcagggaaattggtgcgttatcctgcagaaagcctag

SEQ ID NO: 178707 - DNA, 2004 bp, Artificial Sequence
  Description of Artificial Sequence: Synthetic coding sequence
atgttcgccatggacagcaaccaccagagcaactacaagctgagcaagacagaaaaaaagtttctcaggaagcagataaaagcgaaacacaccttactcaggcatgagggtattgaaacagtaagttacgctacgcaaagtctggtcgttgctaacggaggcctcggcaatggcgtgagccgcaaccagctactccccgtgttggagaagtgcggactcgtggacgcgctgctgatgccccccaacaagccatacagtttcgcacgctacaggaccaccgaggagtccaagagagcctatgtgactctgaacgggaaagaggtcgtggatgatctaggacagaaaattacgttgtacttgaatttcgtggaaaaagtgcagtggaaagaacttcggcctcaggcactccctccagggctaatggtggtggaggagataatctctagcgaagaggagaaaatgttgctggaaagcgtcgactggaccgaagacacggataaccagaactctcagaaatccctaaaacaccggcgcgtgaagcacttcggctacgagtttcactatgaaaataacaatgttgataaagacaagcccctcagcgggggcctccccgacatctgtgaaagcttcttggaaaagtggctgcgaaagggctacattaagcacaaacctgaccagatgacaattaaccagtacgagcccggtcaaggcattcccgcacatatagacactcacagtgccttcgaggatgagatcgtgagccttagtctgggaagcgagatcgtaatggacttcaagcatcccgacgggatcgcagtgcctgtgatgttgcctagacgctccttacttgtgatgacaggggagtcaaggtatttatggacccacggaatcacttgtcggaaatttgacactgtacaggcctcggagagtctgaaaagtggaattattacaagtgacgttggtgatctgacactatccaagcggggattgaggacatcttttaccttccggaaggtgcggcagactccatgcaactgtagctatccacttgtctgtgattctcaaagaaaggagacacccccaagcttcccagaatccgacaaggaggcctccaggctcgagcaagaatacgtgcaccaggtgtacgaggagattgccggacattttagttccacacgccacacgccctggccccacatagtggagtttctcaaggccctcccctccgggagcattgtcgccgacatcggctgcggaaatggcaaatacctcggtatcaataaggagctctacatgatcggatgcgacaggagccagaatcttgtcgatatctgtagggaaaggcagtttcaggcttttgtctgtgatgccctggccgtcccagtccgatctgggtcttgcgacgcctgtatctctatcgctgtgattcatcactttgctactgccgagcggagagttgccgccctccaggagattgttcgtctgcttcggcctggcggaaaggcattgatatacgtttgggccatggagcaggagtacaataaacaaaaatccaagtatctccgcgggaaccggaacagccagggcaaaaaggaggagatgaatagtgacacctcagtgcaacgcagcctggtggagcagatgagagatatgggatcccgagatagtgcgtctagcgtcccaagaatcaacgacagccaggaaggtggttgcaattctagacaggtgtccaacagcaaactgccagtgcacgtcaacagaaccagcttttactctcaagacgttctggtcccctggcacctgaagggcaatccggataaaggtaagcctgtggaacctttcgggccaatcggttctcaggacccttctccagtattccatcggtactaccatgtgttccgggaaggggagttagaaggcgcctgtagaacagtctctgatgtgcggatcctgcagtcttactatgatcagggtaattggtgtgtcatcttacagaaggcatag

SEQ ID NO: 178708 - DNA, 1995 bp, Artificial Sequence
  Description of Artificial Sequence: Synthetic coding sequence
atggacagcaaccaccagagcaactacaagctgagcaagaccgagaagaagttcctgcgcaagcaaatcaaggcaaagcatactctgcttcgacacgaaggcatcgaaaccgtgtcctacgccacccagtctttggtcgtagctaatggaggcctcggaaatggagtgtccagaaatcagctcctgcctgtgctggaaaagtgcgggctagtcgacgcactcctcatgccccctaataaaccatattcttttgccagataccgtacgaccgaagaaagtaaaagagcctacgtcactcttaacgggaaggaggttgttgacgacctagggcagaaaataactctctatttgaatttcgtggaaaaagttcagtggaaagagctccgaccacaggctcttccacccggcctgatggttgtcgaggaaattatttcctcagaggaggagaagatgcttctcgagagcgtggactggacagaggacaccgataatcagaattcccagaagtccttgaagcataggcgggtgaagcactttgggtacgagttccattatgagaataataacgtggataaggataaacctttgtctggagggctcccagacatctgtgagagcttcctggagaaatggttgcgtaagggctacataaagcacaaaccagaccagatgacaataaatcagtacgagcctggacagggtatccctgctcacatcgacacacattctgcctttgaagatgaaatagtcagcctcagtctgggttctgagattgtcatggattttaaacacccagacggcattgccgttccggtgatgctccctcgtagatcactcctagtcatgacaggggagtctcggtacctttggacccacggaatcacttgtcgaaagttcgacacggtacaagcaagcgaatctctcaagtcaggaatcataacctctgatgtcggcgacctgacgctctcaaaacgggggctgcgaaccagcttcaccttcaggaaggtccggcagaccccctgcaattgctcctaccctctggtatgcgacagtcagagaaaagagactcctccttcctttcctgagtctgataaagaagcctcacggttggaacaggaatacgttcatcaggtgtacgaggagatcgcgggccatttttcgagtacacgccacactccctggccccatatagttgagttcttgaaagcactgccctcagggtcaattgttgcagacatcggatgcgggaacggtaagtatctgggcatcaataaagaactgtatatgattggatgtgacaggagtcagaacctcgttgatatttgtcgcgagcgacagttccaagcctttgtctgtgatgctctggccgtgccagtccgctcaggatcctgtgatgcatgcatctccattgccgtgattcaccatttcgctactgccgaacgcagagtggccgcgcttcaggagatcgtccgactgctgcgtcctggaggcaaggctctgatctacgtttgggctatggagcaggagtataacaaacagaaatctaaatacctgcgaggtaaccgcaacagccaggggaaaaaagaggagatgaactccgacactagtgtgcagagaagcctcgtcgaacaaatgagggacatggggagtcgtgacagtgccagctctgtgccgcgcattaatgattcacaggaggggggctgtaacagcaggcaggtgagtaactccaaattgcctgtccacgtgaatcgaacgagtttttacagccaggatgtcctcgtcccttggcatctgaaggggaacccagataaagggaaaccagtcgagcccttcgggcccattgggtcacaagaccccagccctgtctttcacagatactatcatgtgtttcgggaaggtgaactggagggtgcctgccgaacggtgtctgatgtcaggatcctgcagtcctattatgaccaaggcaactggtgcgtgatcctgcagaaggcatag

SEQ ID NO: 178709 - DNA, 675 bp, Artificial Sequence
  Description of Artificial Sequence: Synthetic coding sequence
atggacagcaaccaccagagcaactacaagctgagcaagaccgagaagaaatttctccgcaagcaaatcaaggccaagcataccttactccgccacgagggcattgagaccgtctcatatgcaacacagagcctggtggtggcgaatggaggactggggaatggggtgtctcggaaccaactcttgcctgttctcgagaagtgtggcctggtagatgcactgctcatgccgcccaacaagccttactcttttgctcggtaccggaccaccgaggaatcgaaacgggcctacgtcactctgaacggcaaagaggtcgtggacgacctggggcaaaagattactctctacctaaatttcgtcgaaaaagtccagtggaaggagctgagacctcaggcgctgcccccagggttgatggttgtggaagaaataattagctcagaggaggagaaaatgctgctggagtctgtagactggaccgaagatacagacaaccagaatagccagaagtctctgaagcaccgtagggtcaagcattttgggtatgagttccactatgaaaataacaacgtggacaaggacaagccactcagtgggggcctgcctgacatctgcgagtcctttctggagaagtggctgcgcaaggccgagaaaaacctggaggtgggaattcactag

SEQ ID NO: 178710 - DNA, 1338 bp, Artificial Sequence
  Description of Artificial Sequence: Synthetic coding sequence
atgaagaaccccgaggcccagcaggacgtgagcgtgagccagggctttcgcatgctgttctacacgatgaaaccctctgagacttccttccagaccctcgaagaagtaccagactacgtcaaaaaggcaacgcctttcttcatttcactgatgctgctcgagttggtggtcagctggatccttaagggcaaaccacccggccgcctggacgatgccctaacctccatctctgccggagtgctcagtcgcctgcctagcttgttctttagatcaatcgaattaacatcgtacatatacatttgggagaactatcgcctttttaatctgccttgggacagcccttggacgtggtactcggcttttctgggtgtagatttcggctattactggttccatagaatggcgcatgaggtcaatatcatgtgggccggacatcagacgcaccatagcagcgaagactacaatttgtctactgcccttcgccagtccgttttgcagatttatacgagctggatcttctacagtcccctggcattgttcatccctccctccgtgtacgccgttcatttacagttcaacctgctctaccagttttggatacatactgaggtgataaacaacctgggcccccttgaactgatcctaaatacccctagtcatcatagagttcaccacggtagaaatcggtattgtattgacaaaaactatgccggcgtcctgatcatttgggataaaatatttggtacctttgaggcggaaaatgagaaggtggtatacggcctgactcaccctatcaatacctttgagcctattaaggttcagttccaccatttattttctatctggaccacgttctgggcaacaccgggattctttaataaatttagtgtcatctttaagggaccagggtggggccccggcaagcctcgactagggctaagcgaggaaatccctgaagtgacgggtaaggaagtgccctttagttcctcatcgagtcagctattaaagatctacaccgtagtccaatttgccttgatgctggcattttacgaggaaacctttgctgataccgcagctttgagccaggttacactcctgctgcgtgtgtgttttatcatccttacactgacctccatcgggttcttgttggaccagcgacctaaagcagccataatggagaccttacgctgcctaatgttcttgatgttgtaccgctttgggcatctgaaaccattggtgccaagcctgagtagcgccttcgaaattgtcttctctatttgcatcgcattttggggggttcgctccatgaagcagctgacctcacacccttggaagtag

SEQ ID NO: 178711 - DNA, 1977 bp, Artificial Sequence
  Description of Artificial Sequence: Synthetic coding sequence
atggccgaggccgccgccgccgccggcggcaccggcctgggcgccggcgcctcctatggatccgccgcggaccgggaccgggaccctgatccagacagagcgggcaggagattgagagtgcttagcgggcatttactggggcgtccccgggaggcattgtccactaatgaatgcaaggcgaggcgcgctgcttcagcagccaccgccgctcctacagccactcctgcagcccaggagtccgggaccattcctaaaaaaagacaggaagtcatgaaatggaatggctggggctacaacgattctaagttcatcttcaataagaaaggacagatcgagctaacaggaaaacgatatccgcttagcgggatgggcctgcccacttttaaggaatggatccagaacactctgggtgtaaatgtggaacataaaacaacaagcaaggcctctctgaaccccagtgatacaccgccatctgtggtcaatgaggattttttgcatgacctgaaggagaccaacatcagttattcacaagaggcagacgatcgagtgtttcgagctcatggccactgcctgcatgaaatctttctgctcagggaaggtatgttcgagcggattcccgacatagtcttgtggcctacgtgccatgatgatgtcgtcaagattgtcaatctagcctgtaaatataatctgtgtatcatcccaattgggggtggcaccagcgtcagttatggtcttatgtgcccagccgacgaaacgaggactatcatctcacttgacacttcccagatgaacaggatcctgtgggtggatgaaaataatctgacagcacacgtggaggccggcatcactggacaggagcttgagcggcagctcaaagaatccggatactgcaccgggcatgaacccgactcacttgaattttctacagtgggagggtgggtctccactagagctagtggcatgaagaagaacatctatggcaatatcgaagatctggtggtgcacattaagatggtaactcctcggggaattatcgagaagtcatgccagggcccgagaatgtctacgggaccggatatacaccatttcatcatgggcagcgaagggacgctgggggtgattactgaagcgaccattaaaatcagacccgtccctgagtaccagaagtacggatccgtagcctttcccaacttcgagcagggggtagcctgcttgcgggaaattgctaagcagaggtgcgcgcctgcgagcatcagactaatggataataagcaattccaattcggacacgcccttaagcctcaagtttcaagtattttcacttcattcctggacgggcttaagaaattctatatcacaaagtttaaagggtttgacccaaatcaactgtcggtcgccactcttttgtttgaaggcgacagagagaaggtgctacagcacgagaagcaggtctacgatattgccgcgaaattcgggggcctggcagcaggcgaggacaacggccagcgcggctatctcctcacttatgtaatagcatatatccgggatctggctttggaatactacgtgttaggcgaatctttcgagacatccgccccctgggacagggtcgtggatttatgtaggaatgtgaaggagaggatcacaagagagtgtaaggagaaaggggtccagttcgcccccttcagcacctgcagggtaacccagacctacgacgctggcgcatgtatttatttttatttcgcttttaattacagggggatcagcgacccattgaccgttttcgaacaaacggaagcagccgcccgggaagaaatcctagccaatgggggaagtctgagccatcaccacggggtggggaagttgcgcaaacagtggttaaaggaatcaatcagcgacgtgggcttcggcatgcttaaatctgtgaaggagtacgtggatccaaataatattttcgggaatagaaacctgctctag

SEQ ID NO: 178712 - DNA, 966 bp, Artificial Sequence
  Description of Artificial Sequence: Synthetic coding sequence
atggaccccaagtacccctggagcaagtgcggccacaagaccacctccaaagcctctctgaacccttctgatacaccacctagcgtcgtaaatgaggacttcttgcacgatctcaaggaaacaaatattagttactcacaggaagcagatgaccgagtttttcgcgcccacggccactgcctccacgaaatttttctcctgagggaggggatgttcgaaagaatacccgacattgtcttgtggcctacctgtcacgacgatgtggtgaaaatcgtgaatcttgcctgtaaatataacttgtgtatcattcccatcggaggaggcaccagcgtttcttacggcctcatgtgccccgccgatgagactcgtacaattatttcactagacacaagccagatgaatcggattctgtgggtcgacgagaataatctaaccgcacatgtggaagctggcatcacgggtcaagagttagagcggcagcttaaagaaagtggctactgcaccgggcatgagccggatagcctggagttttccactgttggaggatgggtgtctacaagagcgtctggtatgaaaaagaatatttatggtaatatcgaggacctcgtggtgcacatcaaaatggtcactccgaggggaattattgagaagtcatgccagggccctagaatgtcaactggtcctgacattcaccattttatcatggggtctgagggcactctgggagtgatcacggaggcgactatcaaaattaggcccgttcctgagtaccaaaaatacggtagcgttgcctttcctaatttcgaacagggcgtcgcctgcttgcgtgagattgcaaaacagcgatgcgccccggcttctatccgcctgatggataataagcagtttcagtttggacacgcacttaaaccacaggtaagttctatatttaccagctttctggacggcctaaaaaaattttattag

SEQ ID NO: 178713 - DNA, 1176 bp, Artificial Sequence
  Description of Artificial Sequence: Synthetic coding sequence
atggacatggccagcgagagcgtgggcggcaagatcctgttcgccaccgatgactttttcgctccagcagaaaatcttatcaagtccgacagtccatgcttcaaagagcacgaatacaccgaatttggaaagtggatggatggatgggagacaagacggaagcgaatccctggacacgactggtgtgtgctgcgtctaggaatccaaggcgttataaggggcttcgacgtcgatgttagttactttacgggagactacgcgcccagggtttctatccaagccgcaaacttagaagaggacaagttgccggagatcccagagcgaggaactcgcacaggtgctgccgcaacaccagaagagtttgaggccattgccgagctgaaatccgatgattggtcatacctggtgcctatgaccgagctaaaacccggaaatccagcaagcgggcacaactacttcctggttaatagccagcagcgctggacccacatcagactgaacatcttcccggatggtggcatcgcccggctccgcgtttttggaaccggacaaaaagattggacagcaactgacccaaaagaacctgcagatctggtggctatcgccttcgggggagtgtgcgttgggttctcaaatgctaaatttggccatcccaacaacataatcggcgtggggggtgctaagtctatggcggatggctgggaaacggctaggcgccttgatcggccacctattctggaaaatgatgagaacggcattcttttggtccctgggtgtgaatgggccgtattccgcttagctcacccgggcgtcataactagaatcgaaatcgacacaaagtatttcgaaggaaatgcacccgattcctgcaaggttgacggctgcattctgactactcaagaggaagaggccgtgatcaggcaaaaatggatactgcctgcccacaagtggaaacccctgttgccagtgaccaagctaagtcccaaccagtcacatctattcgactctctcacacttgagttgcaagacgtgattacacacgcccggctgaccatagtacccgatggtggcgtgtcccgcttgcgactacgcggatttccttctagcatctgcttgctacggcccagggagaaaccaatgctgaagttttctgtgagctttaaggccaacccatag

SEQ ID NO: 178714 - DNA, 486 bp, Artificial Sequence
  Description of Artificial Sequence: Synthetic coding sequence
ggccggaaggccagcgagaagaccggcggccgggagggcgagcccgccgatagaggtttacagctgggaggaaaagcttttgggctcttaaaagctcagcaggaggaaaggctggacgaaattaacaagcagtttttggacgacccaaagtacagcagtgacgaagacctaccttctaaactcgaagggtttaaagagaaatatatggagtttgacctgaacggaaatggcgacatagatattatgagcttgaaacggatgctggaaaagcttggggtacctaaaacacacctcgagctaaagaaactgattggagaagtctcgagcggctccggagagacattctcctatcccgactttctgagaatgatgcttgggaagcgtagtgccatcctgaagatgattttgatgtacgaggagaaagcccgtgagaaagagaagccaacaggaccccccgccaagaaggctatctccgagctgccgtag

SEQ ID NO: 178715 - DNA, 282 bp, Artificial Sequence
  Description of Artificial Sequence: Synthetic coding sequence
atggagttcgacctgaacggcaacggcgacatcgacatcatgagcctcaagcggatgcttgagaagcttggcgtgcctaaaacgcatctggagctgaaaaagcttattggagaagtctcaagcggaagcggggagaccttctcttatcccgacttcctgcgcatgatgctaggcaagcggagcgcaatcctgaagatgatccttatgtacgaggagaaagcaagagaaaaggagaaaccaaccggaccaccagctaaaaaggctatatccgaacttccatag

SEQ ID NO: 178716 - DNA, 444 bp, Artificial Sequence
  Description of Artificial Sequence: Synthetic coding sequence
atgagccagacccgggacctgcagggcggcaaggccttcggcctgctcaaagctcagcaagaggagcgattggatgaaatcaacaagcagtttctcgatgaccccaagtatagcagcgatgaagaccttcccagtaaattggaggggtttaaagagaaatacatggagttcgaccttaatggcaatggggatatagatatcatgagcctcaaacgaatgctggaaaagcttggggtgcctaaaacccatctggagctgaaaaagttaatcggcgaggtctcttctggctcaggagagacttttagctaccctgatttcctgagaatgatgctcggaaaacgctccgctattcttaagatgatccttatgtacgaggagaaagcaagggaaaaggagaagcctactgggccgcccgccaaaaaggcaatcagcgaactcccttag

SEQ ID NO: 178717 - DNA, 282 bp, Artificial Sequence
  Description of Artificial Sequence: Synthetic coding sequence
atggagttcgacctgaacggcaacggcgacatcgacatcatgagcctgaaacgaatgcttgaaaagctgggcgtccctaagactcatctggaactcaaaaagctcattggcgaggtaagttcaggaagcggggagaccttttcctatcctgattttctgcgcatgatgctggggaaaagatccgcgatcctgaagatgatcttaatgtatgaagagaaagctagagagaaagagaaacccactggccccccagccaagaaagccatctcagaactcccgtag

SEQ ID NO: 178718 - DNA, 444 bp, Artificial Sequence
  Description of Artificial Sequence: Synthetic coding sequence
atgagccagacccgggacctgcagggcggcaaggccttcggcctgttaaaagcacagcaggaggaaagactggacgaaatcaataagcaattcctggacgatccaaagtattcctctgatgaggatttgccctctaagctagaaggctttaaggagaagtatatggaatttgaccttaatgggaacggtgatattgatattatgagtcttaaacgcatgctggagaagctgggagtgccgaagacccatctggagctgaagaagctgatcggagaagtctcttctggcagtggggagacgttctcttatccagactttcttcgcatgatgttgggaaagcggagtgccattttaaagatgatcttgatgtacgaagaaaaggctcgggaaaaagagaaaccaaccggcccccccgcaaagaaggccattagcgaactcccatag

SEQ ID NO: 178719 - DNA, 486 bp, Artificial Sequence
  Description of Artificial Sequence: Synthetic coding sequence
ggccggaaggccagcgagaagaccggcggccgggagggcgagcccgcggacagaggtttgcagctaggaggcaaggccttcggactgctgaaagcacaacaggaagaacgccttgacgagatcaacaagcagtttcttgatgaccctaagtacagttcggacgaagacctgccaagtaagttggaaggcttcaaggaaaagtatatggagtttgatctcaacggcaacggcgacatcgatatcatgtcactgaagcggatgctggagaaactgggagtcccgaaaactcacttagagctcaagaagctgatcggcgaagtgtcttccggtagcggagaaacctttagctacccggacttcctgaggatgatgctcggcaagcggagcgcaattcttaaaatgatcctcatgtacgaagagaaagcacgcgagaaagaaaagcctactgggccacccgccaaaaaggccattagcgagctgccatag

SEQ ID NO: 178720 - DNA, 444 bp, Artificial Sequence
  Description of Artificial Sequence: Synthetic coding sequence
atgagccagacccgggacctgcagggcggcaaggccttcggcctgctcaaagctcagcaggaagagagactggatgagatcaacaaacagtttctagatgaccctaaatatagttccgacgaggacctgccctccaagctggaaggcttcaaggaaaagtacatggagttcgaccttaatggaaatggtgatatcgatataatgtcattgaaaaggatgctggaaaagctcggggtgccaaagacccacctggagctgaagaagctcattggcgaggtgagcagcggttctggggagacatttagttatccggactttctgcgaatgatgctgggcaaacggagtgctattctgaaaatgattctgatgtatgaggaaaaggcgagggaaaaggaaaagcctacggggccacctgctaaaaaggcaattagcgagctgccatag

SEQ ID NO: 178721 - DNA, 444 bp, Artificial Sequence
  Description of Artificial Sequence: Synthetic coding sequence
atgagccagacccgggacctgcagggcggcaaggccttcggcctgctgaaggcacaacaggaggagcgcctcgacgagataaataagcagttccttgatgaccccaagtactctagtgatgaggatctgccatccaagttggaggggtttaaggagaagtatatggaattcgaccttaacggtaatggggatattgatatcatgtcattgaaacggatgcttgagaagctgggcgtaccaaagacccaccttgagctaaagaagttgattggagaggtttccagtgggagcggagaaactttctcttatcctgatttcctgagaatgatgttaggaaaaaggagtgctatcctcaagatgatcttaatgtacgaagagaaggcgcgagaaaaggagaaaccgaccgggcccccagcaaaaaaagcaataagtgaactgccttag

SEQ ID NO: 178722 - DNA, 282 bp, Artificial Sequence
  Description of Artificial Sequence: Synthetic coding sequence
atggagttcgacctgaacggcaacggcgacatcgacatcatgagcctgaagcgcatgctcgaaaaactgggcgtcccaaagactcacctcgagttaaagaaactcatcggcgaagtttcgagtggtagtggagagactttttcttatcctgatttcctgcgcatgatgctgggcaaacgctcagcaatcctgaagatgatcctaatgtacgaggaaaaagcacgtgagaaagaaaagcctaccggtccacctgctaagaaagcaatctccgagttgccttag

SEQ ID NO: 178723 - DNA, 282 bp, Artificial Sequence
  Description of Artificial Sequence: Synthetic coding sequence
atggagttcgacctgaacggcaacggcgacatcgacatcatgagcttgaaaagaatgctggagaagcttggagtgccaaagacgcatttggaactaaaaaaattaataggggaggtgtcctctggctccggtgaaactttttcttacccagacttcctccgtatgatgctgggaaaaaggagcgctatccttaaaatgatcttaatgtatgaggaaaaggcccgcgaaaaggagaagcccactggacctcctgctaaaaaagcaatttcagaactaccctag

SEQ ID NO: 178724 - DNA, 486 bp, Artificial Sequence
  Description of Artificial Sequence: Synthetic coding sequence
ggccggaaggccagcgagaagaccggcggccgggagggcgagcccgccgaccgcggactgcagctgggcggtaaggcctttggacttcttaaggctcaacaagaagaacgattggatgaaattaacaagcagtttctggacgaccctaagtatagtagtgacgaggacctcccatccaagcttgagggtttcaaggaaaagtatatggaatttgatctgaacggtaacggagacatcgacatcatgtctctcaagcgcatgctggagaagctgggtgtccccaagacgcacctggaactgaagaaactcattggtgaggtatcttctggctccggcgagaccttttcataccccgattttctaagaatgatgctcgggaagcggtccgccattctgaagatgatacttatgtacgaagaaaaggccagagaaaaagaaaaacccaccgggccacctgcaaagaaggccatttctgagctgccatag

SEQ ID NO: 178725 - DNA, 282 bp, Artificial Sequence
  Description of Artificial Sequence: Synthetic coding sequence
atggagttcgacctgaacggcaacggcgacatcgacatcatgagccttaagcgcatgttggagaagttaggagtgcctaagacccacctcgaactcaagaaactcatcggagaggtctcatctggctcaggggagacattttcctaccccgattttttgaggatgatgctaggaaagcgctcagccatcttgaaaatgatcctcatgtatgaggaaaaggcccgcgagaaagaaaaacctactggccctcctgctaaaaaagccatttctgagctaccatag

SEQ ID NO: 178726 - DNA, 282 bp, Artificial Sequence
  Description of Artificial Sequence: Synthetic coding sequence
atggagttcgacctgaacggcaacggcgacatcgacatcatgagcctcaaaaggatgttagagaagctgggagtgcctaaaacacatctggagctgaagaagctgattggagaggtcagcagtggcagcggagaaacattctcttacccagacttcctcaggatgatgctaggcaagcgatccgccattctaaagatgatcctgatgtacgaagagaaggctagagagaaggaaaagcctaccggcccccctgctaaaaaagcaatctctgaactgccttag

SEQ ID NO: 178727 - DNA, 444 bp, Artificial Sequence
  Description of Artificial Sequence: Synthetic coding sequence
atgagccagacccgggacctgcagggcggcaaggccttcggcctgctcaaggcacagcaggaggagaggctcgatgagataaataagcaattccttgacgacccaaagtattcctctgacgaggaccttcccagtaagctggaaggcttcaaggagaagtacatggaattcgacttgaacggcaacggcgatattgatattatgagtcttaaaagaatgctagagaagctaggagtgcccaagacacacctcgaacttaaaaagctcatcggagaggttagttccgggagcggtgagaccttttcgtaccccgattttctgaggatgatgttgggcaaacggagtgccattctgaaaatgattctgatgtatgaggaaaaagctagggagaaggagaaaccaactggacccccggccaagaaggccataagtgagctcccatag

SEQ ID NO: 178728 - DNA, 486 bp, Artificial Sequence
  Description of Artificial Sequence: Synthetic coding sequence
ggccggaaggccagcgagaagaccggcggccgggagggcgagcccgccgacagaggactccagctcggcggcaaggcattcggacttctcaaagcgcagcaggaggagcgtcttgatgagataaacaaacaatttttagacgatccaaaatattcgagcgatgaggacttgcctagtaagctggagggcttcaaggagaagtacatggaattcgatctaaacggcaatggggacatcgatattatgtcactgaaacgcatgctcgagaaattgggtgttccaaaaacccaccttgaattaaaaaaactgattggtgaggtctcctctggcagcggcgagacttttagttatcctgattttctcaggatgatgctcggaaaaagaagcgccattcttaagatgattctgatgtacgaggaaaaagcaagagaaaaggagaagccaactggcccccccgcgaaaaaggcaatcagcgaattaccatag

SEQ ID NO: 178729 - DNA, 444 bp, Artificial Sequence
  Description of Artificial Sequence: Synthetic coding sequence
atgagccagacccgggacctgcagggcggcaaggccttcggcctgttgaaggctcagcaggaagaaaggcttgacgagatcaacaagcagttcctggacgatccgaaatattcctccgacgaagacctgcctagcaaacttgagggattcaaggagaagtacatggaatttgatctcaatggaaatggagatatagatattatgtcactgaagcgaatgctagaaaaactaggagtgcccaaaactcacctagagctgaaaaagttaattggagaagtatcctccggaagcggtgaaaccttttcatatcccgactttctgagaatgatgttgggcaaacgaagtgcgatcctgaaaatgattctgatgtatgaggaaaaagctagagaaaaggaaaagcctaccggccctcccgccaagaaggccattagtgaactgccatag

SEQ ID NO: 178730 - DNA, 486 bp, Artificial Sequence
  Description of Artificial Sequence: Synthetic coding sequence
ggccggaaggccagcgagaagaccggcggccgggagggcgagcccgccgaccgcggcttacaattgggcggaaaagccttcggtctgctgaaagcccagcaggaagaaagacttgatgagatcaacaagcagttcctggatgatccgaaatatagttcggacgaagacctgccgtccaagctggaggggttcaaggagaagtacatggaattcgatctcaatgggaatggggacattgacattatgagtttgaagcgcatgctggaaaaactcggcgtaccaaagactcatcttgaacttaaaaaactgatcggggaagtctcgtcgggatcaggggaaactttctcatacccagatttcctgagaatgatgctgggtaaacgcagcgccatccttaagatgattctcatgtatgaagagaaagcccgtgagaaagagaaacctacaggtccgcccgctaaaaaggcaatttctgagctcccatag

SEQ ID NO: 178731 - DNA, 486 bp, Artificial Sequence
  Description of Artificial Sequence: Synthetic coding sequence
ggccggaaggccagcgagaagaccggcggccgggagggcgagcccgctgaccgcggactgcagctgggaggtaaggcatttggattacttaaagcacagcaagaagaacgtttggatgagatcaacaaacagttcctagatgaccccaagtacagcagtgatgaagatctgcctagcaagttagaaggattcaaagagaaatacatggagttcgacctaaatggcaacggtgatatcgatattatgtccttgaaacgtatgcttgagaagctcggtgtgcctaaaacccatttggaactgaaaaagctgatcggggaggtgagctctgggtccggcgagacattttcctaccccgatttcctgagaatgatgctgggcaaacgcagcgcaatacttaagatgatcttaatgtacgaggaaaaggccagagaaaaggagaagccaacgggtccaccagccaagaaggctatctccgaactgccatag

SEQ ID NO: 178732 - DNA, 282 bp, Artificial Sequence
  Description of Artificial Sequence: Synthetic coding sequence
atggagttcgacctgaacggcaacggcgacatcgacatcatgagcctgaagaggatgcttgagaagctgggagtgccaaagactcatctggaattaaagaaactgattggcgaggtgagctctgggtcgggcgaaacattcagctatcccgattttttacggatgatgctgggtaagaggtctgcgatcttaaagatgatcctgatgtatgaagagaaggcaagggagaaggagaagcctacgggtccaccagctaagaaggcgatttctgagcttccatag

SEQ ID NO: 178733 - DNA, 1062 bp, Artificial Sequence
  Description of Artificial Sequence: Synthetic coding sequence
atgagcaagccccccgacctgctgctgcggctgctgcggggcgccccacgacaacgggtgtgtactcttttcatcatcggctttaagttcacattcttcgtttctattatgatctattggcatgtcgtcggggagcccaaggagaaagggcagctgtacaatcttcccgccgaaataccatgtcctacccttacccccccaacacctcccagccacggacctacacctgggaacatcttcttcctcgaaacatcagatcggacaaatccaaactttctgttcatgtgctctgtggagtccgcggctcgcactcaccccgagtcccacgtactcgttcttatgaaaggcctccctgggggtaatgcttcacttcccaggcacttaggaatctcgctgctttcttgttttcccaatgttcagatgttgcccctcgatctgcgtgaactatttagggacacacccctggccgactggtacgctgccgtccagggacgctgggaaccatacctgctgcctgttctcagcgatgcatctcggatcgctctcatgtggaagtttggcgggatttatctggacacggatttcattgttctaaagaacctgaggaaccttaccaatgtactcggcacacagagtaggtacgtcctcaacggagccttcctggccttcgagcgaaggcatgagtttatggccttgtgtatgcgggattttgtggaccattacaacggttggatttggggccaccaggggcctcagctgctgaccagggtgttcaagaagtggtgttccattcgttcgttggcggagtcccgggcgtgccgcggagtcactactctgccccctgaagcattttatccaataccgtggcaggactggaagaaatactttgaagatatcaatccagaagaactgcccagactcctttcagccacttatgcagtacacgtctggaataaaaaatcacaaggtactcgctttgaagccacctcacgtgcactgctggctcagttgcacgcgcgatattgtcctactactcatgaggcaatgaagatgtatttgtag

SEQ ID NO: 178734 - DNA, 1062 bp, Artificial Sequence
  Description of Artificial Sequence: Synthetic coding sequence
atgagcaagccccccgacctgctgctgcggctgctgcggggcgccccaaggcagcgggtgtgtacgttatttatcatcgggttcaaattcaccttcttcgtgagtattatgatctactggcacgtggtgggcgagcccaaggaaaagggacagctgtataatttgcctgcagagataccatgtccaaccctcacacctccaactccaccttcacacggcccgacccctggtaacatcttctttctggagacaagcgataggaccaatcccaattttttgttcatgtgcagcgtggaatccgcagcacgcactcaccccgagtctcatgtgctggtgcttatgaagggcctgcctggcggcaacgccagcctgcccaggcacctggggatatccttgctctcttgctttcctaatgtccagatgcttccacttgaccttcgggaactttttcgcgatactcccctggccgattggtatgccgctgttcagggccggtgggagccttatctgcttccagtgctcagcgacgcgagccgaattgccttaatgtggaaattcgggggtatatacctggataccgattttattgtgcttaagaacttgcgcaatctgactaacgtcctgggtactcaatcgagatacgtgctcaatggtgcgtttcttgcttttgagagacgacacgagtttatggctttgtgtatgcgcgatttcgtcgatcactataatggctggatttggggccaccaaggaccccagctgctgacacgcgtttttaaaaagtggtgcagtattcgctccctggccgagagtcgggcctgtagaggcgtcactacattgcctccagaggctttctaccccattccctggcaggactggaagaaatactttgaggacatcaatccagaagagctgcctcggctgctgagtgccacatacgccgtgcacgtttggaacaagaagagtcaggggaccagatttgaggccacttcacgtgcccttttggcccaacttcacgcgcggtattgtcccacgacacacgaggctatgaagatgtatctgtag

SEQ ID NO: 178735 - DNA, 1062 bp, Artificial Sequence
  Description of Artificial Sequence: Synthetic coding sequence
atgagcaagccccccgacctgctgctgcggctgctgcggggcgccccacgacagagggtctgtaccctgttcatcatcggcttcaagttcaccttcttcgtgagcataatgatttactggcacgtggtgggcgaacctaaagaaaaggggcagttgtacaatctccctgcagagattccctgtcccaccctcaccccaccgacacccccctctcacgggcccaccccaggcaacattttctttttggagactagcgacaggacaaaccccaacttcctgtttatgtgctccgtcgagagtgccgccaggacacaccctgaatcccatgtcttagtgctcatgaagggcctgcccgggggcaatgcatccctgccaagacacctgggaatctcattactgtcgtgtttcccgaacgtccagatgctaccacttgatcttagagaactgtttcgcgacactcctctggccgattggtatgcagccgtacagggacggtgggaaccatacctgctccctgttttgagcgacgcttctcggattgcacttatgtggaagttcggtggaatctaccttgacacagactttatagtgcttaagaacctgcgaaatctaacaaatgttctgggtactcagagcaggtacgtgctgaatggcgcatttttggccttcgagcgcagacacgagttcatggccttatgcatgcgagacttcgtggatcactacaatggctggatttggggacaccaaggcccacaactgttgacgcgtgtctttaaaaaatggtgttctatccggtctctcgcagagtctcgcgcctgccggggggtcacaaccctgcccccagaggccttctatcccatcccctggcaggactggaaaaaatacttcgaagacatcaaccccgaagaacttcccaggctactgagcgccacttacgctgttcatgtgtggaataagaaaagtcagggaactcgcttcgaagccacaagccgcgctctacttgcacagctgcatgcccggtattgcccaacaacgcacgaagcaatgaagatgtatctgtag

SEQ ID NO: 178736 - DNA, 1311 bp, Artificial Sequence
  Description of Artificial Sequence: Synthetic coding sequence
atgagcaagccccccgacctgctgctgcggctgctgcggggcgcccccagacagcgggtgtgtacactgttcattattggattcaagtttacctttttcgtctccataatgatttactggcatgtcgtgggggaacctaaagagaagggccaactttataacctacccgcagagataccttgtcctaccctgactccaccaacaccacctagccatggccccacaccgggcaacattttcttcctagagacctccgatagaaccaatccaaatttcttgttcatgtgcagcgtcgagtcagcggctcggacgcatcccgaaagccatgtgttagtgctgatgaaaggacttcctgggggaaatgctagtcttccacgtcacctaggtattagtctgctgtcctgctttcccaacgttcaaatgttgccactggacctgcgggaactgtttcgggatacccctcttgctgactggtacgccgccgtccaggggaggtgggagccttatctgctgccagtgctgtccgacgccagtcgcattgctctcatgtggaagtttggcggcatatacctcgacactgacttcattgtgctcaagaacttgcggaatttgactaatgtcctcggcacccagtcccgatacgtgctgaatggcgccttcctggcatttgaaaggaggcatgaattcatggcactctgtatgcgcgacttcgttgatcactacaatggctggatttggggacaccaaggaccacaactgctcaccagggtctttaaaaaatggtgctctataagatccctagccgaatctagagcctgccggggcgttaccaccttgccacccgaggccttttaccccataccatggcaggattggaaaaagtactttgaagacatcaaccctgaggagctgcctaggttgctctctgccacatatgctgtgcacgtttggaataagaaaagtcagggtacagctggccctgctgcgtgtcctctgttaccccatgacgcaagaggacacgaaaacgttttggtacgcgggcctccgggccatcttccaaacctactgctcatggggcactgggcagctctgcccggagaggcgaggcttagagctagggagcgcgaagcacgtgcggccacaggactgaggcaggccgttgaggagctctgggagcaggcccagtgggaggccgttgatacccctcgaactgtatcctgcctggaagccggcctgacacacggagccattgcctccggtgggcgaagcgtgtctgcccctggcctgctcgacaatagacaggagggctag

SEQ ID NO: 178737 - DNA, 309 bp, Artificial Sequence
  Description of Artificial Sequence: Synthetic coding sequence
atggccctgctgaaggccaacaaggacctgatcagcgccggcctgaaagagttctctgtgctgttaaatcagcaggtgtttaacgacccacttgtttcggaggaagatatggtgactgttgttgaagactggatgaatttctatataaactattatagacagcaggtcactggagagcctcaggaaagggacaaggctctgcaggagcttcgtcaagagctcaacacactggctaatcctttccttgccaaatacagagactttctcaagtcgcacgagcttccgagccaccctcctcccagttcctag

SEQ ID NO: 178738 - DNA, 1488 bp, Artificial Sequence
  Description of Artificial Sequence: Synthetic coding sequence
atgagcatgctggtggtgttcctgctgctgtggggcgtgacctggggacccgtgaccgaagccgcaatcttctatgagactcagcccagcctttgggcagagagtgagagtttattgaaacctttggccaacgtcaccctgacttgtcaggctcatctggagaccccagacttccagctcttcaaaaatggagtcgcacaggagccagttcacctggattccccggctatcaagcaccagttccttctgaccggcgacacacagggccgctatcgatgtcgcagcggcctctcaacgggctggactcagcttagcaagcttctcgaactgaccggcccgaagtccctccccgcaccttggctgagcatggcgccagtctcctggattactccggggctaaagacgaccgccgtttgcagaggtgtgttgagaggcgtgacatttctcctaaggagggagggagaccatgaattcctagaggtgccagaggcccaagaggatgtagaagctactttccccgtccaccagccgggaaactatagctgctcctataggacagacggagagggcgctctgtccgaaccatccgcaaccgttaccattgaagagctggcagctccaccccctcccgtattgatgcaccacggagagtcctctcaagtactccaccccgggaacaaagtgacacttacatgcgtcgccccactgagcggagtggactttcagctgagaaggggcgagaaggaactgcttgtcccaaggtcaagcacgagtccagaccgcatctttttccacctgaatgctgtcgcccttggcgatggcggccattacacttgtaggtataggctgcatgacaatcaaaatggctggtctggggacagtgcaccggtcgagcttatcctctctgatgagaccctgccggctccggagtttagccctgagccagagtctggacgcgccctgcggctgagatgcttagcccctctggaaggtgcccgttttgcattggtgcgggaggatagaggaggcaggcgcgttcataggtttcagagccctgcaggaacagaagcacttttcgagctacataatatttcggtcgctgactccgccaactacagctgcgtctacgtggacctcaagcctcctttcggcggttcagcaccctccgaaagattagagttacacgttgatggcccaccgcccaggccccaactgagagctacttggtccggtgcggttcttgccggacgcgatgcagtgcttcgatgcgaagggcccattcccgacgttacctttgagctgttacgcgaaggagaaacgaaagccgtgaagactgtccggactcccggagccgccgccaaccttgaattgatttttgtgggcccacagcacgccggaaactacaggtgtcgctatcgctcctgggtaccacatacatttgagagcgagttgagtgatccagtggagctgctggtggctgagtcctag

SEQ ID NO: 178739 - DNA, 1059 bp, Artificial Sequence
  Description of Artificial Sequence: Synthetic coding sequence
atgcggagcctgggcgccctgctgctgctgctgagcgcctgcctggccgtatcagccggtcccgtgccaacacctcccgacaatattcaagtgcaagaaaatttcaacatttctcgcatttatgggaagtggtataacctggctataggttctacttgcccttggctgaagaaaatcatggatagaatgacagtgtctacactcgtgctcggcgaaggagctacggaagccgagatctctatgacaagtacccgctggaggaagggcgtttgcgaggagacgtcaggcgcttacgagaaaacagacaccgacggcaagtttttataccataagagcaagtggaacatcacaatggagagctatgtggtccacacaaattatgacgaatacgcaatctttctcaccaaaaagttctcccgacatcatgggcccaccatcaccgctaaactctacggacgtgctcctcaactgcgagagacccttcttcaggatttccgagtagtggctcagggggtggggattcctgaggactctattttcacaatggccgatcgtggggaatgcgtgccaggggaacaagagcctgagccaattctaatccctagggtccggcgggccgtccttcctcaggaggaggaggggtccggtggtgggcagctagtgaccgaggtaaccaaaaaggaggactcatgtcagttaggatattcggctgggccctgcatgggaatgacctctcgctacttttataacggaacctccatggcgtgtgagacctttcaatacggaggatgtatgggtaacgggaataacttcgtaacagaaaaagagtgcctacagacgtgtcgcacagtcgccgcgtgcaatcttccaatagtgcgcggaccctgtagggcttttatacagctgtgggcgtttgacgcagttaagggtaaatgtgtactctttccttatggcggctgccaaggtaacggtaataagttttattcagagaaggaatgcagggagtattgtggcgtgccaggggacggtgacgaagagctcctgcggttctctaactag

SEQ ID NO: 178740 - DNA, 813 bp, Artificial Sequence
  Description of Artificial Sequence: Synthetic coding sequence
atggaccggatgaccgtgagcaccctggtgctgggcgagggcgccacagaggcagagatctccatgaccagcactagatggagaaagggcgtttgtgaagagacttcaggagcatacgaaaaaaccgacaccgacggaaagtttctgtatcataagtccaaatggaacattaccatggaatcctatgtcgtgcataccaattatgatgaatatgctatttttttgacaaagaaattctcgaggcaccatggacccacaattactgccaaactctatgggcgggcccctcaattaagagagaccctgttgcaagacttcagagtggtggcacagggagtaggaattccagaggacagcattttcaccatggcagacagaggagaatgtgttccgggggaacaggagcccgaacccatcctaattcccagggtaaggcgggctgtacttccccaggaggaggagggctctgggggtgggcagctggtgacagaggttaccaagaaggaggattcttgccagcttggttactctgccggcccatgtatgggcatgacaagcaggtatttttataacggaacgagtatggcgtgcgaaaccttccaatacggtggttgcatggggaacggcaataactttgtcacagaaaaggagtgtctgcaaacctgccgcactgttggcgagtgtggctcaccccccctatgtgcactgcaccctcaggacccagtgccccctgtgaatcacttacggatcgagaaagtggcaaaccgggggcattctagtgggcggacaccgggcggcttcctcaagagttag

SEQ ID NO: 178741 - DNA, 897 bp, Artificial Sequence
  Description of Artificial Sequence: Synthetic coding sequence
atggtgcggatggtgcccgtgctgctgagcctgctgctgctgctgggacccgcagtgccccaggagaatcaggatggacgttacagcttgacatacatctatacaggattgtcaaagcacgtggaagacgtgccagcgttccaagcgcttgggtccttaaacgacttgcagttttttaggtacaattctaaggataggaaatcccaacctatggggttatggcgccaagtggaaggcatggaggattggaaacaggattctcagcttcagaaggccagagaggatatcttcatggagacactgaaggacattgtggaatactacaatgattctaacggctcgcatgttctccaggggcgatttggctgcgagattgaaaacaatcggtcctctggagctttctggaaatattactacgatggaaaagactatatagagttcaataaggaaattcctgcatgggtgcctttcgatccagcggcacagatcaccaaacagaagtgggaggcagagcctgtttacgtccagagggccaaagcttacctcgaagaagaatgccctgcgaccttaagaaagtaccttaagtactcaaagaacattctcgatcgacaagaccccccctctgtggtggtgacctcacaccaggctcccggagagaagaagaaactcaagtgcctggcttatgacttttaccccgggaagatagatgtgcattggacgcgagcaggagaggtccaggagcccgagttgagaggggacgtgcttcacaatgggaacggtacttaccagagctgggtggttgtcgcagttccgccccaggataccgcgccctacagttgccacgtgcagcatagctcactggctcaaccacttgtggtcccatgggaagcctcatag

SEQ ID NO: 178742 - DNA, 1104 bp, Artificial Sequence
  Description of Artificial Sequence: Synthetic coding sequence
atgaagagcctggtgctgctgctgtgcctggcccagctgtggggctgtcactcagccccacacggcccgggtctgatctatagacaacctaactgtgatgacccggagacagaagaggccgcactggtagccatcgactacataaatcagaatctgccttggggttataagcatactcttaaccagatcgacgaagtaaaagtatggccacagcaaccaagtggcgagctttttgagattgaaatcgatacactcgagacaacctgccacgttttagatcccactccggtggcaaggtgtagcgtgcggcagctgaaggagcacgccgtagagggggactgtgatttccaactactgaaattggatgggaaattcagcgtcgtctatgcgaaatgtgacagcagcccagattccgctgaggatgtaagaaaggtgtgtcaagactgcccgctgctagctcctctaaatgataccagggtcgtgcatgctgcaaaggctgccctggcagcctttaacgcgcagaataacggttcaaactttcagctagaagaaatttctcgtgcacaactcgtccctctgcctccgtctacgtacgtggaatttacggtctcaggcacagactgtgtggcaaaggaggcaaccgaggccgccaaatgcaacttgctcgctgagaaacagtacggcttttgtaaggcaacactctctgaaaaacttggaggagcagaagtcgctgtaacttgcatggtatttcagactcagcccgtgagcagccagccccagccagagggcgctaatgaggcagtgccaacacccgtcgtcgatcctgatgcacccccttctccgcccctgggcgctcccggcttgccccctgccggctcgcccccggattctcacgtcctcctagcagcccctccgggtcaccagctccatagggcccactatgatcttcgccacacctttatgggcgtcgtgagtcttggctccccgtcaggcgaagtgtcccatcctagaaagacccggacagtggttcaacctagcgtgggggcggccgcgggaccagtcgtccctccttgtccgggcaggatacgccacttcaaggtgtag

SEQ ID NO: 178743 - DNA, 1302 bp, Artificial Sequence
  Description of Artificial Sequence: Synthetic coding sequence
atgttcgccggctgcttcttcttcctgctgaaccagagccggaaccacccagtgagcctgtgcaatagctccggtcgcttgcaacagattaataaggcccaccaccccccgtgggtgtacctttcccagcaaagcacttgggttggccctgaggccagtaatcacctgcatgcctgccagggccttagcggagcagcaatgaaaagtttggttctgctcttgtgcctggcgcagctgtggggttgtcactctgctccccacggtccggggctcatttacaggcagccaaactgcgacgaccccgaaacagaagaagcagccctcgtggccattgattacatcaaccagaacctcccttgggggtacaagcatactcttaaccaaatcgatgaagtgaaagtctggcctcagcagccctctggtgaactttttgagatcgaaatcgatactctcgaaacaacctgtcacgtcctggaccccactcctgtcgcgagatgttccgtgcgccagcttaaagaacatgccgtcgagggcgattgtgacttccagctgctaaaactcgacgggaagtttagcgtcgtctacgctaaatgtgactcctccccagactcagctgaggacgtaagaaaggtgtgtcaggactgccctctcctcgcccctctgaacgatactagagtcgttcacgccgccaaagcagcactcgctgccttcaacgcgcaaaacaatgggagcaacttccagctggaggagatctcaagggcccagttagtaccgcttccacccagcacttatgtggaatttacagtctccggtacagactgtgtggctaaggaagcaaccgaggccgccaagtgtaacctgttagcagagaaacagtatggattttgtaaggccaccctctctgaaaaactaggaggcgccgaggtcgctgtgacctgcatggtgttccagacacaacccgtcagcagtcagcctcagccagagggcgccaacgaagccgtgcctaccccggtcgtggaccccgacgcacccccctccccacctcttggagcacctgggctgcccccggcagggagccccccagatagtcacgtgctgctggccgccccccccgggcaccagctgcacagggcccattacgatttgcgccacacattcatgggagtggtgagcctggggagtccaagtggtgaagtctctcacccaagaaaaactaggacagtcgtgcaaccatccgtgggggccgctgctggccctgttgtcccaccatgccccggcaggatccggcatttcaaggtgtag

SEQ ID NO: 178744 - DNA, 4425 bp, Artificial Sequence
  Description of Artificial Sequence: Synthetic coding sequence
atgggcaagaacaagctgctgcaccccagcctggtgctgctgctgttggtgcttttaccaacagacgccagtgtttccggaaaaccccagtatatggtgctggtgccatcccttctccacacagaaaccacagaaaaaggctgtgtcctgttatcctatttgaacgagaccgttaccgtgtctgccagcctagagagcgtgcgcggcaataggagcctttttacagatctagaagcagagaacgatgtacttcattgcgtcgcttttgctgtacccaaaagctccagcaacgaggaagtcatgtttctaactgtgcaggtcaagggacctacacaggaattcaaaaaaaggacgactgtcatggttaagaacgaggactcccttgttttcgtccagacagataaatctatttacaaacccgggcagaccgtgaagtttcgggtggtgtcaatggacgagaatttccacccactgaatgagttaatccccttggtttatatccaggatcctaagggcaacaggatcgcccagtggcagtctttccagcttgaaggcggcctgaagcagttctcgttcccattgtcctccgagccattccaaggttcgtacaaggtggttgtgcagaagaagagcggagggcgcacagaacacccgtttacggtggaagagtttgttctacctaaattcgaagtgcaggtgactgtgccaaagattatcactatcctggaagaggaaatgaatgtgtccgtgtgtggcctgtacacctatgggaagccagtgccaggccacgtgacagttagcatatgtcggaaatatagcgacgcttcagactgtcatggtgaagactcgcaagccttttgtgagaagttctccggtcaactaaattcgcacggttgtttttatcagcaggtgaaaactaaggtctttcaactgaaaagaaaggaatatgaaatgaaactgcacacggaggcccagatccaggaggaaggaaccgtagtagagttaaccgggcgtcaaagctccgagattacccgcacaatcacaaagctgtcatttgtgaaagtggactctcacttccgtcaggggatccccttcttcggacaagtccggttggttgatggaaagggggtgccaataccaaacaaggtgatattcatcaggggcaacgaggcaaactattatagcaacgccacaacagacgaacacgggttagttcaattctcaatcaacaccactaacgtcatgggaacttcacttacagtgcgggttaactacaaagatagatctccctgctatggataccagtgggttagtgaagagcatgaggaggcccaccacaccgcatatctggttttctcaccttccaagtctttcgtgcaccttgagccaatgagccatgagctgccgtgcgggcatactcagacagtgcaggctcactatattctgaacgggggtaccttgctcggtttgaagaaactatccttctactacctcattatggccaagggtgggatcgtgcggacaggaacccatggcctcctggttaaacaggaggacatgaaagggcactttagcatttcgatccctgtgaagtctgatattgctccagtggccaggcttctgatctatgcagtgctccctacaggagacgtgatcggagattctgccaaatatgacgtggagaattgcctggctaacaaagtcgacttatcattttccccctcgcagtccttaccggcatcacacgctcatcttcgggtcactgccgccccacagtcagtctgtgccctccgagcagtggaccagagtgtcctacttatgaaacccgatgcagagctgtctgcatcttccgtctataatctgctgcctgagaaggacctgaccggctttcctggtcctttgaacgatcaggataatgaggactgtatcaaccgtcacaatgtgtacataaacggcatcacttatacccccgtgtcttcaaccaacgaaaaagacatgtactctttcctggaggatatgggtctcaaggcttttacgaacagcaaaatcaggaaaccaaagatgtgcccccagctgcagcagtacgaaatgcacggccctgaaggcctgagggtgggcttctacgagtcggatgtgatggggcgcggacatgcccgtctggttcatgtcgaggaaccccacacggaaacagtcaggaaatactttcccgagacctggatctgggacctggtggtggtcaactctgccggggtagccgaagtgggcgtcacagtcccagatactattaccgagtggaaggctggtgctttttgtctctcagaggatgctggcctcggaatcagctctactgcctcccttagggcatttcagccattctttgtggaactcaccatgccatattcagtgataaggggcgaggcattcaccttgaaagctaccgttctcaactacctaccgaagtgcatcagagtgagcgttcagctggaggccagccccgcctttctggctgtcccggtagagaaggaacaggcaccacattgcatttgcgccaacggacgccaaactgtgtcctgggccgtaacacctaagtccctgggcaatgtcaacttcacagtatccgcggaagctctggagagtcaggagctgtgcggcaccgaagtccctagcgttccagagcatggccggaaagataccgtcatcaagcctctcttggttgagccagaagggttggagaaggaaactacttttaacagcttgctctgcccctcagggggcgaagtgtccgaagagctgtcattgaagctgccccctaacgttgtggaagagtcggcccgcgccagtgtgtccgtgctgggagacattttgggctccgccatgcagaatacccagaatttgctgcaaatgccctatggatgtggtgaacagaatatggtgctctttgctcctaacatttatgtcctagactacttgaacgaaacccagcaactgaccccggagataaagagcaaggcaatcggctacctgaacactgggtatcagcgtcagttaaactacaagcattatgatggatcatattccacatttggggagcgctacggccgcaatcaaggcaacacatggctgaccgcctttgtgttaaagacgtttgcgcaggctcgcgcctatatcttcatagacgaggctcatataacacaggcacttatctggctctcacagagacagaaggataatggatgctttagaagttcgggctctctattaaacaatgcaataaagggtggtgttgaagacgaggtgactctctccgcgtacataaccattgcactccttgagataccattaaccgtgactcaccccgtggtgcggaacgcattgttttgtttggagtctgcatggaagacagcacaagagggggaccatggttctcatgtgtataccaaagccttgctcgcttatgccttcgcactcgccggcaatcaggataagagaaaggaagtgctgaaaagcttaaacgaagaagccgtgaagaaggacaattctgtacactgggagaggccccagaaaccaaaggctcctgtggggcatttctacgagccacaggcaccctcagcggaggtcgagatgaccagctacgtcctgctggcctaccttacagcccagcctgcacctacgagtgaggatctgactagcgccactaatatagtcaagtggataacaaagcagcaaaatgctcaggggggattctcttccacacaggacactgtggtggccctgcatgcactctctaagtatggcgcggctacattcacacgcacaggaaaagccgctcaagtgaccatacagtcaagcgggacattctccagcaaattccaggtggacaataacaatcgtctgctactccaacaggtgagcctgcccgagctgccaggggaatactctatgaaagtcaccggcgaggggtgcgtctacctgcagactagcctgaaatataatatcctcccagagaaggaggagtttcccttcgctctgggcgtacagaccttaccccagacttgcgatgagcctaaggcccacacctccttccagatttccctctccgtgtcatacaccggatcaaggtcagccagcaacatggccatcgtagacgtcaaaatggtgtctggcttcatccccctcaaaccaacagttaagatgctcgaacgctctaatcacgtttctagaaccgaagtgtcttctaatcacgtgcttatttacctggacaaagtgtcaaatcagactctttcactcttttttacagtcctccaagacgtgccagtccgagatctgaagcctgctattgtgaaggtgtacgattactacgagactgatgagttcgctattgctgagtataatgctccttgctctaaggatttgggcaatgcctag

SEQ ID NO: 178745 - DNA, 507 bp, Artificial Sequence
  Description of Artificial Sequence: Synthetic coding sequence
atgggcaagaacaagctgctgcaccccagcctggtgctgctgctgcttgtcctcctccctacagacgcaagtgtgagcgggaagccacagtatatggtcctggtcccgagcttgctgcacactgagactacagagaagggctgcgtgcttctatcttacttgaacgagacggtcacagtgagtgcctccctggagtcagtgcgagggaatcggtcgctttttaccgacttagaggctgagaatgacgtcctgcactgcgtcgcgttcgccgttcctaagtcaagcagtaacgaggaagtgatgtttctgactgtccaggtgaaaggccctactcaggaatttaagaaacgtaccaccgtgatggtcaaaaatgaggactccctggtttttgtacagactgacaaatctatctacaaacctggccagaccgtcaagtttagggtcgtgtccatggacgagaattttcaccccctaaacgaactgatacccctggtttacatccaatag

SEQ ID NO: 178746 - DNA, 4470 bp, Artificial Sequence
  Description of Artificial Sequence: Synthetic coding sequence
cgggtgcagtacgtgtgcagcccccccgcccccagcttctgcaacatgggcaagaataagctattgcacccatcactggtgcttttactgcttgtgcttttgcctactgacgcaagcgtctccggaaaaccccagtatatggttctggttccttcattgctgcatacagaaacaacagagaaggggtgcgtgctgctgtcatatctgaacgagacggtgacggtgagcgcttctctagagtcagtgagaggcaataggagcttgttcacagatcttgaagccgagaatgacgtactacactgtgtggcattcgctgtgccaaaatcttcttcaaatgaggaggtgatgtttctgactgtgcaagttaaaggcccaacgcaggaattcaagaaaagaacaactgtgatggttaagaacgaggacagcctggtttttgttcaaacagacaagagcatctataagccgggacaaaccgtcaaatttcgcgttgtatcaatggacgagaactttcaccccctcaatgaactgatccctctagtgtatatccaagaccctaaggggaatcgaattgcccagtggcagagctttcaactggaaggaggtctgaagcagttttccttccccctgagctctgagcctttccagggtagctacaaagttgtcgtgcagaagaaaagcgggggtagaaccgagcacccattcaccgtcgaggaatttgtcctacctaaattcgaagtccaggtgaccgtgcccaagataattactatcttggaggaagagatgaatgtcagtgtgtgtggactatatacatatggtaagcccgttcccggacacgttactgtatctatctgcaggaaatattctgacgcgtctgactgccacggcgaggattcccaagccttctgtgagaagtttagtggccaactgaacagccacggatgtttttaccagcaggtaaagactaaggtttttcagctgaaacgcaaagaatatgaaatgaaactccacacagaagctcagatccaggaggagggcacggttgtagagttgacgggtcggcagagttccgagattacgagaacaataactaagctgtctttcgtgaaggtcgattcacattttaggcaggggatacctttttttggtcaggtgaggctcgtcgatggaaaaggggtgcctattcctaataaggtaatctttatcagaggaaatgaagccaattattacagtaatgctaccactgatgagcatggccttgtgcagttttctatcaacaccacgaacgttatgggaacctccttaaccgtgcgggtgaactataaggaccgttccccctgctacggttaccagtgggtctccgaagagcacgaagaggcgcaccacactgcatacttagtgttttccccatccaagtcatttgtccatctggaacccatgagccatgaacttccctgcggccatactcaaactgtacaggcgcattatattctgaacgggggaaccctgctgggcttgaaaaagttatcgttctactatcttattatggctaaagggggtattgtcagaactgggacgcatgggctgctggtcaaacaggaggatatgaagggacacttttccatcagtattccagtaaagtccgatatcgcccccgtggcccgcttactcatttatgccgtcttacccactggcgatgtgatcggggattccgccaagtatgatgtcgaaaactgtcttgcaaataaggtggacctgagctttagcccctcccagtctctaccggcttctcatgcccacctgcgtgtgaccgcagcgcctcaatctgtttgcgctctgagggcagttgatcagagcgttctgctcatgaagccagacgctgagctgagcgcctcaagtgtttataatctcctccccgaaaaggatctcacgggctttcctggtcctttgaacgatcaggacaatgaagactgcattaaccggcacaatgtttatattaacggcatcacctatactcctgtctcttccacgaacgaaaaagacatgtattcctttctcgaagacatgggtctgaaggccttcacaaactctaaaatcagaaaacccaagatgtgcccccagcttcagcagtacgaaatgcatgggcccgaaggccttagggttggattctacgagagtgatgtgatgggacgaggtcatgccagactcgtgcacgtcgaggagccgcacactgagactgtgcggaaatacttcccggagacctggatctgggacctggtggtggtgaatagtgcaggcgtagctgaagtcggcgtgacggttcctgatacgatcactgaatggaaggccggagccttctgcctcagcgaagatgcaggccttggtatctcttcaactgcaagtctcagagctttccagcccttttttgttgagctgaccatgccatatagcgtcatcagaggggaagccttcactctgaaggcgacggtgctgaactacttaccaaagtgcattcgggtctctgtccagctggaagccagcccagctttcctggccgtccctgtggagaaagaacaggcacctcattgtatctgcgcaaacggtaggcagacggtctcttgggctgtgaccccgaagagtctcggcaatgtcaacttcacagtgagtgctgaggctcttgagagccaggaactgtgcggtactgaggtgccctctgtccctgagcatggtcggaaagacactgttatcaaacccctgctagttgagcctgaaggcctagagaaggagaccacatttaactctcttctgtgtccctccggtggggaagtttcagaggagctgtccctgaaactgccaccaaatgtggtcgaggagtccgctcgcgcaagcgtgtcagtgttgggtgacatcctgggctctgctatgcagaacacccaaaatttgctccagatgccgtacgggtgcggtgaacagaacatggttcttttcgccccaaacatttatgtcctcgattatctgaatgaaacccaacagcttacacctgaaataaagtctaaagccattgggtatcttaacacaggctatcagcgacagctaaattacaaacactatgatgggtcctattcaaccttcggcgagaggtacggcaggaaccaggggaacacctggttaacagcattcgtgctcaaaacattcgcacaggcaagggcttatatttttatcgacgaagcccatatcacccaggccctgatttggctgtctcagagacagaaagataacggctgcttccgtagtagcgggtccctcctcaacaacgctattaagggaggtgtagaagacgaagtgaccctcagcgcgtacataactattgctttactggagatccccttgactgtgacacatccagtggtgaggaacgccctgttttgcctggagtcagcttggaaaaccgcccaggaaggcgatcatgggagccatgtgtacaccaaggccctcctagcgtacgcttttgcgctggctggaaaccaagacaagaggaaggaggtgttgaagagcctgaacgaggaggccgtaaaaaaagataactccgtacactgggaacgtccacagaaacccaaagctcccgtagggcacttttacgagccacaagcacccagtgcagaggtggagatgacgtcatacgtgttgctggcgtatctgaccgcgcagcccgcaccaacgagtgaggatttgacaagcgcaacaaacatcgtaaaatggatcactaaacaacaaaatgctcagggtggattttcatctacacaagatactgtggtcgctctgcatgcactctctaagtacggtgcggccaccttcacaaggactgggaaggctgcccaagtaactatccaatccagtgggacattttcctctaagttccaagtcgacaataataatcggttgctgttacagcaggtgagcctccccgagcttccgggcgaatactcaatgaaagtgacgggtgaaggatgcgtgtacctccagacaagccttaaatacaacatcctgccagaaaaagaagagttccctttcgccctgggcgtgcaaaccctccctcaaacctgtgacgagcctaaagcgcacacgagcttccagatctctctgtcagtatcatatacgggatcacgatcagcatccaatatggcaatcgttgacgtgaaaatggtgagcggattcatccccctaaagccaactgtcaaaatgcttgaaaggagtaaccacgtgagccggacagaagtcagttctaatcacgtgctgatatacctggacaaggtctctaatcagaccttatccctgtttttcaccgtgcttcaggacgttcctgtccgcgatctcaagcccgctattgtcaaggtatatgattactacgaaaccgacgaattcgcgattgcagaatacaacgcaccatgttccaaagacctgggaaacgcgtag

SEQ ID NO: 178747 - DNA, 4365 bp, Artificial Sequence
  Description of Artificial Sequence: Synthetic coding sequence
atgtgggcccagctgctgctgggcatgctggccctgagccccgccatcgctgaggagcttcccaactatctggtcacactgccggcgagattgaattttcccagcgtgcaaaaggtttgtctggacttatcaccaggttattccgatgtgaaatttaccgtgaccctagaaacaaaagacaagacacagaaattgctagagtacagtggcttaaagaagcgacatctgcactgcattagctttctggtgcctcctccagctgggggaaccgaagaggtggcaactattagagtgtccggggtgggaaataatatatcgttcgaggaaaaaaagaaggtgcttatccaacgtcagggaaatggcacctttgttcagaccgacaaacccttgtatactcccggtcagcaggtatattttaggatagttaccatggactctaattttgttccagtcaatgacaaatatagtatggttgaactccaagatccgaactccaatagaattgcccaatggctggaggtggtgcctgagcagggcatcgttgacctgagctttcaactggccccagaagccatgctggggacgtataccgtcgctgtagccgagggcaaaactttcggcactttttcagtggaagagtacgtgctgcctaagttcaaggtcgaggtcgtcgagcccaaagaactgagcaccgtgcaggagtcttttctggtgaagatctgttgccggtacacttacggcaaaccaatgctgggcgctgtgcaagtaagtgtgtgtcagaaggccaatacctactggtatcgggaggtagagagagaacagctgcctgataaatgcagaaatctcagcggtcaaaccgacaaaaccggctgtttctccgcgcctgtggacatggctaccttcgatctgatcgggtatgcttattctcatcagattaatatcgtggcaactgtcgtggaagagggtacaggcgtggaggcaaatgcgacccagaacatatatattagccctcaaatgggaagtatgacctttgaggacacaagcaatttctatcaccctaattttcccttcagtggcaagatcagagtccgggggcatgacgacagttttttgaagaaccatctcgtattcttggtgatttacggtaccaatggcacctttaatcagaccttagtcacggacaataatgggttggccccattcaccttggaaaccagcggctggaatggcactgacgtctccctcgaaggaaagtttcaaatggaggatcttgtatataatccagagcaggtccccagatactatcaaaatgcttaccttcacctgcgtcctttttattctacgactcggtcttttctgggcattcaccggcttaatgggccgctcaagtgtggccagcctcaggaggttctggttgactactatatcgaccccgcagacgcctcccctgatcaggagattagcttttcatactatctaatcggaaaggggagtcttgtgatggaaggacagaagcatttaaacagtaagaaaaagggcctcaaggctagtttttccctctccctgacatttactagccgacttgcgcccgacccatctctcgttatctatgccattttcccttcaggtggagttgtggctgacaagattcagttctctgtcgagatgtgctttgacaatcaggtgagcctgggcttctctccaagtcagcaattaccgggcgcagaagtagaactgcagctgcaagctgcccccggctccttgtgcgccctgagagctgtggatgaatccgtgcttttactgcgtcctgaccgggagctctccaacagatcagtctatggaatgtttcccttctggtacgggcactacccctaccaggtcgccgagtacgaccagtgccctgtgagcggcccgtgggactttccccagccgctcatagaccccatgccgcaaggccactctagtcagcgaagtattatctggcgtcctagtttttctgagggcaccgatctatttagcttcttcagggatgtgggtctcaagattctcagcaatgctaaaataaagaaacctgtcgactgttctcacaggtcccctgagtactctacagccatgggcgccggcggtggccatcccgaggccttcgaatcctctacccctctgcaccaggcggaagacagccaagtgcgccaatatttcccagagacctggttgtgggaccttttccctatcggaaactcaggtaaagaggcagtgcatgtaacagttcctgatgctattacagaatggaaggccatgtccttctgcacctcccagtctcgtggattcggcttaagccccacggtaggactgacagcttttaagcccttcttcgtggatctcacattgccttattctgtggtgcggggagagtcattccggctgacagccaccatcttcaactatctcaaggattgcattcgcgtgcagaccgacctggccaagtctcacgagtaccaattggaatcatgggcggacagtcagaccagttcctgcctgtgtgcggatgatgctaaaacacaccactggaacattactgctgtcaagctgggacatatcaactttacaatttctactaagatactagacagcaatgagccatgtggtggccagaagggattcgtccctcagaaggggcggtcagatacactgattaagcctgtgttagtgaagcccgagggggtcctggtggagaaaacgcactcaagcttattgtgtcccaaagggaaagtggcctctgaatccgtttccctggagttaccggtcgatatcgtaccagactctaccaaagcttatgttaccgttctcggggatataatggggacagcattgcagaacctagacgggctcgttcaaatgccgtccggttgtggcgagcagaatatggtgctatttgcaccaattatatatgtgttacagtacctagaaaaggctggattactcacagaagagatccggtcgagagccgtgggcttcctggagatcggctatcagaaagagctgatgtacaaacattctaacgggagttactcggctttcggcgagcgggatgggaatggcaatacttggctgacggcttttgtgactaaatgtttcggacaggcccagaagttcatcttcatcgatcccaaaaacatccaagatgccctaaaatggatggccggtaatcaactgccaagcggctgttatgcaaacgtgggcaaccttctccacacagcaatgaagggtggagtggacgacgaggtgtccttaacggcttacgtcactgcagctctgttggaaatgggcaaagacgtggacgaccctatggtctcacaagggttacggtgtttgaagaattccgctacctcgacaactaacctgtatacccaggctttacttgcatacattttctcgctcgctggcgagatggacattaggaacattctgcttaagcagctcgatcagcaggctatcattagtggagaatctatttattggagccaaaagccaacgccatcctccaatgcatccccttggagcgaacccgcagctgtagacgtggagctcacagcatatgccctcctggctcagctcactaaaccctctctcacacagaaggaaattgccaaagccacttctattgtagcctggcttgctaaacagcacaatgcgtatggcggattcagcagcacacaggacactgttgtggcccttcaagccctggctaagtacgcgaccactgcatacatgccatctgaggagattaaccttgtggtgaagagtactgaaaattttcagcgcacgttcaatatccaatcagtgaatcgattagttttccagcaggatacgctgccaaacgtgcccggtatgtacacactggaagcctcgggccaaggttgcgtctatgtgcagacagttctcaggtacaacatcctccctccaaccaacatgaaaaccttctcactgagcgtcgagattgggaaggcacgttgtgagcagcccacatccccacgctctctcacgctaactatccacacctcatacgtggggagcagatcctcttccaatatggcaattgtggaggtcaagatgctcagcggcttctcgccgatggagggaacaaatcagctcctgctgcaacaacctttggtaaagaaagttgaatttggcacagacacactcaacatctacctggatgagctgattaagaatactcagacctatacgtttacaataagtcagagtgtactagtgactaacctgaagccagcgaccataaaagtctacgattattatctgccagacgaacaggcaaccatacaatactcagacccatgcgagtag

SEQ ID NO: 178748 - DNA, 4365 bp, Artificial Sequence
  Description of Artificial Sequence: Synthetic coding sequence
atgtgggcccagctgctgctgggcatgctggccctgagccccgccatcgccgaggagctgcctaactatcttgttacactgcccgccaggctcaactttccctcagttcagaaggtctgcctggatctgtctccggggtatagtgacgtcaaatttactgtcacccttgagactaaggacaagacgcagaaattgctcgagtatagcggactgaagaaaagacaccttcattgtatctcctttctcgtaccaccccccgccggcggaaccgaggaggtggctactattagagtgtcaggtgttggcaacaacatttccttcgaggaaaagaaaaaggtgcttatccagaggcaggggaatgggacgttcgtgcagacggataagcctctttacactccaggtcaacaggtgtatttccgaatcgtgactatggatagtaatttcgtgccagtcaacgacaaggtctcctgggaagaaggtcaggatccaaattctaaccgtattgcccaatggctcgaagtagttccagagcagggaatcgtcgatctgtcatttcagctcgcgcctgaagccatgctggggacctacaccgtcgctgtcgccgaaggaaagacgttcggcaccttttccgtagaagaatacgtgttacccaagttcaaggtggaggtggtggagccaaaagagttgagtactgtgcaagaatcatttctcgttaaaatctgttgtcgttacacctacggcaaacctatgctgggcgctgtgcaagtgagtgtgtgtcaaaaggccaacacctactggtacagagaggtagagagagaacagcttcctgacaaatgtaggaacctgtccggacaaactgataaaacgggctgcttttcagccccagtcgacatggcgacctttgatctgatagggtatgcttacagccatcagataaacatagtggcgacagttgttgaagagggcaccggagtagaagccaacgccactcagaacatctatatctcccctcagatgggctccatgacttttgaagacacctccaatttctatcaccccaacttcccattcagcggcaagataagggtcagaggacatgatgacagcttccttaagaatcacctggtctttctcgttatttatggtaccaatggcacatttaatcagacccttgtgacagataataatggcctggccccctttaccctggagaccagtggatggaacggtacagatgtgagtctcgaaggaaagtttcagatggaggatctagtttataaccccgagcaggtgccccggtactatcagaacgcctatctacatctcaggcctttctattccacaacccgctcgttcctagggatccatcgcctgaatggtccactgaagtgtggtcagccccaggaagtgctggttgattattacatcgaccccgcagatgctagccccgatcaggaaatctcattcagctattatctcatcgggaagggctcgttggtaatggagggacagaaacacttgaactctaagaagaagggtcttaaagcaagcttctctctctctcttacattcaccagcagactagcccccgacccttcactggttatctacgcaatcttcccttccgggggtgttgtggcagacaaaattcagtttagcgtggaaatgtgtttcgataaccaggtctccctcggattcagccctagccagcagttgcctggtgctgaggtcgaacttcagttgcaggccgccccaggctctctgtgcgctttacgcgcagttgacgagagcgtgctcttgttgcgacccgatcgcgaactgtccaaccggtcagtttatggtatgttcccgttctggtacgggcactatccataccaggtcgccgaatatgaccagtgcccggttagcggaccgtgggacttcccccaaccacttatcgacccaatgccacaaggacactcctctcagcgcagtattatatggagaccttcattctctgaaggaacagatctgtttagtttcttcagggatgtgggccttaagattcttagcaatgcaaagataaagaaaccagtggattgctctcaccgctcccctgagtattcaacagctatgggcgccggcggcggccacccagaggcctttgagagctccaccccattgcaccaggcagaagattcccaggtgcgccagtatttccccgagacatggctgtgggatttgttcccaatcggtaacagtggaaaggaagctgtccacgtgaccgtccctgacgccatcaccgagtggaaagcgatgagtttctgtacctctcaatccagggggtttggcctctctcccaccgtgggactcaccgccttcaagcctttctttgttgatctcaccctgccctattctgttgttaggggagaatcctttagactaacagccactatctttaactacctgaaagactgcattagggttcagaccgatctggccaaaagccacgagtatcagctggaatcatgggccgactcccagactagttcatgcttatgcgccgatgacgccaaaacacatcattggaatattacagccgtcaagctgggacacatcaatttcacgatttcgacaaaaatattagatagcaatgagccctgcggcggtcagaagggcttcgtaccccaaaaaggacggagcgacacactcattaagcctgttttggtcaaaccggaaggcgtgctggttgagaagacacacagctctctgctgtgtcctaaagggaaggtcgctagcgagagcgtctctcttgaacttcccgtggacatcgtccctgatagcaccaaagcctacgtgaccgttctcggggatataatggggacagctctacaaaacctggatggcttggtgcagatgcccagcggttgcggcgaacagaatatggtgctgttcgcccctattatctacgtcctgcagtatctggagaaggccggcttgcttacagaagagataagaagtcgggcagttggctttctggagatcggctaccagaaggaacttatgtacaaacactccaacgggagttactccgcttttggtgagcgagatgggaatggaaacacttggcttacggcattcgtgacaaagtgctttggacaagcacaaaagttcatcttcattgatcccaagaatatccaggatgccctgaaatggatggccgggaatcagttaccgtctgggtgctacgcaaatgttgggaacctactgcataccgccatgaagggtggagtcgacgacgaggtgagcctcaccgcatacgttacagccgcactgttagaaatgggcaaagatgtcgacgacccaatggttagtcagggtttgaggtgcctcaagaatagcgcaacctcgactaccaatctctatacacaggcgctgctggcttatatttttagcctggcaggagaaatggacatccggaacatacttctgaagcaactggatcagcaggccatcatttcaggcgaatcgatctattggtctcagaagccaacaccctctagtaacgccagcccttggagcgagcctgctgccgtcgatgtcgaattgactgcctacgcccttttggcccagctgaccaagccatcactgactcaaaaggagatagcaaaggctacaagtatcgtagcatggctggctaaacagcacaacgcatacggggggttttccagtacacaggataccgtcgtggcccttcaggcattggccaaatacgcgacaaccgcgtacatgccaagtgaggagattaatcttgtcgtcaagtcaactgaaaacttccagagaacgttcaatattcagagtgtcaataggctggttttccaacaagacacacttcctaatgttcctgggatgtacaccttggaggcctctgggcagggttgtgtatacgtccaaactgtcttgagatataatattttaccgcccactaacatgaagactttttcactgagcgtagagataggcaaggccagatgtgaacagccaacaagcccccgaagcctgacccttaccatacacactagctatgtcggcagcagatcatcttctaacatggccattgtcgaggttaagatgctgagcggcttcagccccatggaaggcaccaaccaactcctgctgcaacagcctcttgtgaagaaagtggagtttggaacggacaccctgaatatttatctcgatgagctcattaagaacacccagacttacacctttacaatctctcaaagcgtcctggtgaccaatctaaaaccggccactatcaaggtctacgattattacttaccggacgagcaagcaacaattcagtactcagacccctgtgagtag

SEQ ID NO: 178749 - DNA, 3015 bp, Artificial Sequence
  Description of Artificial Sequence: Synthetic coding sequence
agcttcctgggcatccaccggctgaacggccccctgaagtgcggccagccacaagaggtgttagtagattactacatcgatcctgccgacgctagccctgaccaagaaataagcttcagctactacctgattggtaagggtagtcttgtgatggaaggccagaagcacctgaatagcaaaaagaaagggctgaaggcgtcatttagcctgtcattaacatttacctcgcggctggcgccagatcccagccttgtgatctacgccatctttccaagtggtggtgtggtcgctgataagattcagttttcggttgagatgtgttttgataaccaggtatctctgggcttttctccttcccagcagctccccggagccgaggtcgaactacagttgcaggccgcgcccgggtccctctgcgctctgagggccgttgacgaaagtgtcctgctgctccgcccagacagggaactcagcaacaggtcagtttacgggatgtttccattttggtacggacattacccataccaggtcgctgagtatgaccagtgtccagtctctggcccttgggactttccccagcctttaattgatccaatgcctcagggacactcctcacagagaagcatcatttggaggccttccttcagcgaaggaacagatttgtttagcttcttcagagatgtggggctgaaaatactcagcaatgccaagatcaagaaaccagtcgactgcagtcatagatcaccagagtattcaacagctatgggagccgggggtggtcatcctgaggcatttgagagcagtactcctctccaccaagccgaggattcacaggttcggcaatatttccccgaaacttggctctgggacctgttccccattgggaattcggggaaggaggcggtgcatgtgactgtgcctgatgcgattaccgaatggaaggcaatgtccttctgtacctcccagagcagaggctttggactctcacctaccgtaggcttgactgccttcaagccctttttcgtcgacctgactctcccatattccgtcgtccgtggagagtcatttcggctgaccgcaacaatttttaattacctaaaggattgcatcagagtgcagactgacttagctaaaagccacgagtaccagttggagtcctgggcagactcgcagacttccagctgcctgtgtgcggacgatgcaaagacacatcattggaatatcaccgcagttaaactcggacacataaacttcacaatctctactaagattctcgacagcaatgagccgtgtggtggacagaaaggctttgttccacaaaaaggccggtccgatactctcattaagcccgtcttggtcaaacctgaaggagtcctggtagagaagacacacagcagcctgctctgtcccaagggaaaggtggcgtcagagtccgtgtctttagaactccccgtggatattgttccagattctaccaaagcctacgtcactgtactgggcgatatcatgggcacagcacttcagaatctggatggcctcgttcagatgcctagcggctgtggtgaacagaatatggttctgttcgccccaattatctatgtcctgcagtatttggaaaaggctggactcctcaccgaagaaatccgctctcgagcggttggatttctcgagataggataccagaaagagctcatgtataaacattctaacggatcctactctgccttcggtgaaagggacggcaatggtaacacctggctgacagctttcgtgaccaaatgcttcggacaggcgcagaaattcatcttcatcgaccccaagaacattcaggacgcgctgaagtggatggcaggaaatcagctgccctcaggctgttacgccaatgtcgggaacctcctgcacacagccatgaaggggggagttgatgacgaggtgagtctgaccgcctacgtgacggcagcccttctggagatggggaaagacgtcgacgaccccatggtgagccagggcctgcgctgccttaaaaatagtgctacatccactacaaacctgtacacgcaagccctcctagcctacattttctctctggccggagaaatggatatacgaaatatcctcctgaaacaacttgatcaacaggccatcatctctggcgagtctatatactggtctcagaagccaacaccatcctctaatgcaagcccctggtcagagcctgcagctgtggatgtcgaactgacggcctacgcactactggcacagctgacaaagccaagcttgacacaaaaagagatagcaaaggcgactagtatcgtcgcttggttagccaagcagcataacgcgtacggtggtttcagctccactcaggacaccgtggtggcattgcaggccctggctaaatacgcaaccacagcttacatgccttcggaggaaatcaatctcgttgtgaagtcaaccgagaactttcagaggaccttcaacattcaaagcgtgaacaggcttgtctttcagcaggacaccttaccaaacgtccctgggatgtatacactggaagccagtgggcaggggtgtgtgtatgttcaaacagttctgcgatacaacattttacctccaacaaatatgaaaaccttcagtctgtcagtggagattggcaaggcaagatgcgagcaacctacttctcccagatcactcaccctgactatccacaccagctatgtgggctcccgctcttcttctaatatggccatcgtagaagtcaaaatgttgagtggcttcagccctatggagggaaccaaccagttgttactccagcagcccctggtgaagaaggtggagtttgggaccgataccttaaatatctacctggatgagctcattaagaacacacaaacctataccttcactatatcccaaagcgtgctagtaacaaacctgaagcctgctaccatcaaagtctacgactattaccttccagatgaacaggcaacaattcagtattcggacccttgcgaatag

SEQ ID NO: 178750 - DNA, 1830 bp, Artificial Sequence
  Description of Artificial Sequence: Synthetic coding sequence
atgaagtgggtggagagcatcttcctgatcttcctgctgaacttcaccgaatctcgcacgctccatagaaacgaatacggtatcgcatccatcttggactcctaccagtgtaccgccgagatcagtctcgcagatctcgctaccatcttctttgcgcaattcgtgcaagaagcaacatataaggaagtaagcaaaatggtgaaggatgctctgacagccatcgaaaagcctactggcgacgaacagagtagtggttgtctggagaaccagcttcctgccttcttggaagagttgtgtcatgagaaagaaattctggaaaagtacggccattcagactgttgctcccagtctgaggagggccggcacaactgtttcctggcgcataagaagcctacccctgcttccataccactctttcaggtcccagagccagttacttcatgtgaggcctatgaagaagatcgcgagacatttatgaataagtttatctacgaaatcgcacgacggcatccctttctttatgcgccaactattctgctctgggccgcacgatatgataagattatcccgagctgttgtaaggcagagaatgcagtggagtgctttcagaccaaggcagcaaccgtcactaaagaactgagagagtccagcttactgaaccagcacgcctgcgccgtgatgaagaatttcggaacaagaacattccaggccatcaccgttactaaattgagccagaaattcactaaggtcaatttcaccgaaattcagaaactggtgctcgatgtcgctcacgtccacgagcattgctgtaggggcgacgtgctggattgcctgcaagatggagaaaaaatcatgtcctatatttgtagtcagcaggacaccttgtcaaacaagatcacagagtgctgtaagctgacaactctggagcgaggccagtgcatcatccatgccgaaaacgatgagaagccagaaggactgagtccgaatctgaaccgttttttaggtgacagagactttaaccagttttccagcggcgagaagaatatctttctggcctctttcgtgcatgaatatagccggcgccacccccagctggcagtgtccgtcatactgcgcgttgccaagggctaccaggagctgctggaaaagtgcttccagactgagaaccccctggagtgccaggacaaaggtgaagaggaactgcagaagtatatccaagagagccaggctctggccaagagatcctgtgggctgtttcagaagttgggcgagtattaccttcaaaatgcatttcttgtagcatacacgaagaaagccccccaactgacgagctctgagctgatggccatcacgaggaaaatggccgcaactgcggctacatgttgtcagcttagcgaagataaacttctggcgtgcggcgagggcgctgccgacataattattggacatctctgtataagacacgagatgactccggttaaccctggagtgggacagtgctgcacgtcaagctacgccaaccggagaccctgtttcagctctttagtcgtcgacgagacttacgttccaccagctttcagcgacgacaagttcattttccataaagacctgtgccaagcgcaaggagttgccctgcagacgatgaaacaggagtttctgattaacctagtgaaacagaagcctcagatcaccgaagaacagctggaggccgtcatagctgatttctcaggtctcctggagaagtgttgccaggggcaagagcaggaagtctgctttgctgaagaaggtcagaagctgatatcgaaaacacgcgccgctctgggtgtttag

SEQ ID NO: 178751 - DNA, 3735 bp, Artificial Sequence
  Description of Artificial Sequence: Synthetic coding sequence
atgaacaaccagaaggtggtggccgtgctgctgcaggagtgcaagcaggtcctggatcagctgctacttgaagcccccgacgtcagcgaagaagacaagtctgaagaccagcggtgtcgagccctcctcccctcggagctcaggacgctcatccaagaggccaaagaaatgaaatggccattcgtgcctgagaaatggcagtataagcaggcggtgggtcctgaagataagacaaacttgaaggacgtgatcggggccggcctacaacagcttctcgcctccctgagggcttctattctggcacgggactgcgcagcagctgcggcaatagtatttctagtcgatcgctttttgtacggactggacgtatcaggcaaactgttgcaggtggctaaagggcttcacaagctccagcccgctactcccatcgcacctcaagtggtgatccggcaggcaagaatcagcgtcaactcgggcaaacttctcaaggctgagtatatactttcaagtttaatctcaaataacggcgcgacagggacctggctctacagaaacgagtccgacaaggtgctcgtgcaaagtgtgtgcattcagatcaggggacaaatactccaaaagctcggcatgtggtacgaggcagccgagttaatttgggcctctatagtagggtatctagcgctgcctcagcctgataagaagggactgtctaccagtcttggaatcctggcagatatctttgttagcatgagcaagaatgattacgagaagttcaaaaacaatccccagattaatctttctctgctcaaggaatttgatcaccacctgctctccgccgcagaagcctgcaagctggccgcagcctttagcgcctacaccccattgtttgtgctgaccgccgtcaatatccggggaacttgcctcttgagctattcttccagtaatgactgccctcccgagttaaagaatctccatttatgcgaggctaaggaagcattcgagataggcctgctcacaaaacgtgatgatgagccagtgacaggaaaacaggagctgcactcctttgtaaaggccgcctttggcttgacaacagtacacaggagattacacggcgagacaggaacagtgcatgccgcgagccaactgtgcaaggaggccatgggaaaactatacaatttttctacttctagccgatcgcaagacagggaggcgctgagccaggaagttatgagcgttattgctcaagtcaaggagcatctgcaggtccagtctttctcaaatgtggacgatagatcttacgttccagagtcattcgaatgcaggctggataaactgatcctccacgggcaaggcgatttccagaagattctggatacgtactcccagcaccatacttcagtctgtgaggtattcgagtccgactgtggtaacaataagaatgagcagaaagacgcaaaaactggggtttgtattaccgcgctgaagactgaaattaaaaacatcgacaccgtctctacaacgcaggaaaagcctcattgccagcgtgatacaggcatctcatccagtttgatgggaaagaacgtccagcgtgagctgagacgcgggggaaggagaaactggacacattccgacgcttttagagtgagcctggatcaagacgtcgagaccgagacggagccgtctgactactccaatggcgaaggagctgtgttcaataaatctctgagtggttcacagacaagctccgcctggtccaacctgagtggcttctctagttccgcctcttgggaggaggtgaactaccacgtggatgacagatcagcgcggaaggagcccgggaaggaacatctcgtggacacccagtgtagcacggccctgtctgaggagttggaaaacgaccgcgagggcagggccatgcatagcctgcactcacagttgcatgacctgtcgctgcaggaacctaacaacgataacctggaaccctctcagaaccagccacagcagcagatgcccctgactccgttttctccccacaatacgccaggcattttcctagctcctggtgctggactgctcgaaggggctcccgagggtattcaggaggtccgaaacatgggacctaggaacacctccgcacacagcagacctagctaccggtcagctagctggtcatccgatagtggccggcctaagaacatggggacccacccttccgttcagaaggaagaagcttttgagattatcgtcgaattccccgagacaaactgcgatgtaaaagaccggcaagggaaagagcagggcgaagaaatatcagagaggggggctggcccaacatttaaagcctctccttcttgggtcgatccagaaggcgaaaccgcagaatctacagaggatgcacccctagatttccacagggtgttgcataattccttgggaaatatctctatgctgccatgttcttcctttaccccaaattggcctgttcaaaaccctgactctaggaaaagcggcggccccgtggctgagcaggggattgatcccgacgcatctaccgtggatgaggaggggcagctccttgatagtatggacgtgccgtgcacgaacgggcatggatcccacagactgtgtatcctccgacaacctccaggtcagagagccgagacgccaaattcatccgtctcaggcaacattctgtttcctgtcctgagcgaggactgcaccactaccgaggaaggaaatcagcctggcaacatgctgaactgctcgcaaaacagtagctcctccagtgtctggtggctgaagtcacccgcattcagcagtgggagttcagagggagattcgccttggtcatatttgaatagcagtgggtcgtcttgggtttccttacctggaaagatgaggaaggagattcttgaagccaggacccttcagccagatgacttcgaaaagctgctcgccggggtgcgccacgattggctgttccaacgactggaaaatacgggcgtttttaagcccagccagctccatagagcccattcggcactactgctgaagtattctaaaaagtccgaactgtggactgcccaggaaactatcgtatacctaggagattacttgaccgtcaaaaaaaaaggcaggcaaagaaacgcattttgggtgcatcacctccatcaagaagagatcctgggtaggtatgtgggcaaggactacaaggagcaaaaggggctctggcatcacttcacagatgtggaaaggcagatgaccgcccaacattatgttacagaattcaacaagaggctctacgaacagaatatacctactcagatcttctacataccaagcacaatactgctgattctggaggacaaaaccattaaaggatgtatatccgtggagccgtatattcttggtgagttcgtgaagctgtccaacaatacgaaggttgtcaagaccgagtataaggctacggaatatgggctggcctacggacacttttcttacgagttttccaaccacagggatgtggttgtcgatctgcaggggtgggtaaccggcaatggtaaagggctgatctatctgactgatccccagatccactcagtggatcagaaagtgtttaccacgaatttcggcaaaaggggcatcttttactttttcaacaatcagcacgtggaatgtaacgagatttgtcataggttgtcattgactaggccctctatggaaaagccttgtacgtag

SEQ ID NO: 178752 - DNA, 429 bp, Artificial Sequence
  Description of Artificial Sequence: Synthetic coding sequence
atgaacaaccagaaggtggtggccgtgctgctgcaggagtgcaaggcactgctccctagtgagctgcgtacgttgattcaggaggcgaaggagatgaaatggccatttgtacccgagaaatggcagtacaagcaagccgtcggtcccgaggacaagactaacctgaaagatgttataggagctgggcttcagcagctgctcgccagtttaagagcctctatcctcgctcgagactgcgcagctgcagcggcaattgtgtttttggttgatagattcctgtacgggttagacgtttccggaaagcttttacaggttgctaaaggattacataagttgcagccagcgacacctattgccccccaggtggtgattagacaggccagaattagcgtgaattcaggcagccaccctgcaaaacacagcatgtag

SEQ ID NO: 178753 - DNA, 3735 bp, Artificial Sequence
  Description of Artificial Sequence: Synthetic coding sequence
atgaacaaccagaaggtggtggccgtgctgctgcaggagtgcaagcaagtcctggaccaactactgctagaggctcctgacgtttccgaagaggataagtccgaggatcagcggtgtcgggcactgctgccctccgagctgagaactctaatccaggaggcaaaagagatgaagtggccctttgtgccggaaaagtggcagtacaaacaggctgttgggcccgaggataagacaaatttgaaagacgtgataggcgctggccttcagcagctgctggcatctttgcgcgcatcgatcttagcaagggattgcgccgcagcggctgctattgtgttcttagtcgataggttcctgtacgggttagatgtgtctgggaaactgctgcaggttgccaaagggcttcacaaactccagcccgctactccaattgctccccaagttgtcatcaggcaggctagaatatcagtgaattcagggaaactgcttaaggctgaatacatcctgagcagcctgatttcaaataacggcgcgacaggaacttggctttaccgaaacgagtccgacaaggtacttgtccaaagcgtgtgtattcaaatccggggtcagatcctgcagaagctgggaatgtggtacgaggctgcagaattgatttgggcgtccatagtgggctatctggctttgccccagcccgacaagaaaggactgtcaactagtctcggcattcttgcagacattttcgtgtcaatgtcaaagaatgactatgagaaattcaaaaacaatccacagattaatctgtccctgctgaaagagtttgatcaccacctgctcagcgctgcagaagcttgcaagcttgcagccgcgtttagcgcttacacccctctgttcgtgctgacggccgtcaatattagaggcacgtgcctactttcctatagtagcagcaacgattgtcctccagaactgaaaaacttgcatctttgcgaagcaaaagaggcattcgaaattggactgcttacaaagcgggacgatgaacccgttacaggcaagcaagagctgcattccttcgtgaaagcagccttcggccttactacagtgcaccggcgcttacatggagagacagggactgtgcacgctgctagtcagctgtgtaaagaggcaatggggaagctgtacaatttctcaacaagttcccggtcccaggatagggaggccctaagccaggaggttatgtccgtgatcgcccaggttaaagaacacctccaagtccaatcctttagtaacgtcgacgaccgcagctatgtgccggaaagctttgagtgccggcttgacaagctcattctgcacggtcagggggattttcagaagatactggatacctactctcagcaccacacatctgtgtgtgaggtttttgagtccgactgcggaaacaacaagaatgagcagaaagatgctaagactggagtgtgtataactgccctcaaaactgagatcaaaaatattgacaccgtgagcacaacccaggaaaagcctcactgtcagagggataccgggatcagctcttcattaatgggaaaaaacgtacagcgggaactgagacggggaggacgccggaattggacacactctgatgctttccgagtgtctctcgaccaggatgtggaaacagagactgagcctagcgattacagcaatggagagggggctgtgttcaacaagtcactttccggttcgcaaacgtctagcgcatggtctaacctttccggcttcagtagctccgcatcttgggaggaggtgaattaccacgtcgatgatcggtctgccagaaaggagcctggtaaggagcatctggtcgatacccaatgctccaccgcgctgtctgaggaactggaaaacgatagggaagggcgtgccatgcattctctgcactcccagctgcacgatctctctttacaggaaccaaataatgataacctggagcccagccagaaccagcctcagcagcaaatgcccttgacacctttctcccctcataacacccccgggatctttcttgcacctggcgctggcctgctcgagggagcccctgagggaattcaggaagttcggaatatggggccacggaacactagcgcccacagcagaccatcgtaccggtccgcgtcatggtcgagtgattctggaagacccaagaacatggggacccacccctcggtccaaaaggaagaggcgttcgaaatcatagttgaattcccggaaactaattgtgacgtgaaggatcgccagggcaaagaacagggagaagagattagcgaacggggggctggccctacatttaaggcatcaccctcctgggtcgaccctgaaggcgaaactgccgaatctacagaagacgcaccccttgacttccacagagtgctgcacaactcgttgggaaatatctccatgctgccctgctcaagcttcacacccaattggccagttcagaaccctgactccaggaagagcggcggcccagtggccgaacagggaattgaccctgatgccagcacagtggacgaggaaggtcagctacttgatagtatggatgtaccttgcactaacgggcatgggagtcaccgtctctgcatcctgcgacaaccccctgggcagagagcagaaacacctaatagttctgtgagcggcaacatattatttcccgtactgagcgaggattgtactaccacagaggagggaaatcagcccggtaatatgctcaattgcagccagaattcatctagttcaagcgtgtggtggcttaaatctcctgctttctctagtggcagctccgagggagattctccatggtcttatttaaattcatcgggctcgagctgggtctccctccccgggaaaatgagaaaggagattctagaagcccggaccctgcagcctgacgattttgaaaaactcctggccggagtgcggcacgactggctgtttcagcgcctggagaacacaggcgttttcaagccttctcagctacatcgcgctcattcagcactgcttctcaagtacagcaaaaagtctgaactatggactgcccaggagactatcgtatatctgggcgattatcttaccgtgaagaagaagggtaggcagcgcaatgccttttgggtccatcaccttcaccaggaagagattcttggacgctacgtgggtaaagattataaagaacaaaaggggttgtggcaccatttcacagacgttgaacgacagatgacagcccagcattacgtgacagagttcaacaaaagactgtatgagcagaacatcccaacccaaatcttctacatcccctccaccatcttgcttatcctggaagacaagactattaagggctgtattagcgtggaaccatacatcctaggagaatttgtgaaactgtccaataacaccaaggtcgttaagaccgaatataaggcaacggaatatggactggcttatggccatttctcctacgaattctcaaatcatcgggacgtcgtggtggacctccaggggtgggtcaccggtaatggaaagggcttaatttatctgaccgacccccagatccattctgtggatcagaaggttttcactacaaatttcggtaaaagaggcatcttttactttttcaacaaccagcacgttgagtgtaatgaaatttgtcacaggctgtcactgacccggccttcaatggaaaaaccctgcacttag

SEQ ID NO: 178754 - DNA, 3501 bp, Artificial Sequence
  Description of Artificial Sequence: Synthetic coding sequence
atgtgccggaagcggacccgggcccggaccagcgccgccgaggcctcccttagggcatctatcttggctcgtgactgcgcggctgccgcagcgattgtgttcctcgtggataggtttctctatgggctggatgtgagtggaaagttactccaggtcgcaaaaggcctacataaactgcagccagcaactccaatagctcctcaggtcgtaattagacaggccaggatctcagtgaactcaggtaaactgctcaaagccgagtacattctttcctctcttatatctaacaatggcgcaaccggtacatggctgtaccgcaacgaaagcgataaggtgctggtccaatccgtttgtattcagattagaggacaaatactacagaaattggggatgtggtatgaagccgccgagctaatatgggcgagtattgtgggctatttggctctccctcagcctgacaaaaaggggctctcgacttcattgggcatcctggccgatattttcgtgagcatgtctaagaacgactatgagaaattcaagaacaacccccagattaatcttagcctcctgaaagagttcgaccaccatctgctgtctgccgcagaagcttgcaaacttgccgccgcctttagcgcttatactccactctttgtgctcaccgccgtaaacattagaggaacatgcctgctatcctattcctcttccaatgactgcccacctgagttaaagaacctccacctctgtgaagctaaagaggcattcgaaatagggctgctgactaagagagatgacgagcctgttaccggcaaacaggagttgcactctttcgtgaaggctgcatttgggcttaccaccgtgcaccggaggctgcacggtgagaccgggacggtgcacgccgcttctcagctgtgcaaagaggctatgggaaagctgtacaatttctccacctcctcaagatcccaggacagagaggccctgagccaggaagtcatgtccgttatcgctcaggtgaaagagcaccttcaggtccagtcattttccaatgtggacgataggtcttacgtacctgagtctttcgaatgtaggctggataagctgattttgcacggccagggcgatttccaaaagatacttgacacctactcccaacatcacaccagtgtttgtgaggtttttgagtctgattgcgggaataacaagaatgaacaaaaggacgccaagacaggtgtttgcataacagcccttaagacagaaatcaagaatattgacaccgttagcacaacacaggaaaagccccattgccagagggataccggcatctcaagttctctaatggggaagaacgtgcagcgcgagctgcgaaggggcgggaggcgcaactggacccattctgacgcatttcgagtcagcctggatcaggatgtcgaaactgagactgagccatcggattacagcaacggagagggagcagttttcaataaatcccttagcgggagtcagacgtcaagtgcttggtctaacctttctggcttcagcagttcagcaagctgggaggaggtgaattaccatgtcgatgaccgtagcgcccgcaaggaaccgggaaaggagcatctggttgacacccagtgcagtactgcgctttctgaggaattggagaacgatcgggaaggtagagcaatgcactctcttcattcacagctgcacgatctgagtctgcaggagccaaacaacgacaatttggaacccagtcagaaccagccacagcagcaaatgcctctgactccattctcccctcacaacactccagggatctttctggcacctggtgcaggactcctcgagggtgcccctgaaggcatccaggaagttagaaatatgggcccaagaaatacgagcgctcactctcgtccatcttacagaagtgcatcgtggtcctctgacagcgggcggcctaagaacatgggaacgcatccctccgtgcaaaaggaggaagccttcgaaatcatagttgaatttccggaaacaaattgcgacgttaaggataggcaaggcaaggagcaaggggaagagatttcagagcgcggggcaggacctaccttcaaggcaagcccttcatgggtggaccctgaaggagagacagctgagagtacggaagatgctcccctggattttcatagagtgctgcataacagcctgggtaatatcagcatgctgccctgtagttcattcacaccaaattggcctgtgcagaaccccgactcaaggaagagcgggggccccgtggcagagcaaggtattgaccctgatgcttcgaccgttgatgaagaagggcagcttctagacagcatggatgtcccctgtacaaacgggcacggctcccataggctgtgcatcctcaggcaacctcccgggcaacgggctgagaccccaaattcctcggtctccggcaacatcctctttcctgtcttaagcgaggactgcactaccaccgaggagggaaaccagcctgggaatatgttgaattgctcccaaaatagcagctcttcaagcgtttggtggctgaaatccccagcttttagttctggatcaagcgaaggggactcgccatggagttatctcaatagctccggaagttcctgggtatccctacctggaaagatgcggaaggagatccttgaggcccggacacttcagcccgacgatttcgagaagttgctggccggtgttcgacatgactggttatttcaaaggcttgaaaacaccggagtcttcaaacctagccagcttcaccgggcacactcagccctattgctcaaatactctaaaaaaagcgagctctggactgctcaagagactatcgtttacctaggcgattatttgactgtgaaaaagaagggcagacagcgtaatgctttttgggttcatcaccttcaccaggaggaaatcttgggtcgctacgtgggcaaggactataaggaacaaaaaggactctggcaccactttaccgatgtcgagaggcagatgactgcccagcactacgtgacggagttcaacaaacgactgtatgaacagaacatccctacccagatcttctacattccgtccacaatcctgctcatcctagaggataaaaccattaaaggctgcatttcggtggagccgtatatactgggcgagttcgtgaaattaagtaataatacaaaagttgttaaaacagaatacaaagcgaccgagtatggacttgcatacggacacttttcctatgagttctccaaccacagagatgtagttgtcgacctgcagggatgggtaacaggcaacggaaagggccttatctacctgactgacccccagatccattcagtggaccagaaggtgttcaccacaaacttcggaaaacgtgggattttttatttcttcaacaaccagcacgtggagtgtaatgaaatttgccatcgtctttccctgacccggcccagcatggagaagccatgcacatag

SEQ ID NO: 178755 - DNA, 1149 bp, Artificial Sequence
  Description of Artificial Sequence: Synthetic coding sequence
atggccctgcagggcatcagcgtggtggagctgagcggcctggcccccggtcctttctgtgcaatggttctggcagactttggggctagagtcgtgagagtggaccgtcctgggagccggtacgacgtttcccggctgggccgcggcaagaggagcctcgtactagatctgaaacagcccagaggcgcagctgtgctccggaggctgtgtaagagatctgatgtgctcctagaacccttccggagaggggtgatggaaaagcttcagctggggccggagatactgcagagagaaaacccccggctgatctatgccagattgtccggttttggacagagcggatccttttgtcgtctagcgggccacgatattaattatctggcactctccggtgtactaagcaaaatcgggcggagcggcgagaatccatatgcccctctgaatctgctggctgacttcgcagggggcggtctgatgtgcgccttgggcattataatggctctctttgatagaactagaactggtaaggggcaggttatcgatgcaaacatggtggaagggacagcctacctgagcagcttcctgtggaaaacccagaaactgtctctatgggaggcacccagaggacagaatatgctggatggaggggctcctttttacactacctaccgcacagcagacggcgaattcatggcggtcggcgcaatcgaaccccagttttacgaactgctgatcaaaggactggggttaaagagcgacgagcttccaaaccagatgtcgatggacgactggccagaaatgaaaaagaaatttgccgatgtttttgccgaaaagactaaggccgaatggtgtcagatttttgacggcaccgacgcatgcgtgaccccagtcctcacattcgaagaggtggtccaccacgaccacaataaagagaggggctcttttatcacatcagaggagcaggacgtcagtccacgtccagcccccctgctgctgaacaccccagctattccttccttcaagagggacccctttataggagagcatacagaagaaatcctcgaagagtttggcttcagtagggaggaaatctatcagcttaactccgataaaattattgaaagcaataaagtgaaagcgtctctttag

SEQ ID NO: 178756 - DNA, 597 bp, Artificial Sequence
  Description of Artificial Sequence: Synthetic coding sequence
atggccctgcagggcatcagcgtggtggagctgagcggcctggccccaggccctttctgtgcgatggtcttggccgacttcggcgcccgggtagtgcgggtggaccggccaggatccagatacgatgtgtcacgcctcggacggggcaaacggtcactcgtgctggatctaaagcagccgcgcggcgccgccgtcttgagaagactctgtaaacgctccgacgtgctgttagagcccttcaggcgcggcgtcatggagaagttgcagctgggccctgagattctccaaagagagaacccacgccttatatacgcacgcctgagcggcttcggacagtcgggcagtttctgccggctggcaggtcacgatatcaactaccttgctcttagcgggggccgtaactcgattttcaaatttttctccgtggagaacagtgagatcgagtctgttgggagtacttcccgaactgaacatgtgggttggtggtctacgtttctctacgacctgcaggattcccgatggggaatacacgggtgttggagtaataggacaccggtactccgcgccgccgatcagaggacctggaccaaggtgtag

SEQ ID NO: 178757 - DNA, 690 bp, Artificial Sequence
  Description of Artificial Sequence: Synthetic coding sequence
atggccctgcagggcatcagcgtggtggagctgagcggcctggccccgggacccttttgcgccatggttctagccgatttcggcgcgagagtagtgcgcgtggataggccagggtcacgctacgacgtgtctcgactggggagggggaaacgctccttggttttagatctcaaacagccaaggggtgccgctgtgcttaggaggctttgcaaaaggtccgacgtcctcctggagccttttaggcggggggtgatggagaagctgcagctgggcccagagatcctgcagcgcgaaaacccaagactcatttatgccagactctccggtttcgggcagtcagggagcttttgtcgattagccggtcatgacattaactaccttgccctgagtggaggccgaaactctatttttaagttttttagcgtcgagaatagcgagatcgagtctgttgggtcaactagtagaacagagcatgtaggatggtggagtacttttctctatgatctgcaggattcacgctggggtatccacggttgttggtctaaccggactcctgtgctcagagcagccgatcagcggtcattgatcccctattttaatctgtatcttcagtttctcaatatatcaatgcaaaatttgttcaaggtgcatacgttacttcggccttgttattttctggggcagaaatag

SEQ ID NO: 178758 - DNA, 1185 bp, Artificial Sequence
  Description of Artificial Sequence: Synthetic coding sequence
atggccctgcagggcatcagcgtggtggagctgagcggcctggcccccggacctttttgtgctatggtcttggccgacttcggggccagggttgtgagggtagatcggcccgggagcagatacgatgtgtcccggttaggcagagggaaaagatcactagttctggacttaaaacagccacggggcgccgcagttctcaggcggctgtgcaaaagatctgacgttctgctggaaccctttcgcagaggggtgatggagaagcttcagctgggcccagagatcctacagcgcgagaacccaagactgatctacgccagactgtcgggctttggccagagtgggagcttctgcaggcttgcaggacacgatattaactatctcgccctttcgggggtactgtccaagattggtagatccggcgagaacccgtatgccccactgaatctgttagcagacttcgctggcggcgggcttatgtgcgcactcggaattatcatggcattattcgatagaacgcgcaccggaaaagggcaggtgatagatgctaacatggtggaagggactgcctatctttcctcattcctctggaagacccagaagctgtctctctgggaggccccaagaggccagaacatgctggacgggggcgcccctttttacaccacttatcgaactgctgatggcgagttcatggcggtcggggccattgagcctcagttctacgagctccttattaaaggactagggttaaaaagcgacgagctgccaaatcagatgtcaatggacgactggcccgaaatgaagaagaagtttgccgacgtgttcgcagagaaaacgaaggctgaatggtgtcaaatctttgacggcactgacgcctgtgtcactcccgttttgaccttcgaagaggtcgtgcaccacgaccataacaaggaaagagggtcattcatcacctccgaggaacaggacgtgagtcctaggccagctcctcttctgttaaatacacccgccataccctcattcaaacgcgacccttttataggtgagcacaccgaggaaatcttagaggagtttggcttcagccgcgaagaaatttaccagctgaattccgataagatcatcgagagcaacaaagcaggctccaaattttggatcttatatcccacgcacagtaacatacagaaatag

SEQ ID NO: 178759 - DNA, 1002 bp, Artificial Sequence
  Description of Artificial Sequence: Synthetic coding sequence
atggccgccggctgctgcggcgtgaagaagcagaagctgagcagctcgcctccctcagggagtgggggaggtggcggagccagcagctcctctcactgcagtggagagtctcaatgtagggccggcgagcttggcctggggggggccggaaccagactaaatggtctggggggcctgaccggaggcgggagtgggtctggttgcacactgagtcccccacaaggctgcggtggaggaggtggaggtattgcgctgagcccgcctccgagctgtggcgtgggtactttgctgtccacaccagctgccgccacgagtagttccccaagctcttcaagcgccgcatcttcatcttcacctggttcaaggaagatggtggtaagtgccgaaatgtgttgcttctgcttcgacgttctgtattgtcatctttacggttatcagcagccacggacaccacgttttacgaacgagccttacccacttttcgtcacctggaagattgggcgggacaagaggctacgcgggtgtattggtacctttagtgctatgaatctgcactctggattgcgagagtacactctcacgtcagctttaaaagatagtcgcttcccaccgatgacccgtgatgagctgccccggcttttctgctccgtctctctccttaccaattttgaggatgtatgtgactacctagattgggaggtcggagttcatgggattagaatcgaattcatcaacgagaagggcagcaagcggacagcaacgtatctgcctgaagttgccaaggagcagggctgggatcatatacagaccattgatagtctgttgagaaagggtggatacaaagcacctataacgaacgagttcaggaaaaccatcaaattgactagatatagatcggaaaagatgacgctcagctatgcagagtatctggcccacaggcagcaccatcactttcaaaatggcatcggccaccccttgcccccgtacaatcactatagttag

SEQ ID NO: 178760 - DNA, 633 bp, Artificial Sequence
  Description of Artificial Sequence: Synthetic coding sequence
atggtggtgagcgccgagatgtgctgcttctgcttcgacgtgctgtattgccatctgtacgggtaccagcaaccacggactccaagatttactaacgaaccttatccccttttcgtgacttggaaaattggaagggacaaaaggcttcgcggatgtattggcacattctccgccatgaatctgcacagcggcctgcgagaatatacccttacgagcgctctaaaggattctagatttcctcctatgaccagagatgaacttcctcgattgttttgttccgtttccctgctgacaaattttgaggatgtctgtgattacctggactgggaggttggcgttcatggcattagaattgagttcataaacgagaaagggtccaaaagaacagctacctacttgcctgaggtcgcaaaagagcagggttgggatcacatacaaactatcgacagcttgttgcgcaaaggaggatacaaggcacctataaccaacgaattccgaaaaaccatcaagttgaccaggtatcgctcagagaagatgactttgtcgtacgcagaatacctggcacaccgccagcaccaccacttccagaacggcataggccaccctttgccaccttataatcactacagctag

SEQ ID NO: 178761 - DNA, 891 bp, Artificial Sequence
  Description of Artificial Sequence: Synthetic coding sequence
atggccgccggctgctgcggcgtgaagaagcagaagctgagcagcagtccccccagtggctccggtggaggaggcggtgcgtcctcctcctcacattgtagtggagagagccagtgcagggctggcgagctagggctggggggcgccggcaccaggcttaacgggctgggtggtctgacaggcgggggtagcggctccggttgcacccttagtcctccgcaaggctgcggtggcggaggcggtggaattgccctgtccccacctccgtcttgcggagttggcacactgctgagcacacccgcagccgctacctcaagcagcccttcttcctcgtctgcagcctccagcagttctcccggctcacggaagatggttgtcagcgccgaaatgtgctgtttttgttttgacgttttgtattgccacctgtatgggtatcagcagcccaggacaccccgattcactaacgaaccttacgcgctgaaggattcccgatttccacctatgactcgtgacgaactgcctcggctcttctgctccgtcagcctgctcactaattttgaggatgtatgtgattacctcgactgggaggtgggtgtccacgggattagaattgagttcattaacgaaaagggctccaagcgtaccgcaacttacctgccagaagttgcgaaagagcaaggatgggaccacatccagaccatagacagtctgcttcgtaagggagggtacaaagctccgattaccaacgaatttagaaaaactattaagctcacgcgttataggtcagagaaaatgactctgtcctatgccgagtatctggcccatcgtcagcaccatcatttccagaacggtattggccaccccttaccaccctacaaccactactcatag

SEQ ID NO: 178762 - DNA, 2862 bp, Artificial Sequence
  Description of Artificial Sequence: Synthetic coding sequence
atgtgcaaccccgaggaggccgccctgctgcggctggaggaggtgttttctgcaacattggcgcatgtgaactcgctcgtgctacagccactgctgcccgcagccccggacccatctgacccttggggccgggagtgcttacgcctcttgcagcaactgcacaagagctcgcagcagttgtgggaggtcaccgaagaatctctacatagcctccaggagcgccttcgctaccccgactcaaccgggctagagtcgcttctgcttctgcggggagcggatagggtgctccaggcacacattgaatatatcgaaagctatacctcttgcatggttgtccaggctttccagaaagcggctaagcggcggtccgagtactggagaggccaaaggaaggctctgcggcagctccttagcggggtctcgagtgaaggcagtgtgggcgcctccctgggtcaggcgcttcatcagcccctggcccaccatgtgcaacagtatgtgctgctgctcctctcactaggagatacaatcggggagcatcaccctactcgggagctggtggtaaacgcagtgaccttatttggaaacctgcagtcatttatgaagcaggagctcgatcaagcagtggccacacaggctctgtggcatactctgagggggcgcctgcgggacgtgctgtgcacgcctgcacaccggttactccaggactctcaagatgttccagttactgtagctcccctgagagccgagagagtgctgttattcgacgatgccctggtcctgctgcaggggcacaacgttcatactttcgatttaaaactggtgtgggtcgatcccgggcaggacgggtgcacgttccacctgctgacacctgaggaagaattttcgttctgcgccaaggacagccagggccaggccgtatggcagtggaaggtgacttgggcagtgcatcaggcccttcacggtaagaaagactttccagtgctcggagccgggttagagccttcccagcctcccgactgtcgctgcgccgagtatactttccaagctgagggccgtttgtgtcaggcaacatacgagggcgagtggtgtagaggtcggcctcatggtaaggggactctgaaatggcccgacggacgtaatcatgtcggtaacttttgtcagggtctggagcacggatttgggattaggctgctcccccaggcaagtgaggacaagtttgactgctataagtgccattggagggagggatccatgtgtggctacggtatctgcgagtactcaactgacgaggtgtataaaggctatttccaggaaggcctaagacacggttttggagtgctcgagtctgggcctcaggcacctcagcctttccgctacacaggccactgggaacgtggtcagcgctcaggttatggaatcgaggaggatggggataggggggagcgatatatcggtatgtggcaagccggccaacggcacggccccggggttatggtgacccaggcaggagtatgttatcagggtacgttccaggctgataagacagtgggcccgggtatcctcttgtccgaagatgattccctctacgaaggtaccttcacacgtgacctgaccctgatgggcaagggaaaagtaaccttcccgaatgggttcacgttagaggggtcattcggctctggcgccggcagagggcttcacactcagggcgtgctcgacactgcggctctgccccctgatccttcatctacatgcaagagacagttaggagtgggcgcgtttcccgttgagtcacggtggcagggagtgtacagcccctttcgggatttcgtatgcgcaggctgtcctagagacttacaggaagccctgttgggcttcgatgttcagtcctctcgtgaactgaggcggtcacaggattacctgagttgcgagcgcacccaccctgaggatagcgtggggtcaatggaggacatcctggaggaactcctgcagcaccgagagccaaaggccctgcagctctacctgcgcaaagcgttgagtaactctcttcatcccctgggcaagctgctgaggacgcttatgttgacttttcaggctacctacgcgggggtgggtgccaataaacacctgcaagagctcgcgcaagaagaggttaaacagcatgcgcaagagttgtgggccgcttacaggggtttgctgagggtggcgctggaacggaaaggccaggccctcgaggaagacgaggatacggagactcgcgacctgcaggtccacggtcttgttctgccgcttatgttaccatctttttacagcgagctcttcaccctttatttacttctgcatgagcgtgaggattcattctactcccaggggattgcaaatctgagcttgtttcctgacacccagcttctggagtttctggacgtgcaaaagcacctttggcctctcaaagatctcacgctgaccagtaaccagcgctatagtcttgtaagggacaagtgttttctgagtgccacggagtgtctacaaaagatcatgaccacagtcgacccaagggaaaaactggaagttctggagcgcacttacggcgaaattgaaggtacagtttccagggtgcttggtcgggagtataagctcccaatggacgatctgttgccccttctcatatatgtcgtttcacgcgcgaggatccagcatcttggagccgaaattcatctcattagggacatgatggaccccaatcatacagggggactgtacgacttcttacttaccgctcttgagtcttgctatgagcatatccaaaaggaggatatgaggctccaccggctccccggtcattggcatagcagagaattatggtag

SEQ ID NO: 178763 - DNA, 903 bp, Artificial Sequence
  Description of Artificial Sequence: Synthetic coding sequence
atggaggacatcctggaggagctgctgcagcaccgggagcccaaggcgcttcagttgtacctcaggaaggcattgtccaattcacttcatcctctggggaagctgttacggacccttatgcttaccttccaggccacgtacgctggtgtgggagccaataaacatcttcaggagctcgctcaagaagaagtgaagcagcatgcccaagagctctgggccgcgtaccgaggcctcctgagagtagccctggaacgcaaaggacaggcattggaggaagacgaggatacagaaactagagacttgcaggtgcacggcttggtgttgccgctgatgctgcctagtttctacagtgagctctttacgctgtatctgctcctgcacgagcgtgaagattcgttctattcacaggggattgccaatttgtccctgtttcctgatactcagctgttagagttcctggatgtccaaaagcacctttggcctctgaaagatttaactttaacctcgaatcagcggtattcacttgtgagggataaatgcttcctgtccgctacggaatgtctgcagaaaattatgactaccgttgatccgagagaaaagctagaagtgttggagcggacatacggcgagatcgagggcaccgtgtccagggtcttgggcagggaatacaaactgccgatggatgacctgctgcccttgttgatatatgtggtctccagagccaggattcagcatctcggcgcagagattcacctgattcgtgatatgatggatcccaatcacaccgggggcctctatgatttcctgctgacagccctcgagagctgttatgagcacattcaaaaagaggatatgcgccttcaccgtctccccggccactggcactcccgcgagctatggtag

SEQ ID NO: 178764 - DNA, 2862 bp, Artificial Sequence
  Description of Artificial Sequence: Synthetic coding sequence
atgtgcaaccccgaggaggccgccctgctgcggctggaggaggtgtttagcgcgacattagcccacgtcaacagtttggtcctgcaaccactgctcccagctgcccctgaccctagtgacccatggggcagagagtgcctgcgcttgctacagcagctccacaaatcctcccagcaattatgggaggtgacagaggagagtcttcattccctacaggagcgcctgagatacccggattcaaccgggcttgagtctcttctccttctgcgcggcgcggaccgagtgctgcaggctcacatcgaatatatagagtcgtatacgtcgtgcatggtagtacaggcatttcagaaggccgccaagcgacggtcagagtattggagaggacagcgaaaagctctaaggcagctcttatcaggcgtgtccagtgaaggcagcgtgggtgcttcgctcggacaggcactgcatcagccactggcacaccacgtgcagcaatatgtcctcctcttgttgtcactcggggacactattggcgagcatcatccgacgcgggagctggtcgttaatgctgtaacactttttggtaaccttcagagcttcatgaagcaggagctcgatcaggccgttgccactcaggccctctggcataccctccggggccggcttcgggacgtgctatgtacgcccgcacaccggcttcttcaggactcacaggatgtgccagtaactgtcgctccactgcgcgcggaaagggtactgttattcgacgatgctctcgttctcttgcaggggcataatgtgcatacatttgacttaaagctggtctgggtagaccccggtcaggacggttgcacctttcacttgctaacgcctgaggaggagttctccttttgtgccaaagactcccaagggcaggctgtgtggcagtggaaagtgacctgggccgtgcatcaggcattacatggcaaaaaagactttccagtgctaggcgccggcctcgagcctagccaaccacctgattgcagatgtgctgagtatacctttcaggctgaggggcgactgtgccaggcgacgtacgagggcgagtggtgccgcggaaggccgcatggtaagggcacactaaagtggcctgatggccggaaccatgttggaaacttctgtcagggtttggaacacggattcggcatcagacttctgccacaggcttctgaagacaagttcgactgttacaagtgccactggagagaaggaagcatgtgcggatacggtatctgcgaatatagcactgacgaagtctacaagggctatttccaggagggacttcgacacggttttggggttttagagagcggcccccaagctccgcagccattccggtacactggccattgggagcggggacagcgtagcgggtatggaattgaagaggacggcgatcgaggcgagaggtacattggaatgtggcaggctggtcagcgacacggcccaggcgtcatggttacacaagcaggggtgtgctaccagggaacctttcaggcggacaaaactgtgggtcccggaatacttttgtccgaagatgattcactgtacgaggggacatttactcgggatctcacactgatggggaaaggaaaggttacatttcccaacggtttcaccctggaaggctccttcgggagtggagccggccggggacttcatacacagggggtgctcgatactgctgcactgccccctgatccatcttcaacttgtaagcgacagctgggcgtcggagccttcccagtggaatctcggtggcaaggtgtgtacagccccttccgggattttgtttgcgctggctgccctcgggatctgcaagaagccctgctgggattcgacgttcagagctcacgagagctgaggagatcacaggattacctaagttgcgaacgcacccatcctgaagacagcgtggggtcgatggaggacattttggaggaattgttgcagcaccgggaacccaaggccctgcaattgtatctgagaaaggccttatcgaatagtcttcatccattaggcaaactcctgcggacattaatgcttacattccaggccacttatgcaggagttggagcaaataaacacctgcaggagctggctcaggaagaagtcaaacagcacgcccaggagctgtgggctgcataccgaggtctgctgcgagttgcgctcgagcgcaaaggccaggcgctcgaagaggacgaagatactgaaacaagggatctccaggttcatggtctcgtgctgcctttgatgctcccttccttctactcagagctgttcacgctgtacttactcctgcacgagagggaggactccttttacagccagggaatagccaatttaagtcttttccccgacacacagctgctcgaatttctggacgtgcagaagcatctctggcctttaaaggatttaactttgacttctaatcagcggtactccctcgtccgggacaagtgcttcctgtctgcgaccgagtgcctgcaaaagatcatgacgaccgtggatcctcgggaaaaattggaggtgctggaacgtacttatggtgaaatcgagggaacagtgagtagagtgcttggccgagaatacaagctgccaatggacgacctacttcccctgctgatttacgtggtaagtagggctagaatccagcacctgggagcagagattcatctgatcagagatatgatggaccctaatcacacaggggggctgtacgacttcctcctgaccgccctggagtcatgctacgagcacattcagaaagaggacatgagactgcaccgactgcccggacactggcactcacgagagttgtggtag

SEQ ID NO: 178765 - DNA, 12504 bp, Artificial Sequence
  Description of Artificial Sequence: Synthetic coding sequence
atggagcccgaggacctgccctggcccggcgagctggaggaggaggaggaagaggaagaagaagaggaggaggaggaggaggaggctgcggcagccgcggcagccaatgtcgacgatgtggttgtggtggaggaagtcgaagaagaggccggccgcgagctcgatagcgactcccactacggtcctcagcacctcgagagcattgatgatgaagaggatgaagaggccaaggcctggctacaagcacatcccgggcgcatcctgccaccactgagccccccccaacacaggtactctgagggcgaacgaacttctctagaaaagattgttcccctcacatgccacgtgtggcagcagattgtgtatcaggggaacagtaggacacagatatctgacacgaatgtggtttgtttggaaacaactgcccagcgaggctcaggagatgaccagaagactgaatcctggcattgcttaccccaggagatggattcctcacagacactcgacactagccaaacgaggttcaatgtgcggaccgaagacaccgaggtaaccgatttccctagccttgaagaagggatactcacacaaagcgagaaccaggtcaaagagcccaaccgtgatctgttctgctcccctctgctagtgattcaagactccttcgctagcccggacctgcctctcctgacgtgtctgactcaggaccaggagtttgctcctgattccctgttccaccagagtgagctgagcttcgcacccctcagaggcattccggataaatcagaagacacagaatggtcttcccgacccagtgaagttagtgaggccctcttccaggctaccgcagaggtggctagcgacctcgcatccagtcgctttagcgtttcccagcaccctttgattggatcaaccgccgtggggagccagtgccccttcctccccagcgagcagggaaataacgaagaaacaatctcctcggtcgatgagcttaagatccccaaggactgcgatcgctacgacgacctgtgctcatatatgagctggaaaacaaggaaagatactcagtggccagagaacaacctcgccgacaaagatcaggtctccgtcgccacgtcatttgacatcaccgatgagaatatcgcgactaaaagatctgaccatttcgacgcggcccgctcttacggacaatactggacccaggaagactccagcaaacaggctgaaacttacctcacaaaaggcttacaaggcaaagtggaaagtgatgtgattactctggacggccttaatgaaaacgctgtggtgtgctctgagagagtggctgaattacagagaaagcctacacgggaatctgaatatcacagctccgacttaaggatgttgcgtatgagtccggatactgtccccaaagcgcccaaacatcttaaggctggcgatacgagtaagggaggcatcgctaaggtgactcagtcaaatcttaagagtggtatcactacaacccccgttgactccgatatcggcagccacttgtcgcttagtctcgaggatctgtctcagttggccgtctctagtctcgaaacaactaccgggcagcacacagacactcttaaccagaaaacactggccgacacccacctgaccgaggagacactgaaggtaactgcgattcccgaacctgccgaccaaaagacagccacgccaaccgtgctaagttcctcacacagccataggggcaaaccaagcattttttatcaacaggggttaccagattcacacctcacagaagaagcacttaaagtgtctgcagcccctggactcgctgatcagacaacaggcatgtctactctcacgtccaccagctactctcaccgagaaaagccaggcacattttatcaacaggaactcccagagagcaacttgacggaggaaccactggaagtatctgccgcgcccggacccgtggaacagaagacaggcattcctaccgtttcctcgacatcacacagccacgtagaggatcttttgttcttttatcggcaaacccttcctgatggacacctcactgatcaagccttaaaagtttctgccgtgtccggccctgctgaccagaaaacaggcacggcaaccgtgttatcgaccccccatagccaccgcgagaagcctggaatcttttaccaacaggagtttgcggatagtcatcagactgaagaaactctcactaaggtttccgccacccccggaccggccgaccagaagaccgaaatccctgcagttcagtcatcttcctattcacaaagggaaaagccatcaattctttacccccaggacctggcagacagtcatttaccagaagaaggcttgaaggtctccgctgtggccgggccagcagaccagaagaccggtttgcctactgtacctagctccgcctatagccatcgggagaagctcctcgtcttttatcaacaggcgctgctcgattctcacttgcccgaggaggctctaaaagtaagtgccgtgtcaggacctgccgatggcaaaactggaaccccggctgtgacatctaccagttctgccagtagtagtctgggcgagaaacctagcgccttctaccagcagacacttccgaactcgcatctgacggaagaagccctgaaggtatctatcgtccccggacctggggatcaaaagactgggattccctccgcccccagctccttctatagtcatcgcgagaagcccattatattcagtcagcagacactccctgattttttgtttcccgaggaggcactcaaagtgtctgctgtgtctgtgctcgcggctcagaagacagggacaccaaccgtcagttctaatagccattcccattcagagaagtcgagcgtgttctaccagcaggaactccctgattccgacctccctcgcgagtctctcaagatgtctgccattcccggtctgactgaccaaaagacagtgccaacacccacagtgccgtcagggagcttctcccatcgtgagaagccgtcgattttttaccagcaggaatggccagattcctatgccacggagaaggctctgaaggtgtccaccggacctggacctgcggatcagaagacggaaattccggctgtgcagtctagctcctacccccagcgagagaagccttccgtactgtaccctcaggtgctcagcgactctcacttgcccgaggagagtctgaaggtcagtgcctttccagggcctgccgaccagatgactgatacccctgccgtgccctccacattttactctcagcgagaaaaaccaggtattttttaccaacagacgctacccgagtctcacctccccaaagaggccctgaagatctccgtcgctcctggcttggctgaccagaagacaggaactcccactgttacgtctacatcttattcccagcatagggagaagccatctatttttcatcagcaggcacttccgggaacgcacatcccagaggaggcacaaaaggtctcagctgtcaccggtcctgggaatcagaagacctggatcccaagagtcttgagtaccttctactcacaaagagaaaagccggggattttttaccagcagactctgccaggctcccacatacctgaggaggcacaaaaggtatcccccgtgttgggacccgccgaccagaagacaggcacaccaactcctacaagtgcgagttactcccatacagagaaaccgggaatcttttaccagcaggttctgcctgataatcacccaaccgaggaagccctgaaaattagtgtggctagcgagcccgttgatcagaccactggcaccccggccgttaccagtactagttactcacagtatagggaaaagccaagcatcttttatcagcagtcactgccgtccagccatctaacggaggaggctaagaatgtgagtgctgttcctgggcccgcagatcagaagactgtaatcccaatcctcccgtcaaccttctattcacatacagagaaaccgggggttttttaccagcaggtgctgccccactctcacccgaccgaagaggctctgaagatctctgtggccagcgagcccgtcgatcagaccactggcaccccaactgtgacatccacatcttatagccagcacacagaaaagcctagcatcttctaccaacagtcattgccaggctcccatctcacggaggaggccaagaatgtgtccgccgtacccggccctggcgatcgcaagaccgggattcctactctgccgagtacgttttactcacatacagagaagcctggctccttctatcagcaagtcctgccccatagccacctcccggaggaggccctggaagttagcgtagctccagggcctgttgaccagacaatcggtacgcctaccgtcaccagcccgtcatcaagcttcggggaaaagcccatcgtcatctataagcaggccttcccagaaggccacctgccggaggagagcctcaaagtctccgtagcccctggcccagtggggcagacaaccggggcccccacaatcacctccccaagttactcccagcacagggccaagagcggatcattctaccaactcgcgttgctcggcagtcagataccagaggaagccttgcgggtttcatctgcgcctgggcccgcagaccaaacaaccgggattcccaccataaccagtacctcatatagcttcggcgagaagccaattgtcaattataaacaggctttcccagatggccacctgccagaggaagctctgaaggtgagcattgtgagcggccctaccgaaaagaaaaccgatattcctgccggccctttgggatcttccgccctgggagaaaagccaattaccttttacaggcaggccttgcttgacagccccctgaacaaggaagtggtcaaggtgtctgccgccccagggcctgctgatcagaaaacagagacactgccagtacactccacttcttatagtaaccgcggcaagcctgtaatcttctatcaacagacactgtcagactctcatctgcccgaagaggctttgaaggtccctcctgttcccggaccagatgcccagaagaccgaaactccttcagtgtccagcagcttgtacagttaccgcgaaaagccaatcgtgttctatcaacaggctctccccgattcggagctgacccaagaggcacttaaagttagcgctgttccgcagcccgccgaccagaagaccggtctgtccactgtcacgtcatccttttattctcataccgaaaaacccaacatcagttatcagcaggaacttcctgatagccacctgacagaagaggcgctaaaagtgtcgaacgttcccggaccagccgatcaaaaaacaggcgtctcaaccgtgacaagcacctcttatagccatagagaaaaacctatagtaagttatcagagggagctcccccactttacggaagccggcctgaagattctgcgggtccccgggcccgctgaccagaagacgggaatcaacatccttccctccaactcgtatccccaaagggaacactcagtgatttcctacgaacaggaactccctgaccttacagaagtcactttgaaggcaattggggtgccaggtccagccgatcagaaaaccggaatccagattgcaagttcatccagctacagcaacagagaaaaagccagtattttccaccaacaggagcttcctgacgtgactgaggaagcgttaaacgtgttcgtagtccccgggcaaggcgaccggaaaactgagatacccacagtcccgctcagttattactctagaagagagaaaccaagcgtgatctcccaacaggagttgccagattcacatttgactgaggaggctctaaaagtgtctccagtgagtattcctgcggaacaaaaaacaggtataccaatcggcttgagctcctcgtactcccatagtcataaggagaaactaaaaatctcgaccgtccacatccctgatgaccagaagactgagtttccggcagccacgctctcgtcatactcacaaatagagaaacctaagataagtaccgtgattggaccaaacgaccagaagacgccatcccagacggccttccactcatcctactcacaaaccgtgaagccaaatattttgtttcaacagcaactgccagatcgcgatcagtccaagggcattttaaaaatcagcgcggtgcccgagctgaccgatgtgaacacagggaaacccgtgagtctgagctcttcgtactttcatcgagaaaagtcaaacatcttttccccgcaagaactgcctggaagtcacgtgacggaagacgtcctcaaagtcagcacaatcccggggccggccgggcagaagaccgtgctccccacagcgctgccatccagcttttcccaccgcgagaagccagatatcttctatcaaaaggatctccccgacagacatcttacagaggacgcattgaaaatttcgtctgcactgggccaagctgatcagatcactggtttgcagaccgttccctcgggcacttacagccacggtgagaaccataaactggtgagcgagcatgtgcagaggctgatcgacaacttaaactcttccgactcatcagtgtcgtcaaacaatgtgcttctaaactctcaggccgacgaccgcgtggttatcaataagcccgaatccgcaggatttagagacgtgggctcagaagagattcaggatgcggagaacagcgctaaaacactgaaagagatccgcacactgctgatggaggctgagaacatggcgctcaagcgctgtaattttcccgctcccctggccagattcagagatatatctgacatttctttcatccagagtaagaaggtggtgtgtttcaaagagccatccagcactggagtgtcgaacggggacctactgcacaggcagcccttcacggaggaatcccccagtagtcgatgtattcagaaagacataggaactcagactaatctcaagtgcagacgcggaatcgagaattgggagttcatctcaagcactacagtgcggtcccctctgcaagaagcggagagtaaggtgtctatggcactggaagagacattgcgtcagtaccaagcagcaaagtccgtgatgagatcagagcccgagggctgctccggcacgatcggcaacaagatcattatccctatgatgaccgtgatcaaatctgattcatcttccgacgcttccgacggaaatggctcctgctcatgggactctaatttgcctgagtcccttgagtcagtctcggatgtgttgttgaacttcttcccctacgtgagccccaagacaagcataaccgattctcgggaagaggaaggcgtttctgagtcagaagatggtggggggagcagtgtggacagcttagctgcccatgtcaagaacctactgcagtgcgaatctagtttgaaccacgcaaaggagatcctgcgaaacgccgaagaggaggagagtcgtgttagggcacacgcgtggaacatgaaattcaacctcgcccacgactgtgggtactctattagcgagctgaatgaggacgaccgacgtaaagtcgaagagatcaaggccgaattgtttggacatggaagaactaccgacttgtccaaaggactgcagtcaccaaggggtatgggatgtaaaccggaggccgtgtgtagtcatataataattgagagtcacgaaaagggatgcttcagaaccctgacctccgagcacccgcaacttgacaggcacccgtgtgccttccggagtgctggcccaagcgagatgactagaggcaggcaaaacccttcaagctgtagggctaaacacgtgaacctttctgcatccttggaccagaacaactctcatttcaaagtctggaattctttgcagctgaaatcccacagtcctttccagaactttattcctgacgagtttaagatttcaaaggggcttcggatgcctttcgatgagaaaatggatccctggcttagcgagctggtggagcctgcatttgttcctccaaaagaggtggatttccactcgtcatcacagatgccatctcccgaacctatgaagaagtttactaccagtatcactttttcatcacaccgacattcaaagtgcatctccaactctagcgttgtcaaggtgggtgtgacagaaggttctcagtgtacaggtgcctctgttggcgtcttcaactcacactttaccgaggagcagaatccccccagggaccttaagcagaagacatcatccccaagttctttcaaaatgcatagcaattcccaggacaaggaagtgacaatacttgctgaagggcggcggcagtctcagaagctcccagtcgatttcgagaggagttttcaggaggagaaacccctagagaggagtgatttcaccggatcccattcggaaccctccacgagggccaattgttcaaatttcaaagaaatacagatcagcgacaatcatacacttattagtatgggccggccgagttctacccttggcgtcaatcgctccagtagcagattgggagtgaaagagaaaaatgtgacaattaccccagatcttccaagctgcatatttctagagcagcgtgagctgttcgagcagagcaaagctccacgcgctgatgaccacgtcaggaaacatcattcgccatcaccccagcatcaggattacgtcgccccggatctcccatcttgtatcttcctggagcagagggagctgtttgaacagtgtaaagctccttatgtcgaccaccaaatgcgcgagaaccattctccacttccccagggacaagacagcatcgcatccgatcttcctagccccatcagcttagaacagtgccagtccaaagctccaggggttgatgatcagatgaacaagcatcactttcccctgccacagggccaggattgtgtggtcgagaaaaataaccagcataagcccaagtcccatatctctaatattaatgtggaggccaaattcaacactgtagtcagtcagtcagctccaaatcattgcacactagcggccagtgccagcactccaccgtccaatcggaaggccctgagttgcgtacatatcaccctctgtccgaagacatccagtaaactggatagcggtacccttgatgagcggttccactcattggacgcggcaagcaaagctaggatgaactccgagttcaacttcgacctgcatactgtgtcatcaagatccctggagccaacatctaagctgctgacatctaaacctgtcgcacaggaccaggagtccttgggatttctgggacccaagtcatccctggatttccaggtcgttcaacccagcctccccgatagtaataccataactcaggacctgaagaccattccttcccagaacagtcagattgtgacatctaggcagattcaggtaaatatcagcgattttgaaggacactcaaacccagaaggcaccccagtgtttgctgaccggcttcccgagaagatgaagacgcccctcagtgctttcagtgagaagctctcttctgacgcggtaacacaaattactaccgaaagcccagagaagacactgttttcatctgagatttttattaacgcagaggaccggggacacgaaattatagagcccggcaatcaaaaactccgcaaagccccagtgaaattcgccagtagctctagcgtgcaacaggtgacgttttctcgagggactgatggtcaaccactgcttctgccatacaagccctccgggtcgactaaaatgtactacgttccgcaactgcgtcagattcccccctctccggacagcaagtccgatactaccgtggaatcatcccattccggctccaacgacgccatcgccccggattttccggctcaggtgctgggcactcgagatgatgatctgtcggccactgttaatatcaagcataaagaaggcatctattctaagagggttgtgaccaaggcttcccttccagttggcgaaaaacccctacagaacgagaacgcagatgcaagcgtgcaggtgctgattaccggcgatgagaatctttccgacaagaagcagcaagagattcactctaccagggcggtgactgaggcggctcaagccaaggaaaaggagtcacttcagaaggacacagccgatagttcggccgcggcagcagctgagcactctgcacaggtgggcgatccagagatgaaaaacctacccgatacaaaagcgattacacagaaggaggagatccaccgcaagaagacggttcctgaggaagcatggccaaataacaaggagtcgctccagattaacatcgaggaatcggaatgccattcagaatttgaaaatacaacccgtagtgtttttcgctctgctaaattctacatccatcaccctgtgcatctgccatcagatcaagatatttgccacgaatccctcggtaagtccgtgttcatgcggcactcctggaaagacttttttcagcaccatccggataagcatagggagcacatgtgcctgccattgccctaccagaatatggataagacaaaaactgattacacccggataaagtccttgtcaattaatgtgaatctgggcaacaaggaagtgatggataccactaaatcacaggtccgagattaccctaagcacaatggccaaatatccgatccgcagcgggatcagaaagtgacccccgagcagaccacccagcacactgtgtcattaaatgagctctggaataaatacagagaacgtcagaggcagcagcgtcagcccgaacttggcgacaggaaagaactgtctcttgtggaccgactcgaccgcctggctaagatcctgcagaatccaattactcactctcttcaggtttcggaaagtactcacgatgattcccgcggtgaacgcagcgtcaaggagtggtccggccgccagcagcagagaaacaagctccaaaagaaaaagaggttcaagtcgctagagaaatcccacaaaaatactggtgaactcaagaagtccaaagtgcttagtcaccatagggcaggtagaagtaatcagattaaaattgagcagataaagtttgacaaatacattctgtccaaacagcccggcttcaattacattagcaatacgagcagcgattgtcgaccttcagaagagtccgaactcctgaccgacaccaccacgaacatcttaagtggaaccacttcgacggtagagtccgacatcctgactcagaccgatcgcgaggtggctctgcacgaaaggagtagctccgtctccacgatagatactgcgcgcctgatacaggccttcgggcacgagagggtctgcctcagcccccgtcggatcaaactctatagttccatcacaaaccagcagcggcgatacctggagaagcgatctaagcactctaaaaaagtgcttaatactggtcatcctcttgtgacctccgaacatacgcgtcgacggcacatccaggtggccaatcatgtcatctctagtgacagcatcagctcctccgcatcctcttttttgtcctctaactctacattctgcaacaagcagaatgttcacatgctcaataaaggtattcaggccggaaacctggaaatcgtgaacggggctaagaaacatacccgggatgtaggcatcacattccccactcctagttcatccgaggcaaagctggaagaaaactccgatgtgacgtcctggtctgaggagaagagagaggagaaaatgctattcaccggctatccggaggataggaagctgaaaaaaaataaaaagaacagccacgagggagtgagttggttcgttcctgtcgaaaatgtggagagtcgcagcaaaaaggaaaacgtgcccaatacatgtgggcccgggatatcttggttcgaaccgatcacgaaaacacggccctggagagagccactaagggaacagaactgccaggggcagcatctcgatggacgaggttatctggcaggccccggtcgcgaggccgggagggatcttctgcgcccattcgtcagagcaactctgcaggagtccctgcagttccataggccggactttattagccggtctggcgagagaattaaacgcctaaaactgatcgtccaggaaagaaaactgcaaagcatgctgcaaactgaacgcgacgcactcttcaacatagacagggagcgccagggacatcagaatcggatgtgcccactgcctaagcgggtgttcctggccatccaaaagaacaaaccaatctccaagaaggagatgatccagcggagcaaaagaatctacgagcagttgcctgaagtacagaagaaacgcgaagaggaaaaaagaaagtctgagtataagagctatcgtctccgggcccaactgtacaagaaaagggtgaccaaccagctgctgggtaggaaagtaccctgggactag

SEQ ID NO: 178766 - DNA, 7686 bp, Artificial Sequence
  Description of Artificial Sequence: Synthetic coding sequence
atggagcccgaggacctgccctggcccggcgagctggaggaggaggaagaggaagaagaagaggaagaggaggaggaagaggaggctgctgctgccgcagcggctaatgtggatgacgttgttgtggtggaggaagtcgaagaggaggcgggtcgcgagctggactccgattcacactacggaccacaacatctggagagcatcgacgatgaggaggatgaagaggctaaggcttggctgcaggctcacccaggacgcatactgccgcccctgtccccccctcagcacaggtacagcgaaggagaaagaacgagtttagagaagatcgtacccctgacgtgccacgtttggcagcagatcgtctaccagggcaattcgaggacacagatctccgacacaaacgtggtgtgcctggaaaccaccgcccaaaggggtagcggggatgaccagaagactgaatcttggcattgcctgccacaagagatggactcgtcccaaaccctggatacatctcagacccggttcaacgtgagaaccgaggatacagaggttacagattttcccagtctggaagagggtatcctgactcagtctgaaaaccaggttaaagagccaaatcgtgatctgttctgtagtcctcttttggtaattcaggacagcttcgcatccccagacctgcctcttctgacctgcctgacccaagaccaagaatttgctccagactcactcttccaccagtccgaactttcctttgcaccactccgaggaatcccagataagtcagaggacaccgagtggtcatcacgtccatccgaagtcagtgaggcgttgttccaggctaccgccgaggtagcaagtgacctggcctcctcccgcttttctgtttcccaacaccctctgattgggagtacggccgtagggagccagtgtccattcttaccaagcgagcagggaaataatgaggagacaatatcatcagtggatgaactgaaaattccaaaagactgcgataggtacgatgatctatgctcttacatgtcctggaagacaagaaaggatacccagtggccagagaacaatttggccgacaaggatcaggtgagcgtcgccacgtcgttcgacatcaccgacgaaaatattgctactaagcgcagcgaccactttgatgctgccagatcttatgggcagtactggacccaggaagattctagtaaacaggctgagacctacctgacaaagggcctgcaagggaaggtcgaaagtgatgtaatcacattggatggactgaatgagaatgctgtggtgtgctcagagagggttgcagagcttcagagaaagcccacccgtgagtctgaatatcacagctcggatcttcgaatgctgagaatgtcaccagataccgtccccaaagctccaaagcacctgaaggctggcgatacatcgaagggcggcatcgccaaggtaactcagtccaacctaaaatctggaatcactacaactcccgtggactctgacataggcagtcacctttctttgtcgctggaggacttatcccaactcgccgtgtccagcttggaaacaactaccggtcaacataccgacaccctgaatcagaagacgcttgcagatacgcacctgactgaagaaacactgaaagtcacagctatacccgagcccgcggaccagaaaactgcaacgcctactgttctctcctcctcacactcccatcgcgggaagccctctatattctaccagcaaggcctcccagattcccacttgacagaagaggcccttaaggtatccgctgcaccaggtttagctgaccagacaacaggcatgagcaccttaacgtcaacttcctatagtcacagagaaaaacctgggacattttatcagcaagaactccctgagtccaatctcacagaggagcccctagaagtgagtgccgctcctggacccgtcgaacagaagacagggatcccaacggtgagtagtacctctcactctcatgtggaggacctgctttttttctaccgccagactttaccggacggacacctcacagaccaggctcttaaagtctctgccgtgtcaggtccggccgatcagaaaacagggaccgccacagtactttcaaccccccactcccaccgggaaaagccaggaatcttctaccaacaggaattcgcagactcgcaccagacagaagagacactgactaaagtgtccgcgacccctggccctgccgatcaaaagacagagatccctgcagtgcaaagcagctcttacagccagcgcgagaagcccagtatactgtatccacaggacctcgccgacagccacctgccagaggagggcttgaaggtatccgctgtggcaggcccagccgatcaaaagaccgggctgccaaccgtcccatcttctgcctacagtcaccgggagaagctgcttgttttctaccagcaagccctcttagactctcacctgcccgaagaggctttgaaagtctctgccgtttctggaccggctgatggaaaaacaggaacacccgccgttacttccacttccagtgcatcttcaagccttggcgagaaaccatcagcattctaccagcagaccttgccaaacagccatctcacagaagaagctctgaaagtgtcaatcgtgcccggacctggggatcagaagaccgggatcccatctgcccccagcagcttttacagccatcgggaaaagcctattatctttagccagcagacactacccgacttcttgttccctgaggaagcacttaaggtgtctgccgtgagtgtgctcgctgcccagaaaacggggaccccaaccgtcagttcaaatagccactcgcattctgagaaatcaagcgtgttttatcagcaagaactgcccgactccgatctacccagggagtccttgaaaatgtccgctatccccggattaacagaccaaaagacagtgccaacaccaaccgtcccgtcagggtcgttctcccatcgtgaaaagccctctattttttatcagcaggagtggcctgatagctatgccacggagaaggccttgaaagtgtctactggcccgggcccggctgaccagaagacggagattcctgccgtccaaagctcgtcttatcctcagcgcgagaaaccctctgtcctatatccgcaggtgttgtcagattctcacttgcctgaggaatctctgaaggtttcagctttccccggccccgccgaccagatgactgacactcctgctgtgccaagcaccttctactcccagagagaaaaaccggggatcttctaccagcagactctgcctgagtcccatctgcccaaggaagccctgaaaatcagcgtggcgccgggacttgcagatcaaaagaccggtactcccaccgtcacttccaccagctactcccaacatagggagaaaccctccatttttcatcagcaggcattacctggcacccatattccggaagaagcccagaaggtcagcgccgtcacgggtcctgggaaccagaagacttggattccacgtgtgctcagtacattctactcacagcgtgagaagcctggcatcttttatcagcaaactctgccagggtcgcacatccccgaggaagctcaaaaggtgtcccctgtgctaggccctgctgaccagaaaacaggaactccgaccccaacctctgcatcgtacagccatactgagaagcctggaatattctaccagcaggtgttgcctgataatcaccccacggaagaagccctgaagattagcgtcgcttctgagcccgtggaccagacaacaggcactccagcagtcacttccacgtcatactctcagtaccgagagaagcctagcattttctatcagcagagcctgccaagctctcacctgacggaggaggccaaaaatgtttcagcagtgccaggaccagccgaccaaaagaccgtgattccaatcttaccaagtacattctacagtcacaccgagaagccaggagtgttctatcaacaggtgttacctcactcccacccaacagaggaggcattgaagatctctgtggccagcgagcctgtcgaccaaactaccggcacccccacagtgacttctacgtcatactctcagcacacggagaaaccctcgatcttctaccagcagtctttgccaggaagccatcttaccgaagaggctaagaacgtgtcagccgtgccgggccctggtgacagaaaaaccggtatacctaccctgccatccacgttctactcccacaccgagaagcctgggtcattctatcagcaggtgctgcctcattcccatctgcccgaagaggccctggaggtgtctgtggcccctggacccgtggaccagactatcggcacccccaccgtgacctcccccagttcctccttcggcgaaaagccaatcgtcatttataaacaggcctttcccgagggtcatctcccggaggagtcactcaaagtcagcgtagccccaggccctgtgggccagactaccggtgctccgaccatcaccagcccctcctattcccagcatcgtgcaaaatccgggagcttctaccagctcgctctgctggggtcccagattccagaggaggccctgcgcgtgtccagcgctcctggccccgcagaccaaacaacagggattcctactattactagtacgagttactcatttggagaaaagccgattgtcaattacaagcaggctttcccagatggacacctacctgaggaagccttaaaagtgagtatcgtttccggtcccaccgaaaaaaagaccgacattccagccgggcccctgggcagcagtgctctgggggaaaaaccaatcacgttttacagacaggcgttacttgactcgccactgaataaagaggtggtcaaagtctcagcagcccccggtccagctgaccagaaaaccgagacactgcccgtacattccacttcctacagtaacagggggaagcctgtcatattttatcagcaaacactgtctgacagtcatctgcccgaagaggcactgaaagtgcctccagtgccgggacctgatgcacagaagacagagaccccttccgtttctagcagcctttattcataccgagagaaaccgattgttttctaccagcaggcactgcccgactccgagttgacgcaggaggcgctgaaagtgtcagctgtgccccagcccgcagatcagaaaaccgggctgtcaaccgtgacgtcaagtttctatagccacaccgagaagcctaacattagctatcagcaggagctgcccgattctcatctaaccgaggaagccctcaaggtatctaacgttccaggaccggccgatcaaaagactggtgtgagcactgtgacctctaccagctacagccaccgcgagaagcccattgtgtcgtatcagagggaactaccccactttactgaggccggccttaaaattttgcgggttcccgggcccgcagatcaaaaaaccggaataaatatattaccatcaaactcttatccacaaagggaacattcagttatctcgtacgagcaggagttgccagacttgacggaggtgaccctcaaggccatcggagtaccaggcccagctgatcaaaaaactggaatccagatcgcatcttcgtcctcttactcaaatcgcgaaaaggccagtatctttcatcagcaggagcttcctgatgtgaccgaagaggccttgaacgtctttgttgtgccaggccagggcgaccggaagactgaaattcctaccgttccactgtcatattactcgcgcagagaaaagccaagcgtaatctcgcagcaggagctgcctgacagccacctgacagaagaagcgctcaaggtttcccccgtgagcattcctgctgagcagaaaactggcatacctatcgggctcagcagctcctatagccattcccacaaggagaaactgaagatctcaacagtacacatcccagacgaccaaaaaaccgagtttcctgccgcaactctgtcctcatacagtcagatcgagaagccgaagattagcacagtgattggaccgaacgatcagaagaccccttcgcagactgccttccacagctcatattcccaaactgtgaagccaaacatcttgttccagcaacagcttcctgatagggatcaaagtaaaggcatactcaagatcagcgccgtccctgaacttaccgatgtgaatacgggaaagccagttagcctaagtagcagctactttcatagggaaaagtcaaacattttctcccctcaggagcttcctggcagtcatgtcacagaagacgtcctgaaagtctctacaatccctggaccggcgggacagaagacagtattgccaaccgccctgccaagctcgttctcacatagagagaaaccagatattttctaccagaaggacctgcctgacaggcacctcaccgaagacgccctcaaaatctcatcagccttggggcaagccgaccagatcactggtcttcaaaccgttccatctgggacatacagtcatggcgaaaaccataaacttgtgtcggagcatgtccaacgactcattgacaacttaaactcttctgactcatctgtatcttccaacaacgttctgctgaattcacaggcagacgaccgggtagtgatcaacaagcccgagtctgccggatttcgggatgtcggcagtgaagagattcaggacgccgaaaattccgcaaagacactgaaggaaatccggactttgctgatggaagccgagaacatggccctcaagcgctgcaactttcctgcacctttagcccgattccgggacatatccgacatcagcttcatccaaagtaaaaaagtggtgtgttttaaagaaccttcctccacaggggtaagcaatggagatctcctgcatcgccagccatttactgaggaaagtccgagctccaggtgtattcagaaggacatcgggactcaaacgaaccttaagtgccgccggggtattgagaactgggagtttatatccagtaccactgtgcggagtcccctgcaagaggcagagtctaaggtatccatggctctggaggaaacattgcgacagtatcaagcagctaaaagtgtaatgcgaagcgaacccgagggttgcagcgggaccatagggaacaagatcataatcccaatgatgacagtcataaagagcgacagctcatctgacgccagcgacggtaacgggagctgttcctgggacagcaatctcccggagagtctggagtccgtgtctgatgtcctcctgaacttcttcccttatgtttcccctaaaacttccatcacggacagtcgggaggaagagggggtctctgagagtgaggacggcggcggcagctcagtggacagcctggcagcccacgtgaagaatctgctgcagtgcgagagcagcctgaaccatgccaaggagatcctgcggaatgcagaagaggaggagtcacgggttcgcgctcatgcctggaacatgaagttcaatcttgcacatgactgcggatattcaatctccgaactaaatgaggacgaccgaaggaaggtggaagagatcaaagcagaactgttcggtcatggaagaacaacagacctgagtaaaggcctgcagagttag

SEQ ID NO: 178767 - DNA, 1944 bp, Artificial Sequence
  Description of Artificial Sequence: Synthetic coding sequence
atggccgcccccgccggcggcggcggcagcgccgtgagcgtgctggcccccaacggtcggagacacactgtcaaggtgaccccctccacggtactcctccaggtcttagaggacacttgtcggagacaggattttaacccgtgcgagtatgacctgaagttccaacggagtgtgctcgatttatccctccaatggcggttcgccaaccttcctaataacgcgaaactggagatggttcctgccagtcgctccagagaaggaccagaaaatatggtaaggatcgctctgcaacttgacgatggtagccgccttcaggattccttctgtagcggacagacattatgggagctgctctcccatttccctcagatccgtgagtgcctccagcatccggggggggctacccctgtctgcgtgtataccagagatgaggtcacgggcgaggcggccctgagaggcaccaccctccagtcccttggactcacaggaggaagtgcaactatccggttcgtgatgaagtgctacgatcccgtgggcaaaacgcctggttccctaggttcgtctgccagtgcaggccaggcagccgcatccgcacctctgccattggagagcggagagctctctagaggtgacctgtccaggcccgaggacgctgatactagcgggccctgttgtgaacatacccaggagaaacaatctaccagggccccagccgcggctccatttgtccccttcagtggggggggtcagcggctcggaggtccccccggcccaacaaggcccctgacgagctcgagtgcgaaactgcctaaaagtctcagctctccaggtggcccatcaaagcccaagaaatccaagtccgggcaagaccctcagcaagaacaagagcaagaacgcgaacgcgatccacagcaggagcaggaacgggagaggcccgtcgacagagaaccggtggacagggaaccggtggtgtgccatcctgatctggaagagcggctccaagcctggcctgccgaactccccgatgaattctttgagctgactgtggacgatgtgagacgtagactcgctcagctcaaaagcgaacgtaagcgcctagaggaagcccccctcgtcactaaagccttccgagaagctcaaattaaagagaagttggagagataccctaaggtagcccttcgggttttatttccagaccgttacgtccttcaaggcttctttagaccatccgagacagtgggggatcttagggactttgtgagatcccacctgggcaaccctgagctatcattctacctgtttattacaccgccaaaaactgttctggacgatcatacccagaccctgtttcagcctcaacttggcgaccgagttgcaccatttacgctgggcccaagcctgaaaagatgcctgggaccagagcagagaacaagattaccggtcgttggagacgggggtgatgtcgactccggccggctgctattctggggaccgagcagaggaagagctagcccatccaccggccagccgccatgtcatcccgtttgtcgaccatcctcccccccatctccaaggccatcctctggagatccatcccgggtaaaggccggtcacaaacatgtgggcacaggccgagcaaacctcttccccgccgcgctcgtgcacctcggagctgaggagccagccggggtctatcttgagcctggattacttgagcacgctatctcgccttcagcggccgacgtactggtcgctcggtacatgagcagggcggcaggctccccaagtcctctccctgctcccgatcccgccccaaaatcggagcctgccgctgaggaaggggctctcgtgcctccggaaccgattcctggcaccgctcagccggtcaagagatcgttgggcaaggttccaaagtggctgaaactgcctgcgtccaagcgatag

SEQ ID NO: 178768 - DNA, 1662 bp, Artificial Sequence
  Description of Artificial Sequence: Synthetic coding sequence
atggccgcccccgccggcggcggcggcagcgccgtgagcgtgctggcacctaatggacgcaggcatacagtgaaggttaccccaagtactgttcttttacaggtgctcgaggacacttgtagacgccaagatttcaatccatgcgagtacgatctcaagtttcagcgctctgtgctggacctgtccttgcaatggcgatttgcaaacctgcctaataacgctaaactcgagatggtcccagcatccagaagcagggagggacccgaaaacatggtgcggatcgcgctgcagctggatgatgggtcaagactccaggactctttctgttcaggccagaccctctgggaattgctaagccacttccctcaaatcagagaatgcctgcaacaccctggaggggctacacccgtgtgcgtgtataccagggacgaagtaacaggagaagcagcactgagaggcacaaccctgcaatcactggggctgactggggggagtgctacaattcggtttgtcatgaaatgctacgatccggtgggcaaaaccccgggcagcctaggatcctccgcatccgctgggcaagccgcagccagcgctccacttcctctggagtcgggcgagttgtctaggggcgatctctcaagacccgaagatgccgacacatccggtccctgctgcgagcatacgcaggaaaagcagtcaacgagggcgccagcagccgccccttttgtgccattctccgggggcggccagaggctaggaggccctccaggccccacccggcccctcacttcttcttcagccaaattgcctaagagcctgagcagccctgggggcccgagcaaacccaaaaagtcaaagtccggtcaggatcctcagcaggagcaggagcaagaacgtgagcgcgatccccagcaagagcaggagcgcgagcgcccagtggacagggagcccgtcgatcgggagcctgtggtctgtcaccctgacctggaagagaggttgcaggcctggccagcagagctccctgacgaattcttcgagctaactgttgacgacgttaggcgtcggctggcccagctgaagtccgaacgtaagcggcttgaagaagcacccctggtgaccaaagcttttagagaagcgcaaattaaggaaaagcttgaacgctatccaaaggtggccctgcgcgttctatttccggaccgatacgttcttcagggttttttcaggccctcagagacagttggtgatcttcgcgatttcgttcggtcgcatctcgggaacccggagctctctttttacttgtttattacccctccaaaaaccgtgctcgatgatcatacacagacactgttccaagcaaacctgttcccggctgccctggttcacctgggtgccgaggaacccgcaggggtgtacctcgagcctggactgttagagcatgcgatttccccctcggccgccgatgtgttggtcgctcggtatatgtcacgtgcggccggctctcccagtcccctccctgcccccgatccagcacccaagtcagagcctgcagctgaagagggtgccttagtacccccagagccgattccggggaccgcacagcccgtgaaaagatctcttggaaaagtgcctaagtggctgaaactccctgcatcaaaaaggtag
